United States Patent 8,067,671 (METHODS FOR GENETIC CONTROL OF PLANT PEST INFESTATION AND COMPOSITIONS THEREOF) - sequence listing, part 10

SEQ ID NO: 8544 - DNA, 2521 bp, Heterodera glycines
  misc_feature (2339)..(2339): n is a, c, g, or t
  misc_feature (2401)..(2401): n is a, c, g, or t
ctgttgtacctcttctaatcactgttgtacctcttctaatcactgttctatttcttctaatcattgttgtacctcttcatatcactgttgtacctcttctaatcactgttgtacctcttctaatcactgttgtaactcttttaatcactgttgcacctcttccaatcactgttgtacctcttctaattaccgttgtacctattataatcaccgttgtacctattctaatcattgttgtaactcttctaatcactgttgcacctcttctaataactgttgtacctctcctaatcactgttgtacctcttcatatcactgttgtacctcttctaatcactgttgtacctcttctaatcactgttctatttcttctaatcattgttgtacctcttctaatcactgttgtacctcttctaatcattgttgtacctcttctaatcacttttgtacctcttctaatcactgttgtacctcttctaatctctgttgtacctcttcatatcactgttgtacctcttctaatcactgttgtacctcttctaatcactgttctatttcttctaatcattgttgtacctcttctaatcactgttgtacctcttctaatcattgttgtacctcttctaatcacttttgtacctcttttaatcactgttctatttcttctaatcattgttgtacctcttctaatcacttttgtacctcttctaatcactgttgtacctcttctaatctctgttgtacctcttcatatcactgttgtacctcttctaatcactgttgtacctcttctaatcactgttgtaactcttttaatcactgttgcacctcttccaatcactgttgtacctcttctaattaccgttgtacctcttctaatcactttgcacctcttccaatcactgttctatttcttctaatcattgttgcacctcttctaatcacttttgtatctgttataaaatttaaaaaacggcgcgaagcggccgttcgaggccgcaaatcggcctaaaaaaggccacaaaaagggtgcgaatcgcccgtctgagtccatcaaaatttaataacgggcgcgaagcgcccgtccgactcaacacaatttaaaaaacggccgcgaagcggccgaaaagcacaacaaaaattagaaacgggcgcgaagcgcccgtctgagtccatcaaaatttaataacgggcgcgaggcgcccgtccgactcaacacaatttaaaaaacggccgcgaagtggccgaaaagcacaacaaaaattagaaacgggcgcgaagcgcccgtctgaggccgcgaagcagcctaaaaatcaccgaatttaaaaaacgggtgcgaagcgcccgtctgaggccgcgaagcggcctaaaaatcgctgataattttttaaaaattccaaaacctcttctaatcactgttgtacctcttcatatcactgttgtacctcttctaatcactgttgtacctcttctaatcactgttctatttcttctaatcattgttgtacctcttctaatcactgttgtacctcttctaatcattgttgtacctcttctaatcacttttgtacctcttctaatcactgttgaacctcttctaatcactgttgtacctaaacgggcgcgaagcgcccgtcatgaggccgccaagcggccaaatgttctcaaaaaattaaaagacgggcgcgaagcgccagttattaggccgcgaagcggccgaatgtccccaaaaaaattaaaaacgggcgcaaagcgcccgtcatgaggccgcgaagcggccgaatgttctcaaaaaattaaaagacaggcgcgaagcgcccgtcctgaggccgcgaagcggccgaatgtcccccaaaagtttaaaaaaacgggcgcgaagcgcccgtcctgaggccgcgaagcggccgaatgtcccccaaaaatttaaaaaaacgggcgcgacgcgcccgtcctgaggtcgcgaagcggccgaatgccccacaaaaaattaaaaaactggcgcaaagcgcccgtcctgaggccgcgaagcggccgaatgtcccccgcaaaattaaaaaacgggcgcaaagagcccgtcatgaggccgcgaagcggccgaatatccccgtaaaatttaaaaacgggcgcgaagcgcccgtctggccccacaaaataaaaaacgggcgcgaagcgcccgtcctgaggccgcgaagcggccgaatgtcccccaaaaattaaaaaaacgggcgcgaagcgcccgtcctgaagccgcgaagctgcagaatgttctcaacaaattaaaaacgggcgcaaagcgcccgtcctgaggccgcgaagcggccgaatgttcccaacaaatntaaaaacgggcgcaaagcgcccgtcctgaggccgcgaagcggccgaatatcccccgtaaaanttaaaaaacgggcgcgaagcgcccgtcctgaggccgcgaagcggccaaatatcccccataaatattaaaaacgggcgcgaagcgcccgtcctgaggccgcgaagcggccgaaatccccca

SEQ ID NO: 8545 - DNA, 2509 bp, Heterodera glycines
aaattacaaacgggcgcgaagcgcccgtcctgaggccgtgaagcggccgaatgtttcccacacgataaaaaacgggcgcgaagcgcccgtcctgaggccgcgaagcggccgaatgtttcccacacgattaaaaaacgggcgcgaagcgcccgtcctgaggccgcgaagcggccgaatgttccctacaaaattaaaaaacgggcgcgaagcgcccgtcctgaggctgcgatgaattgctaaattacatcactttctagcgacgcggcgaagccgcgtcccatagcgcgatagcgctttaaaacatcacactaatggaattaatgttttgtatgttttaaaataacaaatgagggccatatattaccaagccacggatgcacaccatagccaactgggcaccctagtttctactatatatagagaaaaggtgcaactcgtagaaaaaattataagtccccgtggtttgcccgtaggctcctgaaagtgcggcattgcttaagcaactttttgaggcgcatctgggaaaaataaggatttttcggtccggcggccagttgagcgccagcggcgctgaaacggccaaataaaaaaaatcgtcgcggttttcgggctgtaacttttctcagcgaaccgggagcggaaaaagtccgctgagagggcacaccccagacatgttggctacaactttgtcactgatcactttttgatcagatcaaatgccgagcctgtagaaattggcgactgaacggcgctcaaaatgccggttttacgtttttcgggaataactcgctgggggttaagcggagcgggttggcgccgcttgagcatttgtgcagtttttaaagctgcatccgatggcgttttcagattttgaaaattctcaaaatttttcgagctaggccccctcgaaaatttttcgtttttgaattttatgattttttaacgaattttcccagaaaaacggagaccactttcaagcaaccgtttttcaagctctatcgattggtgacatttttagaaaattttcgatttttttccggaaatagaaaaaatttttggcctgagcgggacatttgagtcccgggcccataactcgtcgggggttggttttagcgaaaaattgccttagagcaaaattgtagagctttcaaaatattaaattattttttttacaaattcaaaaaataaataatgaaattctttaattaaaaaaaataaataaatttaaatattttataaaaaatatttgaaattaataaaacatgtaaaagtaatcaaaaatgcacagaaaaataatgtacaccgatcggatccgaacttcgccccccccccccctcaaaatgatgcctcagaatccccaatcacacagggattctgagggcttaacgatgtcaaaagtaaaaactgattatgtattcatgatcagcggcccaaattacccctaatgacatgtttttggaagatttttgtgaaaaaattttttcaatcaaaatcctgtccaccccctttggtcccgaaccccaaaatcacttttatttttgtatctttttttaatcgagaaaaatagggagaattttatgagatttatttgaaatttataccacaaaaacaaaaaaagttattccagatactactaaagaaacaaggagtttcgtttccaaaaacaaaatctccttacggtttgccgggagggattcgaaatttcgaccttgggggtaacttttgacggcgcattcaggaaaactatagattttccgatccgagggccaactgagcgccaggcgccgaaaagtcacttttttcgaagcagtttttgcagtttttgggattcaaaaattttttaaaggcttaaatgaaaaatcggcctcgataggattttaagttggacttttttggattttttttgtttcttgaccgaaccccaaggtcttgtcagtttttccgaaaaactggctaaaaattgcatacttttttgggccatttcagcgccggctgaataactcgccggggtttgaccggaggaggtcggtgtaagcggcttttttgtacagcttgacgagctctatccaaccatgcttttagatttcagaaattttcagaaattttcgagctaggccccctcaaaaattttccgtttttgaattttatgattttttacagatttttccggggaaaacggagaccactttcaagcaaccgtttttcatgctctatcgattggtgtcaatttcagaaaaatttttaaaattttttttggaaatagaaaatttttggttgctaggcctcaatttcagttctggcgcaataactcgtcaggagttgattttatcaaaaaatcgtctaagagcttttttgtagagaactttaagcccaatctaatgtgctttatctcatgtttttatcttaaatttaaaaaaagttataaaattaattgtgattttgaaactcaaaaccaaaggggggaccccatggttttgcatttcatgaaaaatttttttgctcctaaatt

SEQ ID NO: 8546 - DNA, 1463 bp, Heterodera glycines
acggaaaaccaaaaaattaaaactctcggatttcgagttttcgatttaacaaaaccaagatggtccaggcagcagtagaaaatcttcgtttctcaaatcggagaggaaaaataaggaggactcatttagctctcgcaatcagccacaacaaaattctgggaagtaaacgcttcgcagtgaaaaaaaacatttatttagatttggaccccctaaatgtcctattttgagggtttggaccaactttttagatttgtttacaatgaattgcgatttataaaaacagacctgaaaactcctgatcaggtcttggatcttcaagcggtcattgatggcacgtgtcgattcatcggccggggtcattttttttgctaatgaaaaaattaaggtatattaggatgacaaatagatatatatatgttttgagtaatagtacagtagtacagatggtaccatcaatacagaaatatgcatacgatcaaatattatccgcacatttacaaaaaatgaatatttcatccacaatatattttcatcttccgcttggattgcgcatgacttccttctcatccctcctcattcgttgaccatctcggcgcttcgaaatactggaaaaattgaaaaaattacaacaaaaaattggaatcggaaaaacgcaaaaaaaaatttccgaccgaccgtgccgttcggtgcaggacacttagcaagcggcagtcgattcatcaacgggtggttgtccatcgcatccatccatctcatcggcgtatttaaacagccgcttcgcggcggcggtatccaattgacgccgccctttcattttttgctaatgaaaaaaagaggtatattaggatgacaaatatatatatatatatatgttttgagtaatagtacagatggtaccatcaatacagaaatatgcatacgatcaaatattaaagttcatcggcaaatttacaatgaatatatttcatccacaatatattttcatcttccgcttggattgcgcatgacttccttctcatccctcctcattcgttttgccatcagttcggcgagcagtgcgcgtcaaaaaactgttgaaaattaaaatttcaataaaaaacgaaaaatcctcaaaaactacccaatgtcgttgtcctggatgttgatgcacagcatagtgtccaaagtatggtttgcgtcccactcccacttcgccactgtgcgccgatccgtgccgctccgctggcgtacaaccacaggctccgcggtcacacgccaacgcagcgtcagccactcgcccgtccgttcattctcccgctcaacgacctcggtgttgcgacgcgatgcccgatgacaaacgacgacgtaattgaccgcaatggaatcagtgctttaaaaaactggaaaaattgaaaaaattacaacaaaaaaaaattggattccaaaaacgcaaaaaaaaaaaaaaaatttccgatcgaccgttc

SEQ ID NO: 8547 - DNA, 4813 bp, Heterodera glycines
cgaccggccgttcgcaggcttgacgtgagcgtagaccaatgcgcgcgtcgccactttcgaatcgtcaaaaattttgggactgccatctgggagcggtgtgtgcagccatcgcaacagttgatgcttcggcttctcattgaaagtaacttccaggtcgacgcacctgtgcgaaatgggggaaatttttgaaaatttgcaaaaaaatttcgccacgaccaaatgtagatggcacggaagccaatcacgccgttcggtgcagggcacttggcaagcggcagttgattcatcaacgggtggtcgtccataacggtgacagccgcccctgtcccatccgattggtgcccgatgaatacccagcttccacttgcgcatgttgaaatgcgtggccaccagcctgccgaagcgcgcgtcgatcagtgcaaaacttcgtgcccacctcagtgcggtcaatccaaaacagagtgtccagccaaacgtcgtttgccatgcggctactgaaaatagaaaatccgaactgttgatgcatagcagtgtccaatattcgatttgcctcccacttccacttcgccactgtgcgctgatcagtgccgttccgctggcgtacaatcacggcatgtgcagggactcgcgcattcggcgtcagccgctcgtccgtctcttcattctcccgttccatcttctggaagttggtattgcatgcaatgtgacaaatgacgaggaagttgacagggacggcactcgcgttgaaaaactgtaaaatgattgaaattcaaaaaaaaatggaatcaaaaaatgcaaatatacggttttacgcgtcccatgaatgactatcatcctcagtttctttgggcatatcttttttcatacttggtcaatgcctatattcttggtatcaaacgaaagcttaaagtctacagaagcttttgtataactaaattctcggctaaaagcaatagacaaaaaattattcttgaaaatactcgaaaaaccttgaatttcatgttttctcattgtaatttattttctaatgcaagtaattgctgttttcttggatttataagatcccgagagttcaagcttttgattggtaccaagaatataagcattgaccaattaagaaaaaagttatggcctaagaaactgtggatggcatgggacgcgtaaaatcgattagaaaaatgaaaaaaatggaagcaaaaaatgccgtaaaatctttcggaccgtgattaagcttggcatgaacgaagcccattgcggtttgcgccacttgcgaatggtcacaattttcggacggccatccttgcgcggtgtgtgcagccagcggaacaggttgtgcttcggcttctcatcgaactcgtccggcgggttgagcagggcattgatgtgcacagcgctgggcggcggtcggatggggaacatgtgcgtgttggtgatggcacgaaggttagcacagtcgaacagcacattcggcgacacatggcgacgcaacagcgcgaagttgacggctttcatgtcgttcagtgcgaggacggcgtgcgaaatgagtggccaaatgcgttgcgccatcaccgcccagcagcggaggtccgtcgaatggatggtgaactgcacagcgatgccgcgattgatgacacgttgcaggcactgcagaaatgcgatcacttccaggtcgacgtacctggaaaattagggaatttttaaaaatttgcaaaaaaattttgttcgctaagaccaaatgtagatggcactgaagccaatcacgccgcccggtgcaggacacgtggcgagcggcagtcgattgatcaacgcgttgtcgtccataacggtgacagccgccgtgccgccccggtcccatccgcttggtgcacgatgaacgcccagctcgcccagcctccacttgcgcaggttgaaatgcgtggccaccagcttgccgaaacgtgcgtcgatcagtgcaaacttcgtgcccacctccacgcggtcaatccaaaacagagtgtccagccaaacgtcgtttgccacgcagctgctgaaaattgaaaaaatttaaaatccgattttttgtgaaattttaaattcgggcggcttacaggtcggccagcgcaacatttggatggtccgacattgctcaattgtcgtcgttttcgttgtacacagagaagggatgattgatgaagatgaattgccgataattaatgaatgatgaaaataatggcaaccaaatgaattttttgtgccttttatatatgaatttatccgaaaaatttgactcttccgactaaaaaatttgctatttaaggcccacactttttgcttatccacgttcattccgttcattcattccatccacttaattattcgtcctcctccaccgccacttaaatcgtcagtttatttaggtaattaattgttttgttatgtgcattttcattgtgctaattgccccccccccccatttttcagcgaatggccaacgcaatgtacgcggcacgggcgcgcgcggccaaggcggaaaagcgtcaagcgcagctgcgcaaggcggccagagcaagggcaggaaacgtaagtttagattaaaaaaatttaaaaccgaaaataattttccccaatttttttcccacagaccgccaaatcgcgacgagccgagcgctgttcaatttgctggggccgactgagccgaatcacgcgtaccacgatgggctgccaccatccgctgcaccgacgctgcctctacaattgggtgcgcgtcaacttgttttgtccgatgtgcggctacaactacacgcgcgggaggccccgtgatcgccatggacgacgcaccaggggactccatcgtatgacgccggatcaggtgcgacgtgaaatggaccgcatgcgtcatatcaggcgctgatggaggaggaggagaggtgggttttgttgaggtgtgggacgggggcagcagggaggacgagtgtaatttttggttctgtttcagtttggtgttttgtgggggagggagggtaataccaccgccgatggtatcccaccccccttttcgaaaaaaaaattttcaaaattttttagagcggttttcaaggtcggggaatacgattctaacatccatttgggccgtgtgttgggggagggggcggaggacgtgcaatttttggttctgtttcagtttggtgtgttgtgggggagggagaaatgaaaaattcagaatttattggactcaatttatttttaattatcatttttttgaattttcaggcccggaaacgagaagtcgtcgcaatcgcatggcaaacggcggaaggatggaaagaacggacgacggatcacacaatgaatgattgccgagtgtatttattgatgtatttgtgatggatattcactcatttgttgtctcataaccaagtcagaagaacacacgcattgtttgtatcacttaccattatatttgtactgaattgaatgcataaaattgttgagcacaaatttgattccaaattttaaggggggtcaatttttaatctcaaatcttatggtcgtgtgaactcatagagcccccggctcaagtacagtttatgcgcccaatcaaattgttactttaaattgctatttttttcaaaaatcccgaaaatattgatttcttcaatatccgattttgtcaatgataagccgtgccatcccacatattgattttaagcgcaggtcaacagaaatagagagctatccgaaacatggccactggatgaaaatttaattggacgcacaaaaatccattggacatataaactgtacttaagccctaaatttatcataaaagcatacacaaaacaaattaaaattaagttgatcaccaccacaacaaaacaacaattttataaacgtcaaatgggctcaaattcattctcaaacacagaaattcaaattgatcgatcacttctcaaggaatctcgattcgattccactgatcataaaagtcccatccaatcgcttccttttcccattttgcccatttgctttcgtcgcgcacaattggacaacggatcagaagaaaattgcgggtatctttcatttctttcaacgtcaattgttcccgagtcaattcgttggtcagatcgaagagctcaacggaattagcagaaggcggcagatgaaactcaatgacgacaatgaaattgacggaagaagaagcattggcaaatgcctaatgggggaaattggataagaaatgcgaaatgataaatgaatgacattttacggttaagtggcccaagttgggcataaaaatttttttgtcagagaatcacaaacggcactacactttataagtccaatcaatcaaccatatctggtttttatacaatacaataactttgttcatgttctaattaaaatatttttgctatcattcgaaagctaaaagtcaaaagaagttaaaacatataaaatcttagtgtttaggcaattacaaaaaagaatgattaattaattttgttaattattgaacaaacttattgtgtaaaaaccaggtatggttaattgatttgactcataaagtgcaatagagctccccaaacacagtatgaattgcaaataaaagcaaatccaaatcaccgctttgaaggcttcaatccttgacgccaaatcccagtgctcgttattactccacaaaaagcatttgcgcatctttggcacattgtccggacggggagtgaaaagccatttggccaccgcttgtccatctgatgccatggcattgtcatcgcacgggaattcagggaaggaattgtcattgaaacgcgaagcgatggacattcgttgagaa

SEQ ID NO: 8548 - DNA, 1365 bp, Heterodera glycines
atcaatgaacaatgttctcgagactttcgagaaatgccattcaagattctcgatgggtccttcccataatcactgattacgtttggactcattcattgctttcctcctcccatttatagttttcgccccgttccggccctttggagggcggcaccgtcgtggacatcgttggccatgatcttggctcgcgtctgcaagatgtccaggaccgtgtccaagtcgcgggtgtgccgtgccgtgtcctccattacgaattgtcagttcgcattctttgcgtcaccgaacgttcgccgctgcccttccgcgcgcccatccgcttgacaatcggtcgcagcgcgcgtcgcaacgctcagtcagcggaacactttgagtttcgcagcccacaagtgctgtccgcacagcccacgtttgggccacagagcggaggcacgcgactgcagctgatcggcacaaatttggatgtggggcggaacgcgagtgtgtacttagacaacttggagtgttctcttcaggaaaagagggaagtgagtgacgcgcgcggaatgggagggcgaaacgcaagggaaataaacgggggaacggaaggcgggtgaagtgtaaggggaaaagcgggagacggggttggggaggcgtggaaagagtgtgggagaagcaggtgagatagagaagaagaagcttccccgagaggaagattaatggatcaattgaggcaacaattgatcctatatgatcgagcaaagtggggagctggagagggcagggtcggtagttcagctggtagaacactggtccggaaagccagagacgccggttcaaagccggcccgccccatagtttttccctcaaaggcttccccgctcgttcatatatttcacaagcatatatgtataaaaatttaataaattcagaattgcatatataaattttaaaaatcaaaaatttttgcaattgtctaaaaattgttctaattttatattattattttcacgctgtgacatttcattttttcgctgcttaagcttattaaaaatttcataggtaattttttagagaataaatgtttggaaatattttttattaaatgcttagagacaatacaattttatcgtattttagatggtaattaggtgtaattgattatgactttccaccaggaatcatttcatttagtatttgaatttgttgtttttaatcctcagctttttgaatttgtcgcattacactcacaagagcatgtgaacatggaaaatttctgcttccgcaaacgttgggtcgattttatgattgaaaccctgttcggccctgacaacagatttgatgtaggtcatagcaacacctgccaaaaatcaaatttaaaaataaaaa

SEQ ID NO: 8549 - DNA, 2527 bp, Heterodera glycines
tttctgctctccgcccccaccgttccgtccgcttcaccttatgagttggaattgatctctgagcttggcgcgtgccatccgctcaattcgagtgcgttgagttgtgacagtccgagtttggcactgccaacggcgcttcttcggcagtcgtctatggcgcgatggatggttggaatggcaatggacggagtgcggacagtgcgcaatttggggccgatcattcaggtgagttcggctgagggaagaagcgaagggcaaaaaaaatgccaaaaatgaatggccaatgagagaatggcatccatttgcagctgaccaccgtgcccgacccccagttttcgcctttcgccggccttcacattttgcaggcggaacagcctctgatgctttccggacaatggctgagtcaggcggcgacgccggcggaatattcggtgggaaaaatggcaaaatgaaaagcaaaaaaaatggcttttccccaccatgcttaattaatcccttttttctcttttccatttaatttccttcccatttcccaaggttaccattggcactgccctttgtccggttttccttctcgagcccgaccgacttttgtgccgtcctccgactgtgcctccgttgcccaccgatgattcgggaagtgaaatgcccgatgggaggccacttgtcgtcgtaagtgtctcccgccattttcggcattgttatttctccgtgccatgccgttcttcgtttacttgtcttttgccaggtgcacattggccgtgtccgtgtcgaaattggtccgttggaatacgccggcggcgccattagcgccggaatttcacgcatcgattggtcgcgtcgcgcgggcgttctcggattggccgtccttctggtcatcgtcattgttgtgctggtcgcggtcggattggcatggcgaagacggcagggcgagcacgagcggacgtaccgacgcattcagttgcaaatggaacagatggaaagccaagtgcgctccgagtgcaaacaggtgatgggtggtgggtactgagatggcgggccacaactacccggggggcttttaaaaagggagaataaatggcagctcagatgcctatgtaataagcatctctctgtttaggcctttgccgaacttcagacggatgtactcgctgaacttgacggggtcgacgacggcgccggcattccctttttggaaagtcgcgagtccgtcgcccgtctcctcctgcgcgacttcggcgagccgacgataaacggcgcatacggcggagcgatttattcgaggttcatcggcagagaagaaatatttatgggcaatgattcattaattacccatttagtcagttgccgatgactttggcacagttcgaatcgctgctttggaatcgccaggtgaaacatcggcaaaactcatttttgtgccatttctctaataaatgccaatttcagttcatttatgtgctcgtccaaatggcagaagaggagccgacaatcaggtgagataataaatggcaaaacacattaaaaactcgctcgcctttttttaatttaagtttgtcatttgtcactttggtgccaattcttggcctgtctttttggcatttatcttggcattcattttcctttggcattcctcacttcttttctgtctttggcattccgttctccctctttcgttgttggcattctgtttaaccctttggcattccgtccctctccctccctttgtcagtgcctctgaacgtgcttcgctcgcttcgcttcttctcgccgtcctctcccgcaacttggccttcgcctccgacgtagtcctttccctgctttctgcccatgttcagcgctgttcgctgatgcactcgccccatttgctgttccgccactccgattcgctggtggaaaagctcttccaacaatggctcgccctttgccttttgccgcatttgcgcgactccgaaggccccgcgcggtcgcttttcctcctttacagggcactcaaatcgctgacagaaaaagtatgatcggaatttttgatcacccattcgatttgaccaaatttgcctcgtttaagggccccgtcgacgcggtcaccggccaagcgcgttattccctttccgagcagtctttgctccgcgaaagtgtcgaagcgcgtcctctcactgttttggtagggaatggctcgccatttcgcttacaaattagttttggttttcccttctttggcaggttattccgttggatggctttgaccaggcaccggtgccaattcggactttggattgtgatacgatttctcaactgaaggccaaactgttggacactttgtatcggaatgtgccgtactcgacacgggtcggcatcgaccagttcgaccttggtaagtcggaggactgactgacggcacaattcgctaattgtccgtttctgaatcgcccgtgccaaattcgtaaattgtccttctttcagaatggcgttgcccacgtcgtggcaaaggtttgcttttggacgacgatcagccccaacgaagcgg

SEQ ID NO: 8550 - DNA, 4182 bp, Heterodera glycines
caaaaaaaaaatatattcatttagcaaaggcaccgcgcaacgttttgtggacacattttttgagtccgttctgttcaccgagcagcagcagaacattcccgtcgttttgaagtacgtcttcgactttttggactccgaggcggcacattgcccacaggcacggcacttattaatgaacggacgaatttatcattctcatagctgattgatccaattattaaatttattgcttaatcgtcgcctcgctttttcagcccatcgattcggatgttctgcacgcgtggaaggccaactgtttggtgttgcgcttttggcagcagtttctccactgtcccgacttgctctttgatgtgccgcctcgtcccgcgagtttggccggctctttggccgttgttggccaaactcttgtcgaggcgttcaggtgggaaaggcacactgatcagtggacaagcaattgctgagggattgattgtccgatcatcatttgacgaatgccaatcccaaaattgggctttagccgtgccgatttggacttgagcagtgcgagtccgtccagccgtcttttgtttgcgcgtgacatcgcccgcttccgtccccgggcggaagacttgttccggtggatagcggcacaaccgcccatctccgcccagcactttttcgattatgtcggcaccctttcaaaggtagaaaatgacgatgggacttcatctttaacttttaaatgctaattgccttcatcactaattaccctccgttgtcttttcgtgttaacaccaactaactttaatgagtttctctccattagcaggtatccgctgatggcgtgagcagcacttttgccctgggcgagttgctcaattggaccaaggccaacggactgcgtttgatcgcggcgcttgaggccgacgcggaggcgcggcgcgcgcggctggcggaaagattgaggcaaatagtgcaaagcacactgatggagggggcggaagagcacgtttatgcgacactgcggtgaaaaggggacgaaaagcgcaacgaaaaggagccaaaagacgggggaaaagggccaaaaaggaaaaaaaatggacaattggccaaacgacggatggacggaggggaagtcagtcgccgcgagaagaaaatgccgaccgaccgattaattccactgacgggtgccataaaattttattgtttcagaaattaattaattaactgcccattgttcatatttgtgcatttgcctatttatgtgcatatttaaaaaacatatcgaatacgaataaaatattaaataaaatgcttttttaaatgccttttattaattaggtaatttgttcgttttgccatttctctcttttcgccgttggatttaccatttttggcattttcctctgccattcgtccctttctttcggtcggtcattctccgtctctgctcgtctgtttctgctgctccttctctctctcccccttttccgtctttccctccccaaccgtgttgtctctctcccctttctcccttgtcttttgccgtttctctctttctttgctgtccattgctccgctcaatcgccgttgcgcctccgccaaaaagcgtttgtgcgcttcgctgccctccgccagccaatccaacgcgtccgcggggcccaactccttcctcccccgtggaggaggagggcgtgcggaagcgcaacgcgggcccaaagcgtttctcgcgccgccgaaatgccataaaaccgagcggaatgccatctgacaaaaagcggagactgaagcgaaacaaacggaaaatttgcgccatttttaggggggtcaaaaactttcgagaatttcgacaattaattaattatttaattaatagccttcgggttgacctgcatttcgttgcgcgactacgcacgcgaccgcgagcagtgcgaaagtcaatgcgcaagcgattagaacggctaaaaaccaagcggcactgcgcaagcgttctgtgcaaaaggagggaagggtactgtacacaaacaaaagaaagactactttgagcaaacactgtgatgagtgcttacagtactcttgtgacaataaataccgtaccgttgctgaacggtggcctccctctgctgctttccgtgcgaatgtctagcgcttcggatgccctccggcgtttcggcccttcccgcgcctccccaattagcacataatccgttccctcggccaaattccgcaaatcaaacaccacttgaggcaacacaattggcaccgtttgatgccattgggaggtgcctattaaagttggggaggggggtaattaagagagaaaacaattgaaaaaataaaatgacaaaagattacaaattttaaaatttacattttaaaatataaaagaaaattgaattcaaattgaaaattggtcatttaaatgaacagttaatgccttttttcgtgtagttgagaaggaaagaggagcccgacatgcgccaatggccggcggaggaagcgtttccggagggaaaccaacggacgcgcaaaatggtgggggaaagggagtggatggagaagaggggcgggtcggggtctggaagagtgggtgggccattcgtcaaaatgctaattaccctaattagtctgccctcccttaattacccctgaggggccatgtccgcgtgtttcgccatgtgcgcggtccctctccgccgcccgtctcggcccaaacggcgacgcggaaaggcgtctccggggacagagactcgtgaaggtaaaagagttggcgacgaagcacaaaagtctcttcggtgaagccggaggaaaggtctaaaaacaaaggacgaaacaatcggcagaacaaaggaaacggggcaatggcactttcgaaggcgaggtaaagccgcggagatttccgttgggatggagcggcggctcccaagtggcgagaagggagcgcgagccgacggaatggacacgcaaatttgtgcactttggagggcgctaaaggaacgggaagcaagtcaaagggggactaattagtcaattaattaattgtcaacgattaattgcctaattagtgtcttaccgccttcgattgtcgtgaatttcagcaaattcgacccttcgctttcgtattggccattcaaaacgcacaccttcgcgcaaaaggttttaattttcggaaaggaagaatcccaaaattgactttggcctcgtaattggtcagtgcctgaagccccgaaattgtagccacggtggaaatattcggcacaatttgagaagtgatcagaaagggacggacagaaggccaatggtccaactgacaaagagtgatcaatgagcaaagaaatgtgaaatgggcggagaaaaaagggtgaaatggcaacaaaaaaaaactgacgcgaaatccaacgaaatggccacggacagagctgaaatggccaaatgattgggctaaaaatggcccaattgatcagtcacagtcacctcgccgacttcagctcctcccaacccaattcgaccgtcgaatggtttcgatgcgcaaccaatcggagtccgcgcggtgcctccaatggcactgaaagggggcagcttttttccaatttggcattttccgtttgggatttgtgccgaccgtcttcgcccgaccagcccagcacagtttcgggttcaatcgcggaaaagccgcgcgaattcactgcgcgcacttggacaagaaaaggccgaaaggtgggctgttccctaatcgtggtctgattctaaaaaagatgtgtgcccctttcaagcagtgttttcttctttttactgcaaatggatcttccacaaagaattcgtgccaatccgtcggtgctgagtcgtccatttgccgatagcgcaccaaatatttcagtccatgcgcattccaaacatttcttgatagaggcgtccatcggatcacttttattcgtgttaaagcattataattattcctaaaactacccaaattgtccggttcagtgccctgggcgtgcacttccattgggttcgagaagggcacgtccggaggggtggcgcacgggacggaagcggacggagccgacgcgggttcactggcaccgtacgaattatgggcgaacatccgaaaggtgtaattgaccttaatgacggagtggggaatgctttttgttgtatttcaatgggatcctgatttttcagacagggaccaatcggttcgac

SEQ ID NO: 8551 - DNA, 1961 bp, Heterodera glycines
agacaatgctttgctctgtggacttttatgaagtgagtgagcgtaacgcgtgtgaccacagcaaattcaaacccgacaaaaccgcgtccaaaaaattgcttttctgtcaaaatccgatggattttttttgttgatcaaattgaaattcatttgctgcttttgtcgcgttgagtttttatgttcgccaagtgtcaaaaagcatttcctattattgcgtcgcttaatttgttgttttttaagttcttcgtctttcggtatgccttcccttctgtctttggctggtgtgcttctgctgcgctctcatcccgtttgctgatcaattggacgaacttctggacctgcttcaacttccgcgcggattacacaattgtgccgttggtcactttggtgagtttgtgtgccacctttttgccatttgattttgtggcattttccaacttttaggtgctcagcattgtcttggcgtgttcatccgtcttcgagattttcttcatgaattcggtgctgaaaaagaagtgccccgtgtgtgcttatgcttcaaccgacgactacgatgatgatgatgattatttggtcacggaatgtgccatcgactgagcttaagcagacacgaaatcgggaacaatgctgatgccaacaaaacataaccaatgcgatgaaacaacaatgtgatggataagacatatgatcgatataatctaattctacgtaaactgttgtattccgttgtctattccattatattagtagatgtatgtatatgtatatatgtatcagattatctatttcaaaaccataaactgctgtattcaatgtgttgtgtattgtatgttccattatattagtagataaaatcttgattgatgtaaagtttttagtaagaatttattcccaattagttatccgaagtgtgatcactgatcagatagatgctcactaaatcttttttgcatcatcattttatttatttttaatactatgtatcagggatgtgccgagccagacaaaatccgattccgattatggccaaaaatccgatacggttttaaaaccgattacgattatggcccaaaatccgattaattgcgattccgattacgattccgatttttttaaaataattttttcccaaaaattttattcataatcaaaatcataaattttaagattgtgatgcaaaaataagtttgtccacattctcaggcaataaacgttttctcagatctgtcaatcaacccagcggtggagaatattcccagatatttgacatttttgctaaataacaaaaaacttgattatatcggggagaattaatccggcactgctttgtgagaaaaatttaatttcagtcattatgttaaaataagattaaaacattcgttttagaaaacattttttttcaaaattcattggtattctcgctaaaaaaattccttcaaaaggtcaattcttaggggtgtaataatcggatttcaaggcaaaatccgattacgattatccgattccgattatggcccaaaatccgattaattgcgattccgattacgattacgattacgattcggcacatccctggtatatatgaatattaacacatttatttatgcatttaataaaaaattccaaatttattttatttatctaaatataaattttcgtgaaaaattattcaaaaaataagatgaaaataattgtttgcactgcttcttcagctgtttctttattcattatcattatcccatattttttaattccaatttcaaatgcaaatccatcggtgagtttaaattttaggaataattatgtatttgaaaccacactaattaggtcgatgacgaaatgctaattgcatttgtgaaagaaaatcatgaaatgcaaatcagtgaatattcaaagcaaaagtatgaggcataccttggcattgtgtattttatgagaaagaattggcaatgtgacaaaat

SEQ ID NO: 8552 - DNA, 5388 bp, Heterodera glycines
ttctcattttgttcacggtgatcagcagatagcgtttcgttttcactgtcattgttatccaaaaacttgcgcttacgacatttttgaagatttttaatttttttacgattcatcatacgtctaaattcgtaaatttatgctgtgttaactaaactcggaaaaaattttagtggtaacactttaaaaactaaatattttataaataaaaagaaatttggggacgaaacgactaattttggcttgggggacgaaacgacgcgggacgaaacgacgcaggacgaaacgacgcgggacgaaacgacgcgggacgaaacgacgcgggacgaaatgacagcgcgccgacttatgcgggggatttaaatcggtacatgacaaaatttggtgccatataatgtagtggattttttgaatttccggcaaaaaattacgcaaattggctttatgtgacattttgtctaacgctaagcttgacccatagtgtagattttaagcttccgtttgatacatcccaagaatgtatagacattgaccaaataagaaactaagttggtcattcattggacgcgaaaactggaatagagcctattttcagcctaatttaaagcttctacagccatattaaaaaccgttctcttacatatgacaaataatgccaatttttggtactttttcactttacgccacataaaataatttttaatttttttttctggagttttcggggtcgctgatcacgaatatgacattcatttcgaccgatttcgaaccccggacccgaattcgaacaaaaagtcaaaatttcatttttcaacaaaattcacatttatcttccaaaatcgattcaaatggatggaatggcaatacaaatgcgttgaaggcatgagaaaagaagaaaacaactattcacatgggtaaatgagacgaacttgatcccacaaatgaaaaaaagcatcatcgccaaatcgcttacgccagagaaattcattccatccatttttttggctgaaaattatgtcactattcgtcactatttcggactttttgtcactatttcttcactatttcggcatttttactcactattttagttaactatttcgggatttttcttcactaaaattcacgtccctaacgatgacaatggaactaccaatatttaatcaattcattgctaaaaattaatggcattaattttaattcaaagaaaattaaaaaaaaaatttttttttacaattcgctaaaccctaattttctattttaaaaagtgtccattcgtccgtcatcccttcgtttaattgcccttcataaaaatgtgcttctcacaaggaattggagacatacgcaccaaatgcaaatttgtcttccagcagcattgtcgatgccccaccaaccaactcgaggccatcaaattcagcaaagtagggaaaattttcaaaaatttttttttttttttcgaattttccaacccgtaaatctcattctgaccctctccatttgttgtgtgttaaggtgattagcgtacaacaaaacagtggagacggtggccaaacttgctgctgcatttggtgcgtcattattggcgttgtaagttttcaaaaaattaataaacgccgattactgacatcctcgggaatttgtttgtatacatataatcgacatgtgtgtctcggtctgtaatgaaagaattcgaaagaatttccggtcggcaacaaaacactgtcaagagttatagacccgggactgaaatggcaaaaatgacctttggactgaaccgtctgtcaaacgatcagaaaataatttgacaagttaatggaccataactttttttagaagcatccaaattaaacaatcttggtatcattcgatagccctaagagtcctctattttaatatttcgttttgtgttgcacaaaagttatggccagaaaattgcaaaaaaccggctttcaaaacatttttggccttcatttttttgaaattttgtcgcttattatagaactcttagaccaatcgaatgataccatggattaatttgaatgcttctagaataatgtgtatacaaattgccgagcaattgtcagtatcgaaatttgtatcaaaaattgcacccccccccccttcacacttttcggtgttggtcgtgttattggcggtgctgctcttctcgaaatcctttgcttatggatcaggctcgacggagttgtttctaattggtacgatcatcatcgtcttcgtggtggtcatggttctgtgctgtatttatgcaggtccaataaatacgcgccgtataatatatatatatatatatatatttcatattttgaaatgaaaaacgcaacgatcagaaatcagtttttccgaccctgaaaaccctgaaaaagcgctttcgacttttggttagaaatcgggtccggggttcgaaattgtgcaaaaacttcttttttttgttcgattttttgtctaaataggtattttggcgcaattttgaaatttcgttacaggcgaagacggtcacagttcgctggaagtgctgtacaaatgcacggcgtgcggcaaagacgtgcacagaacttatgagtgcatcagtacgtacagtacagcaatttttaccgtatcccctctcaattacaatacatacaataaagtcccgtcgatttaagttgacgtcacttacaattggtcgggcggacgacaccgcgacacctttcgctaccgtaatcaaacgtacagtgtgtggggacagtacacggaaaatgtcatgaaaacggtagtgcggacgcggatgaccatgaacaactttgaggcggtggagcgcaaattcgacgtgatgagcgttgttcagacggacaattattacaagacaagcgatgaatggaccaacgatttgattaggcgtcttgaataattgaggcagaggccaaatggcaacaacaatttttgtgtattatatttgtgtatttctcgtatatactttgaaatggcaaagtgcccacatcatttcggtcacataatcgcaccaattaattgattaatccattcatttctgcttcggttgctgatcagtgatcactcgtcccgggggaagcggtgtcgagaagaagacttaacaaaacattgctcagttgtcgattggactcttatgtaaaagcattttaaaaatgttttgttcacccgtcgtcgtatccgccatcttcgatctgaatgtcaattgagttcgttcgagcagcacccaattccttccacacattgtcccatttcttatcatcccatccaattggacaacggtcgagccaaaaattgtttgtgtcatattgttccagtgtcaattgctccccagtcgcttcgttgatccgatcgaatggcacagcggagttaagcggagaagacggcagaaagttaattgaaaaggaaaccggagaagaagcattggaaaatgcctaaaaatgggacaaaaaaacgcaaaaaacgaataaaatgcccagtgataatcaccgaccgctttgaactgttctatcgttgacgaccattgatccggtgaattaacaggtgatttgagcaacttgggctgaccatccggacggggcgtcaacacccattttgccaccgcttggccatccgacgccatggcactgtcatcgggcggaaattcggggaaagtgccgtcatccaaccacacaacgcgaagggatggacaatcgctgagcgaagacggggccaattgacgcaaacggcgaaaaaagatggtgttcaaaatcatcagatgcatggaagcgcggaacattggccaaatgtggagcaaaaagtagtccaaaatgcgaacattttcagtggtaatgtccaaagctgttgcacaagtgccgaaaagacggtgaaaacggtggagaaattcgatgacattttgatcgatgtaactgaaaagtgcagaaaattatgaaaaatttctatctaatcagtttgttacatgatctgaatgcgtctgaatccgatgactttgttcggcaacggatttcgcgggattggcaatggatttccatcggcatcgtcaatttgcatttgcttggggccatttccgacaattttccatgtaattagcaattgtttgttcaacatccatttgcgcgttttgaagtgttcatcaacgtagaagtcaaatcgacggctgatcagtgcaatttcgaggccaagttgagaaggcgcaagaaagtcgaacaccaaaagccaacaatcggcgcagataaagctgcaaaaaagaagaattttttcggaatttttgtttatttttttacatttcttttttgggagggcgtcgccgttttttgacacggtcaaaaaagaaccaaagaatggaggcaccacaatcgaccaacagaagaggcacggcacgccaactgaaaaatgaattggtgaagtgaatgaatgaatgaattgaaagagtgggaaaagcatcaaagcgagggaaggcaaaagtgaaattttattttaaatccaatgaagctaattgtaagcctcaaaattaagtgaattttgaaacatttaaaagttgagcaaaagaaatgtgaaaacatcagaaaaaaagaagaaataataaacgtaccgaatttttgaaggcatttgcagcaacaaaatgatcggggaaaatatcggaagaatgaatgaaaggaatgaggaggaagagaagaaacaaaggcatttttatactaaaaatattagcgtacatttgagtaccgatgaggaaaaaacatataaaagacagagaaaattggcagtcaatgtcattgtttttacaatcataattatataattacgaccgactaattaataactgcaaaaaagctcaaatcaatcattcatttaacacacagagaaaataatacacgaataaatttaaattcttattcaattatgaatccaaaaaaaggatagaccgatcattttcaaataataattcattcactgcgctgatcactgcttggcaccgcggcactcgagaacacttagctgttaatcctttgtcctgttatccaattccacagcgtcaatgctttagttaaataaaattcaaaaaattttaattcgtgttcactgatcagcaaaatcgaaaattccacaacattttttttaaattattaacccaactcaaattcctatttttaatggtcagcgtcaataggcagtttaaagagcaaacaaaaatatcatcaatcaatcaatccaattcatcatagctcaaaaagatcggtcattatttcttaaatatcaatcattccgctgataactgggccccgtcggaggtgtcgagcacactttttcgtcactttgatctggcggagacagcggcctaaatgaaatgcaatgtcaattcgatgaaatccgaatctaacagttatt

SEQ ID NO: 8553 - DNA, 1740 bp, Heterodera glycines
cggcaaatgcacgccattacaggtggacaaaatcagtgatcactgtctgatcagactggggaagctgagtgatttgttcaaaacttacaggataatcactctgatcagtctggggaatctagtgatttgggcagaagaaatgtagttggtgataacgaatgggacttagtctgactattgtgatcaacatccattctgatgataatatgattcttacgtcctccccctctccgccgtttaggtggtgaatttgctgaacggactgtacaccgcctttgacggcatcatcgacacccacgactgctacaaagttggtcagtcagcggccgatcacttccattttgatcattttacaacgcatttccccgcacagaaacaatcggcgacggttatttggtgtgttccggcattccgaagcgcaacggcgaccaacacgcgaaggaaattgcggaactttcgttcgctttcctccgcacggtgtccaacttccgcgtcgaccacctcccctccgaacgcgtcaatctgcgcatcggcttccattccggtccctcccctcccctcccatttcaaatttggcatttcctcccaaatttggcattttcagggccagcagtcgccggcgtcgtcggtctgacgatgccgcgctattgcctttttggggattcggtgaacaccgccagccgaatggaatccaacggaaagggtaaaattgggggggggggggggaaacaaattcatttcccatttcagccggcaaaattcacatttcatcgagttcaaatcgcttcttgaccaccgtaatcggaggatatgtgacggagccaaggggcgaagtgattataaaggtaattagggggggggaaaggcttttgttaattaattgcctgattaattcattagggcaaaggtgtgatggagacattttggctgttggggcgaattggcgaagtccatttgccggaagggccatccgtggcggaacggaagagcccagcggaaatgcgctgattgaccggtaattaacggtttacctcagttgggcgccagcatgtttttctactataactttctataacttttttctttgtcatccaaatccaacaatgttgctatcattcgaaagcttaacatgtttagaaactttttctaagatattgcggtacttatgcactttacagaccataaaaaataaaattattttttaaatcatataagaaatttatagggggttttcggggtcgctgatcacgaatctgatatccattttgaccaattcgaactccgaccacgtattcgaataaaaaatcaaatatatctatgagctctaatatggtgttaaggagctcttgaaggtgttgatagcgcatcttaactcgggtttgaccaattccgaactccggacccgaattcgaacaaaaaaaaattgagtttttttaatcaagaataattttttcagggtaaaagcttctaattcattatcaactatttaggtgtaaaacaatgtttcaattcttaattaaataaaaaataaggaattggcgccgaaaattgacaaactagagccattgctcataatgctattttgaaaaaacgaagaaaaaacttttttatattgatccccaaatccgcaccgtccatataattatgcagaaatttgaattttatttaaaaaaatatatttaattttattgccgaaacggcattggccaaaacgtattgccgaaaagggattgtcgaaaa

SEQ ID NO: 8554 - DNA, 2661 bp, Heterodera glycines
attttctgttctttaattttgtcattgtcactattttaaattaaataatgatctgacaaatacccaatttattctctcctccattaaatggacgacattttttaaaatttgtttaaacgaaaattcacaaatggtaaaacaatacggtaaaaagtcataaaatgatatacagtaatttacaaaaatattgaaataagttggccaaatcaccggaacattttcaacgccctctccgcaaatcggcgctgctccggcgccaaccgccgaagagatcgccacgaatattcgcctccgtccggcaattgctggtgaaggcttgagaaggcgctggaatttttcaaaataaaatttaaatgattaaaatcgaatttcgaattgttgggggactgccttaggtccaccgcccacagctgcgcttcggcccacgcgttgtccgtctctttgccctgcgccgtctccgccctctccgtgcacacgtgcgccacccctccgtcccgctcgccttccccaagtgccgtcttcgtgctcagcgtgtgaatgtccgggtcggacatgccgagttggagcagcacctgtgccaagtgttcgtccaccatcggatgaccgggcgaaaagcgccagcgaaacggcaaaaggccggaggcggaaaggacgagcaccttttgggatattggaattgccgaaaaccatggaaaatgaaaatttaaaaaaataagaaaaccaacattacagtcagtaaccacaacagtacagtacccctaccgctccctcactctcgcgcactgtctgttggaaatttgttcgccttaaatctctggcccatcttcccctgctaattcacatgtgaccccagcatatagagcatgccattcaaaatgccatcttcacccatccctcgtccccacctgaatctcctccgctccgttctgctcacaattgtcatcttcgtcttcttttctgcagtcgttctcctcctcctcttcgtccacaattcgtctaatcagtgcgtagatcagcatccgattgggcccaaaccgcgcgaatttgccccttccggccattccggtccgtccgccgggattcagcggaattccggcaccattcagactaatcgaccgcttagccctcctcgaatttggcgactgtttgcactcgtcaatggcggaaaaaatcgcctgaagacagcgctggcgccactgccgcccaatttcgatgagtcccttggccgaatggtcatccacgtgcttttgcaattctgccgggaactgattggccgcttttgaaaacgaattgggacgataatgaggctgaagttggagccaatcgcgttccgaagctgggacctaaagaaggaaaccgtctttctcccactccgtccgactttttcccgtccgatcagtctttccccgtccgaccaatattttcccgtccttttcccgtccgatcagtcttgccccgtccgagcagtctttccccgtccgatcagtcttttcccgtccgatcagtcttttcccgtccaatcagtcttgccccgtccgaccagtcttttcccgtccaatcagtttttccctcgtccgctgtttatcccctattcaatcacttcgagtcgcgtcggcttttcctcctcgcctccttccgtcgccataactttccatcgctgggccccttttgtcgtgccgttgtttttgtccacctgttgctgtaagcaactgaatgcgattagcagatgggctttgtccgctatttgttgctgcgtttggtgccttccctccgccggcgtcccttccgtcgcgcttttccattgggcaacggccaaacggcgccaatagccgcagagtgggcgaccccgcgagacgggcacctttttaacgatggaggagggcatttcgaaaaacgaacgaatgtacagtaccaggcaaggaccaaaaatactaccgtatcaatggccaactcataaaatatgaaagagtgaaaagcccaatgcgtccttttcccagctcaccgatgggtttttgtagaccacgatgtatttgctctgcggactgttcggcgcccgtcccccaaagtccgggtgatcggtggccaaacattgcgcaattcccttgcggcgctgcagacacgaaaaggcgccgcccccgccgcagcgacaaaaggcgacagagagaagaaacagcggagtgaaaggcgggggaaggcacggacggacactgtggcaacagattacggattggggttacggtaagaaatgaaatcggcgagacaatggaaaaaggatggaatgtgggagaagagtaggcactgtgatcagattaacgggacactctcgaaaatgccattttcttcccaaagtatggcgccaaggaattgccgtcccacctaaacgaggtggtgagcgagtacagctggtacttccaaatctgatcggcctcctcctccactcgctttgctgtcctcgcgaacagcgcgaacaaaatgggccagctgagcagcttgaggaacacaaagaactcgaacacggtcagctgggcaaaccagccttgggcagggcatctgagaatttttgaaattaaaaattcaaaaagcaaattggcacaagcacctcgggttggcataaccaccgacactttggcaaaagggccgactttggggcagcaattgcct

SEQ ID NO: 8555 - DNA, 1916 bp, Heterodera glycines
cgatgcttttcatggataaatgggcggacaaatagtttttgatggcgccaatcccaggcaccagccaacaccttctgctcgatgtgccgcctcccactgcgctcgtcccgtcgcagaacatcagcgaccgtctgtccggactttgccttcgcgaggacaccgaccggcccatctccgccgatgcgccgccgttgtgcatgttcatcgccaattgctgctgatgttgctgcaccaattgattctgctgctgctgtgccgtctctttgcgctccgtcccgttttcgcgcacttgggaagccgacggcaaaaaggagtcggtgaccgtactctcgtcgtttgtgctcatcccctaaaattgaattgaaaatatctttcaaagctatttgtgcttctttaaattagtccacctgagttggtgagattgtgccctgctcggcaacgggtccgtttggcatggcggtcggctcgtgcactgtggtcatcggcggcatcagcagtgccggattgcgcatgtcgtcccgggagggcggaaacgcgtaaatggcacttcgcatggagtgcatactgtaagagaaggacaaatcagatactgtaggaccgccaaaaaatgcttcccgtttccaaaaactttaacatgatcaaaaactcgacctgttctgggaggaggagcgcaccttctttatttgacgcccgtcttcgagcagtgccaccgtcggactgattgggcgctgagcatccggcaccacgcagttttcgcgccgaattcgaacccaaaatgccgcgggcagcacaaaaagggcggagagaagaattttgagccagttcgggaagggcaaaatgcgcgaaatggtgcgcaaatggattcggccgtacagtaaacggagcacccaccgctgacaacactcgtgggccaaaaaactccgtgcatttgtctaattggtgatttaaatgtcatttttatgaacatgcataagcgaacggcggacttcaaatgcaaattgggtgagggtcagctgccgaaaagtgcccatcgatttgcaaagcgaattgtacgccttggcagggctgtcgcggtaggcgctgtccaacagttgaacagcgaattgggaaagttgctgggcgagccgttggaggggctggtcgtagaaaagccagggacgggactaagcaaacaaatcggatgaagataattagaatatctcaattgcctttctcgccaaagtgcgcgaagctttggccaacgcaagcgaaagtgccatcggttcggtggaataggcacaaaaaagacggacgagttcaggccgatggatcagaagggcccagacgatcagcgcacggagggacctttcctgatcattaacgggaaattgggcggaggaggagcagaacaaatcggacgagaaaaatgtgacggaaagaccgccgcaaagatggcactgaaaagcgaaacgccaaatcaaaaacgaaacaacggcaaattgagcaagcagaccatcaatcggttgattcgcgtggcgaactgttcatcaattcgtcccaactcgcgatcgatgccgaaataatggcccaaaatgatggcattgaaaaaatactcaaaattttaaataaaataaatggcagatcagagaaaaaaaccaattacctgatcaccggtgtccgcgagccaatccaaaagcaattgggaattgacaagcaaaggaatgttttggtcgagcagagaagccaacacgccgattcgatcgtcggacgaaagggccgaacggagcaaaagggacacttgctaaacttgttaatgaattttaacttttaaagtgattcaatccgattaacatccttttgcttgtgagaataagcggtagcggtacggtaattaccggtgccgtttttgaaaaagtgagataccgttaccggttttg

SEQ ID NO: 8556 - DNA, 4118 bp, Heterodera glycines
tcatccgcgcataacttgacggttgaaaaatttcgcctgtgcacgggttgaacagtgcctctttgatgtcatcctgaaccttaaaaacggaattcgactttttattgccaaattagaaaaaaaaacccattttcccaaaaaaatcaagtaaaatttttctaaaaatccataaaattagcaaaattttggtgaaatctgttccaaatctgtcgaaaatttccaattttttcaaggcggcgcctaaccgaaccactcctgttccccaaaagttttttgaaaaaatcgccgcaaaaaataaaaatttttgaaaaaaaatttaaaaatggtacaataactatgcacaaagccaaccttccgtttggcgccatatctttgctgaaccgtccggcacatgtccaattcgtccctggccgcctcggaggacgaggcgcgccttcgctttcggcgttttttgcgctttggcactcctcttttctgaaaaaaaaattgaaaaaattaaaatttaatactcaaaaattttgctgtcagctaacaaagcaaagtccaagtttttacggaaaaataaaattatgttttagagaaattgataattttttctaattagggtcggaaatttcgtgtttccaattaattctgatttccgaacattttttggggcctcggaatgccatccctaaaatgttgactttgtgaaatgggtttttttggtcaccggacagaacagtaccggacagaaacaaaaacaaacttcggccgccgccacactttcgaaattatcatttttatttgcaacaatgttttcatttttgtcctcctcctctttttggtgtgccgacatttttttgaaatgaaataaataaaataaaagaatgtacaaaagggaaaaaattaattatgtaattaattaattcgcaaataagcgaaaaagcaattttatttttatatgggatttaatttttatgagattagagttcaaaaattatgcatataaatttttttttaattggaggtaaaattcccaaaatttcttcgaaatgcgttaaatttaagaaaaaaatttcgaaaacttaattccgttatgaaaaatctactcagaaaattaggggtttttttgaaaaattttcggtccttttcttagatgtcatatgttttttcgggtgtgtcacggaccgggtcagttgggcgccgccgattgggcgacgccgattgggcgacgccgattgggcgccgccgtttgggcgccggtacgattgggcgccgccgattgggcgccatggggaaatttaaattcattaaccttgcctcaacttagggttaaggactttccaaggacgggtataataatttacaaggacgtaacgtgaaagtttcattaaattcaaggatacaaaaaaattataatatgcaatgaaaaatgattgcagtattttttcattattattttgtttctgttcatcagtttcctcatttcaccgcatgtgcacttttttgcggtatgcttttttcaaaaaactttttgggaacattggttccggcggttgccgatcagcaggaaaatttttttgaaagatttcagggtacttatgtatgcactttacaaaccataaaaaaaaatattttttaaaacatttctagggggttttcaggtcgctgatcacaaatctgacatctattttgaccaatttcgaatcctggacccgaattcaaataaaagacgaaaatttatttttcatcaaatcaacctttgttgtcccaaaatccattcaaaagaatgtagatgattaaaaacattatataaaataattgtttttctcgaattctttttcaaggacattaaattcaaggacagcttcaaattttaagttacagggcataatttcgaggacccatgccattaaaaaagaaggagtcatgaaggaattttgtgactcaaatagattttaaccccataaacattacgttttttgagtgctgtttctcgtaattcaggtgaatggctagaaatttttgtagtaatttcagttttttacgtttttggataatatgaaaacgaaaaatttggctgccgcatggcgcccaaacggcggcgcccaatcgtacccgcgcccaaacggcgtcgcccaaacggcggcgcccaatcgacccccaccgatcgacccccaccgagaaaaggatgttaaattttgattggacacggaataggcaatggtacactgaaaataatgaaaagccagaggataaatgatagaaagaaccataaaaagagttgaaattcaccaaacaaaaaacccaatttttcaaaaaactcatttttcaaattcgagttcatattaaaagctttttagcattgtcggaaattttgaaaatttgagtgagatttgttaacagatttttaacataaaaaagattggtttttgggattattaagctcaattggtaggattttcatttaaaaaatgataaaatatgtatcaatctaaaaaaatatattaatatatttttaaatttttttccctttaactccaattttcatcactaattttcactcagacccccattccttttcacagcatttaaattaaatttcgtggtaaatttaattaaaaatcatgaaaaccttcgttgtttgaggacatttgaggacaaatggaagaggagtcattttgtcatcggaggagccaaaataatcagcagaagacggggaagaaagccctcttggccgctttttctcttctgacgtaaaaagcttttgagggaaaaactatggagcgggccggccttgaaccggcgtcacttctggctttccggtccaatgttcaaccaacccactaccgatcctaccctcatgatgatgttggggatgatgatgatgatgattatgattactgtgcaataaattccttcgtctgatcattttcaattgcgcattttcgtcgtcgttttttaaattggccgagagtttagcaaaaagcggaagaagcaaaagcagtgaaaagcatggccaaactgagcagcagaacatccatccaatgggaggacagaaacaattgggaaatgttgctggattggatagaagtttaaagtacttttaccaaaaatatttggtgatggaggggtataatttctaatattaatgagtgttttgactaataacatagattaattgtgaatgggttgcgttggtcctgctttgctaatatatatttttttaatttcaaatttgaattttccggtcaaaattcccaaaggttctgcaaattcatgaccggtttttcacgcttctcagctttatcttttttttcaaaaattctcgtgcctatttttccctaaagggtgttgactttcgtttctcacctattcaaaagaattctttccgcttcacacactttgtgaggggccttaatgggttcaacaaaagtgaggtccttttgcatatcgaaagcagccgaaaagtgccactcaaaacgttccatcggcgagtgccattctcacaaatagcatttgagaagaagcacacaaaaataacgaagtgaatgggacggcaaattggagatgtaataaatgtttctaaatccatgtgagtgagtaaaattgggatgggcgggcgccgcgtgagcggggggggggggatttagtgaagtgagtacctaaagtgtcgaaaagccgagaaaagcatggcatggcattagctaattactatgtgaataagtgttgcgacacagtgaaatagaaataacaaaatgagaaagaaaaagtatagtaaaaatatgtgacaataaaaatccaattaattaatcatttcaatgagtcaattttctagacagaagcattctggaagtgagacttttgtgaaaattgaaaatttgaagataaagtttgatttggaaaaaccttgtcaagaattgctcgacattcattcaaaaccgacatttctgtctgatcactagggcttgtaattatattgaaatccatatttttttcctggactgttggaggtctgaaacgcacgaaaaacatgtttttagcttagtttgaagcctctaggacggatttctatatccatattttccatatttaaagatttatgtccaatttccatatttgtccatattttagca

SEQ ID NO: 8557 - DNA, 1105 bp, Heterodera glycines
ttaattaatcccttattttcagctcgccgcattgacctttattcaaagcaatcgcaatttgtggtcaccggacgaaggggaaatgggggaaggcgatttgccacttgaaggtgctgggaataacaagaaaaaaacccgttaattaataatttatatttgaattaagaggaattggccgattgggtgcaggcggagacatcggacggacaattttactattggcacatttacacggggggtaagtgttttacattggaatagatttaggaaaacggaacttcatactgtaatattttattaagaaactcgttgggaacaacccgagaaattttacacttctgcccaatacgccgaacgttatgccaacattgtggaagagacaactgaccagagggaagtcggacagtgtgccaattccgcctacgatttaacacaatcatcggtattaaaaaaagttctgcaaattagaaccgaagaattacgaagaatttgtccatcgccggcacaagtcagactgcttgtcctgaactgattgacccaacttttgtgcaccaaatgactgttgccgaggtgaacaatcaaatggcatcgacaggacatgaagcgccacccccggtgaaaaagtactatggaatgagggaaaagcatggtaaaggcagcagaaattaacttacaattagaggctggaaacaggctcgctggtactgaggcgagctttttttctctaactcgaaaattccgggccttttaaaacggacttttcgtaagaatcccttaaaaggatctagccttaatcaaattagcaagcattactgttaacataggagaatttctcaaagttttccattgataattttttgagttatagaaaagctcggtttcagtaccagtgaacccgtccggtctctacttacaattaacacattaactattagtaattgtaaacaaaaacgaatttttttgatggtgggcgaccaaatgaacgacagacatacggcgaggaagacaaaagcaatgcccaaaatcaaatgctgacgagggatgaacggcggaagatcagaagagagcgaaaagcgatgagtgacaaagcggacgacggtaaaga

SEQ ID NO: 8558 - DNA, 4192 bp, Heterodera glycines
  misc_feature (29)..(29): n is a, c, g, or t
  misc_feature (129)..(129): n is a, c, g, or t
ccttcgtttccagaggccaatttggtttntagggtattttctggccaaaagtgatcaatgacggtgccgtcgacgatattgcccagcaaacagccgtgaaacgcccaattcgatgttcacatcgacgtntcagaaggggcttatcatggacacggacaaagtgattctgatgcgtaaggtggaaatataaaataaaataaaataattatgaaaataattaggtgcgctcggatattttaatattataattaggaatatggtagattcggacaattaaatgaattctaaagtaatttgtttgctggaccgggttcattcattatttttaaatacaacttcatttagtgagatacgtgaacttgcgcgtaaactaaatattatttaagctcggacggaatcccacggggattgtcggggacccctacccttctaggggtgtgcgttagtcttggttctcgattcccgagtcgagaaatttcgggggttttttgggtctcggttctcgtatcgtttctcgcggtcatttctcggtctcgggctaaggttctcgattcttggtaaaaaccgatttctcgcacgatccctcccccccccatttcccaaaattccgggttttcaccttcacaaccatcgggcgcaatttttccattataaaaaaggtgtcacgctctttctcctccatgctgtccaatttttggatgatttcgtcgccaaagtaaacatttttggagcctctctttaatggtgcgacttcgttccatttcattacgaaattgtccgggttcgcttttaccatcttaataatttaaatatttatttaaaaatattaattttacccgaattatttcctccgcttcttcctcatctgctcctatgctccaactcttcggcataactttgcgcacttccgctgctaaatgtgcttcttctggcatcctaaagaaatgctccacaacgcccggcttggaaagttcctggccaaaatttaaatattaaactcagctaatccataggcgccgatacactccgccgcaaaaattttgcaaatttgaattcaatttgtgcacaaattttgtccaaaaaatggccaaatttgcgaatcttgaaccaattttttatgaaaagaataagctaaaggagtccggtggtgccgataggcgccgccggttaagttcaatttgttaacagatttttgtccgtaaaatgagcctatattgcaattttaatcgatttaaaaaggcaaaaaacgatgaaaaattgcaaatttctataagtgcacttgccatttttcaattaaaaaaaatctggtactgaagtgtcattggcacgggagcctataatttgcatctttctcatcattttgcgttctaaatcgattccgacttttttaaatggttttttgtttgggagctatgagacatatttacccaatttttacgaaaaatagggattttagtgtaaaatttttgaaaatgggatttcttaaatccttttgccccaaataactttatttcgagcgaattttaaagaaatttaatgagttttaatttaaatgaggtcatccttgagactttgcttttatttgtttttcgcacaatatatgtagttggctttgttctaaaaagtttcaggaataggggaggggccggcgggcaaggcgccgccggggaaattttttaaaatttggctctatttcttagcaaactttgcccaaaaaatgacaaaatttctctataaaacaatatgtaattcgtaaattttaagttttagccagggtaaatttttcacggaataacgaataaccgtgaattagcaccgtgaaatgtgatcgtgagtgaaaaaacactttaaatattattctcagcaaattcatttaaactaattaaccgcacttatttaatcgttaattaatccacctgttgcactttttttgaatgcgccaacaagaaaagtatattccacacttgctaaattagttttaacaataattagaaaattaacaatgaagtttcaatattaaaaccgcaaaaagccaaaattcttagagaaaaattgagcgttttacatttgattgaggcccaaacgaatgagttaaaatcgcaataattaaaatattcgtgtaaaatttgatttttggtttctcatgcgataggataagcgcaaataaaagatataaaaccccatccttaattataattatttttcaatttatttttttattacaatggcttttgagagtttaattgctctcaacacttcactattggctttagttgtcaaatcatccgtggcattgcgggccattgaaacggcaacagtgaatttgccatccaaaatcaaaaaattgtccgagttgagctttagcctttattatatcattttaaaaatcgaattaattaaatttaactaattcaccggtcaattccctcttccaatgtgaggaaaacgcatttcggctttggctttccctcaaaaatgcgttccattgcgtattgaattgcgcgcgcttcgacgagcaaaaaaatgcgaatttttgggtggacaaaaagaatcactgcattaggatcaccgaattcctcccttaagcaatgccaaaataaaaaagtaaaaaacaaataaaacatttatttattaaaaaaacaaggaataaccatttaaatgctgaagtataacctttaccattatcaatcggttgacttttaactcaatgacagattcggtttttccctctcctttctcttttcatctctcactctcttccccctttctctctctctctctcggtctcacgctctctttctatcccctattctttcccgctcccccccccctctccctctctctctcttcgccctttatctcgtatccactcatcctttttctttttttatctctctcctctctctaatctctctctcctctccatgtcgctctctttctctccctctctctcctctttatcatgagtcataatattctctatcttgcgctctctctctctaacctcttacctcctcgctcgaaacgggccagttgcgtctgagccaagtttagaccaccataacttttttctttgttgaccaaatccaacaatgttggtatcattcgaaagctcttaacaagctctatcggctatccaaaaatcacaaagacataccgacatataaaaaagttataaattaaaatatgcaaaaattctgactttttggtagtgttcatgttgcaacttttttataagttgttcaatcgcttagcaatatcttatcaaaagcttctaaacatgtagagctttcgaatgatgccaaatttataaaatttgacaaacaaagaaaaaagttatggtgctttatgcttggctcagacgcaactgacccctaccgtccccgctcccccccctgtctctctctctcttaccccttttctctctaatcccctcgtcctctttgtcactctctttttttgtcactctctcttttctctctttccttttttacccactctatctctttcttttccctctctctcttaaactgaccatgctctgtacattgccgtggccaacatttcgctggtcagattttccggcatcaccgatattgaattgtcaatgccgacattggaaagcattcggcgatgaagtgcggtaaggggctgaggagtgccgtagccgccaattgagccgccattcaattcaatcttaaacagagaacaatttcgttaaagttacaaaaaaaaaaaaaaatttccggaacgcctacaaaattccctaaaattttaaaatttgacctaacattggcaattttggtaaaataaaaaaaaattgcgtaatccagcgtcgctggaaaactttctgttgaaattgtcccaaattttcaaaaatccgcgcgcccgatcccgtgcccgttcgggctcgattagggctcaatttgtttacctgtttaagcgtatattttttctcattgcttttttcatcaatttcttcgctggccatataatcctaaataaaaaaataaatagaaaaaaaaccttttttttaacaattaaatcttttttatgttcattttaatttttaaatcatttgtctgtgaatataaacaaatttaaaaaagaattattttggataaatgtttaatccgcagagttgcgatttttgagccaatttaatcattgatgtcctcaaatcctaactaat

SEQ ID NO: 8559 - DNA, 1504 bp, Heterodera glycines
  misc_feature (1306)..(1306): n is a, c, g, or t
  misc_feature (1333)..(1333): n is a, c, g, or t
  misc_feature (1383)..(1384): n is a, c, g, or t
  misc_feature (1425)..(1426): n is a, c, g, or t
  misc_feature (1460)..(1460): n is a, c, g, or t
tagtgttaagtagggatgggaaatttagataaataaaatttacggaatttaaaaatgcttttttcctgttcatttagtaattgtcagaataatatgaatttttgcagagaaataaataccttggtataaatattttctgcctgcaaaatataaaaagattttatgtatccaaaacgtttttataaacattcccgtgtttaataaacttgaaaatttcacggaaaaatatttccctgaaattttcaagatttaaaaacattactaaataaacagaaaaatcagcatttttaaattccgtgaatcttatttacctaaatttcccatccctagtgataagagtaccataattaatggcatatggcatttttttgccaagtcttttggggggtctgtgccgaaggcttctttttgaaaaatttaggcaaaatttttttaagttctgaataaatattaaaaaattaataaattcataaatttataaagttagaacggatttaaagcaattttgaaactattttcattaactttttctaagaattttttttgtttccctcaacgttgattaaaaaattcttcccccaattcttacagtgtattttaggatccagttggatccttctagccgggtagggcacctggattgcattttcaaaaagtcgtcttgcaaaggccgctgtattgagtctggacccggggcctaccccagtaaaattgttgtgcctaattgctcaaaagctaaaaacagctgaaaaatagaagaatatacaaacagttttacttgattttgttcaactttgtatgctttaaaatgtcatattttggcaatattttccaaaccattggcctaagtaaaggaattgagccttttggctttatttaaattcaaaattgcatttaatttttaaaataattcgagccccacgatgacattacaattaaagcctatggcatttgccaagtttttagggatctgtctgtattttcaaatatctttttctcattcttttctcgaaatgttggtcaatagttttacttaaattttgtttaattttaattttaaacattatacttcattgattttgccacatgcgtcacatttcagtttacttcttggcaccggaaaagtcagcccattagtcagtgcccaatcttttgcgtcgcgaattcgctccattaaaacattttcgtccctttcaatgttttccacacaatatttcacttcattggctgttgataaaaaaagaaacttttatttcatctaattttaaatatttaaaatatttttaaattttgacttttaaattanattttttcattaataaaattaccttgngtaagagtggaattcacaaatttgagctgaataattccgagaaagaatannattataaagttgcacttcatcatttagtttggttttataannatataatttgaatatttttatttcctttaaatancatttgttttatgggtgcagcttgggatgtgtttatctaaatca

SEQ ID NO: 8560 - DNA, 1590 bp, Heterodera glycines
  misc_feature (1581)..(1581): n is a, c, g, or t
acaatttgtttatggtgccagcttggatgtgtttatctaaatcatttttaaaatatgaaaacaaacaggaaatgccaacattccatcgataaattaatggcaaatcgatgcatttccggactcggatttgctttaattatttattaaaatttatccatctggtgaaaaacccacaaacacaaaatttgcagtttaaaatttgaatggttaactttggcaaaagcatcggaaattcgattgcaaagatcgattagtcaaaattttaaagcggaaatattggcgagatcaacggaattcgattttggacaaaaactccggcagaagtgaagttgcaattaaaattgttggcacactttggtttacggcaactaaattttacattcttggtattgctctacagttctgaggattttactattttaaaaatagatacacagttgatgagggattatttgttagattcttcattttcagtttcttattatgtcatctccctttattaaagggtctaactttccttgtttttttttcatttccaatacaaaaagctcactttattgaggattgttctattaatgcttttcaaaatctccattttctgttggtcagtgatcaggttgctgaaaaccggaattaacttaagagaaaatgatcagtttgagagtaagccaaggaacttctcgaaaattatggaaaatatcgccatcatcgccttgttgttggatcagcagaacaagtctaccccccccccccttcaaatgttagccaccctttccccctattttcaccaattggcaccaaacgtgccaattagggcacatcaacggatttggcccttcgtcacctctcttttctcatccatcccctcacctgtcgctccccttcatcttggtcttcctccgctcccaatgtgcttattattagcattttgttctgcgccaacttttgcgcttgggtgcccaaattgcccctcctcttccattcggcgtcgcttttcgttcgatctttccccgccggccattcgcccctccctccttcccccatcggcaatcttcatctttttcatctgtataattcatcgcggtgcaataacttgtctattcttcctcttcctcctccttttctgcgttgatcccctctttctcttccttctcttgtctaggttatccggccctttttcttatcacttattattcggtttctttttcctttattttttccgtcttttgtcgattccattcattaatttaaattcacgaagtttttgtggttcggcattccgatttgcgattcccgaatttttctttaaatcaatttaaaataaaacttaaaagttcactagggtaatctgtaagaccgggaaagttagaatgtaacaaatttctaagtgatttggtatttcgacctcatttgactttgacctcaatttatttattatttattttcacatattttgtctttttttaattcctgtgatcatccatatattttgtcacttactctacgacatttatctgatagtcgtcagagtaagtggttctcgcccttctgatgacttttttattttttatgaataaatanataaataaa

SEQ ID NO: 8561 - DNA, 2775 bp, Heterodera glycines
tatgactagggtttgtaataatatggaaatccatattttttcctggactgttggaggcctgaaacgcatgaaaaacatgtttttagcttggtttgaagcctctaggaaggagttctatatccatattttccatatttcgtgatttatgtccatatttttccatattttggcattatgtccatgttttatgtacatatttttgcattttttcaaaaaacccctattagaacggcccccatcagataaattggcagttttgaccccaaaggccgtaaaaatttccgaaaagacattttttagcaaaattttgtcgaaaaaattgattaaatttaaattttcttaaaaattggtaaatttatgtcaaaaataagcaaaaatggaaatttttgattttttggtcgtttttctctagaaattgcttgttttcttctaaaaacgagttcttataccgtatttagccattttagatgtattttactagaatttaatgaatttgaaaaattttttttgaaaatttacccataacggaaaatttatgtccatattttcgccattttatgtccatatttcgggcttttttggtccatattttatggccatatttcatccatataattacaaaccttaattatgacatttttaattattgtcatttaatattaaaattctgcgaaagcatccattagaaataaaattaatttaattgggatttgtttgtgagcatgcgaataaaaattatgaataaaacaaaattaatttcatttttcacatgcgcacagccaacttttaaaaagatttacacgaagtcacgcaatgattttctaagtaccggaccgatttaaaattgtttaaatgatgaaacttttgtcatatcgtgtaaatgcaaaataaaaattattaattttttttgttttatcttaattgagactcacgcgatgattgaatgtcacaaaattttaagatatattgacatattaaaaaatttaatttttttcctttcacataattagggatacgatttttagttgctaaaaacagccaaaatagttcgtttttaggttacatgccaaaaatgggaatagttgctaaaaactttctatgcagggatggcagatctgaggctttagcctcatttttggttttttgacaggtcaatgaggctaaattttcaaaatgaggctttgaggctttttgtggttttttgagaaaaaccgcaaaataaagaatttttttaatgaaaatatgctaaaaatatggtcaaaattcttaatttttcccccggcggcgcctatcggcaccgccggaccgtaaaaatccttaatttacaaacaaaaatttgctcaaaatcgcaaaatttggtcgcattgaacgtgagggcccaactgacgtagaccacattgattatcttttgaaataaatattcatagcattgattgtggatagcgcagcgatcagtaaaatgctttatatcgtcacttatgcgatgatcagcgtgggtagttggtctagtggtatgattctcgcttagggtgcgagaggtcctgggttcaattcccagactacccctactttttaatattcaaaaacgcattcatcaaaactaatttttattttttttataaatgcgggatatacaaacagaaacagaaaatgccaaattggcaaagcaattaaaaaaagccgtaattatcaataggtgaactaaacatttgtagtgactaattggatgggaagctcattaagctcattctgctattgtggtatcagttgattttgatttgaaatttgtttgaaaacaaatgcaaactgctctttgaatgcttgtcgttactccgtactaaataaaaaaattaaattaaaaacttattttaaattttatttgcctcgttaagtataaaatgggtccgtccgttcgatgccgcaccaatattcagaagaattacggcgattatttgaccaaaccaagcagtgatttacatgtaaaaaattaaattcttataatttttacctaatatatatggattttttagcaaattattaaataaatttaataaagcctctttcagctctattaaaatagaaatttaaaaaaattgaatgcaaaaaatgaactctaaaaagtggaaatgcacttgaaatttaaattaacattttacggtaaaaaaaaactattaaaacctaagaaaaactttgagtcaaagtaaataaatagggatcgacaaacaggaatgaaacatgatatgaacgtgatgatgcatttcgagaattatttgacaaatcgcttaaatattattttcctctaattacatttcttataaaatttattttatgaaaatcattaaaattttatatagaatcatttgaatttttaaacgaatatgcggctaatctgaatgaatacctttttagtaaattttcccaaaattactctctcacagcttatagtaaaatagaaaaaaaacgcaaaaattaattattatcatttttcgattaaaactcttgtaccgatattcttgttagatctttatgtatttttactcttcactcaaataattacatataattattttgtaagcaattttttttatatctgagtgcgtccatttttattacactgacgaaatatgtgtcaaatgatggaaacgcgcgtaataagtagagaccgaacttaaaaggcaccaaaattcgcgaaaaaggcactataataggcatcaaaaattgaaaaaatggcatgaaaggcaaatcccgaaaaaggaatgaacatagcatttaaat

SEQ ID NO: 8562 - DNA, 2958 bp, Heterodera glycines
atactatttaaatattttccaattttaattaaatttaaataggattattttttgaaaagataaaaatattatttcaaaaatgttgacttcttagcttgggaacctaacagagttatcctggcaaaaataaaatttttatttttttgtggtttacaagcaaattaattttttttttaaattttaatttattcattcttggttattgcccatcttagtgacttatttttttgaaatatattttcatgaggctcgtaattttgtagccaaaaaatacgaagttttcgaggttcgaagcacgaatcttaaagttcacacagccctggtcctgatcttgactttatcatttatttcgttagtcatggccaacttgccggctcttaaatttatgctcaaattgcaaaaatcaatcgtaaaagaaatgataaactcattaaaattaaacttttcggcagttaagtagtcgcaattatttcaaaaagtttttgacactttttccttgacatattttccctgacaaagaaacgtgtgattttttacttaagcatacgtgtgaatttgcacttaataatggggaaatttgtgttaattgtgaatgaattttctgttcttcccccataatttgtgccttttgaatggggctgctgcccttacggctcacacttttgtgccccatttcatttgcgcctcataagtatcaaaatttgtcttatttaatttttatacttcagttcattaaaaacaaatgttttaatattttgaaattaatcaacttatgcaaacataaaaacatgaacacaacggcaccaactgacattgacctgtttctttttttcctcggcggtgccgttgaactgttgaccaattttgttggcattccgttatccattgccaatttgattttggtggcacgcacatcggtcatccacccgaacatgaaagccattctcatcttccagagtctctttattatcttggtaaattaaattcaattaaatcaaagtatttaaataaaaaacaagaaatgattattattctaaatttaagcgtggttcctgtcgttttgtcatttgtcttttcaagttcttcctttgggacccaattggtgcagaatctacgctatttttcccggcacttttaaaaatgtatttcattggcatttatgctcgtaattttgtgccccatgttctggtcgttgaacgcattttgtccactttatttgtccgaacatatgaaaagaatcgtggcaatctgttcagcattctgtggatgccttttgcggtgagataatcgagacttaattgccaaattgataacgaattataacgaaaaagtatcttcaaattcaagtacaccaaaaggaatttttgaaaattttgttaagcattaagaatacataagcgatcaaaaattctatttgcagttgatcatcccaatttatattgccaccacaacatcttcaccgcatgatcataaccaaccaataacgaatctgatcacaactgccgtccaattgctggtcggaagcattgtgttaggcattttctaccaattaagccgatacaattccaaaatttatcaaaaaatgttccaaaatattggctcgaataatctgtcaattcgttatcaggtaatccatataaattaattatataatcattatttattttgaaagctctctgaaaacattcgcattggcaaacagctaataccgccactgtttctgaatttgggcaacattttcgcgggaacaatgattttattatgggactttcttgatttgccattttatatttatatattcaatttggctgcgattatcaactcaattttcggccttcttatcgaatttttcattataacgtaaacaaatgtaaaacttaaaatattaatttaatttaaaagttttaagatgccatccatttttgaatagggatttgtgccaatttttgaaccgtattggtaaaatgtttggatttaatcatttggcctataatcatcgaattggtgatgcaactgtaacatttggcacaaataatactgctccttctttggctgctgtcaatggcattgctcaacggaatttgatcagcggaaaagcattgattgataaccaaacaaaaccagaagatcattttgccatgctgaaagaagcatgggagaaggggccgatgaaatgacaaaatgccaattcgcaaaattaactgaaaaactatttaacatttttgaatttccgttgtgaattaatgcatttattaaaaaacggatcatttgagatttacatgaaatgccaaaattattttccgaataattcgatcataattgattttctggtgaaacaaatggagttttcggcagtggccaacccaatcaaagagagtgctcaattggtacttcaaatcatttgcaaaatcagcagtagttgaacatggcaaaacatagctacctaccgtaaattgtccgtaaaaatggtacggtagttgatagaattaaaaataagttaatatttgaaattttttactgatattagtgcagtaaataagaaccgaactcagattgattaaattttggatacatttgctttttccgttcctgctaaaatataaagttgagcaaagtgtaatcaaactctatttaaatccttcaatttggttaatttagatgaactgaattcggaccaaaagcaaatgaaatgggtcaatttaatatgtcatttgaatttgaatcaccatcggtcgatgaccaatgacaacaaaacttttttggcaaacacaaaattaaacgcaatgcaaaaaaaacaggaccaaatcaaaccacatttggtgtgaaattttttaatttttttaatttaaagaatatttttaagagggacgaatttgaacattttaaagaattggtgagcaatgacaattttctgcgcacaacaaagaaatatggagaaatctttagtttctgtaagaa

SEQ ID NO: 8563 - DNA, 2400 bp, Heterodera glycines
  misc_feature (6)..(6): n is a, c, g, or t
aaagcncattttcgactcaaatggtcaaccaaaatttgccattattaatatgcaattgataaatgtttttttcgcggtgtcttttttcaaaaaactttgggggcggtgcaattttttaccagcagtaccggtactagaaaaaccagtaccgtattttttcattttaaagaaactagtatcggtataaaaaaaccggtgattactgtattggtacacttttactttaattttgaaaaatttattccagctttaataaaaataataaaataatttactctatgatcaaattcaataataaccaataatgtttgaattaaggaaacaaaataattgaaaaaaccgaatagaaatgtgttttgttaatatttaaggaggagaactacagtacatatttcaataaatatgataaaatatttcttaatttacaattaaaggaaataaaaatttaagtgaatcgaatgaattcttatttggcacagattatttttgaaaatgctccatctgagaatattcgcttccaaattcagacaaatgttctcgcagttgcgcttgttgatcctgcaaaatgacaatttctttttgcctttctctcccttttattaaaaatttaaatggttaacagaaattgcattctttttttgtagttttctacgattatgaaatgaaaagtatttttatttttcaaaattctctctttggcacatccctttgctaatttacccccccccccccccctcccccaccttaaggtgttttgggatttctgcgtaaacgtcgacaaataattcctcgggcgctctctttttcaatttctccgccttcgcaaatgaattcatcacttctcgccgaacctccaaagggttgggaatggtcacttttttcattcctttaacaattatttcactaaccgtgccaacccattgtttatcttgcgcatctaacgaaatatgtttttgtgaatggataaatggcaaattaacaaaatgcaaagcctaacaaagaacgcaccgtcccaccattgacgccgttccaaaaaccgtcgaaagcgaccgatcggagggtccaattcggcccattctttcacttcttccatgggtctgatcagtgtttttttggataaccaaaaagcgagcggaagagaaagaaaggaccgataagcggaggaatcgtcggaagttgagtggtggccgacgcggtaagtcattgcttcgatcatcaccggattgttctccaaggccaactttcgggcttccgaagtgactttgtacacggcgaacggatcattcccatccaccctaaggcacaaaggcaaacaaagtcattttgaaaaccgaattttaatacgaaaggttaattatattaaatcaaatttaattctcctaaagttaagagagatggtttctttaatttaaaactgtttatgaaaaactcagatttgaaaaatttttagtaaatttccggggcgaaaatgttagaataaaattgttaggctcctctaatcaaagattgacacaaaattccttatccaaactgagtttccaaattcaaactcaccccccccccctaattgaattctcatttcaatggattttctaccgaattgtgtgcattccgtaaccaatgcctttgccggcaattccatcgcccgcgtactgttcagaagcgggtgtgctaatcgcaaatccgttgtttcgacaaaagaacaaaacgggacaacgcttaatgatttcgagagagatagctaatcaaaatttctgtaataaattttgtttttttcacaattttccttctttcgcaccaatgcggcagcgaaattaaacgccgcgtgcgcgtccccttccgacgcggccccttccccaaaataaacgcagacgacgcgtttctcgtcagccgatcgttgcgcattggccaatttgaaggcgtaagcggtgccaactgcttggggaagctgagtgccgagcggagaactgatggtgacgaaattcagcggggaagatccgtaatggacgggcatttgtttgcctttgcctgaagaggagaaaatggcacagcaaaaggagacaaaaaagaatttggcaaagatggcattcaatggactgtcagtttctttcgaaatgtttacggaagtaattgcgtaaaattagcatttgtcgggtttattttcgtgttgttttgctcgcccaccttcgtccaattcgttcccatagcattggttcatgcattggtccaacgaaaagccgcgccacagaaggacgcccacttctctgtactgtccgtagaccaaatctcgaagttccaacgcggcggccgagcccatgtgactggccttttaatgagtcgcctttgcctcccaatttcttttacctcctcgccaaaattggtcatataaaatgaaattcg

SEQ ID NO: 8564 - DNA, 1952 bp, Heterodera glycines
  misc_feature (33)..(34): n is a, c, g, or t
  misc_feature (113)..(113): n is a, c, g, or t
  misc_feature (1922)..(1922): n is a, c, g, or t
aaaatgggtcatataaatgaaattcgtcttgcnngttgcgattcatacaaaattttgtccattgtatcaatttaaccatttctttgtatattttaactgcaatgtcctgaaanagagaattctgttggactttttcttattaaaaccttcggcagaggacactcttcgcttccgtcaacaaattctcctcgcgaattaatgcattggtaaattggcattggcacttcattggcactgcttcgaaattccaatttctctgtgaacttcacctgaatattgctgaaattaattaagtttttgtaggaatccattaatttttgggaagttcttatgaatatgataaaaataacatattaattgtccatcaactgtttgttgctttttctattagcagaccaacttctcttttgccgaggtatttttggccaaattcgcgcaatttgaattcgtctgcatttccaatactttgctttgatccgatggtgctgttttcccggtaattaattccacgatttaatacaaaattcggaggaaaagcaatggtccgtaataaaacgatgtctcggaatttaaataaattcatcataattaaactttagccaaaaataattaattaaaaaattattacctaaataaaaatgattaaaattctcattaatggcataaaaactaaaaatttaatcatataattcaaattaaagtgaactacggtagaatcgagagtcaccgaattcggtatacggtagaaaacagaaaaacattatttttgatatttaaaataaaatttaaaattattctttctaaaatactgtaccgttgctgttgcgcagaaagaattgcttaagtaagaaaagtcacaaaagtaaaacaaataaattaaaggcgcaattcgccattttcgaaaatgaaccaagtcgaattgtgagaagttcttctcaccgtccgttaatgtcatcaaatgattgactaatgaatctaaaactgctcttatccttcagaaatgtcacttaatttctcaaaagactcagcttcacagattcccaactttcccgcctcaaattctgacgacggggctgagtcagtggtccgatattaccagggaggaacggacgaagtgaaaaatctgttgaaaaacgaatgttccgttatttacgagtgcaggtcggtgatgggcagccattccgctgagaaacgatgggcttttcttttctcatttcgcccttttttagctgttgtcggtcgctgtttcgctccatcatcaattttgttgcacacaaaagaacgatctgtcgcactttgctttcttcaatacgaacagagcaggccgaattggtccgggacagccaaaaaacgaaccaaaaaggtattcgaaatggaaaaataggggggggggataaagaagtcgaatttggtgggggagaaaagtgacggtgggaagtatctgctggggaaaaagtgtcggcactttttttaaagaattcgcaacccatccccatgggtacgtccatactttttcggcctggcatttatcgcgttggacaaaagttagtttcaaaacaaaccaacccaaagaagagtatattttgaaaaattttgcaacaaatttcattatattaaatttaagaaaaatctcaaaattgttcttttttgagcctacctgcgccattctcgttttccaatatttcttattagagttcgacctggacctggatccaggcctggatttttcctggatccaggtccaggccatttttcggcaacctggatttttcctggacctggattttcctggatttttgtccaggaaatccaggtcaaatgtgaaaaaaaatccaggtccaggcaaaacacgaaaaacctggattttcctggacaaaattttagaatttattatttcaagtgaccgatgttttttttcaaanaaatgattaaatagattcaaaactcattat

SEQ ID NO: 8565 - DNA, 1346 bp, Heterodera glycines
  misc_feature (195)..(195): n is a, c, g, or t
ttttcctggacctgcattttcctggatttttgtccaggaaatccaggttccaggtcaaatgtgaaaaaaaatccaggtccaggcaaaacacgaaaaacctggattttcctggacaaaattttagaatttattatttcaagtgaccgatgtttttttcacgtttcaaaaaatgattaaatagattcaaaactcatntattattattaattagatatttttagaggtttataagcaattaattgattttttcaaacctttttttgatttttaaaatgagtttcaaaaaatccaggtccaggcctggatccaggtcccgaggagcctggatttttcctggacctggattttcttggatttttgtccaggaaatccaggtcaaacatggagtccaggtccaggcatttttcaaaatgtcgagctctatttcttatttatttatttttaactattcgggataaatttattgtagagtgcagcgggaccgggaaatttgggcaagaccgggactttttggctgggaaaaccgggaaaaaagccgggaatttcccggtcccggtcaaaactggtcaaaaccgggaccttggtactcagttgtccgtgttcaggtcccggtcctgctgcactctaatttattgtaaattatttattttcgttattttttattttattttagcctattataaatttttctttaacattttggctttaggtaacagtgaaaaggactccgattcggttaataatggccaaagaaaagttgcgaaagccaatcgaaatttgaatttgcggcgtttcaacccgacgagcaatttggtgagacacatccgatcagtgaatgtgcatttggaaaggacaaatgtacgaaagagtgcctttcaatttgtttttccagtttaattttctcatttttagacggacgtcgaagtccaaactttgccgaaaatcgtcagaaaacctgcggagaccacaattgtcgacggaaaacaagtttcttccattggcgcatttttatttgttttttgcttttttcggtcgttgaaaatttgccatcggaactttcgacactcaaaaagagtgtgccggagaatcgcgttgcgctggtgatgccgcgcgagtgttcagtccgttgtggagagatgcaattgcgacgaaggcgggggacgcaaatgtccaagacgaggccaaatgagggcaaagtttgcgaattgaccagcgaagaggtggcggcaataggggggggggcgaatggcaaaaattagcaaaatgccattggcacagattgaaatcatcgaacgcattccgtcagcaatgcccgtcgatttcaccacaaatcactgcgaggacca

SEQ ID NO: 8566 - DNA, 1516 bp, Heterodera glycines
catacagttgaggtctttaagaaagatgcattacgtccccaccccattcacaactcaaaaaaaaattaaaaattttttttttaaattcaactttctaattttgtagtaaaaaatacattaaaataaattcaaaagaattttagcaaaaaaaaaattttcttcgattttttataattattattaacttttcatttttcaaaataaaatctatttttacaagaaaaaaacactaagaaatttggtacggcaggctgagaggaaatgaattgcttctctccattaagaaagatttattggcgtgtttaaattatgtacatattagcaataaagagaagaaaacaaaattgtttcagcgtgttttggtcatccaactgctcgatcagatcggtgtgcaacagaaacatcggcctccattctgaatcgctttttttgtcgaatttttatggtaaaataaaatttttatttatttttaagtcctcattttttaaagtgtctcacccattctaattttaaagaccaacagataaaaaatgaatgccaaatgaaattgacaaatggttaatggttgttttttttatttaggtatttataaaatttcattgtaaaattatgtgaaaacagaaaatcaagatttaaaacattagttcttttaaaaatttaaaaaataaataaattaagaaaagataaatctaaatcttgtcataattaattcgacctcataagcattcatcagagatgaaggcttcgaattcaataataatacgcaatttatgccaaaaattttaaaaaacattccattttttattttccattcttaataaatttttcgaaatttgtttaaacatttaaaagagaaaattaaactctctaaaaaatttctgactatttaaaaaaaatgggtattatctgtagggatgggatttttaagggtgaaaaagtccaaaataaggccgtaaataagggcgaaaaattcgcgaaataatggcgaaaataaggtcgaaaaagtttcaaatttagaggtgaagttttcaaattgctgttttttacatgaaaataatttaaaattaaggcaaacaattttattcattgattgcagttacaaataaggtacatttcaaaattttcgggggtaaaacgcatgcgattatcagctaaaatggttttgtaaatggaaaaagatcgttccacgtcgcaagatgtcaatggagcaaatttgtaaaaagtgatgaggtttgggggtacatcagattcagtgtttttcccagacagaatctggcaaaattgggacatttttcaattccattgttcttggccacaatgtccgagaattttttgcgaatttcggttgccttttcgcctttacctcatgcacatgagttggcggttttaagaagaatccatggcggttttaagaaacgcccaatgtggcggtttttaagaaacgtcccagcaccatttaattatttaattattgtttaatgttgctttgcgtaaattattttttattaatttttgt

SEQ ID NO: 8567 - DNA, 2779 bp, Heterodera glycines
  misc_feature (75)..(75): n is a, c, g, or t
atgcggtgctttcagaaatattgcttttgttttgcttatcaatttgtccacttgcgcaaactcgtcacgactttnttcggccacgcggtgcaatgcgtgacacaaacatgtcacatgcaacaaattggtgtaaaaaacctgaaaaagagaaaagatttatttgaattttcttttttctaacttttaattgtcttccggcctttttcatgtacgcagccccgtccgtaaccaaaaacagcactcgctctttcttaatatcagcagaaaaactgtctaaaattaaaaaatatctaggaataaaagctaaacgactaccaaggccttcattaacaaaactcgctattgctccactgtccaccttttcaagcgctttcacagaaattaaatgcggggggggggggtgccattttttgccatccaatttgcctaacaacaaattggcgatcattcgccccattttatccgtagtctcgtccaccgaaatccagacaaatgcttcaccaatgtcttccttaatttttgtcattgtctaaaaatcaaaattgaaaaaattttttgaacaattttggaacctcagaaaaaagttggaccaaataattttttagaagagttgactggtctggcacggcgtgttgacaatacttttccaaaaaggaacacaaaactgcgttgttcagcttaaaaaatggtatgttagcagacacaagtgctttgcaaaggtcggcagaaaattggtcttgtttattttcttttgttgtcaaaaaaggctgatgctgaatgcttttctttttcgaaaatcgatccaaattcttgcgatgttttgccgtttcattgtgttgctttaaatcccagtattgcgaacatggaatctgtgaaaaatcgtcatgttgctgccgttgttattgcaagtcgtcgttgtctttacctgctgttcgcaaacttgacaaaaaattattttgccattgtcggtataaattgctccgccgccaatttttctgatccagtcacgaataaatgcagattttgattgaattttgggcattttagttagatatttcctttaaaagtatggattatttggtatatttgaagaaaattagtgaattttccttttgtaaattaaaaaaatcgcgaaataagggcgaaaataagggtgaaatgtcaaaataagggcaaaaacttattttaagggcgaacacccaaaataaggatttctaaggtcgaataagggcgttaaaacgcaaaatttttgaacaaaaaatgtgtttttcgtgcatttctcgtcgagttaaagccgcagaaaaaataaggaaaaacttaaaaatcccatccctagtaatgagtgctcttaataaattaagattgtattttcttagtatattaaaatatttttgaaaaataccaaagaaaacaaaaattatacgaaaatcttaatttttttttggttattatctgttaaaaaatagagcctaaatttcaaaattcgcccggcggcgcttatcggctccgccggccccaaaaaacttttttttttaaatagcccaaaagctctaaatttggtcattttttagacaaaatctgttaacaaatagcattaaaattacagaaacattttccgtcggcgcttatcgacgccgccgaacccccctgtcccccaaaaaaagttcttttaaaaacaaaaaaagtcgtcgacttgctataaaatcgcaaaatttggcagttttgtgagtttttaattaaattttcgaattactcccgctcccgcccgggactcccgttaaaattggacgggattttaacgggagcgggatttttacgggattcccgttcgggactcccgtcccggaaaattttcaactcccgatcccgctcccggaaattttttttttaccggtctctattataaacattagtatttgttattctaaattttaaaaatttcttcttgccattttttattttcttttttttgcaagttttcgtgtcataaataatctctattcaaaaaaccatcgatttagtatagttagattaattaaattttaagttttttaaatttaccctaattatgataattaattaattaaattctttaattctttaaattccaccttttcttcttacaattaatgattttttaatcaaattatgtcaattatagcagatgctgtatccaacggggggggggagtccgaatacaaatttacatatatccatctgatgagggtttatttatctctgcagatggggattttttttgaggatttttaaggctgtccaattaagtccatcacaatataccgtatttattcgattagagccccgggggctctattttatttatttatttgccttttcaatttgatattttgccaacttcattacatatgtgcataatttgttgggctcaaaatgatgacaatcggtggattggatcggccgatcagcagcagtccctttttcactggcgattggttcatttgttggtggtccgtcgtggacttggccaaatcatcagaaccaatttgcttttgctatcccttttttttcttttttttgtgccacgtatccatttgtgataattaccaccaccaacatttgcttggctctagctatcaatctgttcattcattcccatttaattgggatgggtgaagcaaatgagttggggttggccattagctaaaattatttttactaaaataattagaagccctccccttgaaatataagctaagccccctattggggggggggggggggggggggaaaaagaaaa

SEQ ID NO: 8568 - DNA, 2452 bp, Heterodera glycines
tcgtttcggcgccagcccaagtttttgggctataacttttttcttgtaatccaaatccaacaatcttggtatcattcgaaagcttaacatgtttagaagctgattctaagctatcgcttctcgattcgacaattaccaaaaaagttctaaattgaaaattgcaaaaaagtcgaaatttttgaagttttttctttataactttttttacaggctagaaaatctttttgctttttgtaaggctaacagagcatgtgaagggctttctaatgataccaagttgttggatttggttgataaagaaaaaagttatagtccaagaacttgggctggcgccaaaacgtcggcgccgaaacgacctagtccccccctgaatgagaagctccccaaacagaagcctcggggcttacattttagaaaataaaaaatattaacaaattttcaagggttgcccactaacaaacgagcagccttttaactttcttatcagttcattgttttcattgccactttccccccgtgtttttgctgtgtccacacatttttgccaccgctcccgcacattttgctcttcttatgttggcatttttttaaataaattaaatgttttacacatttttttcaaatacagcctcacccgtccgtgtacaaactaaataatcaaactacctaattagtatcataaaatgttgccccgttttgtgtgcccattcattgtgatgtttttgctgatggctctgttcgacaacagttggaagtgcagtgccgacctgcctcctggtccttttgaagataaaacaactgtgcgtccgaccgtgaagtagactgccaagtcgggtgccattggtggtgtgcgggtgggccagcagttgttgcttttgcccatgccgttgttcatcgcgctgtcgctggcgggtaattgtaaaaaccgtatcatattttctctattaaagcacccttccccctcagaagggttcaaaaattaaagcccctgtgggctttattagaggctaattacgataattttattaaccatactaattcaatgtgtatgtcacgcagtttatgctgttttttgactaaaggaagaaagaaagggagggaagttggggtgaaaggaaggaagcgagagaatttaatgaaaagagagagagaaagagggagaaaagagagaaacagggagagagtagagaaagagagaatggtagagcgaagagatgtttagtaaattatgacatagagacaaaagaaagagacaggaagagaaaaggagacaaagaggagagaaacgagacttggatgaaaaacgtatttattaattaaactagggttgcaaccccgaccccgccccgaccccgaaccccgacatttttggccattttcggggaaaaccccgaccccgacgcttcataccccgacaaccccgaaccttaaccccgatcggggtcggggttaaatatacacccctaagaatggcattttcgtgggagaaaatgcaaaaaagttagacgaaatttgaatttttttaaccatttgccaaatttttattaaataaagaagatttgctcaattttggacatttggaatgtggtgtagaggttagtgccattgagattactttctgtcgtgagttcgataccgtttgacgttttcttctttaattattttctttgtgacaaattgtttttttaaattaaatactcatagaaatcgaccaatcttggcatattttgacaaaatacatatcgaagaaaaacaaaaatttaccgaaattcataaatttttttggtgaaaaatcttagaaaatagagcttaattccaaaatttagcactgcctatcggcatcacagggcccaaaaagtcataaaccttattaaaaaaattggctcaaaatcgcaaaaatttagcatattttggacaaaatctgttaacagatctaaccaaattttcaaaattttcccggcggcgcctattggcaccgccggacgccgtaccctttctccttaagtctttagaaaagagcgacgtgaaaaaagatgttttggaaaacaaaaaggtaataaaaaattttaaaatttcaagaaaaaaaaattaattctatacaaaatttctgataaaaaagaaataaaaaaatataaaaacaatagcaaagtgtagagagtgaggagagagaaataattagagaaacagcagcaaagagagagaaagggaaacagagagagagactgtgggagtgaatgattcaagagaaaaatgagagaaagaaagagagttggagagagaaagaaaaaaggagcgagagagagaaagagaaaagaggagagagagaaaaaagttgagagataaaagaggtgagagagaaaaggaaaagaagagagaaagggagagataaagagaaaaagagaaagagaaataaacgaggagttgagagatagagagaaaaggagagagagag

SEQ ID NO: 8569 - DNA, 5375 bp, Heterodera glycines
gcgctgacaaatgagcacgaatatgaaatccatttttgactttgtttcgaaccccaaaccctgattcgaacaattttttaatttatttttttacttaaaaataaattattttttaaaaatcatctaaataaaagtcttccctgaggttttcaaggtcgctgatcacgaataaggtatccatttcgaaccccggaccagatttcgaacaaagtcgaaaatttaaatttttactttatgtatgttcgaatctacataaaatgacttatttttgccgctaaaattacatgtgatttattttctgctagttttaatcaattttagaataaaagtgcgaaatcgaaaaattgaattttcgactttttgttcgtattcgggtcctggttcgaaattggtcgaaatggatgtgatattcgtgctcagcgcatcaaataacccctaaaaattgtttttttttaaatttttattcttttttttctgggaccaataatcttcacaattgccccaaaaagtaccgattggtcaaccattgacaacttaataatccttaataacctcaccgtcatgatcaacaagccattccaaaacacgtcgaaatgtctccgcgtcaatgttttccatgtgaaaagtgaatttgcgggaacggccattggtccctttctttttgcttttgtgctcctcccaaatccgcttgaaatgtttgctctgttgcactaaaacaaaaaagccaactaacaattaattattcatttggtttaaaacaaacgtactcaaataccaatccaccaaatgcaattgtccctcggatgttttgcagttcacttttcgggcctaaattataaggatatcacatcctttcttatttccgattttctatggtttaattgcctttgctttttgcgcgtcattttacctgaattttgacgagtggtggcaatttttcgtcgtcggggtgttcaatttcgaccatcccagcggatccctccgcgtctctcgctccgtcgtcctccccattcattttgatttccatcgttcgcgaatttattgttcctttagcgattgtcttcacctaaaggaattcaattcgcttcgctgtatcggaggctttttgtattatttcacctgttttccatttgttagtttcgcttttagtgaattcgaactttgcggaacgatttcatcttccaatggcttaaaaatttaaattggcaattttgtcaaaaaggagcaatattttagtcgttttgtttattagtcaccccattcgctgacgaattgtcttcggtcacttttggcgtacagccacaaatcgcatcattttcctttcttaaattaacttcggagactgtcccaccacttttgccgtcctttgtttccgtccccaacaacccttttaacatcccaggagttgtcttgaccagactttttccaattagcgtagcagccgcccttttgtgttgtaaatctccatttttcgttgcattaagcaaaaaatcccgggcattaaccatctttaatttatccatcctgcaataaaaataaattattggagcggaaattgacgagataaaattggaaccataaaagaaaacccatgtttttcttggccaaaaaaatgaaaaataaggagacatttcgtcaataaagtttttttttgtttttcaaaagaaaaataaacaaacaattaacttaaagataggctttttcctttctggctttgttcaaaaacttattgttcttttctgttttctaagatggttgttggattaaatcgaaaagattcaagcgaaagtcaggagcccggtcttcatcctttccaggtcttcttaatttaccaaaaacaaaagaagtggtaaagttcgtcccaaaattaatctcttccgttcttcactttccattcatgacttttcctcattaagtatgtccaggccggtttctttacgggtgtcgccacaagggcgattatacaaccattcgatgtgctcaaaatccgactacaggtggacttacacacacaatggctattgcagttcacacgaccataaaataattaaacaacgttcatgcttcataactttttctagaagcatccaaattaaacattcttagtgtcctttgacagcgctaacaataagtgtcctattcaaaatctttgttttctaaacatttttggccataactttagaaacaaaacgaaatttgaaaaagttatggcacattaaatttgccaaattattttatggtcgtgtaaactgcaataaagcccaatcaatgataaatgccaaaatatcatttaatttagcttcaagaagaacctttacgtgggaaaagtcgtggaaaatacagtggaatttttcaatctgccaaattgatttaccacgaagagggaatcgcagcattttggttcctaaaaactgtaattcgaattcccgcattttttaaggcgtggtcatatcccagcgcaaggcctctcaattgtctatggcaagtttatttagaattttgtaagttggaatgtattagttattaaatttaaattatttttatctggagggtaaactctctgacttattgttagccttgtggtgggacgacacccccccccaaccttcaaaaatctttttatggtcgattttttggtcttttctctttgctgattgtctcccattctttcggtctggtacagttttgcactttcgagctgctcaccaaacaggccggcgacttcggctttcacaatttctcaaaatcagtcgattttgtctgcggtgcctctgccggctgtgagttattttggcattttcgccgttcatttggaaaatggcgctcttttgaggtttggccaccacttgtgcaatgccttttgatgtcgttagaacgcgaatggtggcacaaggcgcccatcggacctaccgtaacatggcacacgcattcatcaaaacgtggcgttatgaagggccggcggggtatttccgcgggttggtcccttccctcgtgcaaattgcgccattcaccggtctgtcatgcccattcggaattcaaaggaatatttcaaaaatgcaggtctccaattcacattctacaacttggtcaatgtgtactgggacagcatttggcagggcgacagggaatccgtcggacgaattgtgtcgggatgggtggcggggatggcggccaaaacgataacggtgtgactgcttcacatttaatgcaaagggtggtcaaaaaggacccaaagcaacaatcaattgagaagggtatcgaaacattctcccatatgggcccaaattaaatgcaagtggcgcgcaattaaggcgacaaaaccaccattctttttcaaaaaacattgactttctttgttaattttcttttgtcagtatccgttcgatttggttcggcacagactgcaggtgaaccggcacattcgcaaggacacattcggccagaccacttccgacgggggcatgctgcgcacgtttgtgggcattgtcaaaagagaaaccgtctttggtaacacatttttttgtttaaaaagaaccccttttcccaacgcaaatcgaattgtcaagacctctaattagaaaaatacggagaggcgatcagagagtccttttttgcgatataaaaaaagttgctctaattttcaaattattttaaataatcttttgggggtaaggttttctcagagtgtattccttttttattttctaaactctttgaattcacataatttaggtctgttcaaaggtttgtcccccgcggtgctaaaggcagctgtccaatcgtcgttgtcattctttttttacgaattgatctgcgactttttgcgtactgttgcttgatcttcttgttaattatttattcattagctcaattttcatttttttaaatctattgttgctcttattcggttgtacattcaaaataactattttcatagtaattatttgcatcgtttggctttaataagtactggtagatatagaaagggagctaccatagttaaaattaaaaattcaccaattttccccctccccatctaaaaaatgcaactcggagacccctaatcatttattttaaataatatacgcgaaaaatggcacataatttgtcggcatgacaatgtttggtttttgactgcttaatcaattgtctttttgtgtctgtttttgcattctctccgttccttcgtttcaatttttgtccaaaaacaaacggacaattcgttctctcacttccattcgttcacacccttccgctgaacatttgtaacccatcggacaacacttttggctttccttgcagcaaattccctaagtttgatggatttgtctttttttttcgttttttgtctgtcgaactttgctcaacggacaacagccgaaggtcgtcgtttgttcgccttcatttgtcgggagggagtgggcacagcaaatgtccgtcgatgaaccacagaaagtgccgtcggggcattccgttggcatttttgtgccgtggaaacgctaaaatattaatttgcaattttattacattaagttttgccagtttttgtactctttttgttgcatggtgcgtcgggaacatttgggtggaaagggaaatgccattctgttcactcacacaccgttcctcctcccgcgcacatccgaaatcaattcattaaaaagatttggtggtaattagtcgggtcattacgcaaatcccgcggggcaacaatgggccgagtgggcgcagcattggccgtcctcaaaggggcagcagccaatcttttttctgttctctccgtctctgtggcgacagctgaaccaaacaaagggtgtggtcatcaatgagccgcttcttcctttgccaattccgaccatttttcgttccgttcgcagatggaaattcgctggcgatgggcggcgctgagcgatccgatggaatcgccgcaaatgcgtgccgggggcgccgtttcctgcgccgacttaaaatgggcaactttggcggcagggacctttttcatcggttcacttctgtgcactttctagacaatgataaatgagtttctgttcgctttttccttgggttccttctctgtcccctctttttttttggcattttcccatttcccaccgcgccttcgcactcgccccccctcgcgttgcattgcgtcccgtggggacagcagtggacgtggtccgcgcaacaaacggcccgttcagctgggcagcagccgtaggatatcgaaaacggatgaaaaaaggatgccaatgagtgagcttcttacgctttgctgagcgttagtttcgagtcgccaaaagtcttttcgacggcgtccgaatccgtcgccgagcggacaacacgtgggcacggggaggacacttcgaacttccgtc

SEQ ID NO: 8570 - DNA, 5140 bp, Heterodera glycines
cagcagaatgctgttgcacagcagctgggttcttttcactgtatgcccctcccacccgccgctgccctcgtagaaagacagtcagacagtgcactatttcccacctttccctccctctactttttttcaaattcatttttaacgcaaaattcaaacaaaacgccacaccaattcaaaccacggacacatacacacagacactcaactttaatatataggatttcccgtttccagcatcactacagaattgaccgattgtgtcatagtgaaaacaaattctcgtcagcagctactccacttcacaatccgttctttttctccctttgccctttcaattccaatttgtcatatttttgaaccatttttagcaaatgggtctttgtaagtgcccaaaaaggaaggtcacgaatttgttttgcttcgaacatcgcgtaaatgtgtgcgaattttgtctgctttcgaatcacgaatcggtgctcttttttattctttcttttttgcttaatgctcttttagtgtgtcgttcaaacgtacctttcttggcttaccgacagtgattatgatgccaattgtttgctctgtttcggcatgtttttgttttttatttttttagctttgaatttcagaatcgcttagctccaaagagacattgaggttgaggtgtcttcatttattccactgggactgctttgattcgcgggctcgtcagttgccccaaacgacggctcccgccggtaaattttgctgtgaatggattgatttgactttatttaatcccctctttcaggttacaaatgtccgagttgtttggtttgtatcattttgtatcaattgcagtttgtacgaccataaaattaaataacattgtgcttcctaaagttatgaagagttaaaattgttattttattttatgatcagataactgtaatagagccccatttagacatttcatttaacttttttttctgtttcaggaatgcattttcccatccgaaaaccaatcgtcaccagttgttgacaaactcagggccaaacttcagacagtcaattggggtcgctttggtcttggccttcccagtgtttgtttgatataacatacctattttaattagttatttaacacttacattctaatagagtttaaatttaactgaaattcaaatattattttagtttttccttttgtttttagatccccgaaaatgagcaaaaagttttggctgccaaagtcattgaaatcgcttcgaattctaatcaccgaagcgatgaaaatgtcagcaatcgtcacattgaagctcacacacagtcgccaatgatcgccaattctattacttgccatgaagatccattcgaagcgaacactttcactggtaatcattttgccagaaatgaaaatgattttttatttttagcgaggtccaaatttcccacgaattcaaatggcaattcttcgaacagaatttttatcggtaatgaggacgactcaaaatatgcgaaggctgctgcggcagaaaaaaatattcggtcagtttttttaaattgaaaatccgcattaaaatagcgaatgtgcacgttgcacaaattgaatgcctaaatttgctcaattttcgttgtttttaacagtgttttctcttaggaatcgcttcgttcggcttccccgtcctctcaaacgtgtgttctttgccttactcgtcatcgctttcctttacttcttcctcggcttgtttctcaccggcaatgactcgtctcgtggtgctggcgatgatgaccctttgttcgacccccgcgccaatccgaacataaaagtggccaaagaacggtgataaaacatacgagacaataatttattaatgggacactttttggtgaatcgactgttcaatatttattatatatgaaaccaattatccttttgcttggacgtggggaacggatttgatccttttttaattgtgattttgccgtaatattttttgattagaaataaagagattgtgagtagattttatcatgaataaaatcaattaaaattaaataaatacaaatttttacaacaatattttatcactgtaaattcactgctctgaacccggacttaaacccaaatagaagaccaatggttaaagccggatctgggattcgtaattataccaaatggagaccccaaaaatagcccatttaattttacatttttttagacataaaacccttttttctatgtccgcccctctctctgtctttctctttgtcccgccaccgtcgcgcaccaccgcgtggccatcacttggaatgattgtccgatttcattttcaatttgctctccgtccaatgccacaaatcctcccatttccggcgctggttgaattcgacacgctttcacaggcattacctttagggtgggttatttataagtaaaaactaagatgagagaacctcaaaggccgggtcttccaaatgagcagaggaatttatactaaaattgacataaaaacaataataaattttgaaaaaataccttaacaaaattcgggccatgtgtgctcgggaacggagattcttccaacgaacaaacgaaaggtaaagcaccgcttcttgaggtcgggcggagggaacaaagggaatgtcggagcccaaatgagagagggcggagaggaggacgaagcagaactcgcctggagggaggcaattagcaatcagagcagaagctacccaagacgaagaattaccgtcaattgtgagccaatgggacggaattggctcgttcagaggcggcatctgccaattaattggactattcgtccgttctgtttatctatgccatgtaatagtggttaatagtggcacacctgctcctcctcctcctcccctccggcatcttccttcccctcgtcttcaaaatgtccgtcaccaaatgcgcccctctgcacacccacgccaaatctcaacttccgctccaattcgcagagttcagggccatcactgatcggcaaataggacaaacgggcgcgataaaaggcaactgaggggagttgggcaattcggagaaaagcctcgaggtgaagacgaagcattcccttggggaagaggcgattaagcgacaaagaaagaaataaagagagggaattaacgacacaccaaacgacggaaccgttcactgcccaaatctgaaaaatgggctgacaattcccaaacactgtgaaaacatgccaatgtcagccaaaagtccccagctgatcgaaagaaacatcattttgcttcggttttgagagaattcggcacggtaaagtctgaggcgacggaaggacggacggagtgccatcaaagccatttgagagcaaaaagtgccacggggagggaacggttcgctgaatgaatgggcaaactgacaacagaatggaggagaagccgaacttggccataaaagcgactgaagcggccaaagaattgccagtgcccatgggaagatgaagcaaagggaggcgaattgcccggcgaaagtccgcatgatggaaaagtccgttgatcgcttcgcaaatgaggccatccccactgagagaagaaactttcttcaaaagtgatgttgggttgtcaatgattaccctcccaatgccaacattccaatgccgtccaagtccaactcggcggccaatcgtattgcatgttcaggtccctctaaaacattttgaaaaatcaaagtgtgtgccgcaatgtttgggcctatttatatgatgacagatcaactgaaaagctccgctctaatcgaaaattgaattcattcggattgaccggtttctctgagttcgtaggaaatgcccgcctctctccacaacggctccacttcggtcctccaaaggtgcaaagcgcgcttctgtccgctgaacggattgagaaggacgagcacacggagagaaagcgaagaagggacggagaaagaggagggagaatgggctaaaagagagaaaaaggggaaaaggaaaggggagggaaagggacggacgaggagagtccaaagaaaaagaatgacgaagccaaagggcaagggaacgctgcagggggacgagctgagagggatggtcggggagcagagcgaagcgtaccaaacgacgttggcacgagggccaaatgaggggacagacggagagcagcaaatggggcgaagacggagcaaaggcagggaaatctgaaaaagcggaaaagggggacacggggagttcaaaaggtatttgggggaggggggggggaagttcaaagcttaaccaattgaaatgtaagcatttgtcttaatttgatttgtaatgatgatcctgtaacactttgaaattcatataaaaagtgtcactttttatgaatcacttcccaattcatcatctctaatcattttctgaccttcttcctccgctctttgcgattggtgtggcactgtccgaactgaaacaatgtcatcggaaaagagacagaaggaacggtcggaattggaggcgattggagttggggggcgatcagcagcaacggcagtggggggccatttgaagggaatgggcgacggagagaagcaaaacgaaggacagcaaaagcgagggttttggagggggaaaagtttggcagaaaatgaggacggagacgtaggaagagaagacattttgaggaaaaaaggcgaggggaaagagaggaaaatgaaagattaaaaaaagaagaaatacctatttaataaagaaaaaaacaaaactttattttatttttggtacatttaattaacaaatgatcagtttgaattttaattgctcagattacgaaatacaaaatgaacagaacgaacatcaattgaaattacagggaaaaatgagaggagaacacgaaaagaggggagggggaaagggaaaggggagtgaacaaataaataatcagacggaatgtgatggatggtgactaaagtaaggaattatcgacagatatgcaacaaacaaaattcagcagatgatggacaaaaaaacgaataaattgggaggcggcgattaacacattttggggatgaaattgaaaaagaaaaaccgaattttggtaagggttatttgtctggaaaaggtcaatcttttgacattgtttaaaaaaattccaaccaattttttgaaattcccccgct

SEQ ID NO: 8571 - DNA, 1583 bp, Heterodera glycines
cccccccccccttaaaagcttctctctccccccttatacttccattcctctcggccctgtggccttcgccagttcttccactgccctccgctgtctccgcaacttccgcgtctcttccattgcgctgttcggtcggatgtacgtcgaaagtggcaccgattggcctcgcattggcacattttgctgcttcgctttgtccggcagtgaaagagtgcgcttccttttcagctgtccgatgcgaatgtccgaatccgctcgataagtgctttgggggactggctttgctcggaacggttccctcctcctctccgcctcctcctttcgcctccgctcctccaacatcgcctccaaatgccttttagcgaatcggcatggcaccggtgacctttttattaattcaaaatgccattttatgcattttcaacacttcacctggaagcgagtcgaaatggtttcggaatggtcgtcgaatgaccgacttggaaatgcccctttagtggactttgtgttgggtgccgtattttgcgagcagactcaggtggagttgggggcagacttttgctaatggcagcaataatttgcatggccgtgtcgagagtgcgtctcgcctctgtgtcgagagtgcgtctcgcttctgtgtcgagagtgcgtctcgcttctgtgtcgagagtgcgtctcgcttctgtgtcgagagtgcgtctcgcctctgtgtcgagagtgcgtctcgcttctgtgtcgaaagttcgtctcgcttctgtgtcgagagtgcgtctcgcctctgtgtcgagagtgcgtctcgcttctgtgtcgaaagttcgtctcggcttctgttgaccgtgccattgtcccttttctccctttgctgttctcatcggttcctccgtttgtctggttataaatgtcatcgttttgttctgctcgtgccgttcttttcgacttcgttctgtcaatttctcttccagcaaatgacccaattcaatgcaatcgctgcgcaaccgatccaatcgaaaaagaaacggacgacaaacgatggacacttccattgattgtgagccgaggagagcatttggccaaacgacggcacccgcggcaatttaatggcccacgcggaaagattttttgtttgttttgttgccatagaaacgacgacagaagttatttatttagataagtaatatgttttctattgtttgttttctcatttaaacttttcgaccaattgccgcaacccgaagaaataaagcattttcaaagtgattttggagttacccttctttctctgtcgcctctctccgatcaactaatctctctctctctctcactctcactctctctctctcactcactctctctctctctctctctctctctcactcactctctctctctctctcactctctcactctcactctctctctcactcactctctctctctctctcactcactctctctctctctctcactctctcactctctctctctctcactctcactcttcctctctctctaccctaacttttgctttcactccacgcgctgcggtcaatcattgcctccgagaacgagggcttttgcgtcgc

SEQ ID NO: 8572 - DNA, 948 bp, Heterodera glycines
cggtaaagcgaccgaatgaatttacgagaaaaaaaaatgcaaaaacacttttttgttcagcagtttttttcgaggaaggaaaatacgacgaatgcatcgaaatgtgtggaaaagcggtggaagttggacgagagaatcgggcggactatgcgctggtggcaaagtgcgtaatctttataaataattgctgatgggggttaaggcgggtaataattgcctttctggccccataaaaaggccgattttgagtagttagttttttttagggcgctgatcacaaatctgacaaccatttaaaagcttaggaatttgcctgtgtgttaaagcctttgttatttttcgcttttaagggcttacgctcgaatggcaaacagttacaaaatgaaggacgaccccaagaaggcactgcacttctacgaaaaggcattgtcggaacatcgcgacccggacattgtgaagaagcacaaggaattagcgaaggaagtcaaagagatggagcagaaggcatacattgacccggaattgtcggataaagaaaagaacttgggcaaccaattgttcaagaaaggcaagcaatgggagaagggacgaaaacattgggaaggaaaccaatccgaaattgggaatggcaaatcaatggacaatttggcgttgtgtctttaccatttcatcccttttaaatttttgaggcgattaccccggggctatgagacattacaacgaggcgattaaacggaatccggacaacgctgtgctctactcgaaccgtgccgcgtgcttcaccaaacttatggaattccaaagggccgtcgacgactgcgacctttgcctgaagaaggacccttctttcggttcgcttttccgttttcctttcgttgtgcgatttcctcccgtcattcagttaaggcgtacatcagaaagggcgctgctttgtccgcaatgcgcgag

SEQ ID NO: 8573 - DNA, 4878 bp, Heterodera glycines
  misc_feature (3647)..(3647): n is a, c, g, or t
cagcgcactccaaatgcccgtctcgcggacgccgtacgggaggactttggacacgtaaatgggcatataagtggtcatgaacacaatagtgacgatatcagcaaaggaattgagccaaacgacgagcacaactttgttttggagaatggcactgagaggaaagaggaggaaaaggcgagactgacaatgagcagccactattttggaaaatgtgagccattttcattaataattttgctgatttttcaaatattgctctgttattggcacttttcttggccaaaagcgaggtctaaggaattagcacattaaaatattgtagtttgccatgggacgggcattagaaataaatgccaaaaaatagtttaatttctcaccagtacggcacttttccgctgattgctctttcggccgaactttttccttccgaaatggccgctttttccctccgtccgacgcatttgtgtgtttcgggaaagtccgtgtagagaaaaagccaaaggccaaaaaggaaaggggcgaccatcgcatggccaaaataaaccgaaggccaaccaaaggacggggaagagctgagctgagaccgaaagcaattgaaagataaagagatatcgcacggaaaagcaaaaacgtacaaatccggccacggtatttgtgagagtttgggaaagaggcgtaaaactggtcatacaagagctgaaaaggggcagcaaagagtgaatttgctgtttcatttatacagaaacagtccgtgctggcggagattggcccaccgatggcaaatgaaaccaatggccgcgaaatttgcgccgtaagcaaatccctaaggcaagaaaaagaaatgggagtaaaaagtgggttatggggggaggtgacttggacgaagcggacgaggagaaaggcggtcatgccgcgggcggcagccaacggcaaaagtgcggtggccacggcactggcgacgccggcgccgaagaacacgaaacgagcgccgaagcgcgtgtacagggcactgaacggaaaagtgctgacgatgctggccgcgccgacagcgtaaagcagcgccgacttttcccgcgacgaatagggcaccgtcggaggcaccacgtggctgctgttcagcacgagcccgggcagcacgtcctcctgacaacagagtggaggttgatcagaccgatggcaaatttgggatatcatatcagaaagaggtggcattttttccttttttggcactgaccgatcattggctctgatcagtctcatttttcatacgatttctcatgttttactgatcaatcttttccactttcaaggctgatcagtcttttgtgttcatttttcaatttttttgatcagtttgtttccccgtttgatcactccaaccactaattaccttcaaatgcacgtcactttccttcagcaaaatggacgaattcttgggaaaggacgcgttctcccaattggtccttctcatcacaatttgggtgaaattaaatgcgatcatattggacgaaattgacgtaagacaaagtgcagcaattgtcagaatgccatatctgaacatcccatcccggcaacagcacactctagtcgaactttcgttgtcattttcagctttttcccgccttcttccgccaattgagtgaatgccatcaacggaaaatgccatcttaatatttttcaggcttattaaaaggaaattttcaatttaatttgtgaaaaggcgcaattttgggaatcgatttcatatgaatgaatggaaaagaaacaaaaaaaagaaaacgaacaaattgagaataaatgcatttttattagtaatatgaatctgtgcaaacttttctctcattttaatcaaaaaattaaaggaaaaacaaatcatttttattattatttattttctaaaattgtaaaaggcattaatgtaaatattaatatttttaatttcagatgaacaattagaaatagttttaataaaacctaaacaaaacaaagtgaaaatcgattagaaaagaagtgcgacagcaaatgatcactgatcagattaattaccacaaattctctttttttgttctgttttccttcccgattttttttcctcggcttacagtatcatataaatgtattgacacgagacggaaatacaggaaagattgagttgaaaaaagaaagtaaaattaagaaaaattagcgaaataaatctaaaaggggaaataattaaaaaagtatatattttttctatttataaattcattcactttgttactaaaggcatattcataaatttatttggcccttttcacacgcccccaattgcctgagggggcattactcaaatttggccaccccgtgccctcctccgccgatcccttgggattttgccagtcgaatacttttgccgaatttgcccattccgccggtggcatttgtcaaattttgaatgttttgttcatttcgttttagtaaatgattttgagacttttccaatgcgttttattctcattttgctcaattgttttgcagaacattgcagaaaaagtaaggcatttctgcaatgtctttaagtaatttgaattttaatgcaggcggaccctttgaaattgcggccaaaaagagagggccaaagccaaatgatacgacgaaaatctccggccgacccgtgtctattgaaatgcaaagacgattatgtgagtgatcggcgggggggggaaacattttgccacgaatgagccaccaaatcactgacaaattggcacaatatgcagatgatgtccgccgaactgtcgccccatcggacccaaaattggcgcttggacagtgcaattgggtcaccgctacacggattggtagaaaaatattggccaaagattaattgccgtcctcgacacaattaacgtttaacaggtcgaagcggccagcgatgctaatgccatccatcggattgactacgaatgcaggcaccgttctgcccatttgacatcatttccaattaccgtaccctcaatgtcagttaccacgccaatttcgtcgcctgtctcgagcagtgcggcacttcgccagcggcccaaattttggtggaaggccaagaaacattgaaaacagtgacaatttgctaatttgaccttgattaacgtgaaatttggaaaggtgtgccaaagtttcaaaggcgagaaggaattcgtcggttttattttgccgtgtttggcgcgcaatgggccaaaaattgggaagagctgtcaggtgaaggctaattaagcaaaagaggggacaaattcacaaagtgtgcccaacaaaaaacagcttcactggtctctgctggagaaggacatttttgaggcattacaaagcaaaacagagcaaaacgaagaagagcaaaagcatttggaggagggcatcgggcgaatttgcaggtaattggccaatcaccggcatggcaaaacatactttatgggaaaagtgaaaaacaaacagggaccgggattagacaatgggtcgggtcatttcagaaaattaagattagaaatcctggttatttaattaattaactaattgatttacgactattagggcgatgaacagttacacggactgccatctcagaacagtggcgcaactttgccataggcgcactctttctttttttgtccaattanactcgaagagttcggcgtaagtttcgcttcccatttggcactcttttgcctttcagtgcgttgctccgtcttttgctccgctgggccgagttcgactcgcattccatgcccaaccaatggcccgattgtgcccaatgagatttggatgccattctgaggaatgatggcaaaacttgtcgttagtcaatccaccgattttggcattgtgtttctcattgttaattcacactcatttttttgaatgatgtcattttctgaacctctcctcttcaatttcatctgaaatttctttgctttttctgctgccaattgcgcattcgatggcgaaaatcagcagagcggtgccactgctaatgccacacattgccaacagtccgaacatcggcacaaacccttaaaatttgtttttttcggctctaaagagtgaaaagggcaccaccgacccaagggcttgtagagatgactcttcgccatcttctcttcacattcctgattccggatcatctcgcgcagcattcggtaacggtcgtaagagcgccgaatggccactttttcactttcgattacctccaaagagagtgcgtttgttttttgccaatgttacccttcaaacacttcccaaaatcactttgttgaaaagtgccgtgaagggactgccccggcggaaaagcaaatgggcggttcggtaaggcatttcgcggtcgacgaacacaatgtcgcaggaatgggcggccagaaaataggccgggtcatcgccctgcacgagcatcacattgccaaacttctcaatctgtgcaaaatgcatttatggcaattagagaggggattcgagagggagtctcgaccagctgcagcgactcttgaatcgaatgtgcctgcaaaagtttcttttgtgccccgccttcgcgcatttctttgaatgggaaagtcgtggatttgttcaaactctcataaaacctaaaatgtttttcgcaattttggctaattcaatcgttggaccaatggcctctgtattgggacacaaaagtgtatttgccctgctgaacgtccttcacaaaggatgaagcatctctgatgggaatggccggctttggctgtaccagcgaagtgacaatccaagaacggtacagcgaagtgaagcacacgcaatgcacgaagctgaacagaaacaacgcgaatttgcctatgaaaaggaggggagggggggggggggggaattagcaaaggcaaa

SEQ ID NO: 8574 - DNA, 1300 bp, Heterodera glycines
  misc_feature (30)..(30): n is a, c, g, or t
aatgacaaaacaatggcaatggcattgaantttgattggcaattgcaaaggcaaaacaatgacaatgtggcaattgaaatttgaattggcaatgacaaaacaatggcaatggcatttgaaatttgaattggcattgcaaaggcaaaacaatggcatttgaaatttgaattggcaattgcaaaggcaaaacaatggcaatggcatttgaaatttgaattggcaatgacagtgattcaaacagacacaaattattacccgaaacggtggccaaacggaccgattttggctgcagcaattgaaggcgaagaaggcgccaaaggatctttgaataaataaattaacattcattacaaattgactgatatttaatttcttaattacatagaacgctattaattaattattattttaattaattaaaagacactaattaataacattgtgaaatattggcatttgtgcgacagtgcggcggttgaccaaaaattcgattttttcgatgaccatgaagacaaaactgtgcagggcaatgaacaagacgatggctaaccacgtgtcgacggagaacggatggaacagacgccaaatttcagccaacggaaaactgttgtggtcacggatggcaattcgggaaagagtctgacaaattaggggaaattgaaatcggaatttatggcgagattatgaaattatttccaagtcgaaacgcaccgaataaattggcagagaataatcaaagtcggccatccgcggcggcgacttctgataaaacaggcagcccgtgtccacagtgccttcacccgaaaatgtgaccaatgccaattgcccagagtgaaaggcttaccgttggcaatggcgccgagaacgccgtgccattgtccgtccgtcccctaaagggacaaatctaaaattcagccactaaaacggggggggggggaggggtgagatggggtcacttgccttactccccacgtcaatttccattttgtgatgactcagcacaatcggctcaacagacaaattcaatttggaagtggcaatgcgcagaaactaagcattaaaagtgtaatggttcataataatataattattttagaggcagcggattttgaccaataaaaaaacattaaaatgagcaaaaaaagcaccaaaattgaaaaagaaataattttttatttgaaaacatcgaattttgaagtgttccaaaattcttgtgcttaattaaaattttgtttcgttcataatgtattaattatcaaatgttcactcaattcactgactttttctgctaacaaattaa

SEQ ID NO: 8575 - DNA, 1556 bp, Heterodera glycines
  misc_feature (1469)..(1469): n is a, c, g, or t
ggtcgaagctgtgtgctcccagaaaagagatcaattaatgggtgaaatgagcgtaagccatggactagtcgaagctgtgtgctcctagttgtcaagcgaaaaaatggttggtaacgctgtgtgcttaaaatgactatgtgccaagggcttagtgccaaaaatgaattgtgaatttgaaggcataaagccattgtgtgattttttgttattgtttgtattatgtgatgcctaactggttaaatgttgaaccgtttttaatgccaaaattggttttactgaataaatgacaatgcataattcgatgaaattttaatggaaatgcagaaaataagctttgggagaagccaaaaaaaggaatgaatgtgtgaaaatcagagaaaaggcagaaaaaagatgtaattgaagtactttaattaaaattgaaaggatgatgtaattaaaaaaggaaaagtaaagggtcaaaaaaaaaagtgaatattttggaataaaaaaccttcgaaaaggtaaagcagcacattttgagaaaattgatgcaaagataaaattgataaaatgaaaagtaagaagtaagcgaatattttcttctatgaaatgaagattaaaaattaaaaaaccggagactgttttgaagaaaggaaaagcaaaatttgccattaacgtgaaagtgaaataacccgagatgggtgtcaagagaaaatgacataagtgaatgaagcaaatgggaagcttgttcaactgaacggcagtggatgatgatgttcatcaatgggtgaccatcaatgggcgcccgaaggctgatcagaacgatggacgtgatcagaagtgatgaggcaaaagccaggaggctttttttcgaggaggagagaaatgctgtatccgcagcattcaaaatttcatattttgtgcataatgtacattgccctactttctcccgaccaatcccgtcgtaaacttatccatctgttcatcccatcccaagccaatcctatccctctcatttccaatgttatcgtgccatttcttcctattcacctctgttgcatatgccatccatttctcttattcccttttgtgtttttccgtcattacccctcatcctatccaaaagtccatccccattgtgccagtatataagtccatccaatttccccctcgggggctgcgagatgtctgcggtgggtcagtctgtgccattccttgcctttggcaatcctttcccaaataaccaattgcactgacccacccaaaatgctctgaggttgttgttgacccaaacatattcccggttttcaattcataattatttgtcaatgcttttccttataataaattcctctctcctaaaacggtaatttgaaatggctgaagccttaaacccggggacacaacataatccctagcccgaactcgaataaaaatcgaaatttttaatttttcaaattaatgattttttgttcaatttagattangaaatcggaaatgatcaaaataattttttcgttcacatgttttaaaaaaaataaattattcataaatttataagtatgaaaatctat

SEQ ID NO: 8576 - DNA, 5264 bp, Heterodera glycines
cagttttaaattacggaacgggcaaaaacccagtcataagtgccgttcgtattcaaaaaaaattttcatttcccccccaaaatttggataagccacttttttctccggcccgatgcctaatatcaaaaaatagcccgaatgctgaattaaaattaaagttattaattttgaggaagcgtcgtcgattcgaaattcacgcgcattgacattcacgagttctggctgcagtctcacgttccgttgaaggtgattttgatggccttgaaatgacggaccgttcgttacgaatttattcgcttaattatgctttattacagggaaccaccaaaatccctcaatatgtcttcccggtgaaccaagtcatggccaataacaacgagttgcaaaggtggattaatatattgagaaaaatttacgatttctatgtaattggaaccaaaaaagggacaaaaacggtgccgaggggtgggggattccgatatcagcaacttgaacacaaaatcgtctccaatttctttaatttgttgctggtgtcatgctttttaattgattttccagttttctcctttcgctctgctgcaattggcaaattgtgacattggccccgggtttgccaacccccgtccgccaggctgccgaattggccaagcgcgggcgtgccaatttcaacgagctgaagcggtgagtctccctagccaatctaatcaattaacggtgataattaatccctccagcagtacgccaaaattcatcccgcgcgttgaggacaccgaccagattaattatactgtgctgaacaaccgcctctgttataacgggcatattttggcggacacgcgtttcaacgcttaagggttgatgagactgatcagtgagacggaacgggcggacgatcaaagggacggaaatgagaatcaaattcaattttggatgaaaatatttggaaaacacattcgtcatatttgtctgttctgttctttgccttaattcttcactttgctactttatcaattattgtttaaaaaataacaaaattaaaaaaatatatatggaaaatacacaaattcattaacctaattttttaaaaattaattttaaattcgttttcttcacaaaagcaaaagaagacacgaatggtcacattgtcaaaactagagtccggcgggggttttactggattcccgcccccgtaattttgacccaaatacgggagtaaaaatacactggtaagaattgtttttttttgttaaattaataattttttattgaaactctgtttatatatccaaaatttcaaaaaaaggtttcccgtcggcgcctatcggcaccaccgacccttataatccttaattctcttaaaaactggcttaaatttgcaaagattggtcatttttggacaaaatctgaacaatgtattgtgttcgaatattcaattgtttcccgggccgccctccctcctcctccctggtccctaaaaagttcttttcaaaaaatacgctgcaaagagttgttaaaattaataaagggagttgaaaaataatgttaataaattttttgttgaaataaattagagtgccagtttttttcatctgaaattctatacatacttaaatttcgataacaatagcagttcgtacaatacatttttttacaaaattaagcttatagcttgggccaaatctaacaagggaaccgtcagaactgtgtcagaaaatgcatgtatcataactatttgatagtgcagggccggctactctgaatttttaatgttagcggtgtgttgaagccgaatagaaaagttattggacctcaaaaatcaaaattttgactgtgttttccccttcagggaggtggtgaagtggggaaaattaaaaaaaaacggtggatcagtgggttaaattcctatttttcggaggtccaggttcgaacccaacatgaaaaaaatacattttaattaatgtgcaacaaagttaacgattaaaaaaaccattttttatttaaaaatatacataggtaataatttttctttagtgaaagtaaaccaaaagtcgactaaaaaagtgactgccccatggggcccaatcggcggggcccaaccggcggggcccaatcgacccccaccgggttttaggttctaaaaaagggaacgggtcgtttcggcgccgccgtttcggcgacgccgtttcggcgacagggtcgtttcggcgccaaaaaaaatttctgatttttaaggccctgcaacttttgaagcagacgaaatcccaagccaatcctatccctctcatttccaatgttatcgtgccatttcttcctattcacctctgttgcatatgccatccatttctcttattcccttttgtgtttttccgtcattacccctcatcctatccaaaagtccatccccattgtgccagtatataagtccatccaatttccccctcgggggctgcgagatgtctgcggtgggtcagtctgtgccattccttgcctttggcaatcctttcccaaataaccaattgcactgacccacccaaaatgctctgaggttgttgttgacccaaacatattcccggttttcaattcataattatttgtcaatgcttttccttataataaattcctctctcctaaaacggtaatttgaaatggctgaagccttaaacccggggacacaacataatccctagcccgaactcgaataaaaatcgaaatttttaatttttcaaattatgattttttgttcaaatttagattaggaaatcggaattgatcaaaataatttttcgtttcacatgttttaaaaaaattaaattattcataaatttattaagtatgaaattctatccattcttacaaaggcaataactcgtacaatagcagttcgtacaatacatttttttttacaaaattaagcttatagcttgggccaaatctaacaagggaaccgtcagaactgtgtcagaaaatgcatgtatcataactatttgatagtgcagggccggctactctgaatttttaatgttagcggtgtgttgaagccaaatagaaaagttattggacctcaaaaatcaaaattttcactgtgttttccccttcagggaaggtggtgaagtggggaaaattaaaaaaaacggtggatcagtgggttaaattcctatttttcggaggtccaggttcgaacccaacatgaaaaaaatacattttaattaatgtgcaacaaagttaacgattaaaaaaaccattttttattttaaaatatacataggtaataatttttctttagtgaaagtaaaccaaaagtcgactaaaaaagtgactgccccatggggcccaatcgtaccggggcccaatcggcggggcccaatcgacccccaccgacaagtgatggacggttttgatttttgtgttgccaatggcacagaaaggtcgttaattaacaatttattcataggcacattgaagaggaaagtcgaagtgacgagcagcaaaggcacgagaaaacggcggcgccgatgctaacgacggcaccagcgatggcggcggcacttccgtaagttagtggttcttgaaagaggagtaacgcgctaccgtttcccaccatagttaatcgtcgtttccctttttccaacggtagcagcgcgcgcattgttcggacgccacacattggcacaaatgcccgcgagaatggcaccgcctcattgtccgccatcactccaatcgctgccgcctttcgatggtgcactccgctggccaacacaccaactgtaaggtgcacttttgcatcttttttagcggagatggaggtcaatattttgaaataaaaattatttggctggcacaaattggggacaaaattttggaggttcaacagtaaatatttcgtggggtatttcacgaagggctaaaccaacgggatttagtcgtctcactttgcccttccgtacgccatgttttgtccatatttctgtccatgtcaatcctggtcatttcttcgtccaattgccctcccatccgacattttcgtcgcttgcgctgctcaaccaatatatgctcaccgtatacacgcacaatcagccgggcgttggggcaccaggcttggccaagccgtacgacggtaatttggacaaataatgttagggttcaagccaaacattgttcatcctgcctgtttcctttcagtcggcgtgctttgcgctgccccggcgtacaacggatggttccgcgccattactttggcatacgaccaggtggaaagcgttctccaatcaatcccattttaataatattttatcctgttcattgtcaggaccaggatgagatgttggtccgtttcgtcgattacggcggcttcgcccgtttgcctcgggcggatttgcgccaaattcggtcatttccccgggggtttttccagctaatgtcatcatctcttcccatttcagtactgactttgtgacccttcccctgcagggcatcgaatgctatttggccaatgtgcagccagctggtaattaattgtccctaattgccaattatttcttagggcattttacctttcctttccgttcagatggatctttgcattggagtgacaaggccaacgagttgttccagcagttgtgcgtgtccaaaatcattcaggcggcgctggtgggctattgcaaaacggacggaattccgtgcgttgagctttttgtgatggacagcgccaacaaaaaggtgggcatcagagggcaattgttgtttattgctcaacgaatgagtccgttactcctcaaaaatccaggggattctcgggcgaaaaccctggactctagcaaatccctagtgctaatggactgtgggtccgttccgttttccacggtgccaatgcctttttcatgccgtttcagactgtgcgcattgaccaaattctgttggagcgtggccttgccaaacagatggaactttaatgggtctttatgttcttgaaacggaattcatgataatttatttactttaaagtcactcctttggcctttccgatttttatttatttatttttctataaaacattgagtaaaataaatatattgtagaaatatttgttttatgccttttctggtgattcctatgtctcgcctcttcttggcctgtacgaaaaaataaaaatgggaagggataggacaatttttcaaaatcatttgacacaaaataataaaaaagtttatttttttcatttttcccttcaaaaggcatttcggtggataagcgaataaaatagggaa

SEQ ID NO: 8577 - DNA, 1397 bp, Heterodera glycines
  misc_feature (1315)..(1315): n is a, c, g, or t
  misc_feature (1367)..(1367): n is a, c, g, or t
cccccccccccttttttcgttaaaaatttttttcttctaaaaagtcgtgaaaacacacattttatggggttttaagggtcgctgatcacgaatatgacattcatttcaatcaatttcgaaccgctgacccgaattcgaacgaaaaaaaaaattcaaatttttcaattttccatttttagtctaagaatggtttaaatgaccttttagtgaagcactaatgatattcagtgcgttttcgtgtatttaaacaaagtttgaacaaaaatctgaaaaatcgaaaaattttgaattttcgacttaaaaaaacactgaaaattatacgaaaatttaagagttttcagaaaattttcaaattcttaataaaaacttgctttttgaaaaatatacattattttttagattctcttatgtaaaaaacaaataaatttagaaactaaacatttttaatttttacgtggctcagcccctatttttttttatattcgaatttaaattaaacacatttttaaatcatttttagccatgtggtgctgtgagacggtgatggaaatgacattggcattcaatcgttgtgttgagctgtcctcggcacgttgggctcgtctgcttttccagggcaaacgcatttacttgtggatgcttttcccgaccttatacggcttttactacttctggtacacccaaccgctgatttttagcggcattttcttctcatggttcttcaacccacatgttggatacattgacgattttggcaaaacggtgagtgccaatgtaactcaattttttttaattggcaaaacggtgagtgccaatgtgattaattggtaaaatcgtgaattttttttttttaattggcacaatagttgctaaaggaatatctatgtaatatatcaatttgtgaaataaacaaaaaatatattttttttttgatgggaagaatttattatttttttttagtattacgtaataaaatattaattaaaatttgttcatcaaatctgtatttgagaaaaaatatttaaatatattaaaaaaaatatttcaattatttaatccattagatagattaaattagaaaagtaaattcaaaattaaaatttacagttaaatttttgcctataaacttgaaaatatttttaatttttgttatttttcgaaagttgggaaaatataattaaagattataaaataaaaacattttaaaaattaaaaaacccaattattttgagaattaataattaatgtatttaaataaattatttcaattattatccattttttgattaaattagcaaataataaactaatttanaaatttatatagtaaattttttgcctgtttaataaatttaatttttattatnttttcaaaattaaaaaattcaattaaatat

SEQ ID NO: 8578 - DNA, 4205 bp, Heterodera glycines
tgatggtgctaggtcgtttcataaatccgccaaatcgttattttgtaaatccgcaaatgagcgttccataaatcagttttataaaccctccaaatgtgcgtttacaaatccgctaatttcattaaattagattgctatttaaatgtcttaaatggcttgttttccattgtaattttggcccaggaacgaacgaatgaactccaaaatgtgttagggccaaaccaaatttaaaaatgggagaatgaaaaacagagtgagtagaaatctgtaacttagaaacaaatttattttcattcatgtattcgtttttttctcaaggttgccaatttcctggagaccttagcctcacagtttagttttcgtttttccaaacaccaatgaggctaactaaattttcaaaataattattggagaaaatcctcaaaaatgatcctattttgttcgaaatcgtttgattacaaactctattaaaaatgattttttaatttaattttaattttttttaaaggcattcctccgatcatttatttggcactgaacaagacggtccgtcgtgatgtgtacatcatgatgatgaagccgttgtccaagctgttctactgctgtatcaaagcaccagctgatccgagcaccacccgtctgttcaatacggtcacagtccgtcgaatggcggctggcggcaaagtggtgccagcctcgtccaatgtgcacacagcgaaaatttcaaattcgaatatgaaatattagttttttttttttggcattgtgttagtggcataattcaaaaaaaatgcgagttaaaatctaagtgtgttgattttccaggattgtggtcattttaagttttgacattactgaagaacccaaaaagtgccgatttttatttaatgtattttttgagtcaaaatttttgggcttaaaaaattgccacatttatccttttactaattacgccgctggattagcaacttttcactaatgattttaatgattattcaccgttaattggatccaaaaaatctaacccaaccgtgcccaatgtgcacacagcgaaaatttcaaattccaatatgaaatattagattttgagtttggccattgctgaaaaccccccccaaaaagtgctgttttttaagattgtgccattttttttagtgttggactaatattttaaagtatccttttcagcaaatctcattaaaaattacaaaaaaaatttcgacagcgcccgtctgcactgccgaatcccaaaaactcctcgaattgttttcaaattttgcaggaaaaaactttataattaaaaaaaaaaattaaatttgagagccagttaaagttgaattaatttaaacagttttatgcctttaaaaattcgaaatttcaaaaatcaaaaaaatggaatgcactttttgggtcaaaatttttggttttaaaaaaatttaccaaactcacccatttactaattacgtccctggattagcaacttttcactaatgatttttcatgttcattctccgttaattgatcccaaaaatcttacaatgttgttaatgagaatatgtttgaattttatgtataattgcttcgtcagcacatatccagtcaatccctgtttttatcttaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttcatttttcttgtgaaaatttccaaaaaatggccaaaatatggactaaaaaccttcaccaaatcaaaaaattttaacgcagaaatgctatttttaagcccctttcttcatagcatatgcgcagaaaaaatatgttaatccatataatttacaaccctaatgataaaacagcgatcggaccggtcggtttttttcggtttttaacctaaaccgttcgaccgagaaatttttgattgataaactaaaatttaaaaaaattttaatatctgggctaaagcggggaatacgaattaaatcgtcggagtttatagggattgaagtcaataatattttatttttagggccacaaccatttaattaattgatcattaattaccctatttcttctattatagcccctccctccattagaaccccctctgcatttcccttttaatataggggatgaaatggagaacacgaatcaaatggtggggagtaccaagactgtaccaacaatgttttaattttagggccacaaccaaattaattaattaataattaattaccctctaatttttttttctgttttcattcctttattttttttccaagagttaccaatttactagagaccttagcctcgcggttttagttttttcgaaggccaatgagtctaactaacttttttcaaaacgagattttttgggggttaccccacttttgcgtcccggacatttgcggcccggacatttgcggctcggacatttgcggccccagccaaatcggacatttgcggcccgacatttgcggcccggacatttgcggctcggacatttgcggcccatttcttaagggccattttcggacatttgcggcccaattttttgctgaattttgcggcccaagctaaaatcggacatttgcggcccgacatttgcggctttgccctacatttcatttaaatttattttatgtaattttgaataaatattactattagattttatcaatttaagaataagatattttattctcttcatcataatatttaactttttcaatacatcaattaatacacaaaaataaattttttatttccaatggcttgctcaaggcccaacgagcgtcatttttttacatttcaccccattcatgaaaccactctgcgaggcgatactgtaatgcatttaaatgacgaagcaaagtctcattgtcgcgttcatcatcattgtcgtatcgcaaaattaattctttgatagcacggtcattttcctcatattttttcttccttttctcgctcaacccccttgtggggtccaactcataaggtcgaatgcgattctgttggaattcctcctccacttttagtgctctgataaatctaaataaattaacttctttcgaagtttagtgctgcaatacttagagaatggtggatgcaatccagcaaagcgttgcctaaaagccaaatgccatccctcaattgcattatttgtcctgtgaagattttcaatagttgaatcatgcatattccagtcataatgagaaaaaagtggaacagcacgttcaccatcaacctctcggaaaagataggtactgtaaaaaacataacccgtaagttcaaatattttttagaaatcggcggaaatataactttatttttagtttttatttttagttcagtgtttgaaattaaaatttatggcccagatttgctccagacttttgaaagtaggtgaaaattggcatagcttcctgaggagaattttccctcaagacaatgtatgcgtccaacacttcatcgatttgcaaaaatgccaaagcagtcaaggatcggactgcctttctaaattctgcattttgagcatacgtctgtgcatatccttcagaaacaagctttctcaaaacgctctgccccaagtggaagaggcagtgacgatacaaaaaattttggccaaaaacatttcggaatgcatttttggcaccttaaccgaatgatatcaatcattaagtacatacgaagcaagtaacgccgcttttttgggaatcgtaattattaggacagaacttaatttttaatcccggaatattaaaaaattattagtagctaaaaatgggaaattaagtgccaaaaattttatatatatcataaagacgcaattcaaagtcactaatgactgaaaggggcaaaatgccctgctgaagatgatttcgaattacagtaaacgctcgtaaataagattcttgctgtttgttctgcataattatgtaagctgaaggaacagaagatttgt

SEQ ID NO: 8579 - DNA, 1451 bp, Heterodera glycines
aaaaaatcaaacttagaaaattttccaaggaaaaatttctaggaaaattttttttaataggaaattttaagaaaaaattgttgaaaattttttcagtattttttttgaaattttatgaaaattttctgttttttccgaaatttttcaaaaaaaactagcaaatactttttttctttaaaattatacccttaaatgttccgtctgcagaccagtgcctgtggcgtcttaatcgcctgaggccgttatccgtcagaaatattaaaaaaacaggcaattctggttcttgctgtcttgaatcataaagcagaaatctctgcccatcatttccaacaataaattcgccctttaacaagaaattaaaatatccttttgattctcttttccgctcttatttctacccatggagagacgcatattttacggtcaatcctcacgctttttcgtcatctcctacgaaacagtggccgccattattctgtggttcatgcagaaagaactgcattaagggctgcactaaactcagggaaaagcggaatagctcataccctcaagaagggcacttcgaaattaacaacaaattttgccggtggcgttgttgggggagcggcggctgagaccgcagccaatttaattaggacaaaatgtaaaccccctatttttcaaaaccaactcgtaacttaagcacgatcaccatatttcttcccagtcactgttcggggaccaaaaaagacggaatttttcttggatgaagagtattttaccaacgacgaagacttgcacaatttttttgatgagatggaaaaagctgcaggggtaataactccagcctgctgttaccttggtcacaattaatttttaaattgttaaaaagagtatttccacagatgaagatggtgttctgcgcatgttgatcagaacttcaaacatggaagttgtcagaagcagagccaccacaattaacagacaaacttattttaactgtgacgctatgtgtttgttgccttaggtgtccatatgaccgtagtttaagcattttttaaaatgacgctcgttgggccttgagcaagccattggaaataaaaaatttatttttgtgtattaattgatgtattgaaaaagttaaatattatgatgaagagaataaaatattttattcttaaattgataaaatctaatagtaatatttattcaaaattacataaaataaatttaaatgaaatgtagggcaaagccgcaaatgtcgggccgcaaatgtccgattttggcttggaccgcaaaattcagcaaaaaattgggccgcaaatgtccgaaaatggcccttaagaaatgggccgcaaatgtccgaaccgcaaatgtccgggccgcaaatgtcgggccgcaaatgtccgatttggctggggccgcaaatgtccgagccgcaaatgtcgggccgcaaatgtccgattttggct

SEQ ID NO: 8580 - DNA, 4495 bp, Heterodera glycines
atccaggccgctcagatgcaatccgaaaattgccagtgccacatgacaaatcgactcttcgctcatttctcggagcccctactttactacagtcggttcatcaaaaagatgcgcgaacttagggcgccattggaccaactttttgggaaagacgaactttggaattggggtgaagaccagcagaaagcttttgaaaaagcaaaagagatcatgttgtctgatctgcttttacccacttcgacccctcgcttccaataatcgtcgcagctgatgcttcaaaagatggaattggagcgaccataagtcacattttcccagacaaaacggagaaggtcattgagcacgcgtcaagtgttctttcagaagcacagcggaactacagccaagtcgaaaaagaagctttggctcttattttcgccgtccaaaaatttcacagaatgatttttggaagaaaattcacacttctgaccgaccataaaccgctgatttccatatttgggtccaagaaaggaatcccaatttatgccgccagtcgactccaaagatgggcacttattttgtcaaattacgaatttgacattcgctacatcaataccactgcgtttggtcaagtcgacatgctttcacggcttatcgcgaattatccgcgacccgaagaagatattttgattgcaaaaatttgcaccgaaactgaatgtttcatcggcacaattttgcagtcacgaattgatcaacttcccgtcactgcaaccgaaatagcagaaatgactcaaaaagatgaaattctacaaaaagtggcaaaattctccaaggaaggatggtcacaaaagtgtaatgaccccgacctcgcaccattctttccaaaacggaacgaaattttgcaaatcgagaattgtctgctttatcaaaaccgagtcatcattccaacagtgttacgagacagaacgttgaaagcgcttcacatggcacacccaggaatagtgcgcatgaaagctctcgcacgccaacacgtatactggcctggaatggactcagctatcgagaaattggtaaaaagctgcgaagaatgccaaatcgcccagaaagcagcaccaaaaacattgctttctccttggaatgccaccaaacggccattccaacgtgtgcacattgattttgccggcccatgccaagatggccatgtttatctacttttactggattctttttcaaaatggcccgaagtttatcagatgaatacaatgacatcaaaagcaacgatcagtgttctccgattaatcatccatcgacttggcatcccagaagaaattgtctcggacaatggacgacaatttcgttcgtcagagttttccgaattttgtaaagaatttgggattcgacatacgttcacaccgccatttcatccacagtcaaatggccaagtcgaacgctttgtcgacacctttaaaagggcaatgcagaagtgttcgaaaaaggacaaaaattgggctgagaaaatgctcctgtcctatagaacaacaccgaattctgcaattaatggacattcaccggaccaattattctttggtagaaaactccgcactcaattgtctcttacacatccgacaggaaaagtcaatgagacaattgacaagaccattttccatcaaaaacaggaaaaataccgcacaaaaatggcacaaaatttcaatgaaaagcatggagttaagtcaaatgagtttcttccgactgacccagtgcttgttttgaattaccaacatggtaagtcacattggctccaaggcacgatcatcgaacgcctaaacaattcgccgacttatcgcgtaaatgtgccaagactcggacgaaacattcatcgacatgccaaccaaatgcgccgtcgatatgtcttcgaagaaagtttaggatttgttggtcccgcccaggtggcaaatgacccaaatcatcattcaccggcacatcaaaaccatccaacaccggcacgccaaaacacgacaccgaaatgccaaaagcggaagcagcccgacgaaatccacccaactactgccaattcaccaccaatggcattgagacgctctagtcgcaacaccaaaccgccgatccgcttctcgccaggctgacgccgttcaagaattgaggagggagatgttggatagtgaataatttgaatttatggcgatctgacttattgactttatttgttatttctatgtccatccgccccctccctcgtccataaaagtggacacctcctcccactttttgttctttcctttcatcattcatttatattttatttcccaatttgccctccgaccgaatcaataaaattatttatttatttctttttctttgtgtgttctaagtggaagaacacaacagtcctcaatcattctcagccggcctgcttagtcctcgtaattattaaattagaattttaattaataaaaacaattatttataaaaatgaaaacaaatatgtatcataaaatcaagaaatgcaacccaaaaagatactagaaatttcaattttaataaaatattcaaaaataaataaatgtccaaaattaattatttttattcttgaattttttattttttagcccgcttaattttaattagtcatattaccaaaaatatttgagcattctaagggggcttaaatccaggcccatgaataaattgagtaaaaaaaatataataaaaaatacaagtttatcaaatctaataaaacttaaacttaaaattaaaaaataaatgaaattgttcagtttatttttaataaagcaattggttcgccaagctacttttcggacgaatcatactcatttatggtgttatcacctgaggtttattcaccaaatgttgcatcaaaattatcaaacagtatttttgtgagtttctctatttgaaatattttatttaataaattatttatttataatgataaatttcagttaattttatttttggaaagagaggcatatttaatttaattaatgacgacaaccaaattttcaaggaagtaaatgtttgggttctaagaataattttttcttagaattttttgttacatttaaataaaaattattgggcaaaatttcagcttattctaaaaactatcgttttaatttgagataatttatttcacctaaaaaatgttatcacctaaaaaatgaagtccaagccttggatgaataaaaaatttcctgagaaaccgataccattgcgagagaaaatttaatctcatattttattttattatgggagtgtggtcggcgtatttatagcgaataaaagtttattcaaactaagtagtgaaaaatgaataaatattcataaaatattaaaataacggtaaaatacatacgattatgtatattttcataaaaagcagtaaggctaagacgaataaaaataatttttttttgtgaataaatagaaaataataaatgcgattgaagttgaagacatgaaaaattggtagacaaaagcggacaaaaaagcatataaatatggatgaaattgctagactaatcaaaggaaatgtttcaagggtaaggaaattgattttgttgaaaaaatgaaataaattattttttagattaataaatttgtaaaatgtgaaaatatttttttgaattatacttgaaaatttataaattaagaaattgaaaaatgccaacgacaaaagattctgcacatccgggcatcgattcggacacatccgaacatttttcaacccgaagggtcatgaaacttgacgaaaattatttgtatttataaattaatttaataaaagtgcattttaaattttatttaatttattctaactttttgaatattatagctcgaaaattttaaaaggccaaacttatcaaaaattgctcatccttgctagtcttcttccattggtggccccaaatgcctgaacgttaatatctggtcatatttactaaatttagaattaaattaaaacacttactggtaaatttctgtgaaggatagaaacctcgtctgttcgagatcagcggcaccctaaaaaagttgactcgaataattgattaaaaaattaaatgtcaataagattttgagaattatttttaaaaatcaaccaaaaaattatttaactcaaaattatttatatataaaaaatttaagtctttgaaaattttatataatataagcatataaataatttaataaaaaccaaaccgttaatattagttcacggtaatcgtccaatatttgactagcgaccccttatgcatcggtgatcaatgctttaatttgccgtttcactttgttgtccatcggtagtttttgctttgtcctaaagaaggcaacttacaaccaattgcgcgatatatcgggcttgaacataatcaacagccgatgaacactttcccttttttccgagaaataccatttctccgatacggcggctacccatttggatttttagcacctaaaaatcccatcactattcattact

SEQ ID NO: 8581 - DNA, 1809 bp, Heterodera glycines
  misc_feature (48)..(48): n is a, c, g, or t
  misc_feature (81)..(81): n is a, c, g, or t
atttttttggaaattttcgattttttccagaaatagaaaaaattttgncctgagcgggacattgagtcccgggcccatacntcgtcaggggttggtttagccaaaaatggccttagagcaaaattgtagagctttttaagctctatcgaacggtgtacttcattttcgaaaattttcaaaaattttcgagctaggccccctagaaattttcaaaaattttttttgggttgaaaaagagggtgaaaaaaatttttctggggtaaattagggtcctgagcacaaatatgatgtttattttaagtttcagattttttagaattttttaaaaattcgaaaatatttttaatttttttggtccttggaaatttgggttaaaatttgaaaattcataactcaatggaggactggtcaatttaagtgaattaaagctttaaaaatagcaaaaaatcgggagaattttatgagatttatttggttttataatgttcaaaagaaaaaaagttattccagaatttctggaaattttcgatttttcagaaaaaaattcataactcggttctgaaaagtcatactgtaaaagtaaaatactacaaaaatccgcaattttttgctctattatataaattttatttggcatttctatcacattttaaaaaaaagatacaaaaataaaagtgcttttgggattcgggaccaaaggggggtgaccaggatttttaagtgaaaaaaattttcaccaaaaatcttccaaaaacatgtctttaggcgttatttgggccgctgatcacgaatacgtgatcagattttacttttgacatcgtcaagacctcagaatccctgtgtgattggggattctgggacatgttctgaggggggggggggggggcagcaggttcgaatccggacggtgtaacattatttttctttgtatttttggcttattttacaatgtttttaattaatttgaaaatttcttttaaattatttaaatttattttttttaaattaaagaatttcattatttatttttgaatttgtaaaaaaaattcatttaatttcaaattaaataaatattcaattaataatttccaaggttgtttttaattaataaaagagtattttgttattaaaaaatttttaaattaaaatgcactcgatttttaacctttaataaaaacgtttccttatttatttaattttaaacaatattgtacctctcctaacaatgttgtaccacttctaatcacagttgtacctcttctaatcactgttcttcctcttttaatcactattgtacctcttttaatcacttttgtacctcttctaatcactgttcttcctcttttaatcactgctgtacctcttttaatcactgctgtacctcttttaatcactgctgtacatcttttaatcactgctgtacctcttttaatcactattgtacctcttttaatcactgttgtacctcttttaatcactgctgtacctcttttaatcactgctgtacatcttttaatcactgctgtacctcttttaatcacagttgtacctctttgaatcacttttgtacgtttttgaatcacttttgtacctcttctaatcacttttgcacctcttctaatcacttttgtacgttttttaatcactgatatacctctttgaatcacttttgtaccacttttaatcacagttatacctcttctaatcaaatttgtacctcttctaatcaaatttgtacctcgtctaatcatttttgtacctctttttatcatttttgtacctcttttaatcacttttgtacctccttta

SEQ ID NO: 8582 - DNA, 4049 bp, Heterodera glycines
  misc_feature (71)..(71): n is a, c, g, or t
  misc_feature (105)..(105): n is a, c, g, or t
  misc_feature (168)..(168): n is a, c, g, or t
ctcctttaatcagttttgtatgtttttaatcactgatgtacctctttgaatcacttttgtactcttttatncattttgtacctctttaatcactttgtacctctntaatcagttttgtacgtttttaatcactgatgtacctctttgaatcacttttgtaccactttnaatcacagttatacctcttctaatcaaatttgtacctcttctaatcaaatttgtacctcttctaatcatttttgtacctcttttaatcacttttgtacctcctttaatcacagttgtacctcttctaatcatttttgtacctcttttaatcactttttgtacctcttttaatcacttttgtacctcttctaatcactgttgcacctcttctaatcactgttgcacctcttataatcactgttgtacctcctttaatcacagttgtacctcttctaatcacttttgcacctcttctaatcacttttgtacgcacttccggtttccattgcattatgcgatgtgtcaactccaattattggaggaaaccaagtgcatgtcggctgacgcaaagaccctaacagactaaaacgcgcctaggtagcgaagctcacaaagcgcgaagcgctttttcccagcccagatccgacggttcacgcacccgctagtttctactatatataaagaaaaggtggaactcgtcttaaaaaattataagtccttacggtttgcccggaggggcctgaaaccgtgacatcatttaagcaaatttttgaggcgcatctgggaaaaataaggatttttcggtccggcggccagttgagcgccagcggcgctgaaacggcccgaaaatttttttgtccgtctttggtggcctgtaactttgcgggaagaagcgggagcgaaaaatgcttggtgggaggattttaagttggagtgtttgggataatctggcgcttatttggcatgcctagctgcaaaagcctagcctgtacactttggcaaaatttgaaaaccatttttggcatttttcgaatttcgcgaataaatcgctgggggttaagcggagcgggttggtgccacttgagcatttgtgtagtttttaaagctgcatccgatggcgttttcagattttgaaaattttcaaaatttttcgagctaggccccctcgaaaatttttcgtttttgaattttattattttttgacgatttttcccaggaaaacggagaccactttcaagcaaccgtttttcgagctctatcgattggtggcatttttgaaaaaatttcaaaattttccggaaatagaaaaattttccggaattgagctccccattttgggttttcggtttataactcgtcaggtgttgattttagcggaaatttattttagagcatttttgtagagaattttaagctctatctaatgtgctttatctcatgtttttaccatgagtttaaaaaaagttataaaattaattgtgattttgaaactcaaaaccataggggggaccccatggttttgcatttcatgaaaaaattttttactcctaaattagccaaaatgcatttttatggcataatttgaggtgctgaacacgaatatacgctttattttgtgtttcagactttttggaaggtggttaaaattttttgaaaaatcgtcaaaatttgagccacggaaaatccagtgaaatttcaaaaattcataaatctcttcgtgtttggtcaaatttagtggaataaagctttaaaaatagagaaaaattgggagaattttatgagatttatttggaatttctatcttccaaaataaaaaagttattccagaatttctggaaaaattcgatttttcagaaaaaaattcagaactcccttctgaaaaagtattttataaaaataatatactcaaaaaattcacaattttttgctctattttataaaatttaatttagctttttatcacttttttgaaaaaagttatagaaataaaagtgattttggaatttgggaccaaaggggggtgcacatggtttaaaggggcgtgaagcgcccgtcctgaggccgcgaagcggccgaattccctccaaaaattaaaaaaacgggcgcgaagcgcccgtcctgaggccgcgaagcggccgaattccccccaaaaattaaaaaacgggcgcgaagcgcccgtcctgaggccgcgaagcggccgaatgttctcaacataattaaaagacgggtgcgaagcgcccgtcctgaggctgcgatgaattgctaaatacatcactttctagcgacgcggcgaagccgcgtcccatagcgcgatagcgctttaaaacagcacactaatgcaattaatgttttgtatgttttaaaataacaaatgagcatgtccattttctcttcatccaaaagccaattgcctacgccgcccccgtcaattcccacacgctagttaatatatacgttatattgacaaggagtttcgttgctaaaaccattttctcccggccgaaggccgggagcgccctgaaagtggtggaagggtcttacaactttttgaggagcatccgggaaaactatagagaaaaattcagcgcggacgactgagtcccggggaccgatttctcactttttcttgcgtttgttagcccataactttttttctaaaacccgaatcaaaaagtgcccgctgtgagggcactccccacaactgtcctctacatgatggtattttttatttttttattagagccaccccctggcctgcacgcttggctaactgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggtccataactcgttaggggttggttttatcgaaaaaactccttagggcaaaattgtagagttttttaagctctatcgaatggtgtgccatattgccggaaattttcaaaaattttcgagctaggccccctagaaattttcgaaaattttttttgggttgaaaatgggggtcaaaaatatttttctggggtattttgatgtgctgagcacgaatctgatgttaattttcagtttaggaaattttagaattttttaaaaattcaaaaatatttggcaattttttgaccctcaggattttgggctaaaatttgaaaattcataactcaatggaggaacggtcaatttaagtgatttaaagctttaaaaatagcaaaaaaatcgggagaattttatgggatttatttgggatttctatcttctaaagaaaaaaagttattccagaaattctggaaattttagatttttcagaaaaaaattcagaactcccttctgaaaagtcattctgtaaaagtaaaatactacaaaaattcgcaatttttttctctataatataaattttattttacatttttatctcttttttgcgaattgttataaaaataaaagtgatttttggtttcgggaccatagggaggtgaccaggatttttgggtggaaaaattttttcaccgaaaatattccaaaaacatgtctttaggggtattttatgacgctgatcacgaatacgtgatcagattttacttttgacatcgttcagacctcagaatccctgtgtgattggggattcggaggcatcattttgaggggggggggaagttcgaatccgggcggtgtacattatttttctttgtatttttgggttatttttaatgttttaaataatttcaagatttttataaatatttaattaatttatttaatttcattatttattttttgaatttataa

SEQ ID NO: 8583 - DNA, 4919 bp, Heterodera glycines
gatgaaaatttttgctgcatccgtaaaagtggtgtatccaatggcatccgaaattttgcgaatttgctcaagttggtccctaaacgttagcagtgatggaagaattggccagtcaatacacagaaattaggcacaaattagtcagaattaatttctgggaattggtcaccaatccatatttagtgccagaaggaagcgaagtgtgtgtgtgggaaagcgggataaaggagatgggagaactctctaaagagagcgcccgtggctcagtcggctagatcattttacacggtatgggaaggctgtgggttcgagtcacaccggacgagttgacttttaagacctacacacacaaaaataaaacataaaataatgtatatactaaaaaactgaatttttgtttccaacttggcaaccgaactttattaattaattaaaaatcgaattttttgggggttttaagtcaaacaaaaaatccaagtaatcgcccttttaaataatttttttgtaggttttcaagtgaattgtaaaaaatcccaagtacccgcccgaccttggccttgcccagtcctcccccctttgttggccacctgctctgtgtgctggcaatttctaacagaacccgcaaatcctgctttattggcggctgcgccagcatcccttttttgtgttgtttcgtttccatctcattgttctttgtgctcttttcactcaatcctttgtctttaataattttttttgctgctacaaatgggttggccattgagtaggacggtgccgacatcagcgaggcaatgtcaatgccatcctttggcattccgttcagtgccatgttcaactgctgggctatgaacaccggctttggcaacatcactccgtagaggagttgacggaaatttttggacactttgtcttcattccgattgtccaccagcagatgttcctaaaaaaaattctaaaaatttggttttgtttttgatgaaaaactggcgtccgttaaaagtgttaaatttggaaagaaaaaaaacaatggatcatttagtaaaaatttaaataaggatatttatttaaaattagtctgcctgattagtcatcatgaaagtgttaaataagacaataaaggtacaaaaatatttgaaaaggtcaactaatttgggaattggtttttttaattaattctcatagagttgctaattaagtgttcattaaaatcaaaaacaaatttaaacttaccgtcaataatttcttcacacattgcatgtacattttcaggtgattgctcatgtgttcttcaggcgtttcaatctttttttccttaagagaataattaattttttgcactaattagtcctttatttgtgttaggggtgtccttaatcacacaatgacatttttcaaattttaggcattatcaaaaccaattctttcttttctggtcaatatgggtttatatgtaaatcaaagaaaccttggtaaatttcccatatgtaattggattctttttattattttaggcgaacaatttaaatttttttcaaacttacaacatttgctttctgtacaatgtttggtgtccttgctttttgtctccttgatgatgatgatgatggtactgattgagtagaagcagatttatcagaattattatacattgagaaatcgtagggacttcggtcgcctcttttttggcgacgtgatctctgcttgtggtggtcactgctacttggatagttattattcaccatagcattagcatcatttccaacaaatgaaggtggccccgccattccgggttgctaaaatgaagaaattggtcacccttttatgctttttcaatgccattcaacaaaattccctaacaaaattgaaagcatttgccacagtgctttcccaaacgaaaaaaaactggcaatttttgattctaaagagttttttaaagtcagattttgatcaaaatccaaaatttctcagacatataccaatcataaattttaaaacgcttaaaaatatattcgaatcataaatttttaaaacgcttaaaaatatatacgaatcataaatttttaaaacgcttaaaaatatattcgaatcataaatttttaaaacgcttaaaaatatattcgaatcataaatttttgaaaatgtttaacaatattaccggtggatattggtttagcggtgctaaagacccactgccaccagcagttgaagctaaatgagactgtggcagaccaatatctctgtattgacttgagttcggtggcatgctgaatgatgtgtaagtttggtactgcggagatggcactccattaaatgacatcgaatactgttgcgtcggtgggtactgtatttgatgttggtgttgttgttgtacacttggtactgaattattcaatttttatttaaaatacaattaataatttcaaatatttattcatagttcggtcgtaaccttttaagcgtgattaaaaaataattattttttaattaaatttcgtgttatattgttttgttcataacctgtttggtatggagttatattgtttgttggtgttgggtaaacggagtctgacagtgtcatgcttggtccaatagatgacatcgaatgcggtagcattggtgacccagttgtatacatgagcgaatcatttcgctgagttgtatacggttcctgtatttgattaccgtatccaatgtttgacaccgaatactgtagcgcttgcggttgtccaacatacggttcatccataaggttaattggtggtacttctttattcggcttctttttgacaccagcagcagatggtggctttgttgatgatttttttggcttagcaatcttttcacttgagactggaattcgtttttaatataaaaattgaaaaattagagttccgccggtccaataggctaattccaacgtttttagaactttgcgataaatacggaaatttggtcaaaaaaggcgcagaaatttaaaactgtcccacccctatccgtccaaattttttgaattttgcgaaaaatacgaaaacctggccaaaaaaaggctcagaaattcgattaaccataaaactgttccactcctatacgtgtggtaggtaatttaaaattttgagattaacttatttaaccttcattttgcatcggctttttgtcactgctttttccttgttttgtttttttctctttcccttttgcttcttctctttcctttatttgtgctttttctttttcattatcatcttccttttcctcctcgtcttcttctattatcacttcatcttcttccgtcttctttttgaacacaatgactttctataaaaaaagaatatatcgacatataaaagagcttcaaaatgttaaaaattaaattatgtaattcgactttagtgtttggcgttgccgagagggactgttttaatttttaaatatttttaaaactcattaataccgagaaattaagccatttccagccaagagtgaaacggaaatgagcgcagaggaattgggacagtctttttagtccaaactccccaaaaaattaaaggaaaaatcaaaaatttaattatttagaaattataagtatatgctaaaacaaaattacattttcttatatcaacaattttttttaaaaagttcttacaaaaagttcaaaatttttcgattttcaagggtgtattttttaattcccaaaaagtcgatccttaggggtgtatttttcatttttattgcatttttcttatgaaaatttgccaaaaatgacttaaatatgctctaaaaatgaaaaaatggcaaaatatgcatttattctcgaaaaccctcaaaatatgcttttatatgcactaaaaaacttcaccaaatcaaaaaattttatcgcagaaatgctatttttgagcccctttcttcgtagcatatgcgcagaaaaaatatgcaaaagcatataatttatagccctaattataaggctttaaagtgtcaattccccagcagagcattttccgttcaacttttaaactcacatcaatgtcatcacacattgccatgttgctacagtatctgatccatgatttgttggccgagcaatactgtcgcatgttatcgtaacggtcctcgtcatccaacgcggtcagtgcgtcgaacagtttcatccagcactcttccgtcttttgcgagtcgcactgtctgacctcacacaaatactgtatcagcttctcctccttctctgtctgctgcttcgttagctttttcaccatttttttcatttgcactgtctttgtttctttttttgcttcactattttcaacgctgtctgcttgtctgtccgaactctctgttttaccaactttctcatcttcctctttttcttcctttttactattttcttcctctgtgttttcatcttcctttccttcttcttcatcaatgtccaaaggtcgtgcaaattcaaagtcaagcgttatttcgccatcgtaatcaccataattgaaaccgttggccatttgttggtgcataattaaatcataattgtagtttgatggattcgaccaatcagctaccgttttttgtggctaaaattattcaatatacattttacacatgagaggaaagttgaaaagcctcgaaaatgtgaattatgggaaaaaagacatttctgactctaaaaccctcggaaaaagtcaaaaaattactttaacttcctttattttttaatctcttcaaactttttgattacaattggatgcttttagtaaataccctaccataatgccatattaatggattaaaattaatagtttttacttcttctcgtcgcgcgttgtgattgaagctagccgagccaaggaattcagtgcttggcgtcccaacataataaaggctgtcaatttgctgacctgttaatggctgttgcggtgaattca

SEQ ID NO: 8584 - DNA, 1159 bp, Heterodera glycines
tgctcaccaatgtttgtgttacatttgtcaaatgcgggcgtattgttcgaatcagaggaatttttgcaaattgatcagaattttctttgtgaattattcgtacgtgatcagttggtgatcagcaatgaatttgaaatttggcaagctgtaatttttaatttaattttattgtattaaattgatctttgtttttccgtttaggcactccgttgggccgacgaaaagtgccgtaaaaatgccatcgaatgttccgctgaaaatcgtcgtgatgctcttggtccggcactgttcaaaattcgtttccctcttattcatacaagtgagattgccagatgtaaattggagctgcgaatgttcggcaacccttcgaattgtttcgcaaaatctcggaacggagcatttgacgacaaaatgtgaccatgtttttaataaggaatcggacagctggggatttcctcatttcattacttttacagtgagtggctttaaaacaacttttattcgcttaataattgtaaaattaagaaattgatggacccggacaaaggattttatgaaaaagagggggacaaagtgacattggccattgattttacggttgaagaaaaagggacaaagtgcaaattggtcgataaataagcccattcaatcactatttctgttgatttgatctttttgaaatttatacaataaaattcggcagcaattttaataaaaaatattgctttagccccattttcaagattagctttggtgcttttccattatgccccgccagaaaatgtcatgatcccgataaatcacaacacttttcgagagtaagttgagctaatcaaaaatgtctaaaacaggtctcccaaccagggctggacgtaactgattttcaattacggaaatccgtcattacggcgattttttcagttacggccatccgtaatccgtcatgacgggggtcaaaaaaggccgtaatttggcgtaatccgtaatacgtaatccgtaattttcaaaaaaattttttaatttaaaaaatccaatctaaaaattgttaagattaatttatgatcagaatatctgcttgtttttttgaggtgaaaatcccaatagtttttttcgcggtgtgctttttacaaaaactgggaatgttggggggggggggggg

SEQ ID NO: 8585 - DNA, 2215 bp, Heterodera glycines
  misc_feature (64)..(64): n is a, c, g, or t
  misc_feature (89)..(89): n is a, c, g, or t
  misc_feature (114)..(114): n is a, c, g, or t
  misc_feature (2026)..(2026): n is a, c, g, or t
  misc_feature (2052)..(2052): n is a, c, g, or t
  misc_feature (2154)..(2154): n is a, c, g, or t
agaaaaataaaattcatttataaaaaaatatctgcaaaagaatcgtctcgaaaaataatctaanaagccagttacggatcaaaattacnggaaaaatcccaaaaaatccgtaanccgtaatccgtaatccgtaactccaaaaaggccgtaatttccgtaatacgtaatccgtaattacgtccagccctgctcccaactgaaaattttcaaaaccagcatttggccgacaaaaaatcatcttttggaaaattttactccaaattaaaagaaataaatagaaacattcgttttttgcggcgcattttttccacagtgtcgataggctaaaaatggccattttgaggttttttttccaaaatcagcatgaaagttttgcgctttgaagtcataaatagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaattttaaaaaacttattttcacctattttggcattttgcccaaaatttgttaacaaaaatgcaataaaaaggaaaaacagacccctaagaatcgactcgaaaattttcaaaaatatacctatgaaaaaagaaaaatttctcaaaaatcatctccaaaatttatttgtttattttcttggcgagaattttttattttgaaaattatctatctcattaatgatttggcataatatttttgctttttgaagaaaattttcgattttacaccccaaattcggaactttttggcacctattttcccatttttagcacctattttgggggttttttagaacctaaaacctacttattttggcagtttttagcacctaaaaatcgaagccctagtcataaaagtactgaaaatggagaaactaaaaaatcatgtcgtcattgttttttatagtttttacataaaacgattcagttaaaactaaattatttaagaattagaattgatgagtagagctaggatttttatgtgctaaaaatcctgaaatatgtaataataaaatatattctaaaaatgctgaaatatgtgctaaaaactccaaaaatgccaaaataacatacttaaaataattatatatttttaaaatatttttgtgtgtttggtactttttaattgaatgcgtttctgcgaccgcggttttttcttagtcagtcaatggaatcacttaaaaactataaatgtatgtgatgcattgcatgtaaaaatttaaaaaatccattcatttatttatttattctgaatgaatatttacactcgcttatcgcacacataaatacatttattattattatataagcagcataggtatagacatataatataggctcggtctaattgtattgctttgggttgtacaaatcatcttcgtcaagctcatcttcatacgatttcggtcggcccatcttctgctgctgctgttgattgtattgttgcggcggcttgtacaggtcatcatcgtcggccccagtttgttgttgctgttgtggtttctgactgtattgttttggattgtacaagccatcgtcggcaagtgcggcttcatacgtcggtcgaccaccaccaccagccgccgctgccttctgctgttcagtgtactgcttcgggttgtacatgtcgtcgtcggccagcttagcgccgtacgctgctgctggtcgctccgcttgcttcggctgttcctgctggtcgtactgcttcggcttgtacatgtcatcatcgttggcggcccatatcgaagtgggaacagccttaataaacgccgtgtcaagaaacattaaatgaatacaacacagcaaaacagagggtgcacgcttcgccccccgtgaaattaaaaaaaatttttttttctaacttaagaatttttcaagaaaaaatcttagtaagttttttcatatgaaaattctaagaaaaaatttttcgatanattttcagcgattttttttgaaattntcttgaaaatcttagtaattcaccataaaatttctcaaaattttttttcatagatttttttatggaaaaacttattaagattttttcttgagaaatttctgntggtaattttttttgtaaattttcacggatggaaacgagctgtccccgcaaaacaaaaact

SEQ ID NO: 8586 - DNA, 3663 bp, Heterodera glycines
  misc_feature (728)..(728): n is a, c, g, or t
ttctgtccttaattcctcctgaagccattttggcaatttgttcagccgataatcgaagagtttctctgtcatcggttcggcggaggacagtgccaaactgcagaccaaaagctgaaaaaaacaatggaaccgattgatggcattttgatccgctcattatgatcagcctgccttattggcggagaagctattcacagaaatgtaatagcaaaagtgttctccgccgaagtgacgtctaaacaaatccaacagaaactgacgcccttcggcaaccatcgaattcttttgggggatgctaattaccgcagtcattaaattgatccctacattaatgtcgggcctgacgaagaaattgaccattaaagtaccttaattaatttttattttttgttgcatttttaaaactaaaaaatgccatttgaatggagcattttgacaaatttgtccgccattttgtcatagtcaacaaaagcttcgaaaaatgggcacaaaagcgggtatttctgaccgggagggatggcacttattttgcatgcgtcgacaacaacacaatcaaagcgtccatctaaaagtgacaattttgccacaaatgtacataaaaaacaaagttattcactgattcaccgttctcggcccattctctgatgaattcgacgccgtcccttacgaccactttttggcgcggcgactgctcaagtccgaaccatttgcgcgcgatgtacctgtgncggcaattttgttaccaaaatggccactccctcaatggccggctccaactcgccggacaccacttcgtgctgcaatggcaagacggagtccgttcatttgacctctcattggggcattttcgttctcaccgatgggtcagtttctagtagaaagttcggcaccgatgccccgccgaggccgaccatcagagtacggcgtgtgggcccgctgggctccaaccgggcacagccggagacgaacatttgggcggctatcgctttcatgtaaggcagggggaggttgctcttccgaaccgtccaccggcgggcattttgtgccgaaaatggcgtatctgatggatttgatatcagtgatttattggagtgtaggacagatgtgtacggactgagttttgggttgggaattcagtctcgatcagcaatcattactacatttaatacaattgcttccactaaattttatgccaaaattaattctattttcaccggggtcgtcaggcagcaaatcggcaatagaaaacacaacattcgcttccgactcgtccattaacatgcgctggtaccttctcctgaatttattcattcattatcaaaaatctttaaaagtcggagtgttcggcactatgaaaagcctgtaaccattcaccatttggtgccgttcgattgccattcgttccgaactaaatcctcgactttgaagcagtgatcggccccatttggacagatcacttcctgcaaaatcagaagggaattctctccgtcccaagcagcggaacgggcggaaggcgaatagacgacgaatttggcattttgacggagggaatgccaaaccaaaaactgaaagtgatcggagaagtgatcaaggagaaggggagaaatgcaccgaaatggcagagacagagacgagacagaagaagagcagagaaacggtgtggggacgaaatcggcggctgccgaacggacggacgagggacggaacgccaaaattcttacaaataggcatcttttcttaaaatacaagtctgccttatattctaaattcgaattctgataaagtataacaataaatagagatacaaaagaaaaaaaattcttttttagttctaactttctctcatttcagtgtactatctttttttttatttgtgttttagggaaaactacttatttaacttaatgatcatcaaaacgggtgcttggtcatgtgaggatttttcaacatgggtttttaaaaaagggtttctattatatgtatgtatttttttatgctggcattggtattaattttatttttaatttataccaaaaattatcttgaatagggtaattaatatgtccaaataccgctttgtaagaaaatttccgaatcgaaaatttaccggtttttttgaaaagtttttttagtttaagctattttgatttttattttaacattaaaaataacagaaaacattatatcgatttatcagcaataagctgtagttttgtcctaaaaaaatcctttcgttttatgaatattcatttcgtcgctcgctagtcatcgcaaatcagcaaaatgtgcagccttttttcgtcagatctatgaaaaaaaatatcgaaaaagagtcaagacagcaaaaagttggatattaaaaagtaggaatttatcgaatttaatttcaaaaaagaataaattcgaaaccaaatctccgccttgggcttcttcttccacatttcattttcaatgctcatttctgtccttaattcctcctggagccatttgggcaatttgctcagccgataatcgaagagtttctctgtcatcaattcggcggagtaaatgtcaaactgcagaccaaaagctgaaaaaaatgatggcaccgatttatggcattttgaattccctctttttgtggtctttcaaaacttggcttattactgaaattaagtccgttctaattaaaattgaaccaattaattataaaacccaaattctcaaataaaacccatttctcatttggcacgacgaatgtgttgatgatcagagttcagagttccttcatttatttgacaggaattatttttccttttttaaaatccttccactctaagcatttttttatattttgtccacaatcgttttgggattaactaaaccctcaaagggacaaatcaaaaaggttttttggccggagggggcttttggcgccgcacgcgtcgattatcagacagtcaaaacggccatcttaaaaagcacaattcaatacaactcaatttaaattcgtttaatttggcaccatccaaatgcgaaacacgcgaatgaagagtaatttattcaaaaatgcttttaaattataaaagaaaaattaagaaaatataaaattaattgtaaaagcctaataagcgactggcttcctcagctgtgtttcaaatattcgtccacattttcttcttttttttgtccttttccgcgttcattttccgcctttgtattggcccgagcggtagccgggaatggcacaatgggtgtatttgttggtgtacgagcagtggcagcagcccttgaaggtgcagctgtagcagccgcggcagcacgtcactccgtccggcttgccgtcgccggtgcacacgccgctgggttcgcaatggatctgagggcaataataaccaaattagttaattattctaacaaattaatggacaactactaatcaagccgaagaaatgaattaaactcaccaatgccattccgatgccggacaaggcgagcaaacaacaaaataaggcacggcttcgccattgagcagaaaatgcaaccaaaaaaatagaaaattaatctaaaataagttattttattaatttttaaattcaaaatatttgtcgatcaaatttctgacaaaaggccatttaaatattttatcgacgtccattctgctgaatgaacttaccataaata

SEQ ID NO: 8587 - DNA, 1764 bp, Heterodera glycines
  misc_feature (1753)..(1753): n is a, c, g, or t
ttcgattttgacacaaaaatccaccacaaacaaatgaaggaacctctaaaggataagtgaagctggtgcccacaatgcctccgagagcgccgccggtgaaatgaataaaaaactgaaaaagaaaatttttaaatatcgaaaaggttttttacataaaaaaaaattcttttgtgataaattgttcttgggattttgagtaataattcgcgtgcaaaaatttattcaattttttttagccccaaaaatttcccgtttttccaacctaggaaaaaagttttatgagtttttcaaactcgggcttacctcggaccaaccgccactttgtgccaccaaaccgtcaccaccatttttgccgccaatgttttgtccatcggcctccgccaaaaaatgcatttgccttggacatttggaatcattcatttttttagatttatttatactcttaaaattgaaagtgttgtgatggaaagtaaaacccggattcgaaaaggcaaatttcgaatttacagaaaatttaaaaattccgaagctccttctttcatttttttttctcgaaacaaagtcacttatggcgatttcaaggtcggagaatccgattctgacaactatttcgacccaattccgaactccgaacacagtctcgaacaaaaagccgaaaattcaatttttcgaattcgcatttttggtctacaaatggttgaaaagtactttattgaaacagtgatgatttttagtttgtttccttaccattaagccggttttaaatcaaaaatgcaaaattcgaagttacgactttttgttcgaaaacgggtccagggtttggaattagaccgaaatagatttcagaatcagatatcccgacagtgaaaacccttaaaatgactggggaccagctcggctactaggtatgcagtgttaaaatttttcggggggattaccccttcacaaacaaacaaaaaattttcgctgacccgacgaatttgttgagggaagtgctgaccaactctgtcccatttcgttgttttggcacttggaaagtgcagaaaaatgggagttaaacattgaaatatcatttttatccacgccgaaatcttaatttcttgaaaaattatcattttttgttgtaaaacgaggggggggggggggtgggggtaagaaagccaagaaaatgacatgagaaactgaaaagaggtgtatgtttaaatggaaaaataggtaatttgatatgcaatatttcataaattacatggatttcgattaatgtaaatcctaactaaaataatatttagtttaacaaaaaacaacactaacaacaacaaaaataacaacgacaaaaaatcaaagtgaaagttgagcaggaagcaacaatatgtaagcgaatggtggtaacaaaaacaaaaaaataatctgtcaaaatctatgatgaaattcaaaaaaaacaaacaaaaaattttaaatgaaaaatttttataggcggctaggcgagagttgggtagggtataattaattgccgatggacagacaatcttgatcgattatcgtgccacactgcgattttttcgtgcaaagaactgcttcaactcctcatagcagccgatcatgacggcacaagcgggtgccacgcgcgcaacacgcggcacggcgcctggggcacaaagagaattaaaaacaacaaattatcggtgaaagcaaacaaggcaattttgttccttagccctagacaataaagaaattaaatttttttccctaaatntttcagaaaat

SEQ ID NO: 8588 - DNA, 1602 bp, Heterodera glycines
  misc_feature (1476)..(1476): n is a, c, g, or t
  misc_feature (1533)..(1533): n is a, c, g, or t
  misc_feature (1539)..(1539): n is a, c, g, or t
  misc_feature (1542)..(1542): n is a, c, g, or t
  misc_feature (1547)..(1547): n is a, c, g, or t
  misc_feature (1558)..(1559): n is a, c, g, or t
  misc_feature (1567)..(1568): n is a, c, g, or t
  misc_feature (1572)..(1572): n is a, c, g, or t
tgtaaatttcaaaatttgtcgaggaaaaaatgtataaaattaaatttataactcaaaggaggggcccccaagtgaattgtcacagattttcaaagaatttcttggtttttgcaaataagtatttttcattgttttcaattttttttttcgagggaagggcgggggtaaagtgcaccttgccaaaaaaggctttgcttcaaaaacgcaccggtgaacagagcgccaagccccttgctgttgaccagctcgcgcatcactccgaacatgttggtgttacgcgtcgacatttttgctgccttctcatggtgtgcatgccgttcagctgggaaagttttttttttgaaaaatttgcaaatttaaaaatttttcataaattttttattagaaaatttcaagaatttttttttttgaatcgcaagaaaatagaatcgtcgaaatttttttctaaaaaatgggcaaaatggtacaccccctcccccatgtacgagttaaagagaaaaagagggacggctagagaaaataggaaaataagaggaaagacagttagacaaatgaggagagattggggtgtgctctcccagctgtgtccgctaatgagggaatggcacaaaaaactctaaaattgacgaatttccttttaaatttcttcgctcacttaaattttttgaaaaacttttaaacgcaccatcaatttggcccaacgtgatttgttggtgggttttgaccacgtcaaatggcaatgtgagaagggcagcaacggagccggacaaagcgccggaggcgaaggaaagcgcaaagttcggctgttggcggtgggcaatttgcatcagacggggcttgctgaactcgtacagggaccagtagatggctggaaaaaaaaaattttaatgataatttacaaattttagaaaaaaaggaaattcccataaattttacatttttaaaatatgagaaaattttacataaaaaatatttacaaacatagaatttccagagaaaactttagttttaattttcagcggtttttttggacaatttaaaaaaaatcttagttcaattattattaaattttgaacaatatttttatacaaaaaaaaatttttttttcgacaaaccggaaaatggaatgtcacgcattattgtcgctgtccaccctcgccacagtgccatgtacccatcagatttgactgtccgcacaattgcacctcgcaattctaaactcaattaaaattgcaaaaaaaaaaaaaaattttttttgattactctaaaattttttttgttacgcccctctcacaagaaaaaaaaaactgcaaatttatcatttcttggtaaaattttcctcgaaaaattggctatttttaggcatttttaccgctataggagagacgttcggattgcattttggtgcgcaccaattccagcggggacaccaccgacacggccatcgtgcgggcgacagtgccagccaaaagcggngccatgaacgctgaaattagtgcataggtatataatgaaaaaaaaaatttcgcttangtttcngcnaattnccgtacaattnnttgactgnncganagcagcaaaaaaaaaaaaaaattttttttt

SEQ ID NO: 8589 - DNA, 3249 bp, Heterodera glycines
aagggcagcaacggagccggacaaagcgccggaggcgaagcaaagcgcaaagttcggctgttggcggtgggcaatttgcatcagacggggcttgctgaactcgtacagggaccagtagatggctggacaaaaaaatttttttaatgataatttacaaatttgagaaaaaaaggaaattcccataaattttacatttttaaaatatgagaaaattttacataaaaaatacttacaaacatagaatttccagagaaaactttagttttaattttcagcggtttttttggacaatttaaaaaaaatcttagttcaattattattaaattttaaacaatattttcatacaaaaaaaaaaaaaaaatttcgacaaaccggaaaatggaatgtcacgcattattgtcgctgtccacccgcgccacagtgccatgtatccatcagatttgactgtccgaacaattgcacctcgcaattctaaactcaattaaaattgcaaaaaaaaattttttttttgattactctaaaattttttttgttacgcccctctcacaagaaaaaaaaaactgcaaatttatcatttcttggtaaaattttcctcgaaaaattggctatttttaggcatttttaccactataggagagacgttcggattgcattttggtgcgcaccaattccagcggggacaccaccgacacggccatcgtgcgagcgacagtgccagccaaaagcggggccatgaacgctgaaattagtgcataggtatataatgaaaaaaaaaatttcgcttaggtttcggcaaaattccgtacaaatttttgactgccgaaaagcagcaaaaaaaaaaaaaaattttttttttctaatttacactcaccggcaccgctgaaagtgctgttgtttttgttgctggccaatgcgttgcgccacatgcacaacatgttgtcgtacattgtgaagtaaaacacagtggcggggatggcactgagccttaaaagggcactttttttaattcaatcattaatcaaaaaagagtaagtacatgctttagttccaaccgcacgcgagaaaatttaaaaaaatataccaaaacttaaaaactttcaaaaaaaagccctaaaattgttaaaaaaaaattttgattggatttttttatgaacaattttgaagttgtagtaaaaaaaaattttaaacattactttgccaaaatttgcaaattttttttaataagatttgcccttatcccatcatgtttcgtcctttttgttagccaaagattttcgagttaaaaccagttttaatttgctgaatttttacattgtgggcgacaatcctgaccagagcgaacggagtccctcaattcgaacaattttcacgaaagcgtcctgaaaaaaaatttttttgaataagatgcaaccaaccatagtttccaaaacggatcaggacgagataaaactgattgtaaggtccaaaagatgacagaaatttttttctgtcagatattggggtactgaaaccaaattggttgactggtccccaatttttgggacaaattacaccaggaattggcacaaaaggccgactattaaatttgggccgcaaaaatcccaaatggtccttaaataatgaaatgtcgaatagcaggggaacccaaaaatgcctgaaaaacccaccaccgaccagcgtgccactgaaatggcccggtcggttgaaccattcgcactgttcactgccagtgccaatgccggccgctctgttgccacaaactcggcaaagatggtccattaggccttaattttttaatgatttttatttggacggaaatttttggcttttataattttttttttttttaaaaagacctaaaatggacccaaaaaattatgcgaaacgcgacaaaaaaaattccattgatttcaaatttttattattgtgcaaaataaataaaatggcattttttgaaaaaatccacccaaaattttaaccaaaaaattgattaaacagagacaaattgtccaagtgaacatccaatttttttttcaaaatttgccacttttagcttttttaagtaaaaattttttatataagcctaaaatggacaagcaaacaaatggtccaatggatctcaaaattttgtttattttttgaaaaaaccaacctaaaatttaaccaaaaattgattaaataaagataaaaaattgcccaattaaatgtgcgatttttttcaaattattaatttatgataaacgatctaaaaaattatcaaagtccaaaaattcttgaaaatgcaaaccgtttgagaacaggaaacattcgccctccgcgaggggcctcacttggctttgcagacgaattttcacgacgtccatcggtgtaacttgacaaaaaaaaacaattttttatttgcagtgggtgcagaaattcccaccctaagccatgaaatttaaaaaaatacgagaaaatttgtaaatttttgagtccatttttctgaattttcatgacaaatttagttaagaaaaaaaaaaaatttccgacagcttcaacaattgcaggtacttccgtgttttgctacccccccccccccccccctcgaaaaattttaaaaattcatattttggggttttcaaagtcactgatcacgaaaatggtgttttgtttgacatctgctgatgatatctggtcatagattaacaaaatatctatgatttcgggtataattttcataaaatccaagggaatttattcgtccagcgcgttgtgattataggcgtctccgaagaaaaaaaaaatttttttttttttttttgcaaattcaacggtttgttttgaaactgacacacaaatttaaaacaaaaacaaaccgacaagcgatgtgaacaatgcaccgaccgatgaagctattaaaagaaaaacccgtaaaaattcatatcaaaattacactcaaaaaaatttctcaccaacaatttgttgtgggaatgtaatgtcaccattataaacggtcgttgtttttgttgttgttgtggttgatgaagacgaagcaaaatcggtgtttggcattggaaaatttcgtttaaaattaatgccttaaaaaactatcgactataaaatctttaaaaaaagctggccccatttggtttcaaaaaaaaaactctgaacacaaaagctcggcatatggtctggaccaacgcctagacttgctggatttttttgaaatttctcttaaaaagcaaaaaaaaaattaattgcttaggaaaa

SEQ ID NO: 8590 - DNA, 2287 bp, Heterodera glycines
  misc_feature (98)..(99): n is a, c, g, or t
  misc_feature (110)..(110): n is a, c, g, or t
tgtcaaagatggcttttatatgtaatgcttatttttgcctatttcaggctttttgtgcttaatgtgcctattttcaggattttcgaaaacatccttanncaaaaaatttnaggggtatatttttctgaatttttgtagtcgcttcttaggggtatatttttgtgaaaattttgggtcgattaatagcctaggagtgtattcttcgttttagtgcatctttgttaacaaattttgtgcaaaacaccaaaatagttaaaaagtaacaaaacgccaaaaaaaagtgacggaaattgactttaatttaaactagagtgcagtgggaccgggaccgggatcgggccgggaattcacggtcatccgaggtcccggttcccggtcccggattttgaaaagctcaggtcccggtcccggtagggcaaccgtttatttattttgtacaacttttctctccaccaatttcctctccaatcctaaccaatcgttacactttactgtaaacccaagccaagccaatttgtgcccatcccagctcactctcgactccacccattttctcgtttgctatttaaactgaactcattccttgcattaataccttttttcctactcactttgactcattccaattttacttacctttctcacttttgctaaataaactcattaacgaacttaaagtcttgctcttgattgggaaataagccgggaacacaacatctttttggtgccacgacccgggaccataaaaagttcccttttcccaaatttctgagcaaggccgagtgtcgaattgctgtcgaggggtggtcgaagctgtgtgctcccaaccgaagagactaattgcggagggctagtcgaagctgtgtgctcctagctgatcaaacggataattatttgagttagtcgatctgtgtgatcctaaccgggctgtgtgccaatttcaaagaaaaaaaaaagtttgaaaaagcagtaaaatgtcaggcgagggaactgatttcaacccagcttttttcacggtggaggaaaatgctctataccaaaccattctcgagcgtttgcgttcttttgaagctgcagtttgcagccaatttcgaaagcttgaaagttgtctgaatggaactgaacgagccacaaaggaccaattgagccgtctccagtcatcgctacaaaatttggacgagaatgaagagatggatgaattcgagactaaggagaaaattttctaattggaagagaaactggaggagatacataaaaatttgaagttcttaaagctaatgtgtctgaaaatttaaaggaatgttttgagaaaattgatactcaggtaaaggaatcgaaatgtttaattgacttgataaatgagaaaattgagtcggtggagaaggaaatgaaattttcgattgacgttgtggaaaccagagtggaattccttgagctcgaaaaatgggcgattcgtcacttgatgaatattggcaggacaacgggcaccatgaccaacaaaaaaaatttgcgcagggcaataattcgtcagaaaatggagagaaaagagatgcagataatggaaaggagagtcatgaaattgaaaatgatgaaaataaggacgaaaataatgaggggcaggaaaaggaaaaacactaatgggcgaaacggagaacttggaagtaatgatggctgaccctttcttaatgaatgtaattcccccgggtgtatatgactgaaacccaagttcgtctttttctcgatggtccgaaagattcatggaccttctttcgctttatccccagctcacggaagagcaaaaacttagccgtttacggataactctttcaggacaagcatggggagaaatggagggtatgagcccagccccaaccacgctccaggatgcatttttgacccctgacctacaatttgaggtaaaggcaggccgacactcaaattactcaaaagcctacgaaatggcacaacattttgaattgctgttagcatcgagaaaacaaagccaagtctctgttgcagaactctcttcaaaggttgaggcattaaccattcagacgcaaaggaacataggaaaaagagccgacgagaggcgtgtctgttattactgcaatcgcccagggcacattgtgagggattgccgagtaaggaaagaagaaagacaaagtggaaaccgacaaagttattataggggggacaggggggctgagagaacatggagaagtgattatagaaatgaaccaagcgaaagcaacaaatggggtaggcaaaaccatcgcgacgaaaattg

SEQ ID NO: 8591 - DNA, 1168 bp, Heterodera glycines
agctgcaccgagcccattttgagcatccgccgcctcccaacctgcgcaaatccaacttcttccacttcacagtcaatctgtacgaccgcgacaatcagcccattgaggtgggccgtcagcaaaaatgccaacaattggctggatttactgttttggaaagtcctacctattcagggttgaaaaaaattccggctaaaacctgctcatttgtgtgttggttgagtcgattaagcccgaattttttagtaaaaatttggcgattgccatagaattggcggctgtcatttaaaatgccgtcatcaaatatacagaataccggaaaaagcttgtttttcggataaggaacaaagatggattcagaataattttaactctctcatatttcaaagtcagtcaaaccctaaaatacaaaaattggcacccatcgccggggtcattaactcattaattacactcaattaattactgtgccaactcgctcagattgagcaggccatctttgccggctttgtggagaaggaaaaggaagtgcacggggagaacacgcgcaacggaattcattatcgcgcatctctgcttttcgctaacggtcagttttttgaattgcattggggagataaagtcctcgagactctggagtaaattttgaaatgccaaaatttggtttggggggatataaaaagaaaatgccgaactctgaacgaggcagcaatgccgagagtcacggttctatgagaaaagagtcgggactgagaaattcgaggagtctcaatcggagagctcatcaaatttgttacagaagttttgaggactgggcttggatgaaatttgtttaaaattgtccaaaaagttaatgaattgtcgtcaaaattctcggtttaaatcgaattggaccgagagtcgagactcttcaaaaaagggggatgagaaattcgagagtctcgagaccggatggaaatgcttcttaatgaaatgattatgtcttggccaagtttaggggaccaaataaactatttgtcagtccttgctcggctcatccactcgcccccggccacacccccgggcatcatgtaattatccgtaatgcaattagggggccaccccgaccgaaaaaaggggatcgactcatttccctatgaccgtttccctatgggccatttccctatgg

SEQ ID NO: 8592 - DNA, 1894 bp, Heterodera glycines
  misc_feature (1831)..(1831): n is a, c, g, or t
  misc_feature (1864)..(1864): n is a, c, g, or t
gctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgactcgcgcatacggtaaactccttggtccgtgtttcaagacgggtcgaacagatgaccggcttatacaccgagaacgcacaactgagagtccgagatggaccgcattggttgctggtacgtgtggcgcgcgagcgcccccgaccaaaagcttgagtgaacacggataagaaaccaaggcacaattcatccagagtaaacagccatccaaagatccgggtgccagactctgaaaggctgacgtgaagaaaaagcacagacagagactggagagcataaggaaggcaaaacgccggcttatggtggcatgtctcagtgcccaggtttcccctccccccccccccctctcccgtgccgtatctcttcgatctcgaatcttcccccccccccccccctcctcccgcattctcgagccattgcccaaatgtgtgtgcgcaataaaagcccgctgcctccagtgccccatgcccccgcccccggcaaaacgtaatttcgctaattaaaaaatgaggggacgtaatgggaggggaaggagggaacggggcacgacggacaaccgcccgcagaagacaattcccctccttggccaaagccgtaataccatggccataaaacgggggtggaggaaggggaaagcaagcaggaaaacgctttttggcacaacattgttaaattggtggagaggagaattggattgacggggagagggggccaagtcgagagtctcgacgggaattcttgcaagaatttatcggtctaaagtcaggaaggtctgaattttaagttttaattcttgaggttttgtttgtttccgatctcgcctcttttgagcgaaagtcgaaactctcgaaatcgatttccagacaaaattctcgggttcgagtcaggggagattcaaatgtttattcccaacttcaattcttttctcgactctttttatgtacaatctcggatcaactctcgggatccttctcattctcgagtcaggatgatagaaaatcatttgtcagatccattctcgacagtttttctatttggtatcaaaaataaagaaatttcaccgattcttgttgcctattttcgacttttcgtgactttgattttccctggaaaaagctatccatcgtctcgacttttcaattcaatttcctccgggtggtcttcgtttttaatgcatttcatcccccgaggggtacacaataatggcacttccctccctccctcacccacttttgtttttgtttttggcattggcgcaaaaaggcccatccatcggtgaccgtcgttccgccaatgtcctcatccccccgttatcccccgggggatcatcacggattggataatgaggtgtgcaactgatggagctggagggaggaagactcattaaggggacggtggcgatgccccgaaaattcattataattgtttatgcgcgcgtcattaggcaccctttaattgccttccctcgttttgtccctcgggggataattagagaggtgcgataatgctcacactttgcacatatgtgttcttgacttttcgaggtcaaactttgaatcgagaagaaaaaaaagtgttgaatttagaagttatacgattgtttgtaattaaaaaataataattcaaaattattagagggttttaattgcttttttanattgattccaaaaaggccataaaatttggcatnttaatttctcaattaatttgatatgccctc

SEQ ID NO: 8593 - DNA, 2577 bp, Heterodera glycines
  misc_feature (2331)..(2331): n is a, c, g, or t
  misc_feature (2543)..(2543): n is a, c, g, or t
  misc_feature (2554)..(2554): n is a, c, g, or t
ttatttgagttcgtcatatgaaaaaatactgggcttctctcctagaaaaattcaggaaaatccatgtccaggaaatccagcttgctgaaaaatggcttggacctgctggacccaggaaaaacccaggcctggatctagccaggtcaggtcggactcgaacaaaatatatttaattattcaaattttcgatttttttaaaacattgtcgcaaccaaaaacgccaataagcggaaaaatttcattttaattaccgtaatttataaggaaattgcatccaattttaatttccccataaatttcaccccaaaagtcgttgctgcgaaaagaagagttgcggcaatcggaacgagacgcccagcgacccggtgatcatcgacaaatacttcctgaagttcttcctcaaatgcaaccaaaactgtcagttttaccgtacccataggggtggcatactgtaatcaaacacatttttgtaggcttaaaaaatgccggaaacccgcgggacatgcgccgcttccaggtggtactgtgtgccacgcctcgcgttgacgtcgacgttttagttggattttttaaaaaatttaaaaatgccgagcggggtttaaaatggaaaatttaattttttgaaaaaaatttctaattaaataattatggcgatcaattttgtaataattggagcatttataattaatcatatttttttagaattttaatatataaatcagtaaattttacatttttggaaaatttttgcattaaaaaaataaaaatttcgaaaaaataatataaaatttaaaaattaattagtgatatataagtacaatattataatttgtagtttttttctcgataaatattttgacctttttttaaatttatgttttcataccgtacaaataaattgtcgcaattttaatgcctaaaactgactccgaaaaacgcggatttgaagctaatccgaaacggaaatccccccgttttttcaaggcaatgtccgacaacatgttcgtgcacaacaattccaagcatggacgacgtggcaaacgcggcagcagtgaaccgtcgatggccgaaggtgaacaaaaaatatgcacattaaaaagtgatagaaagaattttgaccgtccaaaatttttacaaaaaatatgcctaaaaattctgaattttttatagaaatttcttatttacgagtcggaatattagaattcgggcactggctgctgtaggccctcctaacatagttaaaaatggaaatttgatatgttattggtgggcggtataaaactgtaaatttaatagtaaaaaaatgccatcatttaacctgtcgaatatggcatcattagagtgtttttaatcgaaaaatgccaaattcgctccttaacttcagaaaaaatgccatcattccttgagtcttattgatttggtgtctaaaaatggcattttcttcccaatcataattgtttcaagcccatcaaaaatgacatttttgcaatttgacatacaaaaatgctatccaagtcatcaaaaaaatatgccatatttttcaccccaaaaatgccgtcctcattttccccgccaaatgccgtgcgcatattactgtccaatccagaataacacccccaaaaatgccatgccatcattatcattcccatatccccctgtctccccgtcagaaatggcattggcaccctcctcctcatcctccaccgctccatcctcaacaactgccggtggtggcatcgcttcctcttcctcatccgtctcctcttcatccatagttggcacctgttcatcctcatccgccggtggcacaatgccgtccatcaaaatgatttttccgggcgaagtttggtgtcaaagtggtggcacggcgatgatcatcggcgaacagttccacgagggcatgcaagtgatggtcggcggtacggtcacttggcccgaggtgacgaaaaatagaggggatatggcacaaatgatggcatttgccatattttttttggaaaatttgtgccatctttttggctgccatttctatgattaaaaaaatcaactctttaaaaatttgtaaattttgtggtgaaattcaccgaacaaaattttttattttttatttcgcttatttcgttaatttttaactctcagtgaaattcattatttaaaaatgttgtggttagctaacaaaaagtttgttgttgcccccattataaagatggtcactgcccacgcgatcaaagtgaatgtgccggcccgggcaagtcccggcgccgtggacgtggtcgtctgctccccgaaggggcaaccaaaagtgcgctccaatgccatccgcttctcatnacgtttgtaagtgccaaaaataaacatttatagacttatggtaattaaagcagggcaaattccggcatttttggcagtgatcaaattccgaagaaaaaaaatgtattttgtaatttgtttggattgaaatgtttgtgattagaatttgatagcaaatttcacgggactgaattgaaacaaaaatgaaaaatgctaaaacttttcggtagttnaataccctganaacctttgggattttttttttgg

SEQ ID NO: 8594 - DNA, 1553 bp, Heterodera glycines
caaacttgggttaatatttaattttttggacattttttaaataattcgaattttttttgaaattttaaaaatcccgcacggttttcccgcaaattaaaaaaaaaacaattttgagttccaatccaacacggggttctattgtagtttatgcgtccaatcaatgaccattctcagtttcaaaggtcataattttaaaaaaatttaaaattttctcaaatgcttttaattttatgacaaattaatttttcggccgttaaattacgcttttccgttacaaatttgtagtaaataaacaattaacagttctttttaaacacagtttatttaatcaaatccttcgtccgaatccgaacgttccctcggggatgcgggcactcggttttcttcaatctaaaatagaatgaaaaaaacatagggcagctgcaacttgagccctgaattttaatttacgatatactttcaaataaaaatttggaaaaatctcaaaaaactaaaaataaaacaaattttgtccaaaaaataaataaacaacgctttttggggtcaattttttaaaaaagttaataaggtagagttgcggatcccggctgcaaggtttgaactctaatttttgcggaatctcatgggtttgattaatctcacaaatcccgcaattaatttgattgatacaatattctttcattagaactaaatatctaagaaaaaagattaacaaatttaccgccttcagtccggaattgacccatcgaattatgcgatcaaatttgtgtcgttttttcacgtgatcatcaaattgcagaatggcaaaatcccattgctaaatgccggagggggagggaagaaaaataaggaataatacaaaataagaaaatatttttttaactctaaaaacattggctatatttgtggtgctagtcatttcccaaaaaactcatattggccattgcctaacaagggcaaaaaactggaaacaattattaattttaataaatttatgtaattatttgccaatgttaaaaataatataaaatttaattttaaaaatagcatttttattggcctgtccaatttaggaaacgtccaaacaccatcatttttaaatgctgtttaaaactcacaatttgatcgtcctccggaaaccagccttcgcctccattcagttgaacaaaaaacaaatcgcattcgtggacttcgctaatcgtgtcacaatgttccgaaaaataggcgcggacattttctcgctaaaataaatttaaaaccatttaattaaaaatccatttaaatatttaatttaaattcaaaattaaaaaaggaccatctcgtgcgggtcttggtcagcaagaagtgcgcgtgcgcgcagtgaaattacaaaaacggactcttcaccatttgtccgctcaaaaagaattgggggtggccacattgcaatgaattatgcaaagtcctgaaatgggtattataaaatattcaccacaaatctttgctcaaaagcaactaaattttaaattgttaattttttgttttatgaaagtttattgagaatttttgatgat

SEQ ID NO: 8595 - DNA, 1839 bp, Heterodera glycines
agataaagcaaattgttgaggatcagctgagtgctctcttccgatccgcatccgttcagtgcgacactttgttcttcttctgcgctagtgccgcttttttcagcttcatcatccgtttccagaacagagaccgaaacaaggtcacagttggggtccacaaagtgcacattccgcagccattcgggcaaaatggcgagtaacgacaattgccgattgggtcgggcggattcgaggcgacagcaaatttctgaaaatggaaccaattcaatatgaaaagtaattgatgaccgaaaggaattgcctgaaaagatgggcatagtcagctgagggtattgggaggacaaactcttgctgatgccaaactgattagtcgggaaagtgctaaaaattagaacagttttaacttttctgcaatgattcctctcacatttctgactgtccatttgttgcaaaactgctgcttatttccattatcggcgtgagagttgtgggagagaaagtgttgttaaggaattgatgacgcaacaattggaccagcaaaaaggccgtttgacggacggaggccaattcaatggacgaagcgaaggattggcaaagacacagaagagaaatgtactcgcaggggaattccctaaaataagacaaaaccaattcaaattggattgcagcattgacaaagaaaacctttgtgagaaaagcattgaaattgcattgaaacaacggatgccgaccaagtcatttttggtgtaacacatttggacaacaagctccaaaagctaaaaggcaatggcttattgaccaaaacggcagaaaaaaccgacccgcggattatgttcattcaaatggagaatatggcaaaggatctgctcacaaatttcatcgacctgtgaaaattaatttacaaaaatgggataattgacattgctaattgttctgacaattgaattcgttgacgagagaagtgtttccaaccaacggaacattgcttcttcttcacaaattctgcccggacattcgaacattgggccaagggtggcgagtgcgcacatcgcccgaatggcatggtgttcaacagaaatgccaacatcgacgccctttctgaatcataaaagtaaaatgactttaatcagcaagaaaaccgaaccttttgtcgattgtaccaatggttctgccgcaccacgacaaaaacaaaaagaacagcgaacgttttatgtccggtggtaacagtttctcgcgttgttcaactgataacagaattaataacctccaattttttctctctcacttggcgtgccgttgatgatcagtgaaatgagcttggcaaaatgtagtctcaaactggtcaaaacgttcaggtcgcggtcctttttatatgaaatttttagaatttagatgcaattacatgatatccatacattgtcattttctgtatgaaaacggatggagtcgaacaattcgagcaatgactgaggcaaagtgccagaatttcgctcgaaaatagcacaattcttcaaaaagtcacgaaaaagggtaaattcaatgatccgaagaatttgtagtcgtaacaaatcttttcgcttccggcgtcgaacatttgtttcgtttttacggtcatttatctctctcaaaatgcctttggaattaaattcttcgagtagaaatctaaattaatcagtgtaaaaacagccaaaaggaaagcatcctactcgaaacattcgggatttatcgagccaattccgagtaccaccgaatctcgcacatcggtcgcctcccaacgaatcctttagaaatttctaattagagctgtcaaaaaaaaaataaaaatcaaacgctactaaa

SEQ ID NO: 8596 - DNA, 3427 bp, Heterodera glycines
  misc_feature (3407)..(3407): n is a, c, g, or t
taaaaaaatatgtggaaatgacgagctgaccgtggaagctgttgagcactgagtgggcaaaaatttcttctcgcaataacccgacaaagcgcaggcccatggatcccattgcatatacccaaacaatgggaaatgaacaaataaaatgccttaaaatgcttcaaggccgtcaactcactcattgccattggccacattcactaaattcgcgtctgtctccaacatcgaaatgcgctcacaaaccaatgcgaaatcttttggccattttttctataaaataaaaaagcacaattaatttattaatattagctgctaaaaccttttccagcgccggaagatgcacgacgtatttgtcaagaacgtacggagtcgcggaatccaaaatgtcaatgaccgccatttcatgattctgaagtttaattgttagtaattgaaaacaaaatattgtattgaccaaataaaacttaccgatggtttgaacagttctatcaattgtttgacctctctaagtaattgaatgaccgcctttttagttgaaagacgagtttgacacagcaaagcaatgccaagtccttcaacacaatgcaaaacaaaggtgggattgatattatcagcgaaggaaagagaggaaatgatggaacggatgatttggggagacccatctgaaccaaaataaaagttgaaaaaatgggaaacaatggcaccagagcaagaggaagttgtgttgcccgttgaggatgtggacgtggcgatgatattggccgctgcttgcatcaccaatttttgttggcttggcgttgctttctcggccatcgatgggttcgtctgcgctgtcgattcgctggcggacggataatgcttcgtaaaattatccgaaaggttttgagtggactcttcgactttcttccgttgctgctccatgagaatgttcgccttccaaacagtgagaagttgcaacagcaaacgaaccattgactcaatcaaagcaggaaaagtatcctttaaaagtaaatgtaaaaatgacatcgaaatagtcacccacctgaatcgaactgatgaaaaagcgaatgaaattgtgaatgatgtcctcccgccattcggggcattcggtgaccaaattctgaagcgattggtacgccgttgttcgaagttcttcgtcgacatgaatgcacattcgagtcaaaaagtcaatcaagtcctggtgggacattgggtccggaagaagacgaggaatggccgcaatgcacgtccgaaaccttgactaattgaatatggtttttgactaaaatgtgcaatcacaagtccagtttggctttcatgtccgcgccgattaaatcgttgtattccttcccccgcatttgtggcgctgtcatcatcagcggtcggcctgtcaaatcgtttaatttcctatttgtttttttttgtaaattaccaatttgtccgtccaatgttcgcaaaatggcatcaaatgccttcctacagtgcggataatattgttctagaccaatggcccgggcaacatccatcgacaaaggtttggtgatgtaattgcgctttgttcgatgaattgtcccgctagtatttggcgcttaaacggaaaaatttaaacaattttaataagtcaaaaaccaagtgatctcgacattcccgggggactctctttctgctggagaccgtccgcgatgaccatcaaagcgcgcagaccgacattcattcgttcgggataaatggccaattggcgagaggctgctcgcgcacatccaatcaaatcgaaaataatctcctgacagtaatttgaatattattctttttgatttttcatccaaaaacattactttaaatgcaaagtcaactttgaattgtgcaataaaatggataattttgacaaaaaagttcagcggggcatcacgcggaactaagtttcgcgagccacgagggaaaagacttccgcaaatgctttcgaggcctaaaaaagcaataaaaaggggcaaataagagtgaaattttattttaactttgataaatttgtaaatgaactcacggctccttgtcgccgtattcccttcacaacttattcgaattatgtaaaccctaaaagaaaataaataaaatgaggaggaaaagtgaattctgaccaaatgaggcgatagagcgattcgagtgccattcgggaaaccatcgaatctttgttcttcaaatttgcaagagtcaaattcaaaaattgaacccaagtggaaaaggaagaatttgcttgactaatgcacaaaagacacgtgagaagagggtaagaagcctgaagaatggacaggtaaaaaacgacccaaaaaagagggaaaatataccatttttgtgctgttttttgttcactaattcgtaggttgggccgtaaagttgtcaacaaaagaaatcagtgaaggaatgttcgtttctgttctgatttgctaaaaatgaaagataagaaaaaacaaaaaacatgttgtttttctttaatccgcccatttttgtcctttcgaaaaactaattgtaaatgtaataaaaatttggaaattgacggagttaaaattaatgaattgtttttttaaaacaaatatcccgggtgattaaaacccaccgctgtcatgggcagaagaatctcaaccagaagtccagccaacgcatgcttcaaatccttttgtttcaaatccacctccaaaaaataagagccgagttcgttgagaaaacccactccaatttcaaattccgacacttggttagtctgaaaatgcatttaattgtgtttcaaatatgattaatatcttcgccaacttgcctgaactctgaaaaacttcgttcccatcagaagagatataatggaccgtaaagcaattgagctggtgagggcgtcctttctgtactcattgaggtggtcgaaaaaagttttttgaatttgtttcgaatgactttgggacaaaatgccgatgacttccgcgaacagctcggccaccaaaagactgttgtcataattgtttccaaaaagtgctctaagtgtaggatattttccaaataattcatttccggtaagaccttattgtgtttgacttacgggtctcggtaagaaatttgtttaaacgaattgtcgatgataaaattgatctgctcgtcacatccgcatgggtgaaaatgcagctgaggaagaatttcgatgagcacaatgcaaaaaaggtaactggccgccaatgtccgtttaattgccctgtcgcgagcatcgctaaattttgaacagtttaaaacaaaccaaacaaaaaaaggttacccaatttcggttatagaaacacgctgctgatgctcgtaccacatgatcatcactttcaatatggacggaaggcatgtctcacaaacgccactaagtgccctcagcaaattgcaanatacgaatcatcgcctcgac

SEQ ID NO: 8597 - DNA, 1876 bp, Heterodera glycines
  misc_feature (1707)..(1707): n is a, c, g, or t
  misc_feature (1807)..(1807): n is a, c, g, or t
aaattttgtattttcaattttttcgctgttattttttttagcaattttataacaggtaaatctgtttgccttgcattagtcaacaaccatgccacgtatcatccagcttcaacaagaagttgttgataaaattgctgccggcgaaggtctttaaaacttaaattcctattttaaagcacttcaattttttaatagttgttgttcgaccaatgaatgcggtaaaagaattgcttgaaaatagtttggacgccggtgcaactgaaattcgtattgaaatcattcaagggggacttgaactcattagaattcaagtaaatcattatgaattattgaaatctcaagggggacttgaactcatttgaattcaagtaaatcattatgaattattgaaatctcaagggggacttgaactcatttgaattcaagtaaatcattatgaatctatcttcgaaatgatatttcgaatgaaggacaatgggcacggcattgcccgggaggacatgtcattggcgtgcagtcgttttgccacctcaaaattgcatgcggctgaggaattgcgatccattggcacttttggctttcggggagaggctcttgcttccatttcgattgtggccaacagcgtcacgataacatccaaaacacaatccgacaaatgtgctcatcgtgctttatatcgcggtgaattttggatatttacccggaatattttgaaaatattttaaaccaaaaaggcaggtgggaaattggagtccgattgttcctccgtggcgggtcttcaaggcacgactataaatgtggatcgcctttttcaaaatgccccggcaagaaaagcagcattacgttatccgaatgaagaagcgaatagaattgccgatttattagtcaaatacgccatccaatttccgtgagcaatgcaaaaaaaaaatcggcgaaattcattgttattttcactaaatgcagctcagtcagctttgttttccgtcgtattaacagcggaggaggaggcggcagttgtggtgactttcgcacaaatggaaacggagaccaacacagcacaattcgcacattactccatgccaaaatgtccaaggtaaatagctgaaatttttcgcatttactcatacatttttcaaaaaacgtttccaggacctgttcaatatcaacattgacgacaaagcattgcattttcgggctcagttctgtttgactagtccttttacgttttttacctccaccgctattcaggcgaaacaggcaaataataataacatttgttagaggacttttcattaacccttaggatcgtcaaagggtgtttcacttgttcatcaacggccgttgtgtggagtgcgttcggctgaagcaatccatcgatgctgtgtttgcatcgaaagatttgtactgtccattcatatctctttcacttttggtaaccaacaataagtgcttttcgatgcccatttaccgtcctaattcccccgtcctcttaataaagcctttctttcgaggggtttcgaaaaatgaatccccatgggtattgagaaatactacggtaatcggttgaaaatcgttttatttttttgatttttggatcgatgcacaccgagtcgatgttaacgtgcacccaacgaagtccatcgtccactttctggagcaggatcttattattgagagaatcgaacaagtgttattttttgttattanattaaattaaatttccaagatattaattactgttttacataataatcacgctcattgtgtcaggaattgcatcatatcgccagccaatatcacaaaaggngcaccattgaattgcatgtttccaaatcgactcagatgacactgctcacagagtgactttctgcctctt

SEQ ID NO: 8598 - DNA, 3455 bp, Heterodera glycines
tgaataaaaacacttttattagagcaaataccacaagaaaggaatattaaatatgatcagaagcgatcagaggcatattcgcattttctgatcactcaatttgatcgggtgggaaaagggttgtaatcagggctggatgtaagtgattttcttcggaaatccataatccacaattacggcgattttctcaattatccgcaatccgtcattatatagggttccaaaaacgccgtaatttccgaaatctgtaaattacgtacagccctagttacaatttgggtcaccatgtccatgctaatgagagagatatgaatgaagcctacaagaaaatcttagtttttttgaaaaattctaattgtaaatcttggttaatcaacttcatctaattttaaatatcaatcgcatattattacattatttccctggaaaaaatttttgatcaaaaaaatatgtacattttcaatgagttatcagagtggagaattgttttgcgatttgcagccgaagaggttcggatgtgggcaccgtaatcaccaattaccgtagcagttgctacagttaatcatgcaaatccgtttggcggattgtaaattgtcttttccttgtagtacacctcctcatgctctttgtcacagatcagcaacaaaagtgcgccaaatacaaagcttaattaggggtttttttaataaattatatattttttgtttttgcttccttacagtaatgctccccaagcgacaccgtaagaccagtcaaactcccaatttcgaagtccatatgaatgaatggacagatagaagcagatggggaagccgaccaatgcgataagttcggcgagtactgaacaaaaagtggcagattaccgtagatatttgctacgtgtccgaaacatataattagttactgtaaattagagttaaaattttttcgaaaccccaaaataaaatttaaaaaattcgggcagattcagataaaaacggagttagccttgatcactgataagaattgagaaatggtcgctcctttggactctttccggcaccgacttacgcccataaaaagtggcacacaacataccagacaaaagggacagccatgtggcagctttgtagaacacgtactttccgcctgcggatcacgcgcggacttcttcagtagcccgtagtctcgccccacctactggccgccgtagtcgagtgtgcggcggttttttagcgcaatattattaaacttaaatacctatgacccaatggccttcaattcttctccctctgttgaattttctttttccaaatttgctctcatctaattgcactattgagccgcgccctccgatttgtcctcgctcctgttctctttccaaaaaatcatcaacaatcatttcccggcagtagtgatacctaatttgataattaatttgattttataatttttttaaaccatgccgcgacactgtccattcctaacatcgtgtcattttcactttccattgtttcaataatacattttttgtatttctcttgatgcgcaaatgagtacataatactaaataataattattcataaaatataaaaaatatagttaaaaacaacaaaaaaaaagaccttaaaatttttgacagtggcatatgtgcattttcaaaccacgaatcaacaaaaagagctttttctgctctacaagtactgcatatgaatgagccggccctgcctctgtttttgtcaaaacgcatttcctttttgtggtgccgtgtcggccgttttccatagcagtaacgcacatttgttaacaagccgttttcaaggctccaatttataactttttgctcatctccaaaaaaatgtaagagcttgcgtctattccaaattgcattaatttgaatattatcacccattattgctaaaattacagtattaaatagatgtataacagcatatttcttgataaattcactcaaaaatgacgtttttttgaaaaatttcaaatgttgataaaaaaaaatttttcactatatgtcgccactttttcatacatttttgtgaataatattcaatattaagcagttttataacaaattcatgtcattttttcgggtgggctgagtccaagttttacctgtatcccaattaataaaatgtgtctttttgttttataatattgtataataaattatcaaaaatttataaggattttcacattcacttttgccaaagagttcgtatgagttcgtttcaaccgcatcaattttggcacaaagtttcgtctgctcattttgcgtttgcaaaagacgatcagcttaaagcaaaaaaattattgttcctaataagttaaaatgattaacaattaatccaattttcactcacaaacaatgccaatccgttccaaaattgcgttcagttcgcctaattttgaaattagttttaaaagattaaaaatgcttcgttacagtaggcattcatttacttaccgtaattttccgtttccttttcctcgtccttttgctgtttcttctccatttcattcaatcgtcccaaaattgtcttctgttcattttgcaattccaagatttggtcaataagtgcttaaaatattagggacaaattattaaaattgttttttaaaatttttaaacagtaatttttacagaatttccttttaattattaatttaattttttaatattaatttaattttttaattttgcaatttcaccatttccgaatcggtagttcaaaatgtcaacacaatttttcaatttgttttgttgttcttccaattcagtgctttttctttgggtggcattggcaacttcggcattcgcatttattttctgtgacaataaaaaataaaaataatattatgtaattgtcattatttgtttctattttctgtttaacgaaaattaaaaattaagtcagattttgttattctttgaattctaataatttagttttgaattttataaattttaaaaatttaaatcatttccacctcatcaattttcattacaaattcttcgtgcatttccttaaattgcccaaatttttccgacaattcatcgattttggcgcaaaattctgactgttcggcattttgttgttgtataaggctatcagcttaaagaaattaaaaatatgtacaattctaaatcaaaatttaccgtatttctccttctcttcctgctgttggttcacctgcttctccaattggcacattctttcccgaatcgcttcgaactgatcagcagaaactgaaaaatactgaactttatttattagttattacaaaatttaaattgtatttacaaaaatacagtatcactaccgtatttaccatgctgattattgtcgttctgctgttggttcacctgcttctacaattggcacattctttcccgaatcgcttcgaactgatgtgaagaaactgaaaaatactgaactttatttattagttatta

SEQ ID NO: 8599 - DNA, 1113 bp, Heterodera glycines
ttgtcgttctgctgttggttcacctgcttctccaattggcacattctttcccgaatcgcttcgaactgatcagcagaaactgaaaaatactgaactttatttattagttattacaaaatttaaattgtatttacaaaaatacagtatcactaccgtatttaccatgctgattgtcgttctgctgttggttcacctgcttctccaattggcacattctttcccgaatcgcttcgaactgatcagcagaaacttaaaaatactgaactttatttataagttattacaaaatttaaattgtatttacaaaattacagtaccctaccgtatttaccatgctgattgtcgttctgctgttggttcacctgcttctccaattggcccattctttcccgaatcgcttcgaactgatcagcagaaacttaaaaatactgaactttatttataagttattacaaaatttaaattgtatttacaaaattacagtaccctaccgtatttaccatgctgattgtcgttctgctgttggttcacctgcttctccaattggcacattctttcccgactcgcttcgaactgatcagcagaaactgaaaaatactgaactttatttataagttattacaaaatttaaattgtatttacaaaattacagtaccctaccgtatttaccatgctgattgtcgttctgctgttggttcacctgcttctccaattggcccattctttcccgaatcgcttcgaactgatcagcagaaactgaaaaatactgaactttatttattagctattacaaaatttaaaacatatttctcttggaagtaatgtaaaagcaaacaaaacttacagtaacctatgtactgtatttttcttgtttgtaaatgccctttactttgataatttctgctaccgtatgatcaattttccctaccgttttcgccctgctgttcgtcctctttcccattttgcttgttctgtttcatttggtgctgctcaatattgacaatcttcgccttcaacacaatgttttccgtgatcagtttctgtttctccaattcggtacgaatttctctctaaaaattaaaaatgcgctaaaaaaagaatttaagttatctt

SEQ ID NO: 8600 - DNA, 718 bp, Heterodera glycines
ttcagtatttttcagtttctgctgatcagttcaaagcgattcgggaaagaatgtgccaattggagaagcaggtgaaccaacagcagaacgacaatcagcatggtaaatacggtagggtactgtaattttgtaaatacaatttaaattttgtaataacttataaataaagttcagtatttttcagtttctgctgatcagttcgaagcgattcgggaaagaatgggccaattggagaagcaggtgaaccaacagcagaacgacaatcagcatggtaaatacggtagggtactgtaattttgtaaatacaatttaaattttgtaataacttatgaataaagttcagtatttttcagtttctgctgatcagttcgaagcgattcgggaaagaatgggccaattggagaagcaggtgaaccaacagcagaacgacaatcagcatgggaaatacggtagggatactgtatttttgtaaatacaatttaaattttgtaataacttatgaataaagttcagtatttttcagtttctgctgatcagttcgaagcgattcgggaaagaatgtgccaattggagaagcaggtgaaccaacagcagaacgacaatcagcatgggaaatacggtagtgatactgtatttttgtaaatacaatttaaattttgtaataacttatgaataaagttcagtatttttcagtttctgctgatcagttcgaagcgat

SEQ ID NO: 8601 - DNA, 1145 bp, Heterodera glycines
agaaagaattttgaaaaactaaaatacattcctcaccatctttcgatctatgataatgccaattttgcctttttaggagttttgatcggcataaaaaagagttagatgaagaaattgaaaagtgccaaagtgatctgttgaaggcaatgggtttggaggaccgcgaagtgtccattgaatgcatcaaaggcgcactgtttctccaaatgtttcaggaagcagtgaaagaaaaggcggatgaggagctgaaagcattaaacagtaagccagcaaaggttttccattgctaattccgggaccaggtcatttgggcgccgacgttctggcgccgacggtttggcgcctatttttgagaaaatcgaattttgcctttttgcatggcaggcgccaaaacgacccttgcgacaaaacgttggcgccacaacgatacggaaaccggataaaacataaatttttttcaatcccagatagccctaacagtattaaagttaagaaaacactgtcttctagtttatttttataggagcattttatttctgctgtttaaataattagttatttttcaaaaatttacttactatcaaattatcagacataatcacttttgatcacttctataatgctgtttaggcttgaaaaatcttaagtttgaacccgattttggacataggcgcaaatgccctggctcaaatgtggggtaaacattgttaagcaaattagcaattttttaaaaattcaaaaattatatattactgagaggcggaccaagcgtctcaaaattttctgaaaaattccattgaattccggtttcatccggattctaatgaaattacaatcagccagaaaaaaaaattcaatttgtaggatattgttggtttcaagatcacctagtaaatcacgaaaaccatatttctacaaaacaatattaaaataaaatgagagaaggataaaaatgtttggcatcgggtgggaatcgaaccccacgcgaccacccgatggcagttctaccattgagctaccgaggcacatccgccctttacttttatggatcttatcaaagcccgctttccgcgttttaacctagggcttcgatcgaaaatttttcaaaataagaacatcaggttcaaaaaatagatttgtggtcg

SEQ ID NO: 8602 - DNA, 3205 bp, Heterodera glycines
  misc_feature (2834)..(2834): n is a, c, g, or t
  misc_feature (2836)..(2836): n is a, c, g, or t
  misc_feature (2930)..(2930): n is a, c, g, or t
  misc_feature (2932)..(2932): n is a, c, g, or t
  misc_feature (2934)..(2934): n is a, c, g, or t
gcaattatttaaaaattgttgcattactcggtaattaatagggatacgatttttaggctataaaaaaccccaaaaataggcacttaaaaaaaagaagaaaaattggcactaaaaaaagctgaaatttaggcgtgtaaaacagggcttccatcgaaaatttttttaactcaagacatcgggcccaaaaaatcagattttggggtcaaaatcagaaaatttcacgaaattacttcaaaacagttatttttacaatttatcctatcaaaaattgatcaaatattatattttcgcctcccattatcggttttaaaaattttggaagggaaataagcaaatcgtaaatttcactgcattcgagatcatgaaatcagatttttaacattttttgcggcacatttcgaaaaattgtgcaaaattttgtgattctaagacaaatctttaagaaaacaaagaatcggaaaaatttttgtaattttaatgcgatttgttaacagatttttgtccgaaaaatgagtaaatttgccacaaatcttatattttcttataaattaatgccattttgccataaaatttcaaaattatgattttatttaagaaatcagaactaattttggtcgctacctccaaatcaggacaaatctgacatttttattttatcagatttggaccctacaaatcaggacaaatctgataaaacaggacagatggaagccctggtgtaaaatgacaatatttattcaaaaataaaacaaaattaagccaaatcagaattgaattacattatttttttaaatcaaaaatttgtcaagaaataaagaaataaattttggagacgaatttttgagaaaattttcatttcttaggggtgtattttttgaaaaaaaaatttaggtcgatttttaaggggtgtatttttcgtttttattgcattttttaataattttcggaaaaattccaaaaacaggttatttcaaaattttttagtctttttaaactctaataaataaaaacctaaaataacattaaatgaaatagtaaatgaatatggtttatgaaatgacgatgttcctcatttgcactcaatttttaaattcattttagtattcgtgggatgttccattctgtgcggaaatcgtttcgctcaaaaagttcaacggacccgaacaaaagatatggttttatggaccttttaaaggaaatggaggatacaattagaggaaatgaatttttcatgaaaaaagtgaaggcgattacgaagaaagccggaattaaagaaggaggtttcttaattattgcaaataattaataagaaaagatgggggtctttctgaatcgtttgggcaacgggataatttgtagtgatgctcgagaccgaaaatttcccaagactcgagaccgaaaacgcggaagtcgagaccgaaacgaaaaaacccgagacttttcgtgagtcaagactgagactctcgagcatcactagtggtttgggcaccgccgtttgtgcgtcatagtaatttagaccctaccatttaagctacagtagttttgagtgtctatgtttgtgccacggggtcccgcgttagttgggcgccttaggttagtgcactcatatgaagggatgggaatttaaggcacgaaaaatctacaaaaagtcgactaaaaaagtaaaaatttgtcaaaaaatcaggaaaaagtcataaaaaacgctaaaaagtaaggaaaaattaccaaaagtgaaaaaaaaaatttaccgttttggaggcggagattttaaagtaaacattttgcctgaaagaatctgataaagttgggcaattgtttcaattcccttagtcttctgaataattacgaaaattttctgttggatttctattcaattttcactgatcgaaccttttcaaattttgccataaaaagtgaaaaagtcccccaaaaaatgataaagtgccaaaaaaacataaaaatccaaaaaagtagaaaaaattcaaataaaaatgcatgttagaagcttcttgaacaaagtgtaggacagtttttaagtcatttgaaggtcatataaaatcggcaacaaaaagaagtcatttgactaaaatcaaatccctaattaattgtttaggattaattgtttaggaggattcggcgcattggaccaatattatgcaaaagaagctcgtctggtttttgccaaaggatcgggccaagattttctgcgcaatatcattgacctcagccagtggatgactgcgaaggaggtgcgcgagtgcgcggaaaaattcaaatggatacgcgggctcaacgccaaggagtcgtgggacattgaagtgaacggaagtggaaaagcgtcatcagtgtcggctgatcttcgcaaagaccaaagcgataaagctattaatgatcggcataatgaagataatgcttatggtggtacttttggtagtgaacgtggtggagaagacgaagatggaagtggttctggtagtgaacaacgtgagtatgacgaagatggaagaggttctggtagtgaacaacgtgaggatgacgaagatggaagaggttctggtagtgaacaacgtgagtatgacgaagatggaagaggttctggtagtgaacaacgtgaggatgacgaagatggaagaggttctggtagtgaacaacgtgaagatgacgaatatggaagtggttctggtaaagactgataaatcttaggaacagagagagagacagagagagagaggtgaagagatagaagattaagttagaagtgaaaattttagtttttatcccaaggttttcgttttttatttctatttttgtccgaattttgcacattcattttnanttggataaatgtttttttgggattgtttagggtggttaaaaaaatatatttttgaaaattaattgaaaatttatagaaagtggtaattttttgntngnaatttatttttggtagattttaaataaaaaatttttttaagaaattgagttaaaaatttgaaaaaagattttttaatttttagggtgagagtggggaagttttttaaataattaaaaaaatgtatttatttgttttgggtgtgattagtaatagtgaatataggatgtagagttagttaaagttttgattaaatttttaaaattattttagttattaattatattttggtgtggtgtatgtttttattttttggtaaagaaattttttttt

SEQ ID NO: 8603 - DNA, 1908 bp, Heterodera glycines
  misc_feature (1886)..(1886): n is a, c, g, or t
  misc_feature (1900)..(1901): n is a, c, g, or t
attttttgctcgcaattcatttttggtccattttaaacaaaaaacttttttaagaaattgcgccaaaacttccaaaaaacactcttcaatttttagggccagactgggcaacttttttcaataattaaaaaaatgcatttatcccttcccggcctgattaccaatactgaatccaggatgcagacttacttaaagttccgatcaaactcttaaaataatttcagttattaattatatttgtgtgtcgtatgctttattttgtgtaaacaaattttttttatcagtacacgctcttagaaaccaggacattatctgtttttgcttaattattttacaagcaaaattgggataaattcaaatcaggacatatatgaaaaatcaagacattttcgatttttttattaatgccaaaaaagagaaaaaaattgagcaatattaaatgaaaatttttcattattataaaatatttcactattatttatttcaaattgtaaaaatgcatttttggcaattattattttttatattttgctttgtttataaaattgaatccgtcaaaatccgaacaaattttgatgaaatatttggcgacggatgggacaaaaatgaaagtgaacaaacagtgaaaattgaacaaaatcagcaaaatgaacacttggaatttattcattttcaccaacagaacagtgatgaaatgggaaatgaacaaattgaacaagtggccaattggggtgatgaaaacattcataaaaatgctcagaatgacaaaaataaagaaaatggtcagcaaaaaaagagaaataattaaaaaatttgatgcaattaaagaaaagttaagggaaaaaggacaaaacacaagcaaagacaaagcaaaaattgaaatgaaaattggaaaattattaggattaaatcgaagtttaatatataaatggaaaaaagaattaaatttaaataaaaacaaaataaaaaagaatttttatgatgagaaaaagcgcaaattcattgaacgatttgatgaatttaaagaattatatggccaaggcaaacagaaagaatttgcgaaggaattgggcatttccaaacaaacatttataaaatggaaaaaagaattggtgccaaatgaccacaaaagtaaggcatttttgttttaatcatttaatataaatttacatatattcagaagaaaacaaattaagaaagatgaagcattatttgcaaataaaagaagcaaatccgaaaatgagcgacgaaataattgtgaaaaaatagggaattggatggacaactctgaatagatggaaaaaggaatttggttcattttaatatgtgatttttgaggtagcctatcaaagataataattagtattattgtttgtcataattaatggcattttacatttgtttgtatttaatggtcgtaaaatatgacaaaagctacagaaagtttttaaattttttttcaataaccctaacttcactagtatgttgttaaattttttaaaatttttggttaatttcattttattaattattgttccaaaatattgcatctatcattcaaaaattcccatctttactgaatggaaaggagtcattggtcatttttcagttctaaacacaatttaaaccataaaaattctcatttcgccagaattttcataaaaaatgctggaaatgattttacaaaaatgtaaaagttatatcaaattcaaaaatgtttaagaaacattattaacagtgataaatgtgcttcatttgatttaccaaaacaaaataataaatttttttttattaatattagataaagtccccaaaatttttaataataattttctcaaaaaaaaaataaataaatagatcgatttcattttgatagttgccgaagnggtgccaaagaccnntgcaggc

SEQ ID NO: 8604 - DNA, 2097 bp, Heterodera glycines
ctaatagcacggggacgacagactgaggaaggaattggcggaagagcagcagcaaaagcgatgggccaaagtgcctccgcagctctccggacactgccgggcccattccattctccctctcattggcactgcccaaatgccgtgccgtgccctgtccccacctcccggggcgcctcaattcgcctccctttgttgcccttcttttactcttcggcttttgaatgccgctacggctgttaggagcaatttgttaccggtaataaatgggcgattaattcccggaatacttatgttcaaagtcggttgagattgacaggcggcgctaaatattcgctgatgtcccccactctttgggtatggtgggggaggggaggaaaagccatcggcagagcgaacgatggcacgaacatttgtactgaagaagttggcaacacttttcctaattccgtctcactttttattgttgtaaaatgatacttcctcaaatgctcttcaccccctcccccaaatttgtcccaaaatgcaattattaatcgccgaccgtttctttcccgtcagtttggctgctcactctttcttctctcttcttacataaacggcaattaacttttgcttactcacttaattctatgttttcccctctccatttgctccgatttgctcgacaattgcccccatttggagtaaacatgagaagcttgggatgatcccccggggatgcgttttctcatcccccccccctctctttcccttcctcagttaccaaatctcagccaaatccatgctgcttgttttccctttgcgtcattgcataagcgtgtccaatttcttgacaacaaccaatttgaatcagttgaaggcaaaaatcggaaaatcagtccaaaaatggcattttccggaataatgacaaaattaatgtaagtgttgaatcgcttattcatttccgcgcatctttcgcaccaatcgcttttaaagtggcggtgcctttcgcttttcccgagattcccatgccaaaaagggcggccatcgaacagacaggaggaagtggaagggaggaacaaggtcaccactattcattcctctgctcccctcaactcggctttctctcctcgtcgctcatctctcctcccacctccgtccgtccatcagcccattatcgtcatcatcgcccatcaatgaatgatcaatcgttcccccatgtccacgccaacccatccaatgaatcgcgccacttcccccccccccccctcctaataaaagcatcgccgccaccgcatttgttcatcatgcaaaaggggggaaatgatgatgatgatggaatggactgctgtggataatgaatgcattgtcctcgccaagtgcaattgagacaatgaccactgactttgtgactttgcctttgcctttgcttttgcctttggggcactgctggcgatgcgtcggcaatttgtgttttaataaatgcgaaggaaagggacaaaaggaggacaataagtgaccaaagaggtaataagtgcacaaagcaattggtggcaccaaataataacaaaaagtgtaacggcacaaactaatccgaaaagagagacaaagtgcgaaattatgccgtgacactaaatttgaaaatggattattagggattgtatttcaaaaacaagtttggaggtttcaggggcagataataaattactaagtgattcttacagtatttttgctactaaatttactatcgtaattctctttgatggggtggtgaattattatttttgtatacatatctctgtcattttcaattttcatttttgctagggcaccaaactttcaatgcccaattcctccttcccgtttaggcattttctctgattgtacggtgcccctggcgttttgcattgcgtctattgccggaggatatcagccaaatagcgataattttcgtttggggcaactgagttgagattgtgtggcattgcagcggtgcccgtttcccgctgtttgcaattattgttccctgctgaatgctgaaaacgctatttgttgggaagggggcaaaatgggggggggggggggaaataggggggggggtcgaatattgtgtcggat

SEQ ID NO: 8605 - DNA, 1654 bp, Heterodera glycines
  misc_feature (8)..(8): n is a, c, g, or t
gaaaatcnttggccttaaaaagttatattgactcaaattaggctcagacggagttggcccgttccacccttccctcccacttttcccccattggccctttctcccctccccttgaaaatgagcatgaatccttctattttttgatgaccaatttacctgttcgaatgtttttgtcatttgggttttcatatacatatattaataaggtaatcaaacaatttttaattgctcattttgtgcttaatgtcttctcgcgttgtgttacacatttcgcactttggctgaacaaatgaaccaattcacttaacaaatggcctcaggcacaatgaaatgaacacaaccaaaagcagagaaagggtggatggataaacaattattctgcggacgcaattcaaaatgagcgaattagggaaatgggcaatgggggggggagaggggggcattgagtggatgagcagcagtggacaaatgcctcttgggggaggggacactgaaagtgctgctgcttttaatggacaaacgcacggaattggggggggggggactgaacgacttgagggcggagattggccaaatccatcaaacgcacgcaatttgaaacaaaaacgagacagacagaattcaaggcgagactcacagattttgagccagcgtgaaaggtgaaaagacccgcccaattgggctcaatgacaatgatttgttgggtaatcgttggaatttgtctttggcctaccgtatgctctctgtgttactaccgtacactcgcgtgaatttgaaaattattgtaatgaaatgagaggaaaaacatttgttcttcctcctctcgaattcactttcttcgcctcccgtcaccatcgcatcaacaattaatcccatttcaattacctccatttgccccttaatttgctcgtcccatttgtctctccgtccattggccttgaaccaatccccgtgttcttttcctttgctcatcttcgacgggtgatgagcatgcaaactttttttgagacggacattcgggggatgaataaataaatagcaacaaaagcagcgaatgaatgaaccaaccaaaagtggggtgatttccccgattcccccccccccgcacaaatctttcattatctcgccaagctttctgctgctgctgttcatacctaattgcgtttcccagccttgacgatggaatccgctgacaaatgggagggggggggggggagaaaagtgggctaacgagaggggggggggagagcagcgaatggcccccgcgggggggggggggaagatcgccgaccctttcttcctttgctttggcatcccttcgcccccaaaattacttttccctacttatttgtcgtattaagtgagtgttaagcgaggcgtgaatgttatgtgtatgtatggcctttcactgaccgttttccgttgaataaaatatggcgtttattttctcacaaaaatctccaaaattgggagggggaagaaagaatggggaaaagagagagggaggccagagaaaatgggggagaaaaagaaagagagacacttaataacataacgtagctgatgaatgaaagaagaaatggcgatgaaacacgcccatccattctacgccggagggggggggggaatttcaagagagagagagtacggaatg

SEQ ID NO: 8606 - DNA, 1460 bp, Heterodera glycines
  misc_feature (51)..(51): n is a, c, g, or t
cagtgctgatggattcaatgagtaagtgaatgtttggtgtgattgttggtntagtgaaagggacagatgaataaaagggacaaagcatcgaataaaacacttcgccgccactgcgtcgcatcaattggactgaatgaacgacgcccaattgggggggggggagggattggattgagttggggtgaggtaaattgagtaaattgagctgatccaccggcgaatcaatgttgggggggggatgagaagcggagaggggaaatgagccaagcggcggactgacgaaggctcaaaactgcgcgcagcgaattgttgggtcgcggtgagaagttagcagcacaggggaaaagcgggggggggggggcaatcccgaagccccaataaatgtaatcccttggacaaacaatggccgtaggggcgtcggacgacactctccgccgcccagggggagggcgaagagagagggcacaaatggttgtgccatttgagtgaacagattcaaaactgttaggttttgcattcagaaggttacttcagcagatggaggggtcatttaattgttttaaataatcgcttcgaaattcgaatccttcttctcccccccccccctcattaattgcattttgccttttcttccataacaattctttatccccttccctctttctttaattatcccattttgaaatgccattcattttctccccctcttttcaattgattttctctgattttgtccgttccatcctccgatccctccgttctcttcatgttctccgctgtcattgcttatacgacttcaatttcaagaaggaatgaatgacgcgagtaaaggaagcctattgctgctgatggccatctcccccttcgaattggtcggcgtgaaatcggatcagtcatcaatatattcggatcgcaaacagctcttcccccttccgcccttccccttcccttcccgcgcaatggcccaccctttcttcttattctcggctaagaccgatctgtcactcgttggtgatgatgctgttgtacacattccccaaattcaaatgccttcaatttcaaccttttttatgccgaaattcccaacttttcaatttgggctcatttggtccttcgctgctccccataattttgatatgctttttaatttcgtcagtttcgtttcattcgataacaaatgcatttttctccttattctgcgcggtttatgtaataaagtgtaaaatgtaatggtaaagcaaaacgagcgaataacggacagcgcagacggagtgcattagcgcccgtcatcgtccgtctgtcattcgccgttttggctatgtaatgaatgagtcgacaaaaactgtggagcattgcctcccgcccccccgttgcctttgccccaatataaaagttgcgcattgcattaggcgaacaccacaaatgagcaacatttgtcggaaatgtccatacattggtct

SEQ ID NO: 8607 - DNA, 4894 bp, Heterodera glycines
cccccccctctcccctactatgcggggctttcgctgtgcttattcatcagtccaacagaagcaaccggggggagggggggggggcggagacagggggaaagaggtagttctgcttgctggcggatacatgcggcggtggcgggcactgccacacgacgacgacggccgtttacttttatccgatgctgtgccaaactaaagccctcccaaatgagaaaatccatttgggatttgcaggttgaagcatagctagtgccatttagatgccccacagtagaagtgttttgctgaaaagggttttttgtttcgtaaattttaaattacaatttaccgaatttgtttttggcttttgtttaatttgaaacttggtatttgtctaaatactttttaaagtaacttttttaaatggtcgcaaaaatactgtaatagtggcaatttcttccattttcaatatattttggctcataatccttccccctccccgcaatggcacattttccgcgcccctctctgtaatactttttgcaaaaaagcaatgccattatgctccctatgttgtcactcggccaattattgtgaacccataaacaccattttactggcggctcaccctgtgactaaatgcctctaatttggacattttgccaagttggctaatcccatttggccataatttgctgtccgcgtgcctctcagcgccttcattaacatcagaaacatatttgtccttttgcgttacataacttggtaaattgaatctgctaagaaatgaaaaatttaatttatttgtctaattaaaatagtaattatatgatttttatcaaaattttttatatttgttttaaagtaattttataatttatttgttctttaataaaaatttacctatacgttgtttataatatgttcacgattggatcaatatttggttaatgcatctaatataaataagcgatccaacgatccaaatgattagttacgaaaaaatgattatttaatgcttttcgtccaatgtttattcaagcaacggtggttcagtggtagaatgctcgcctgccacgcgggcggcccgggttcgattcccggccgttgcaattcctttttgctttatgttatttcttctcaattatttaaatacatttttattacttcgattgcattacctcttataaaatctccaaattttcttttattctattcagctattttaatttgtttttaaatttcctgctgttatcctttaataagcattgctttccaagactcatcccgcccttcacttcctctccccccccaatccaatcctccatttatcatcatcccctcggggagggggctattttggatggctcggctcaatcctctccccattcccatccacttcaatgaaaggaggacgagaaaatgggcagggcgggggatattgagattagggggtgggattaattttaactgccccggggcagcaagctgcagttctctctctcatctctctctctctctcccctctctttctttctctctctctctctctctcttcccccctctctctctctctcctcaccctatcatggtgtttttccctttcctgaagacccttccggaaagaaattattccggaaagcctttgggcaaaaatgcccttcccctccgccaccacaacccctgagagtaggtcccaccgacgcggcataatctcatcccatccgcagaatccgcaaccattaaaataggaaaatcattttgaaaacagacaccctcccccgcttcatccccttctgctgctaatgattgcttttggtcatcggattttagcgacatttatagggattctgagcaatggtcaacacttttcatttagctaatccaggaaatttcatggcttccctaaaacagtgaattcagctttatcttctaatgccaaatttccaaattcgttaaagttttagtccataaatattttccgattaattaagtcgttgcgggacgcatcaaagaaataactaaattggtatttttgaagcgttttttacatttgtgttgatagtctgtccgtttttatttgaaggctaaagtttcccgaaatgcgagtaaattggcattctgcaaatttatcccaacggtaggaaattggcattattcgtgtaaaatgttttggcacaatttttttttgttgacttttccattgccgggggatggcttttgtccgggcaccgaaggattagtttggccgcttctcctcgtcgttggctgtgtggcccatccctaaatcccatcccgaaaaacgaccgtggaccacagcgccccaggacacagggccacggattggacaaaggggcaaagcgtaagggggaggacgcgttttgaatgaataatgagaggaggacggttgacgagattgggatggatgcactcactcattttgggggatttggccatgggtggggccacaaaaacaacgaagcagcgagaatgtgatggaatggaatatttccatattcttggattatgaaagtccaatccgcaggccgggaaaaaatgtttgattttttaaagaaaactgaagaattcgatggttttccaaatttgatcttttggcataacctaatttttgagaaataaaaaaaaaattcgttttcatgcacagaaagaaaacaagacgccattaagagtaaaaccattcttcgtgaaatggcattgaaaaattttaggaaaatataatttcttgttaaatgagttttactgtctcacacattattccaattcatatgaatttggccaactttgtgaaagttctttcatctccatccatcacatcttttcatcctaatccatggccaatattcataaaattgccataatcccaaagtcgtctcatccgcaaatccatttatcggggattgaattttttttcgatatttccttaaattcatcgtttttcaaaattttactcatacaattcatttgtatatatcaactatgctgcattcggtgggggcgggtcccggtcaaaccggggaacggggatgaaaaattttcgaatttcatcaagaaaataaaaaattttattataaattttccttttatattttgactttcaacgaaattaccgaaaaatttccaataccaatttttctggcaaaatcccatgcttttcgtttattcagtgtgccatttttagcttttctgtgtgcttgttcatcagcttaattggatccgccgtgacgaattttatttatctgttctccctcccttcaaaagtcgcgtttaatttcccttcagggcaatctccaagattccaccccatcccccgggggtgcggcgactgactttggccaatctcttctctttttggccttctcgcggactttcgggggcagtaatcccctgcttcaccatttcagtttttcttcatccatttagctaatacatcttcaaaggatggggcagactcaattccacttttataagggtaatattaacggggcaccgaatgcttttcctcgtattttctcaaatttgtcggccattttcattccgagttcatggttttatacaaatcggcatttttgcattcgcaatttggcaggcaaattccactgaagcttatccatctgataatttttttgacactttttttaaataaaaaatatcaattttggccgtaaaatatttaattgtccatttgcgtcgtccattgtgagcactgactaattgttgaaggtcgagattctcaagaaagggccaaacgcaatgatctcaagcttttcttcccccactaggctcatctgctgctaccggattttccctgtgaatgggcgtgggtccctccctccctcctccttgccaagcccgcctttcctctccgtttacttttcctctaaagccacccccacccccggagggcaaatcttttgggcgctgtgcagtgcctccgccgccggcggatagaaaaaggcgacccctctacccccgccgccggtgacagttttcttttcggcttatcgtaagccgagcttctcctcctccaccctttggccgtccgtcgtcgatcggccagtcgtcggttggccaagcggctttatccccgccggacgggcccaatctattggatgggattgtggggcggggatttagcggagcggagcatgggagcatctgcaccagcagaagcacggggataaagcctacctcgcccattggacgagttttgttggctgggattactcttctgctggtgattgccgggccggccccctcctccaacagatccattggcaaacattggaccatcccatccatcatcacagcatcgccatcaagaattccacccatcccctgtcgtaaccttggaaaaacttttgggtcacgttaggtatgtcaaacaaaaaggggggaaattaaaaaaaaatccataatttcactattaaaaattctttttccaaatgtattattttatttaataggaatttgcgtgatcactttcaatcatttgcacaatttaggaaaatttaaatttttaaagtcccaaaaaagcatttcaattaaaaaaagacgcattgcttttttcatcgcttttttattttatttattcatctcaaatccaacggaaaagcgattttttatttttattttttgcgttggcttttttctatgaagctatattttttggatcaaccgctcaaaatgctcttccgctttatgcttctgctgctgattgcggacggtgatgatgagcatgacaacatggcgacggatgggatggtgatgatccgtctgtcccgtcctccccattcatccgcatccgtccgtcctccgattttgtgtccattttagtcattctccccgccctccccctcctctccgtcccatcttcctccccctccctttccat

SEQ ID NO: 8608 - DNA, 915 bp, Heterodera glycines
  misc_feature (14)..(14): n is a, c, g, or t
  misc_feature (158)..(158): n is a, c, g, or t
ttgtcgagctcccncccccccgcccccccccctcagccaacacaatcagtctcgacaacaaaaactattttcccgtaaaaggcggggaaggggggggggggggacttgggccccctgaagcgggggagagaaaggggaagagaagggagaatttgtgncctgcgggtggttattctgctgttttgtcatcaacaatcacctgctgttgctgttgttggctgtgatcatatcctttcttccgggtggtggacaaatcgtaaaatgtttggggtttttcgaaatttttggtttttactgatttgcacgaggccctcgatgatgacaaaagttccgtaaatttgggtgggggtgacttggcatctgctgtattatttaacggtctgtggaatttggaaataattatgatgcattgttttattttatttttgcttgccaatcaacaattgaaatgaaatagtaattttaattgtctacaaaattgatcagacaaaaatgtttgtttttgatcatatttctcaaatggtaatttaacgccctatatttgctggattccgtaaattcttctatctttctcatcacctgcttctcctcactccccggaggggaccgggggaggcctaatcattattcatttcgtcaagatcatcaacccccaggaatttactcgactcttaattaggccagactgatgatcgattgattcattttgctttatcatcctatgaaatcacaaatctacaaataggaaattgcttgtttgtttgtgcgaatatttattcggtaaacatacaaaaatatacaataatggccatttgaagtataatttttgattactatacttattaccttgtaaatacagtaatttttgcttttacacgatatactttaaagcttaagattatgaatttctgaaaa

SEQ ID NO: 8609 - DNA, 3000 bp, Heterodera glycines
  misc_feature (11)..(12): n is a, c, g, or t
  misc_feature (2968)..(2968): n is a, c, g, or t
tctagagtcannggtcgcacggtaaattaggccgaagaatctcgcaaatgcttctcattgttttccaatcaaccggtgagaacactggaaaattttagtcttttgccggcattaagaccagggcttcctcattttcgtaaaatctttcgagcattaaaaaaacgctgttccatcgaaccgttattccctaaaaaatacattgaaatataaaaaaagatttggcgcctactttgactaaattacgctgtggtatgccagtttcgtcttgaagtgccgaaaattcatcgcccaaaacccgtgacttccggatctttctgattgattttttaattttttctaataacgcatcgattgacagctttttaatcccatcccacacacactaaataaagaaaagataatcatgaaatttttgattaatcaaaataaccaagttaaaattatgggcagtgcaatgcagtgattcaaaaccagcaatacgagtcgctttttgcattgcactttcgttgtcacgaacaataaggtgcactttttcagcgttcacaccataatcattaagaacttggctcagcaaaccacacattttttcgccagtatgactgccctaaatgtctgcaaaatttttaagtaaaaaccccttaaccgaaccttaattggaactgcttccatcacgcgaaaagtcggttccatattactgtcaatgtaatgaactgtgacacttaataacgaatgttttccttcgtgagaactccagccatcgattgtaagagaaatgaagtctgttttccgaatgtcctcttttacgcgagctttcacattcgcatacaaattcctcaggacatcacttgtaaaatgccgacgacttctaaaattttaaagatttaaagaccatttttgttttagaccttattttgtacattggagctaaaattgacaataaatttttcaaggcttggtcttcaacaaaagagagaggcaatgatgccaaacaaataagtgccatactgcgtcatcaaccctttttgtcatttctccatccgaactccattgtgcttaatcgactttgaaattttgaaatatccaaataattacaaaagcttttgacgatttttggctgtgaagaagagaacggcgactcatttcttggcattttggcaggtgttgggctcaagcacaagcgaccagtacttgtacttgccaacaaaagactttgaattgattgttggccatttggtttcacttttgctttttcctcttccttcaacaattcttcatatttgtccggatgatgtcgctgcaaatgttctcgtagacacgtcttcggaaaagttgtagactttgagccgtaagaataactacagctcaaacatttcgctgttccatgagaaattttaaaatatttaatatatttgctttgtggtggcattttcaagctaaaaatgtaaaatgtgttaaaaatcatttaaaaagagatatacaatatgtaatataaaataggtaatattgaagaaatatttaatttataaaattcattaacattatcaccattactcacattaagatcaataattaggggagtatttttacttcgaaaactcaatctttaggggtgcatttttcccgaaacttcgagcattttcgcgaagctcgaagtttcccgccccggtcccggtaacgagctcaaaaaacgcatttctgcattaaaaattttcgattctgaggtcattatcggtcactagaaatcactattttggggttttgtcactaaaatagttaacaatcactattttggtgttttgccactatttaattaaattttagttttgacgtgcttcaaagttgggtatttgaaaaaataatatttttagtaaatgattaatttatgtattctattttacattatatatttgaaaatcaataaaattacatttgatgaagatttgaatattttcttcaatttattccattatctttaaatttaaattgattttaataacgattcctcagattagattattttaattaaataaacactttaaaaattgtgattttactgatgaaataagatttaattattttcttgattgtttgaaaattgaccatgagacatgaaaacatttcaacaaaatattcgcgaactgattaatttgttttcagatttttgtcataaatattcactttctcatcgatctctgctaatatactttttaatttcatatttttatactattcatcaatactgcatttaaaaaccattttaacgatttatttcatttaaatttatattaaaatctatttattaaataaaattaattgtcacctcaataatattttttatcaatgataaaatatgaacatagacatgtaatatgttttaaaccattcattttggataattttgtaataataaattttttaagcattcttttatttaattttaattttattgtcttttttaattgtgaatttcaatgccttttttcacttgtcttcttcgaacatgtcgacaatgttttgtgtttcatttcaatttacagttattagcggtctaaagacatgcgcaccaattaatatgctttttaattcatttgtatttgaaggaggtaaatacttctggtattcattcaatccactttctaacctgaattactaatttaaatcattatttagtttgataattatacacttaatttttgtaatctttaattcatcgcaaatttgaaatattttatttaaatatatttatgattattttagactatttctttattttttcgtaaaataatcaaatattttttaatttttgaatttttccaattcatattttcaccaaactcatttttcaaattaaaattatcgaagcttttctagatattttaatacatcaataaaaaatttaagaaaatacacctctaagaatttataaattttctcaaaaaataattaaattttcctgtgaaagtaaaanaattttagttttaaaatttttccttttggaaa

SEQ ID NO: 8610 - DNA, 1563 bp, Heterodera glycines
agtagttagtactgccacaccgtcgtagcgcgcgaagatttcgcgcactagcgacagggtattgggcgtttttgcggcgcggatcaaagggtttcgcgcgttgggcgtagggtttggggtgggtgtcggcgggctcaaaggggggtttggggggttggtcggggaccgtcgtagtgcgcgaaattttcgggacaggtggtcagttaaaattcgaggacatgtttgtgctggtgggggcggatggggagcgtggtcggggaaaagcgacgccaattgattgctgaccaccccctccgtttttctctcctcttccactactgttatgacctccactcgcaatgcctcccctccttcgcttgtgatgccgaaggtcattatgacccccccccccccatctgaatctttttttttgttttgtttctttatttcgtagtttttttatttttttgttttaaatttaaagatggatgatgaaacgtgcttttgcagtggcgctctgtaccccaagcctggtgaggcccccgacgggtcgagaatggtggttcagctaaactgccgctgcacgggggcctaccacttggggtgcatcgccaagcacctcatcaagcgtggtggcaaatgccccacctgccgcaccgagacaattacggagaattgtcgtccaacagagcgctgggtgcagttgatgcgcgatgcaggagatgtcagcgagcaggaggaggacatcgtctttttagacggtgagtttgatgaattaaaaaatatttttaaaaattcaaaaataataatttttatcaaattgtagaggtgctacagccccaaacaccaccaccaccagcagcagcaaatgatgtggcggaaggcacggcgcaggcgagggggcgcgggcggcggacattgcgcgacaattttcggtaagccaagaaaatttttttaattttcgaaatttgactttttttaatttaaattgatttaattaatttttttttaaattccccaacagctatcggatctcggccatcgtcaccagcagaaaaagcctgagtgcgtttctcgcgaactgagggtccactgggagggattttccttcgagcaggattcgtgggaggacgaggcggccatccgcgcggtaagaaatcattaataatttaattattatataaataaataaaaacaaaataaattccagcaagcgccattgatatatgtggcgtgggaggccgcccacgacgcggggcacacaccggaacacaggagggtgttcccggtgcgccccgcgtcgtggatgaccaacgttcgagtgcagagggatttgggagaggccgaaagggcctatcccgggcggcgcacggcggtgcgacaaatttttggtaaaatgaatttaaaaattaaaataataataataataacaaagtagcactggacgcgaatgccgggactgaagcggcggcggcggcggtgccattgacagagggagatgcggcggcggtgccattggtggaaggaggggaggcattgattgatgcgccagcaccaccaacagcagcagcagaaaccgacgca

SEQ ID NO: 8611 - DNA, 2191 bp, Heterodera glycines
  misc_feature (2184)..(2184): n is a, c, g, or t
agataaagttttgaatgatttaaactgagttccaattgtcggctgtgagtacgtttcagggctcagatggcttcggccgcgccgcccctcggcccttctttggggcagcgaggcgtaaacgtggcgaacttctgcaaggagtttaacaatttgacttcgactattcgatttggtgggttttcgcgtttgtgttttcctacatttgatttataaggtacaaatttgcctgtgtctatccacgtcaaaccggacagaacttacgaaattgacattagcactccgaccaccgagtggcttctgcaacaagcggcggggatacgacgtaaccggcaggaggaaggtgggaaattcaatcgctccgttctttccctggcaaaccctttcaatgcttttcaggagaaatcgtcggaatgatttcggtgaaacacgtatacgaaattgccaaagtcaaatctcaagacaaatctctcattggagtgccgttaaaagtaaagacagccaaaagacaaacttgggtaaattagccgatcttttagaaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaaactggccagaacatgatcggattttgattcattgttttctttttctcttcagcttatgaatgaacgtcaagttgtgtaattacactcattcgttcgcttccaaattacccttttgaatgacttttccgatgagtgaggggagcggagagaatggtccttcccaaaagggtttcttccgcccgcgcaattatccgtcaccaattagcgcattgggttgccatcgcatgccaccaatcctcacaaaatcctcctcctccaatggaggcgtcacttagcttttccgtcttgcttcttccattggcttttttctcgtcaaatgccttttttggtgggtcccctttttgcggtgctcctccattccctaggcccgtgtgcgctcgctgtttttgctgtcgcccgtgagactgtccatccctatctgattttgcctgcctcccttccaaaggccaccctttgttcgttcgtgctgctttaattgtcagtctccgccggtggtgccgttggcccctgccgtgccctccccctgctccgtttggcatcccatcgcccgtaggtgctgctgccccggcgccgtttctgttcctttgccccaacaattcgcgcagcatcaactgatcatggccaatgagttcggtggaattgcgccagcgccgttcgcagtgggaggcgaaagggccgcgcaatttccaatcggaccgatggaagcgcagcatcaagttcagccaatcatttatgtgatcgaaagtgagttcgtacgaaagaaaaaaaatgccaaaaagtgaaatagacggaaagggcggacaagtgccaacggaaaacgaaagcgcaagcgaagggacaacgacacaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaagggaagccaaaggacgacggaggaaggaaaagcggaggaaaaggaagggccaagcagcgaagaatcggctgaagaaagtgtgatgaaagaaagtacaacaataaggacgacaatggaggaagaaaaactattgggggaggaggaacagagcaattcaaagcggacaacgaccaaaagagcgacagcgaaaggggcaaatttgaaacggaaagtgcccccggggctaaagcataacagacgaagggtcacaatgagaacgccaatcgccgagggaaagcgccaaaaacaattcgatgaaagtgggggagaaaccggtttacctcagttcggccccaacgtgtttttcaactataacttttttctatgtcattcaaatccaacaaagttgatatcattcgaaagcttaatgtatttagaaactttaacgaagctattgcttcgcgnattagac

SEQ ID NO: 8612 - DNA, 1412 bp, Heterodera glycines
  misc_feature (1316)..(1316): n is a, c, g, or t
cggaggaaggaaaagcggaggaaaaaggaagccaaaagcacgccggaggaaggaaaaagcggaggaaaagggaaagccaaagggacgacggaggaaggaaaagcggaggaaaaaggaagggccaaacagcgaagaatcggctgaagaaagtgtgatggaagaaagtacaacaataaggacgacaatggaggaagaaaaactattgggggaggaggaacagagcaattcaaagcggacaacgaccaaaagagcgacagcgaaaggggcaaatttgaaacggaaagtgcccccggggctaaagcataacagacgaagggtcacaatgagaacgccaatcgccgagggaaagcgccaaaaacaattcgatgaaagtgggggagaaaccggtttacctcagttcggccctcacggttcggccccaacgtgtttttcaactataacttttttctatgtcattcaaatccaacattgttgatatcattcgaaagcttaatgtatttagaaactttttctaagatattgcttcgcgattagacaaataccaaaaaaagttatacatgaaaattgcgaaaaactcgaaattttttttccaggcttgaaaatcttttcgctttttgtaagactaatagagcatgttaagattattggattacaaataaaaaagctatagtggaaaaacacgttggtgccgaaccgtgggccgaattgagcgagtccgggagaaacacagaaagggtggataaaaaaaccattgttcagtgaaaggcgaggcacaagcactttacgactacgaagaggcaaaaagcggggaggacggactcacggggaaaaaaagcgccgcttcaaaacttttcgaagtggaatttttggcatggaaagacaaatttttgcgtgggctgaaagtatttgcaggcacttttcaattatgccgaaatattgcagattatttaaaggaaaggaaacgaaacgcacgacaaaagcgaattccgaaaggcgagacgaaagaatgcaataacggactaatggcacaaataatggccagtgccattattgaggacagttcaatatcgaaaaggctgatcaaaagagcactcaaattttctttcccagaatcgcagtttgacatcatttgcgccgcaggaggtgccctttccctttttaatggagcagaaaaagacggaacttcaggagtgctcagttatgccatttatggaagaagacattgccaagtgaaacggagaagtgtgacttgtttggcatttgaataataacggtcagtagagatcttttgtcaataatataagaaaaatgcatanaaaatgagacaaaacttttcaatcgtcgtccagcacaataatctcgggaaccgccttatcattacacattttcttcgcttccgccttcatttttct

SEQ ID NO: 8613 - DNA, 2858 bp, Heterodera glycines
ttctctcattatttcccgccgcttttttgtttcctgaacattttaacatgaacaatcaaaaattcacttcccatttatttatttgtgtaaaaagcaccttctgaatgccttccatgttctttttgtagaaggaattgaccatgtccgctgttttggtcccgatcagttcagcaacaattttgcaatccccgccaaatcggatcaatgcttgaatattgtcatttgcattagcaattagacgtcttcatttgtccctcccccactctcacctttctttgtttccatttcttccatgtccgaccaatgttgcgtttgtctcatgcgccgtcctttgccaacaatcggtgccgtgccccggacgaacttacgcgcttcttccatgatgctttggtatttcttgttgtccgtcatcgccaattgccttttcagtgcacatgcctccatctgaagctccttctgggccttcgacacgacccttagcaaattcaaatgataaatttcgcatttttattcccccccccattcttcgtttgctttctcactttattttctgttcacaaatggtctcgttgttctgttccacttgcacttcgtccaatccatcggaaatgtcatcaaattgttcgcccatcaccacccgcgccatctcctcaaattgttccgcgatatttttcatttcaggaggacaaattgggattcgtttcttttcttcgatgggctgagcgcacacgcggtgtttgttggttgccctgtaaaagcactaacattttgaagcagggaaaacatttatatttccaaacgttacttaaagtaatttttgcatgctcggcagagctcaagtccattggcactgtataatttgagcacttcgttttggcaaccctcgcaaattaatctgtgcagctccgatttgatttgcgtttgtccctcctcgtcacttaaattaaatgaaaaatgtattatttttgaatccacaaaattttaaatgtttgtgttttccctgtgcactttttcacctttccgatgttccatttttgccacattcattgtccataaagcttttgtagttttgttgttttttggtgaggtaataatgttccaccagctctgacaaatttttgtgggaaagcatttggtggattttggcgaagtttttgccgaaacatttgtgggcctctctgaaagcgaattcgtcttctacggaaaagcgcttcttcacactgtttcttaaagccaattccgacttggctctttttagattgtggtcagactttagcaagatgtaaagtgcctgaaaattagtgtaatttttgcatatttgtattatcccaacaaccgactgaccctatcagggccaatcccataatgatttaatgcgtcacgacaaaactcaacaatttccgtgtcgcccaattttccttgattcttcgaccacaaacattcgtctctttcctcgtcgattttatcgtcctttcttatttttttgttacactcgggcagcataacttggtaaccactgccaataatgatctgcttgctcttgtaactgttcattaccggactcttttttgctaaaggtatttatttaagaatcattaaaatcacggctctattgcagtttacacgagcaggaaaaaatttggcaactcttacaaactccaaaaaagtatttttctgatattttgaaccataaatttttgaatcattgagaaattttttttcatccttcgtagattaatagaggactcttggagctatcaaatgacaccaagaataatttctggttctattgcattttatgtgtccaattagttttttggtatcatttaagtgcaactacctagttgccttgcggtttgctcttaacaaataaaaagccattggattcataaagtccaatagaaccaaaaacaataatgtttattcattattttttatgaattgaatcagtttgggaagggatacctaaacaattacaatacaatatttgatttggttggtcacatgctttttataccagaccgttttcatacgagcacaagtttttggctataacttttttctttgccaaccaaatccaacagtattggtataattcaatagtcctaagtgtcctctacatattctgcaaaatttcaaaaatatcattaaggttcaaaaaaagttattccaaaaaatgttcgaactagctttttgaattcttatggacataacttttttggcgctactgtaaaagttaccgtttttgaaaattttttcaaaaggggggacccttttgttttgcaaaattttttttgtgatagtcataaaaatttattctctggggtttttgggggaccccgatcacgaatccttcaattattttgatcaattccgatttcctaatctaaatttgaacaaaaaatcataattttaaaaattcaaaatttcgatttttattcgggttcgggttagggattagaaattagtcaaaatacatgtcagattcgtgattagcgacctttaaaaccccggataaaaaattatcatggttttttatcttaaaaaaatttttcaaaacaaaatggtccccccttttgtttcataagtggtaactttacagtagcgccacttttttgaaccttaacaaaatttttaaaaattttgcaggctaatagaggacacttagggctatcgaatgataccaaaattgttggatttggttgtcaaacgaaaaagaccccgacccttgtcttttcctaagcttactgttttgtggcacattttttttgttcgctgttgatcgtgttcgtcttgatatttcagattttatcaaagaataaatttgcggacgaattatcgttgaaaacactgaacat

SEQ ID NO: 8614 - DNA, 974 bp, Heterodera glycines
tttattttttatacaatttttcaaaagaaatatataaaacatgaaaatgcattacttgttctcttttttggggtaatattttcacatctctaacacacaaaaaaacatcaaaatcgtaaatgctaccaattttggttatacggataaaaaatctctttggacatttagaatcaatagagaaattaatagttttagcatttttgctgaaaacagcagtttcggacttgagttataacatgataaaagtttgaaagtatcacaacttttttctgggatgtcaaattgcttagcattcgcttagaaaaagattctccttttcaaaaactttttttagataccaaatttgttcagtttagttggggatgaaacgagttatggcagatcaaaataaaaaatacaaaaaaggcatttttcagtgtaaattttgaaatagcgggcaaaaaatttttttttaaacatcgcattcattttaaaatttagcttttattttaagggtaatttaattgtaattagtttctttattgccatgttttggctgaaggtcatcctttataagttaagattggcaatagggaaacggtatcgtctggtcatttggatatcaatcgggaagcaacacggtcctttattatgagaacagatgagaaagaaggagcaattaaaaaaacaaaatgaaaatattttttacatgtaaatattaaaaactaattaataaatttgttaattcgatgctttaatcaaaaaagtaagggcgtaattagggaatggaatactttactgtttagtgaattgataaggaattgaaaataaagcggtttaagcagtcggtcggttgtcctttcctctctcaaatacataaatcgccttttgctttgtttttaattgcccattttattgttgcgcttttgtcgttcgaattggttgttcaaaccatcacaaatgttttttgcaaagggctttgttctgttcggctt

SEQ ID NO: 8615 - DNA, 1113 bp, Heterodera glycines
ggtgtaacttttcccaaaaaaaaatccaaaataatgtaaaattaattaaaatattttgatctttttaaaaaatatagaaataaactaaaaacagtttgaaattaccttttacatggttaaaaatttagcctattaaatatattttttaaaatttattatatatatattttttaaaattccgacttccgagttccgacatttttggggtcggaattccgacttccgaaaatttttggggcctcggaattattgcaagaaacaaagaagatgagaaaaatgctaacaacttatgtcataagaaaatgccaaggaatgccaaaagaagagtgcgaggctccgtatgggatctgcaaaacttgggcacactaaattagcactaatctagcgaatggtatccatctcattaactaagctgtttttgggttaacaaaaataattttccatttgaatatttatccgatcgcgaaccgaacaatacaatatatacacatagtcatgatcagaacaaggacagttattacatacaataatacaatacgatcgaatacatgatcacgtcaatatacaatacacatatgtacatttgttgttcatctgttgcgcacttcagctcagctctagggcttctcagcgatcgccaccacatcgattttgacgcgtccattcttcggcattttgaccacctggcagaggctgcgggcggggtacgtgtccggggtgaagtagcttttgaacgtctcgttgaccgcctggaagtcgctcatgtcagcaagcaaaatcttggcgaacacaactgaaaaaagggaggtaaaattcatgaagacgatgaatcctggagaattgctcacacaccgtgtttgaaggatgatccgccagcctgcagaagttctccgatgttggtcatcgcctgcttcgcctcggctcgcgctcctcccggcaccagctccgtcttgcccggctccattccgatctggccactcacgtacagcgtctggttgctgacgagcaccgcctggctgtaaaaaaaaacaaaaattttttgcttatgatgcgcatccattgtttgctccacctgtagcccatcgcagcaggcgctttggtcgtcgagatgat

SEQ ID NO: 8616 - DNA, 1976 bp, Heterodera glycines
agcgaaatgtgcgaaaacgaaaaggcattttattctggtcactttttactttgactgccccgactaaaaagcacaggggaaacctttcgtttttttttgttgactattttacgttttaaggatcactgaagatgggcatttatttatctcgaccaacatttttgcaaaaaaggaattcccttgtgtttttttcctcgggacaatcaaaataaaaaagtgccgtattttgtaaaaaggtgggagaggaaaaagaaaggacaaattgaatttaacaaagtcgagaaatgataatgcgagttgagttgagtcgcctttatactaaagaaaaaacaaacgtgcacaaacaaattttcaaaaagtgttcggtgaaatttgaacttccttcgattttgacatttcgatttttctctctgtataaatatgcaaccattttcatttgtcgactatcattttgcacttcattaaagtagcaatattttttaattaacaatttcagcgaacaaacttccaacgtcctaatttctgaaacgaccaccattccccaaatggctgctgctccgtccattcgtatcatcgcgacgtccaaggcgcctgctgcgacgggctacaggtggagcaaacaatggatgacaattgagaaagcacaactttatttgcttttctgcagtcaggcagtgctcgtcaacaaccagacgctgtacgtgagcggccagaccgggatgatgccaggaaagacggatgtggtgtcgggaggagcgcgagccgaggcgaagcaggcgatgaccaacatcggagagcttctgacatacgccggctcatccttcaaacacggtgtgtgagcaaaattcagcataaccatcatcgttgatttccgcccctttccagttatcaactgcaacatcatggtggccaacatgagcgacttccaggacgtcaacgaaacgttcaagaacttcttcaccgcggacacgtaccctgcacgcagcttcttccaggtggtcaagttgccgaagaatgcactcgtcatgatcgatgcggtggcggttgtttcgggccagtgaggagaagtgcagaagtgcgcaacagatgaacaacagatgtacattcgtgtattgtatattgacgtgatcatgtattcgatcgtattgtattattgtatgtaataactgtccttgttctgatcacgattgtatgcatatattgtgttgcaccgatcggataaatgcccattgcattctgtatttttgattctcgttagagttcgatcagaggttagcgaagagccattccagcaagttaaaattttccgaaatcgaaaatccggcaaattttcctgaaccattccccgctatgtcaaagggttactctttttttgaagttaatttgggtctccagcaattcaaaaaaccagattccctaagtagcaacttaatatgactaaaatgttgaatattattatccttttatccacctaaaaagcccaaaagacatgagacgcactttcctggacaacggcatttttgaaactgcccttgggcacacaaatacagccatcggcattttccattttacaaaaacaccctcaatttgatggaactcctcagcaacaataaaaacaacacacattgtccttggattttgtctcgaccggtaggtaccctgggaggcatattgaaaaatccgtctacttttccgaaatttcaaaaatcacggaatccgtatgggatctgcaaaacttgggcacactaaattagcactaatctagcgaatggtatccatctcattaactaagctgtttttgggttaacaaaaataattttccatttgaatatttatccgatcgcgaaccgaacaatacaatatatacacatagtcatgatcagaacaaggacagttattacatacaataatacaatacgatcgaatacatgatcacgtcaatatacaatacacatatgtacatttgttgttcatct

SEQ ID NO: 8617 - DNA, 1070 bp, Heterodera glycines
ttcaggaaaaccaggtataggaaagccaatttgcaaaaaaaaatggcctggacctggatccagtaaaaatctatgataaggcactgaacgtgaatgtgtgtggtatttaggggaacacgaaaaatcaaattagataactaattgaaggaccaagaattttttatccatttcgaccccgcaccctgcacaaaaaaatagaaattgtaatcgaacccgctgaaaacaaattttgccaaaaactcacatcctcttacaatggtcgcacattgcgataaaaggcttggccatctcagcactcatttggccatacgcaggggtgacgtgagtcatcaacaattattacacagcacaaaaaaaagaattcaatcgattgcgtgcgctaattgattttaaaaaatcaccaaaagcgtattcgatttgtcaacatttgcttattatttttatttacaccaacaccaatcatggacggtaaaaaagaaaaaaaagcgacaataaatctttttatggataattatgggaaaaaattggcgttctgtcacatttactttttatctttatttctctcacttttacgtactatctcttcattcttaataatgtaaagaacaacatttacttcatcctgtttaacttttttcctacttgttaaatccacaccaaattttgcatatcgctagagaaaaaaattctgcatcgaacgtatcaaatatttttttaggttatacatcccgtttttgtagtagagttcaaaaagtaaaaagttgaaatcagcagtttaggacttgagttataacgtgatgaacatttgaaactcgcacaacttttttctgagatgtcaaattgcttagcattcacttagaaaaagattctccttttcaaaatctttttttagataccaaatttgttcatttttgttgggaatgaagcgtattatggctgatcaaaataaaaaatacaaaacagcatttaccagtgtaagtgcatatactttgtttttgcgtgtgttggcgttttgttttacgccaattattttttggcaatttttttcgttttttaccgtccatgcaata

SEQ ID NO: 8618 - DNA, 2355 bp, Heterodera glycines
aaaagccgatcattagggggtgtaaaaaagtctcggtctcgagtctcgaaagtctcaaagaccgagaccgagactgaaaacccgagaccgagactcgagaccgagaccaaaaaaaccgagacttttctcgagttgagactcgagaccgagactctcgaacatcactagtagcgactaatcactgaactgctgcaagcactgcttaagcagcgtatagggatcagataattgtcgggacattggcaggtgctaaaggaatatgttttcaacaatttctgaagaaataaacatgctttgtattaagttcccggtcccgggttttgaaaagctcaggtcccgatcccggtcccggcaatttgggccggaaaaacgggactaaatttcattaatgaaactgccccaaatttgaaaaaattaataattttgtggcgaaatgtctttagttcaaagtttaaagatagaactgagaaataaattcagattttgatacatacataccattattttttattttgaaatccttaaaatgtattttagaaatgaatacatcaatctggaaaataggtttatttgaaaagtcaaaggatggcaaaatggcggaatgccgagaatgtaaagaaaatggaaggcccaagtatgaatttagcctctctgactccagcaccaaatcactcaaaatccatcttttttcaacaatccatgctgattcggaatatgtcaaaaatttccaacaactggagaagatgaaaaaggagtcaaaagaaaaagctgataagaaacagccgacgatcgaaaatctaatcggcacgaatttgaccagcagcggtagttttgtgttagtaaattttacggattttggtttttttaggcattttgtctgtggctgacaaacgaattatcagcatgataacctgtaacaatctgtcatttggtttgctatctgatccgacttttaaagctcagtgtaaatatgagctgaaggatgaaagcgattatcggtaaaagtcaaagcaattaaaaaattaaaaaaataattttttaggaaaagagttctcccggaagcatacaaactagtcaaggcaaaaatactcaaggatttagatgattgcgccaatctcagcttcacaattgattgttgggcaggtccatcagacaattttttaaggtaattttaggcttcaagaagcggtatttcaaaaaataattaagcttgactggtcacggcgtcacaaaaaattgggtgcaaaagaattttgtactcgctgttcaccattttcccggccaacattctggcaatgccattgcgtgcaatgtccgtaaattattggatagctggaaaataaatgacgatcgagtgtttgcttttgttataatatgttttaaccaatacagaagatgacgcaattttttcgattttttactcaaaaattcaaaaattttgaaaaaatcccgggtcccggcgggatcccggcccaaaaattgggaccgggaccgggagtcccggaaaaacgggagtcccggtgccgggatcccgcccgggtccattttccaagtcccggtcccgatcccggtcccggcaatttcaaaattccgggctctagtgttgaccatggtaaacggagttcaaaagttccatttccgtttgtcgtcctaaagttaacaaattctttctaattgttttttaattttatccatctgttaccttcttttttcgctgcttctcttctttcttctcaacctttctcggttgttcgttcggcttcttaatcaaaaagagtaatcccaaaacaacatccaaattctcatatttcctgaaggatttattcatctggacccggaaaatctttttaaaaattagattttgatatttcgaattgtaaaacatacaaataacaaatacccaaaaacgtttttaatgcatttattaaacattggacccggaataatcattagaatttttatcaaatatttgtgaaaaattgatatttctgcttctaaaaattacaaaaaaaacataaattccccaaaaacaagaaaacttttaagaaatcgctgtaaaattcgcttttttaattagcatcaaagtgtcggtaatcctgtattttattggtcccataaaaagagattaaaaagttgtttttatgcatttcggagtagtactcgggggttttcgggggcgctgatcacgaatatgacatcaattttgacctatttcgaatcccgaacccgaattcgaacacaagtcggaaattaatttttcaccaaaattctattgtccaaaatcgattaaaattcactaaatggccttgaatctatagtttctattatattccgttcatttgaataagtttggga

SEQ ID NO: 8619 - DNA, 2932 bp, Heterodera glycines
  misc_feature (32)..(32): n is a, c, g, or t
  misc_feature (2910)..(2910): n is a, c, g, or t
ggaataataaaaaagagtaatttgatggtttncatttaagtgtatgaaagctgctaaaaatagggcccagtaaaaagataaaaacagataaatgaatgaatgtaattcccaccgatgtatgatgggttgggtgatttgtggtgtcattgtttatttattgttttgttgtttttggcccaattatgtaacgatggtgacaacaaaacaaattattgcaaattgtgggaagaaaattcagaggccaatgagctttcagcagatgaggttcaatagcaggagacaacggaatatgaaaaaaatggaaaaaagtacgagcgaaacttttaaaaacggaaaaagggatctacctaggggtcctatagccaccatgccattagtgctgatcgagacagaaaattccccgatactcgagaccgagacgaagaccccgaggaagaaaccgagacctttctagagtcgagactcgagaccgcgagtctcgagcagcactacatgccacaattctgatgcctaccttattttcaattcggaccaagtcattgcatgaaaaattgaaacaaaaaatagagatttttgatgccaaagtccagtgcggcacgaaatttaattgtgatagaatttcaaatttgtcatgtcacaaaaaattatgtcaccaaaacgtcgaggaaaaccctaaagaagagctgctgctgctactcatatcaaatgtgaatgcatttgttttgtcactgctttttggtccattaaaagtgtcgttcttcagtggtctttgaacccttagagaagaaagaaaacaaaaaatatgatggccaatggacaaccaaccatattttcatctaggcatgtaagtatatacaatagcattatcgtgttattgcacaatttttgttgtgcaataaccatttatatttgtattatgtttgataatcaaaaaaaaaataaacctatgtaattagtaatttaaaaaaattaattaaaagatttggtgacttttttgggttatttttgagatatttcatcaattttttagaaagtttaaaattttataaaattctcgttttaaaatttttcaataaaggtcaaaacgccaagctgtgtttagccgttaaaatagagatttttgaaaatgccgaaacatggcagtaaaatgtggacaagtgccaaattatagatgaacaaatgttgaaccaatacggacaaatgggataaataacccgtaaaatccgttgtccgtaaaaacccgtatttgtctaaaaatacggggtacgggctatgggtccgtaaaaacgcgtatacggaatggcagatatacaaaaaatgatgtaaaaaaatcacaacaaatttcacaatatgtggtgttcaaaaattccacctagagcagcagcttttggccgtcacaaccaatgaaaagccgaaacataaaagaggaggaaaagtccaacagctgttagagatccgtccgtcttttgctagattatttttcaatggatgtgtgcatatccatacataaaacctcgagacttttctgaaatgtgtgtgagggatggggaacacataaatctgatcactccagccggggagggatgaatatgtgggcggtgaataagcatcaacaacacgaggaggggagggggggggataaagccacggatgtaagccgatctccgtcaaaaccccgaccctgatcactgaagttgacctgactgatcagccagtcatttcaaaccgagtaaataaaacgtgaagaagggaggggcgacatttgtgaaatgaaaagcatgactcattttgctttgaggtaaaaagaatacaggattaccaaagtgtcgagatcagaatgccgaccgcaaagcccaattttgtcgggatttataccttcgagcgaaatttttcccacgccgatttctgcggtgttttttgcggcgcgtcatgggacgaaatttgttgagagaaaaccggatcgtcaacagccaacttaatataaataacttcgatccgattttacttaattttgaataatttataatttccacattatttccaatcgtttttttaattcttccactggcgctaatttaaaagagggcctttttgaaaaattttacacattttttggtcttaaatttttccaaatttttttcggtttaaaaagtcatgaaaccaagtacccgcgggtttcgaggtcgctgatcacgaatatgacaattatttgtgcctattccaaaccccgaaagcaaattgagcaaaaagtcgaaaattcaaatttgtttttatattagaatcggaaccgggattccgaattgccctaaatggatgcaatattagtgattagcgacctcgaaaaccctcgggtattcatcattatgtgtaaaaaacaaaaaaaaatgcaaaaaaatttttaaatggcccctttttaaactagcgcacaaattcccatattttctggcggatttatcacatcttggacccgggaaatctttaaaattttcaaaggcggtgccaatatggcttcgacggtaagaatttggtattttttaacacgatttttaactttgcacaaaaaatacaatagttaggaggttgtcacccgcttttccgggattttgattatgagtaatgtatataccttctcggtggtttcctttgccggagtcagttgctgctgaacttgctcctgtgccgatggcacatgcttttgcgtttggtcgattgagtcgtagtcggactgatttggttcaagaggaaccggatggccaaccacatactgaaagcattttccacccaatttgactaattttggatgactcgtaaaatacatttggctctttgaggacgggcggaagcggcggttttccacgaggcggcggggaatagaaaggccgcgcgaacgcctgacaaagggcaagctancgcgaggagcggagacttctcg

SEQ ID NO: 8620 - DNA, 2666 bp, Heterodera glycines
  misc_feature (2540)..(2540): n is a, c, g, or t
  misc_feature (2636)..(2636): n is a, c, g, or t
  misc_feature (2653)..(2654): n is a, c, g, or t
cccaagggccaacgggaaaatgtagttaagtactccacatcgggcccatcccaatttcaaaatcatttcgcatcagacggtattgcaacgatctcagatgagtaaggaattcgtcatcgtttggatccgcaagcaaatcaaatccttcgactaggtttcgcagggccacgtcattgtccctgtaaacctttattcgttcacggagccgaattccgtttgtgggatccaactcgtattgtcgaagtttatcagcagctatacgttcctccttcttcaatacagtgacgagcctacatttactaggattaccaaagggagcaaaacatttggactttgataatggcgggtgtacactagtgaactgtgttcgcaaggccaggtgaaaaccttcctgtgcgttgtttgtacgtcccatatcttgaattatactttcatgatgattccaagttgcaataggaaacaagggtccatggccagcatgaccatgtacatatgttctgtgttaacaaatattatatttgttaacccatttatgtaccttccaatatagtcaaaaactgagattggttggcctccatcttgaataacttgaacattcaattcttgagcttttaagcgaagaaaatattggatgtgccagccgcacgcgccgtttgtttttcactttgccaaaacagccggcgcctttgctttccgaaagatgtgccagccgcacgcgccgtttgtttttcacttcagcattactttaaattcttaattcttacacaacacaaaaagtattttgacaatgacataaaatgaaaacgttttttctatttttacattcctcttttcgataattttttgatgcattaaataaatattttaatgcagaatgatggtaaacaaatttattaaactatttgttttgcttcttctgatctctcccaccaatgaaaagccgcatcagaaaagagccttagtgacaattgcattgattggcgccttagcacaattgaaggcgtatttattagcgcacaccggagttatattaacagcatcaatgataacagcacttacaacattgtctctcgctgtatatgttaagctcaaacgtgagatattgtttttaaatatttagaacttatttattttctaaattatagattgccgatgtggcgatctgttaaaagatttctttcccataaccttcgtcctgaactcgtacgagttctctgtgtcagtggaggaatttacacccgacaacatttttgaaaaaatttcaaaagagctaggccggaatgttcagcaattttgctttggtttgttttaaattggtttaaattattatagaaagatataataaattcagcttctccttcggaaacgactcgaaagattaaaaaaagtgatgaagacatggggcttcttttatgcaacccgaagccaaggacggctggaaatcttcgactgcccctgattcaggaggctggaaatcttcgactgcctctgtttcattttttatgatatttcccgttggcccttgggaaaggcattttctttttttcaaataaagaatcaacgactttgttgccttgaaaagtccatattaaattaatttaattaaaaaataatttttttttgaattcaaaaatgatttttctaattattttaacacgattttattaaaaaggtgattcgcaagtgtcgagtccgcaattgtcgggtccgcaaatgtcgggtccgcaaatgtcggggttatccgcaattgtcgggtccgcaagtgtcgagtccgcaaatgtcgggttccgcaaatgtcgggtccgcaaatgtcgggttccgcaaatgtcgggtccgcaaatgtcgggtccgcaaatgttaaatccgcaaatgtcggatagccgttcatccgggggataaaaattggtggaaaaattattgggcagtaattgcggacattctctccatttggacagaaatgccagaaattgtgttcctttcggtggtaagcaatggcaaaatgtacttaattatatttaaaaaaaaatctaaaattttgaaagaatttattttccacaaaaaactgatccatgccaaaactcattcaaatcattaaggagtggaaaaaaaggaaaatgaccaaaatgggaaaataatggcccgaacaaaatattatgttgataagaaaaaggaaaaaacaatgaaaatctaattaattaattaatattttgagcaaaaatattatttaatatttgaaatgtgtaaataatgaaaattgtgggggtaaaaaaggagggggtaggaaaagaagattagatccgtccagctggaccatactaggcgtgtccgtgggatcgttgggcctacccctgaccgaagtcaggggctaggcgcgatcccgcctattgagtccgagttggctttgtaatagccccttttattaaagcacaaagaaaatgtgaagcaaaagaaatcggatgaaatcggagaaagcaaaagttgatcaaaagatctcaaaagtgatcgctttctccgggtgttggtccgatggctcccacctnaacaattttcgggcggagcaaaagaaggagagaaaagggaacagttggcgtaattagaggaaagggaaaaatgtgattggcaatttgattgattgngcacagaatggaagagnncaaagaattttg

SEQ ID NO: 8621 - DNA, 1124 bp, Heterodera glycines
ttaagataaaataataaatgaattaaatagaccaggaaattggggtatttctactgcttttcaccatttcaatcaaatttttctctgtttataagaaatttatggttttccatttttttttaataattactttacttaatttgattattcttattgaaaaatatttaaaatggaattttgaccaaatttgctaacattttactataatttttataccccaagttataaaaataatagtaaaaaataatctaatccaagaatttaatcaaaaaattccggaagtcgtaattcaggacccaaaaatgttgagagtcgagtccttggttgggcgtaactggattttcaattacgaaaattcgtaaaccataattacaacgatttaatagaaaaattggttaaagtatgtaaattattcagaataaaacttacaaattagcaagatttatgaggcgaaaaatgccaaaataccggcctaaaaaagcaaactaaaaagattttgccgagtccggcggtgccgaaaagcaacgccgagaaaactttggaaaatcttatacgatttattcacagactttgcgtcaaaatgtgctattacaaaaaaattaaaatgattttcttttttgtcatttttcaaaaagaaaaataatatttgccaaaaaactcaaaattttttatgcggtgacttttaaaagattttaaaaaaatagattctgaagacgcatttttttaacagtaatatttgcatttttccgggattatatcccaaatattgaatttatctaatatttataatattttttcttaaataaatcctttgttttattccattaagagcctttttattcacatcaaagaggctcaactctactgaatttccggaaaaaaatctccaatccaatttagttgaaaaataatgatgattttcttccctaacaaataagatcacatttatttaaaagaaaaaaaatttaaattaaataatttgtttttttctattctactgttcaaaaaaaggaaaaaattaaaattttttttagcaaaataatgtgaaaattcgaaagtaagtgttaagaaattaatgttgaacgttagtggttcaagcattttaatttgagtagagccgctga

SEQ ID NO: 8622 - DNA, 2718 bp, Heterodera glycines
agagatatttagagaaagagagaaaaagatggaattgagagaaaggaagataagaagagattatttgagaagagaattcgaatacagcggggggggggggaagagggggttttttgccgatgttgttgggtcatcgaaagactacgcaggtggatgaagaaaagaaaaaggggaggggggtcagcgaatgttctgcagccttccatccatcgattctgctcaccattctttgttcgttcttccgtcctcattttcttcaaattgcgttcctcccaaatttttgctgttcgccttttttctgctcttccgcgcttttccttcgcttttcctccgcttttcctcttccttttcggcgtttgttcagcaatggtttgttgttttcgctggttgttgttgatgatggtcgttcattttcctcttttagttgttgtggtcgtcgtcatgtgtctcgaagctggcgtttgcattgacattggcattggcactcgccattttgatgggcggttgtgcggaagttctgattgcggatgatgttgttgtaggtgggtcgaaaaattgggaagacgagaaaattgagaatggttttcgagaatgaatggaagagagagagaaatacggagatggagagagagatgggagggcgagtgaaagagagagagaatgagtgcgagagggggtcaacaaagggcgaacaatggcaagcaattattgatgagtaattagacggtcaattacaaagaaaagatatttaaatattttgaaaatgtgtcgagatttcgcttaaggcaattttgtattttgtgtttttttttgattgccttaggctttctacataaaagaatgagaggggcccggtcctccccactgcgcctcttcgtcctcctttccttcatctttctctcgcgcttctccgtgcgggaacagttcgtcggcgagctctgaaagcgcgtccgcggcctggagcagtgacttgcggattttgtagatagcttcctccgcgcgttccagtggcatccctttccgaaacggcgcgtatgtcttcctcacggggctcctctccgcgctgcgtgtcgtaaactgcggcactggcgctggagtcggtcttcttttaagcatttcgcgatttaatccctcgggtggaatacagggacggtcatttactgtcccgacggccgatttgagcatgtttgtgaacaagcgcttcccgctcattcccaagttcctttctctgtcccctctttcttctcttcctcttagtttcgacgctgagtccaattcgctttggcactcaaagcgcgccacggcgctggaatagaaaggcctgcgctctcttggcggctccggggggttctcaaagcgctccttctcctttcccaactcctttgcctcttcttctcccatttcttctctgggtttccctgccagttttgccgtcaattcctcaattttgtttcggatttgcctttgcttggcctcctcttcgaggcccctgttgttttgctcccacagcattttcagctcccatagctattttcgatcagccattacagcaattgaccatttttgatcaagttgtgatgatctggtccaaaatgccgttatgtcatcccttttgtaaagagagcgggctgcatcttccggcatctgacgtgctaatgcctttgcgatggaaagtgcattatttcgttcgtgacagtcgctcatccatttctctcgcgcattttggatttttgtccgatgtgtcttccatcccaaataattaagacgagaattttcgtggtcaagattttcttccttccaaagtttttccgactcttcgtcatccgggatttccctttttgtaacgacagtggtgggactttcttcatttggttcatttgggagaacaaatggagttggtgtcacttttatcgtcggagaaataaaatgccttcctcatcagcttcttcggccaatcctctaagctcatcaagaatggaatgatacgacgcagtggtcggagcggtgtcatccgcactctttgtggtgtgaggagagacggtgtttggtgtagccgtggtaaagattaatttagttggcgtttgaatagtggttgtcgggattgtcgttgttggtttgattataatagggctatgaatggttgaagtcgggcggattgttgtaggaatattagtagtagtaattggtcgaattgtcggtggaatatgagtagtagcaatcgggcgggttgtgggtggagtgtgtgtagtagctatagggcgaatagacggcggaatattagtcgtagcgattgggcgaatcgtcggaggaatattagtgatagcgattgggcgaatcgtcggaggaatattagtcgtagtaattgggcgaatcgtcagaggaatattagtagtagcgattgggcgaatcgtcgaaggaatattagtcatagtaattgggcgaatcgtcgaaggaatattagtcgtaataattgggcgaatcgtcggaggaatattagtggtagcgattgggcgggttgtcggtggagtatgagtggcgattgtgggaattgtcgatggaatacgcgttgtagagacgggacgaattgtcggtggaatattagtggtagtaatagttggacgggttgtcgtggcgatttcagcaatttgacctcttccaaattcggccttcttgttggttcaattctcagcacatttggttttctttgtccaggtttta

SEQ ID NO: 8623 - DNA, 2168 bp, Heterodera glycines
aggttcggcaaattccaaattttgttcaagttcgggttggtcaacttgaccttcgagaaaatggtcaatccgctcgggattttcttggcaatttttcggacacagtttggtggtaaatgtttaaatttttgacaatcgaaaaaatcaattttaaaattttgtatcccttttctgattggacttatggacttattatttaatcaccggtttgttttaaatatttatcacaaaataaatcacaatttgtcaacaatggatcacagatcacaaaaaattatcactgttgtccgtctgcggaagtggttgctcccgaattgtccacttcttttgtgcctgtcggcaaaccaaatgttttgcggatgaatgtggccgttcgctcttgcgcagttaggaaccgtctttgatgcagaaggttattctgaagtttctgtgcgcagatgacggtcttgtcgcgggcggcccgagtggcgtaggtagtcgattggactgttttgagtaattcctcgaggattttcctgttaaaatcctcggcacgaatcgcttttgcgaccgattctaagatattattggtttggagttcgaccgatctaacccttctttcttcttgctttttgcactctttgaccgcgttcgaccaaatttctgaccgctcgtcctcgagcgtagtcagtttcttcaaaaaaccgttgtcaatttcgggggagaaattgctgtgaaaattcggttggtccggggtgttctcacggattgagttgaattttttgactgcgtttgttgtttggatgaggtcggcgttttggttggtttttacggtttgttcaacacagtcaattgcttttttcagttgtttggtttggactttgatttcggatgctttcagttttgccagtaatttttgggtctcaggcgagagggtgaccgggtcggatttttcagaggtgggggtggacccaaggaattggacttcggtttgctccgaaggcgaatgagtgcgaatgactaaaaaatggatatcggtacgatcagaaatctttgatcacttttcttcggtggtgtcttttccttcttttcttcttcttcaacttcgtttgggtttgtcggtgcacgagatgccgatcgggttgttcttttcactgaatgggatgggtattgattgatttgtaataggattttgggtgtgtttgtcggtttttgttcgagaaaaatgactgttttgtgtgtgttttggtaggttagggttttatccctttaaaaattttgaattttttgagtgtggggattggttaccctttatagcaaaaatttttaaagttttctcacttttgaagttgggctgcggcacgaagagttttcgctgtttcagtagtttgacgatttgttgtcgaatgccggatcgttgttgtgcgcagggcgttccgggtcgtcgtgcaccactttgtcctttccgcaatcggtgatggacaaatgggggggacgggatgaagagcgcgagtcggggagtcggtcggagattgagcggccggtactgaatgggtgtttgttggctggcaacggcccggatttggcgagagctggggcgattgggggtggacgcttgacggtcaatcggggatggtggaattgctgggggtcaagtgaggcgggaaagcgattcaaaatgcactttattggaatcctcaaacttgggtaattaaaccgaagggggaaatgggggaacggcacaaaatggggggaaaatgggggacggcacagaaatggggacggcacaatggggggaaaatgggggacggcacaaaaatggggacggcacaaaaatggggacggcacaaaaatggggacgtcacaaaaatggggacggcacaaaatgaggacggcacaaaatggggacggcacaatttggggacggaacgggagtggtcggctcggcacacgtcaacggcacgggacgggcggaattgagcgggcggtgtgttaaggcggtagttgggcacggcagggcacggatcggcatggcacagaacagtcggcgcacgaacggacagggccaagagtcgacggcacgaacgggcgggcggcgcagttgtcggcggctgttgtcggcacggggggaagggaaaaaagggggggaagggaagaggagggaatgcccctcggaaaccgttggtgta

SEQ ID NO: 8624 - DNA, 1781 bp, Heterodera glycines
cttgggtattaaaccgaagggggaaatgggggaacggcacaaaatggggggaaaatgggggacggcacagaaatggggacggcacaatggggggaaaatgggggacggcacaaaaatggggacggcacaaaaatggggacggcacaaaatgagaacggcacaaaatggggacggcacaatttggggacggaacgggagtggtcggctcggcacacgtcaacggcacgggacgggcggaattgagcgggcggtgtgttaaggcggtagttgggcacggcagggcacggatcggcatggcacagaacagtcggcgcacgaacggacagggccaagagtcgacggcacgaacgggcgggcggcgcagttgtcggcggctgttgtcggcacggggggaagggaaaaaagggggggaagggaagaggagggaatgcccctcggaaaccgttggtgtactgatttgtggggggtttgggccctccttttataccggcagttcctgcttgaacgattgtttgccaacttggcatgtccaaatttctgtccctaacatttgccaatttttctaacctttttcattttccagtttgtgccactttagccttttctaattttctaacattttactatttctttaatatcattcacaatttgtcccattttaatatttgtttaaaatctgttatttcttttaacgttcaaattattcataattaaagtttaacatttgacaatttttctaatggaaaaattgtgactaaaaatgactaatgatttttctttctttcaattcattcatttcgttcacatttaattaattaatgtttagctgtttaatttaaaattaatttaaatgttttttgtttttaatgtttttattttttaaattaaaaatcctatttcgcgtattcgcgacaaatataaacaggagaatttggtgagaatttaatcgcttcattacaatttgaaaaccgagcgaatcattccaaaaaattcgtaattgttgctcacctgataggaattaaattgccttgcatagaatttttcacttccaaatataaacaggagaatttggtgagaatttaatcgcttcattacaatttgtacaccgagcgaatcattccaaaaaattcgtaattgttgctcacctgataggaattaaattgccttgaatagaatttttcacttccaaatataaacaggagaatttggtgagaatttaatcgcttcattacaatttgaaaaccgagcgaatcattccaaaaaattcgtaattgttgctcacctgataggaattaaattgccttgaatagaatttttcacttccaaatataaacaggagaatttggtgagaatttaatcccttcattacaatttgtacaccgagcgaatcattccaaaaaattcgtaattgttgctcacctgataggaattaaatggccttgaatagaattttttcacttccaaatatgaacaggagaatttggtgagaattcaatcccttcattacaatttgaaaaccgagcgaatcaatgcaaaaaaaatcgtaattgttgctcacctgataggaattaaattgccttgaatagaattttttcacttccaaatatgaacaggagaatttggtgagaattcaatcccttcattacaatttgtacaccgagcgaatcattccaaaaaattcgtaattgttgctcacctgataggaattaaatggccttgaatagaattttttcacttccaaatatgaacaggagaatttggtgagaattcaatcccttcat

SEQ ID NO: 8625 - DNA, 3001 bp, Heterodera glycines
  misc_feature (16)..(16): n is a, c, g, or t
tcactggtttctatancaggagaaaacatgagaaaaagcttgttgatgatgttgtttttggtggagtgaaaccgcgcttttgtgggcttttatgtttcatttttacactatttcaaagggaaacaaaacgccataaaccgtctaaaagtgcaatattttaaatccattcatcgcgtggaattttaaaattttattgagcagtaggaggtaaattgattcgaactcaattcagaaaaaacatgagattttgaaattagaaaccgtggaaattttttaaaaataaaataaaatttttcggtgtcaaaccaacacaacagcttaaacgttcaaataaataaattaaattccttggaaaatccaaaaataaaaatccatggtccaagggattttggcgtttccgtttcaataaatgttacgtgaaaagaagaaaaaaacaaacagcagatgtgtgcatatgtagaaataatctgtgttggcgcttaagaggactaatagttgtacatataattaattaattatacattttgttgccccaggcaatgttttttgttgttgtgattaaaagggcctgaggggggaagaggaaacagcacataaaacaagcaacattaagcataagcaagtagcactatgtgcacatgaaggaaggctaaacacaaaaacattgttgttggaccaaaaaattcaggataatatggaaacaaaatgggcccccggggggagtccaagtgttgttggtggtccccccactccttaatgaggaaaggagttgaagcccctcgaggtcccacttttagggggagggtaaaaattatattttaaaatgagaaatttatttcaaagttgtggagcaaaaataattaaatggaagaatgtataaaacattatctatctttgtaatttattaatgagaggagttgaagcccctcgaggtcccacttttttagaggggagggtaaaaaaatattaaaaaaaaaagaaaatattttatcgttggttatctttggtaatttaattcaaaaaaaaagatgaaagattaaaaaaattttttttaaaaaagcctattaaaaaatacgtataaaaatgtctctccggcctcccaaagggttggaaagaatgaatttttatttttttcactgactctccgattgacattccggacccttccttgtccatccccgaaaaaaatatttatttttttggacagaagggctttaattgggaggaaataaccagaagaaccccacggggtcaatcaaccacatctgccgtttatcattttgcttatgccttttttttgcttgttttgttttgaagagtgccgtggggggtggacacttcggggcggagaaattaaggggtgaggctcccaaatttgtttttgacgaattttggcggcgatgggcaaatggcccaccccaaaaaatggataattggataaattatggggctacatacatatgctcagaatttggtgatgaatatggtcagcattttaatggggaagagggaataaagccgggagtggacagaatttttatccaaggaattcataaagcaaaatactggtttctcatcaagggcatttttgaaataatgatatattgcataaatttttattaaaattcatttaaaaaaatatttaaatataataattagggcaataagcaaaatagaagaacaggcttcatactcaaaagataaatctctcaagaaattgtctacgaaatttctgcaaaaactcaatgtctcaaaaattgaaaaaaaaaattggaagaataagcaaaaagagttggggctgtgtggcagatgcagcagcttttagaaaaagataattggctttatttattggccgcaatttcggcttaggaaaaacaggaatttggggggagaaatgagaggaagtggaggaggaaggttgaaatcaggcgccgattttgccatttcatctgcatataatcccacaaaatcttttttcatgggaaacaaaaatgaatttgaaggggttcggcatcatcaaaatcagtgccaaaattgaaaaatcgaattttaatggacccaaattaaaagccaacaaaatatgacataaaaactcgaaaattggctaaaaaatttccaactttttttttctttggaataaatagtcaccattcacacaaagattgttatcatttctccactttttttcagcaaaacatttattctttcccgtgaataatcgtgtggttcagtgaacacaaaaataatgggcaaagggcggggggaattgaaaaaaaaaatcggtgatgaatcggagggttggggggggggcgatgagatgggttggacgaacgacggaatgattgttgtgaaacaatccaccaaaatgttttttttgggggggggagaaagatgactaaaatgatagaatagatgggaaaatgaattcacaaacagtcaagaaatatacgtaccgtctttcctaatatagagaccccggggatatgtgtggcatacaccctcagaggatgggtatatttcgacggcttttcttgtatatgttttgcagccctgtttattatattgtaaaattttaaaaagttttgttaaatttaaaaaaaaaattagtttttgatctgagaaattcaaaaaccaacccttttttgaacatttttcgtcataactttctttaaacttaatgaattttttgagtaacaacccggcaccaaatgaagaagctgggctggctggttaaaatgcagaaagcggggattaataaaattcataaaagggttttaggacattcgacggttcaggcaaaaaatccgtgctttttaacacaaaaattttcatccctaatccatatttaaaatcactaggggcgtagaattatatggatataaaatcccaaaatctggccataaaaaattgacaataaaccaccgaaaatatggacatataaatgcgaaaatctctaaatatggacataaaatggcaaaaatatgggatataatttttccaa

SEQ ID NO: 8626 - DNA, 1710 bp, Heterodera glycines
atcggagggttgggggggggggcgatgagatgggttggacgaacgacggaatgattgttgtgaaacaatccaccaaaatgttttttttgggggggggagaaagatgactaaaatgctagaataaatgggaaaatgaatttaaaaacagtcaaaaaatatacataccgtctttcctaaaatagagcccccggggctttgtttgtcaaccaccctcaaaaggagggctttatttcaaagggggtctttttttttggggggggggctttattttaagaaatacgttatatataaatgcggtgaagccattataaattttgttagaaaaatttttgtttcactaattagtggtgttcagagtcaagaatcaatttctggcagccatttcagaaactttttcttcgaggttgtgaaaaaattttctagagaaagtgagtaatccattggaacgagcacaaaattctctaacgaattatgtttattcattttttagttgtccaattttgacactctctaactcagcggcgataagtcggataaatcgttgacccaccattcaaaaggcaattacgtagaaaatttgtgtttttgcaatgggattactcattttctctagaaaaaattatctatcccaaagattttttctcgaaaattttcgcgatttacgaattatttgaggttatatgtattattttcacttttttactcaaaatatcctcacttcattgaccaccatcactaatttttgaatgaacattttgaaaataaattcatttggattcgttatttaaatattaattttaaaatacaaatcagttaaataaattattaatataaattaacaattaaaaccagtgtcaaaacattcataataagcacgacgatatttgtcagggaggatgacggtgttccagccttttctttttaaaatgaagttcatggcaagtgcatccgtttccatccaaaaagggtgaattttggcctaaattcatttcttgcattgttatttgagagagttatttttattaaagtaaaataaacgaaaaattacaaagcattgactaaaaacacgaatattagaaagtgggtccttttatgaaacaaaattaattaaggtatattaaattgtttagttaaaaccgaaaaattaaaacttttagcgaatttgtcaaattaatataaccaggaaatcattttcgttactatcagaaaattttagaattttaacttacaaatgtgggctgtttttatcattgttataccattttatagtgagcagtggccgcaaaagtggcaacgtcatttgtttgggcgtcttcagcattgagccattccacaaattccgccattttcccaggcacttgcgcagcagttgcttccaccttctgtccgcccacagacacttcgaccaatctgtattgccccggcgtggattccttctcccccgacatcacattggcatggagaactttgatggtttcaaaattacaccgattagaacaatgacgagaagcggatttaataattattttttaaagacaaatcatacatttactaccatcaaaggatcacggaaaatgcattagagttctgtgcagtgaatatttttttaatcattttaatttttgaaatgttcaaaaaataacacattttccaaaatctattaaaaacaaacataacatgaatggattattgtaagtttatgaccattta

SEQ ID NO: 8627 - DNA, 1439 bp, Heterodera glycines
ttttactcaacaattcatcgcatacaaccatcaaaacaatttaattcttggaaagttttatccccttttcttttgcagcagaaatattctacttgttcagaaattatttttgggtccatcccttcggtgtccaagatgtacaagaagtccttgtcatcatcaaacgacgcggacacatcgcgatcgcgccgcatgccgccggcggtgttccgtcccgcttctctgcctctttgtatgtccactgctttttgatggtcctcgggggtgtcaaaatagtcctctgggggcgttggtgcatcttcgctgctctcctcttgtggcatttgtgaatcgtcgctgctcattttgtcggaaattcttcaaaaaattcttaattttggatacttagatgattcggatcaaatattgacaaatctagaacattatcattttttggcacaacatgtacatatttggcgtttttagcacataaacccgggccctatttatggagagaaaaagaaagacatggaacaaaataagaaaattgatattttatgtcaaaattccaaccgtttcatccaaaatttagtcaaaaaagtcgaagattcaaaattatcacctttgttcttaaattgaccaaaaagttaatttagccaaaaaccattggaacatcaaaaaatggtattctgtacaagtacgaacataaaaatgaattttgaaaattttaaattttcggtttttttcgaattcgggtccaggattcggaattgaccaaaatttttgacgctatatactactttcagaacaaattagaaaaaatcagtactttttttcacactcaccaaaaattcatatttaagcacatttattcctcactaatcatcattagaaagccttaaatattttataatatcatgcaaaattttaaaaaaaatttttattttcaagaaagttatgacgaaaaacgttttaaaaattgttattttttttagtttctcaggctataacttctttgaaacttaacagatttttctgaaattttgcaggatattagaaaaaatttagggctatttaaagatattaaatttttaaatttgattgcttttggacgaagttgtgaaaaaattttctgttcaaaaattgtcatttgatggtttttcgggtaacgcgacctggcaccatcactctttcttctagcaattcgtctgatttggcctctgacagttctttcggctaatattttcgaattttatttttataaaatgcgaaaataaatttacataaaagatatttaaaaaaagtttttgcactttattttaaaaataaatttttgataatgtaaattaatttcatcataaattccacttaaagatgcagctaaatcattcaattaaaaaatacttttaattgaataagcaagcacctacgcaattagcattcgccagttagaaataaat

SEQ ID NO: 8628 - DNA, 857 bp, Heterodera glycines
ctcttttctctctccctctctcttctctttcttcctcccttcctctccctctcttctctttctttctctctcacttttctctttctttctttctttctctctctccctttctttacatctctttctctccctctttcctcttccattttctctttcttctctttgctcttctcttttatctctctctctctcttttctatctctattattttctctctctttctctctctctctttcctcttctctttaggtaaatgcgcatttagtgaaaaatgaagttccaatctttttttttttggagtttttagagagtttgaaattagtcgaaatagatgccgtgttaataatcaataaccaaaaaaaccatataatggtgtgttttttgctttcaagcaaaaaaaaacatgaaaattatttatgggcctaaactacataaaaccaaaatttttttaatgaaaatgatagattaataatataccaattgtttttgaaatgcttacttcttccgcgatttctccaatcttttatttaattatagttaagccgtataaagttaacaacaaaataccgacatttatgtcgaaaaaaaaacaaagaagcataattatttttactcattatctgtaaaatttattaaaattggttggaaataataataaataaaaaatttaataatgtctttcatacaaaaaatagatttacaaaaaaaagtggtattttatttcgaaagattaaggaaaataatggaaagaaaaatgtgtttacgctaaccatattagagaaatagagaaataacgaaattttgttttgttagttacagaatcaagtgaacatttattaaaagaaaagacaatgaa

SEQ ID NO: 8629 - DNA, 2518 bp, Heterodera glycines
atgagcagatcattcgccgcgctcagcctgttgtcctcgtgtcggttgttcatcacgtcagaaaggaatgatttaaccaactaaatttttgatgaaatttctcactcaccatcgtcgagaccgaagccaccggcgccttttgatgtcgatggtgtcgtcatcagctcacaacgtgccgtggatgttgacggcattggttcggcttgttggtcgtcgtcggcaggagttgaagggtatgacacatcaatttccaacatctccaccgacggcacgtccatttcctgcggtgtcatcggtgttggatttgatggtggtcgtccgtcgttgtcccgcgccggtgcctctgatgtcgacggctcttcttcggatggttgtggcgtttttgcatgtgttcggctggggagcggctaaaaatttggaaaattaggattttatgaaaaatgaatggaaaaactcacttttcttggcccatcggccttatctcgcctttccgccttctctcgtctctcctcccatttcgtccaacgcttttgggccccgccccttttttgctttgtagcttgtttattacattttttttgccataaaatctaataaaaatgaaataattatttattataaatttataacttttgatttggactatagacaaaaacgaattcactatagacagatgcagaatttttttttctctatcaatgtgcaaaatttaaagaaattctgttaatgtaaaaaaaagtttcttagagcgaaataaattttttttttcacataattaaattgaagagatagtacgccaaagtgagagaaattacaaagaaaaagagtaacgtcgagatagtactaggcttttctctgcacagtggagttgacccatagtgaagataccacttaagcgatttttggaaatttgtacaattttaactattaaaaagataaccaaaatgccacataaaatatccaaaattgcatttttttcttgaaaatctcttaaaatgaatgtaaaatctacaaaacttcgccaccggccccaaaaaggtcgttgcattgctggtgtacggacatttcgcctactggacatctcgcctactgacatttcgcctactcgacattttgcctactaacccaaaatcggacgtttcgcctactaatccaaaatatgacatttcgcctactgacatttcgcctaccaacccaaaatcggatgtttcgcctaatgccttaaaagagacatttccatgaagaatttctttctaaaatagatttatatttagcttatatttataaaagtacaccgaagcaaagaaattttataaaattcaaacgaaatatagaaagttaaaaatattaaattcataattcaatttgcatcggcatcatccatttcttcttcatcactctcttcatttccacggatgtgaagtccctcaacaaatccctgcattatgagtccgagcagatgcaaaatgttggccaatccttcagattcaaagtcggcctcgtcaaggatccgcaccacattttgttctttgataatgtaccgttgcggtcgttttctacttttctggagctgttctgcgcgtccgatgtccagttaattgtcgatgtctttgatgaacgcagcaatgaagtcactcaatgatggattctttgttctataattgatgtgtactatgtatctttatttatttgaatttttcaacctattcgtcattcgatcgagcgcttcgtttgtgccgagtaattcaaaggtttcatcgtcgacacccgtcctaatttgtgcgcgcagcctgttgttctgcgtttgtcctctcaacattaattacgctgtcttcgtttgctggcatccgaggccttttggttggcttttgcagactctcgagtatttcgcgaacagttggcatcttattaaaaattttttttgttggtttgggctgaaaagggaactttgaataaattacagaaaaatagaaatgaaacaaattatatgtttgatgcaaaaacaacgcattttatactctatcacactatttttcttttctctttagcatttttccagtaggcaaaaattcataggcaaaacgtcagattttggcttagtaggcaaaacgtccgattttaggtgagtaggcaaaacgtccgattttaggtgagtaggcaaaatgtcgagtaggcgaaatgtcagtaggtcagatgtcgagtaggcgaaatgtcagtaggcgaaatgtcagattttgacttagtaggcgaaacgtccgattttgccttagtaggcaaaatgtccagtaggcgaaatgtcatcgtgcctgcattgcttggcctattcccaagctaaaatagaagtttaccatttttaaaaattttataataaaggtgcacaaagtttgaaaacgtcccggtcccggcggggtcccggcccaaaaactgggaccggaaatcccggaaaaacgggagtcccggtcccgggatcccgtcacggttcattttccaagtccaggtccaggcaatttcaaaattc

SEQ ID NO: 8630 - DNA, 2417 bp, Heterodera glycines
tggaaatggcccagccaatgcccttggaaatggcatcatcggtgcccgtggtaatggttggatgcccgttgaaatggcacatgacaatgttacaataattaaaatatcagccaacaccaaccaaaatcgtccagccaatgcccttggaaatggcccagtcgatgctgtcgaaaatgagcctgccgatgccgttgattatggcccagtcgatgccgttggaaatggcccagtcgatgcagttgaaaatgagcctgccgatgccgttggacatggcccagtcgatgccgctgtgctgaaaatacgacgaaaacgtgtcccggcattactattggccgccgtaccgctggcaaaaaaatttgctgttgctcttttggttgctgctggaaaagaaattgggaaaaatcttttttcgggaagtaaaatcaaagacaatccagctgctgatggatatagtgattcgaaacaattttatgtttcggaagaatgcaagagggattttaattgcacctttttcgcttgccacccacatcctgatgcggaaggcgacagtttctgtcgcaagggcttcacgcgcaaatgttgccaagtatttaatttaaatttttaccaaatggaattagtaggtgaaccaatgaaattttgtatctttttgacaaaacgaatggatctattaaaagtccatgaattttatctgcctaaacaccaatcactggacactgtttgtcggcactatttttaggttgtgtagtataagcaaaagtaccatttttacaccagacgatctaattatttaatacataaatttgaattaattaacttcattttaggaatacaatgatggagaaaaggtaattgttcgaggaagattataatgcgagattttaatggctaaaaaaccatcaaaaagggcgttataaaaaagtaaaagtgaaaattctcaaaaaacaacccataattttgctcaaacccaactaaaatttaattcttgatatcatttatagccaaaaaaagttcactattagcctgcgaaatttcaaaattggaaaagagcttctggactagtcagctgacggcaactcagccgaagacaactcagaatgatgacaattcggcttatggacaactcagccgtacaataaaaaattacaaaataaagcctaagcctaggccttgccaagccattgtacgagttgcgtttcaaaattctcgtaaagctgagctgtccatgagtcgaattgtcgcatcagctgagttatctgtcagctgaattgtcctaggctgagtttttatttacaagctagtagaaaactcttagggctattgaatgatatcaagaattaaaatgtttgtattgagctaatttattgtagtttttgttgaaaattttcatttgatggcttttataacggcccagtgccctaatgattgattatctattaactttgataatgataaaactcactcatttttagaaattggacgaaaaactagtttgttttaattaattatgaactaaatgaacatttgaaatatcttttaaggaaaaatgtttttataattttccgatatgcggagaaagtggatgcgttagtgacagaaaatactataccattaaaagcaaaggcggaaaagttgagattatatctcatgcaaaaccaccgcctgaatgcgcttttgatgcggtattacttttttatgcaataaaaatgatgctaaatcatttgaagcaagcgtcgatggttggggtgaaatactattatccatatgactacggagagggtgttcagggggtaatctaccagcatatagtagtattctagtattcaaataataaattttcttgaaagatcgtcaaaacttacgtatttatgtacgacgatgacaaaggatgtaaagagtgtgggtggcgcatttgcttcaagaaaataaatgttattgaagaatttgtgtgtacctgttgtgatcaggcatctttttctgggtgccagtgggtatgtatttttatttgaatctcagagtgaagaactcaaacattggaaaagcatagattttttttttaaataactgcattttttgtttttattacctttttgagtaatttttcccaaagataattaaacaaataaaattcacaaatgataaaaactcaaaaaaatgaattttattttgttttaaaatcacaaatcaaacacttgagttatgaactacaaatataaagcccactcataaatgagttttatgcaaatttacaagaattacaaaattaaaattgctttttgggggtttcccaaaaaaaatatttgatatttttttatattatttttcgtttatttagcaatggactgatatctgccattaccaaccggacaccgaatctgacagtgacactctcaaatgcccaggtgcaatggaaaatc

SEQ ID NO: 8631 - DNA, 2813 bp, Heterodera glycines
  misc_feature (2750)..(2750): n is a, c, g, or t
ttttaaaccgagtccaggtcctgaaaaatccaaaaaaaatctttaaaattttttcatgaaaataaaataaaattttcatgaaatatatttattttacaaacaaactttattttttgtttttaactcgctttttttgtggcgctgttttacattggggcgggtgcggggtccggcggtgccgataggcgccgccggaaaaaaaaatttgaaattttgagtgagatttgttaacagaatttgtcaaaaaatgatctttcaattgaaaaattgaaaaataatttaaagaaattataaaaaaaattctgtaccgttggggaattgaacccaagagaaaaataatgaaaggaagaaggtttagccaccagaccatatttgaattgaacctatccaaaaatagagaagacattaaggaaggagaaaaagagatttatgatttttttcgcgtaaatttgaaaatttttctgattgctcaaaagttcaatctttaggggtgtattttcaactctcgcctctcgtcccaaaaaacgagagacgagaggcgagagtaccaaaaatggcgagagttggcgagagacgagaggcgagagtaccaaaaatggcgagagttggcgagaggcgagagacgagaggcgagagttgtcccacccctgatagggagtatgggtttgtcccccccccccccattttttgaaaaaaatattgtttgttttcaaatcatgaaaatatattataaagggttttcgaggttgctgatcactaattcggcatcctttcaaccaattccgagccccggacccgaattcgaacaaaagtcgaaaattcaaaattttcgattttcatgtgtttggtttcaaacttgggacaaaccctactatttattacccaaaaattcttaaattcttcattcagctcattcatattccatccgcatttatttgatatctttttttcagttcacttctttttaaattctgtttgattaccaattcaaacaaaaaaaaatgtcggacaatccgaagaaagcaaataaagaaatggagaaagcgatgtaaatacctctctaaatttgaattttccatgctaataattttgcttttccattttcagcttcatctctgccgactgttggctgaaggttttcgatttgctgccacctgttcaacttggtcttggaattgctatgattaaccgccgatttgactattacgtcgacgaacattttaaaacgcgcaaatggacattggacaaaatggaaattcgaagcaaaattggacagaatggcacaaaggaaatggaaattgtcaacaatttcaatggaaaagaattgccaatccctcattatccgttgccgaacaaagtcatcggattcggaagcatttttatcctgtaaaaaaaaaatgaatttttgtaatgatttgtgccaatcacaatttcatttaattttcagcttcatcgaccaaaatgtgctcacttttcttcgccgttttcaccgttttttctccgtttgtgcaacaaaattgtacattctcactgagaatgttcgtattttggagttccttctgctcagaatttggccaatgttcaaggacaccattcattggatgtgtttgaaccccatcgcttttcgtctaatccgtcaattggccccctcattgctcaacgattatccatcccttcgttttgtcaatttctttgacggcatttccctcgaatttccgcccgatgatagtgccaatgcgtcggatggccaagcggtggccaaatggctgttcacgcctcgtcccgacaatttgatgatgatctcattgtcagcattcaggattcagcgatggaacagcaatggttggcaaccatggaacatatcaaagcggtgattaattgatttttccaatttaattccttttttccttctttttcttgtctttttttaggctttttccgctgcttcttctcctggtgcatttcgcatttctgtttacttttcgctgccctcttcactttcttccgttgtgccatttgaattgaccaacgaattcaccggggaaaatttgaaattgtccaaagaagaggaagaagaagatataagtggcttttccctcattcgttgtccaattgggcccgatgataagagacagcagcaaatgaataaggaatttagtaaacgaaaccgaattgacatttttattggagacgacggagtcgacgatgggtaattaatacgattaacaattttaaaaatccaaatgcttatttttgtttttcttttcagtcttctcgacggttcgcccgggccgagtgatgatcactgatcagaacagcggaaatgaattgattgattggttattgatgcgattatgtgacccaatgttggcctttgctatttaaatattgttgtatttgattgttgctcataaattcataaaaaaacgagttaggcttaaccaatattttgtaacgtaaaaacgcaaaggaaatgactgtgctaacttataacactgggatggatggattaattggtccaaagctgaagaaatagcatcagatttgttgacaccccaaaaatggaaaaattattaattttcgcatggaaaccccatggcctcgcattttgaggagacttagattttgttgtgattacctatgtgatcgaaatgttggttctcagccatttaattgttgttgtatttgatttttgcttacaaatccataaaacgaattaagcttaaaataagtttttaccacaaaattanaaattgctgttttctgctttactcatcccatttttgtcattccacaaattaaatcaaatataa

SEQ ID NO: 8632 - DNA, 2778 bp, Heterodera glycines
atcaggtctttgggagtattgtctaattaccagcacacaaattgtcgcataatccgactgaagcggagagagaaatggaaaaagcgatgtaataatcgaaatttgatttttattttcatggtaatcattttgcttttccgatttcagcttcatctctgctgattgttggcttgaggtgttcgttttgcttccacgctctcagcttggctttggaattgcgatgatttcccaccgatttgactattttgttgacgaacactttaaaacgcgcaaatggaaattgagaccaattgtaattcaacacaaaattggacagaatggcgcaaaggaaatggaaattgtcaattacgatggaaacgaattgccaatcccacaaattccattgccgaaaaaagtcatcggattcggaagcatttcgatcgggtaaaaatgaatttgtaaatgttttgtaccaatcactctttcttatgttttcagctccatcgaccaaaatgtgatcacttttcttggccattttgaccgctttttcgccacttgtgcaacaacattgtctatcgatactgaaaatattcgtattttggagttccttctgctcagcatttggccaatgttcaaggataccatttatcagctgagtttggacatcatcgcttttcgtcgaatgcgccaattggccccgtcaatgctcaacgactgtccatcacttcgctttttcaatttaagcaacggcatttccctcgaatttccgcccgacgacagtgccaatgcgacggatggccaaacggttgccaaatggctgttcacgcctcgtcacgacaatttgatgaacaatctcacaatctacattgagaactcagcgatggagcagcaatggtcggcaaccgtggaacaaatcaaagcggtgattatttgattattcactttttaaaatatttcttggtatttttagtcattttcctctgcttcttctcctgtttctttcggcatttctgttttaattccgccgtcctcttcaattgattccattgtgccatttgaattgaccaacgaattcaccggagaaaaattggcactgtccaaagaagatgaagaagcagatttaagtggtttttccctcattcgttgtccaattgtgtccgatgataagagacagcagcagatgattattgaattgggcgaccgatggaaccaaattaacatttttatcggagacgacggagtcggcgatgggtgattaacaattttaaaaatccaaatgcttatttttgtttttcttttcagtcttctcgacggttcgcccgggccgagtgatgatcactgatcagaacagcggaaatgaattgattgattggttattgatgcgattattatatgacccaaatgttgggcaaagatatttaaatattgttgtatttgattgttgctcataaattcataaaaaaacgagttaggcttaaccaatattttgtaacgtaaaaacgcaaaggaaatgactgtgctaacttataacactgggatggatggattaattggtccaaagctgaagaaatagcatcagatttgttgacaccccaaaaatagcaaaaattattaattttcgcatggaaaccccagggcctcgcattttgaggagacttagattttgttgtgattacctatgtgatcgaaatgttggttctcagccatttaattgttgttgtatttgatttttgcttacaaatccataaaacgaattaagcttaaaattaagttttttaccacaaaattaaaaattgctgttttctgcttactcaatccaatttttgtcattccacaaattaaatcaaatataaattgttcaaattggcacacgaattttcgcggtctttccacttaagtgccgccgtttcgccaataagcaattccatcggggaaaagctcagcggaatcgctgaattcagcccagtgagaccggtgagaagtgtcagcgatgtgagacgaagcaaattgtccaactgatcgcaatagtcaaatcgcaaacggtgaatgttttttgtaaaatgggccaaatttgacgggcaaaaacatcccaaaggggctggacatccttcgttttgaatgccacacattcaaatgcaaaagggtttttccggatttagtaatactcaccgggtcataccatcggaaatgttatccaatatgaaaagcaaaacttatttgctcggatgttcataaagcacatccttcgttcttttcgtgtaccagagtatataaagctgacaaaatccccttccagtcatattcttcattcagcccattaattccatccccatttatttgatccttttttcagttcagttctttgggaatattgtctaattaccagcaaaaaaatgtcgcataatccgaaagaagcggagagagaaatggaaaaagcgatgtaataatctaaatttgatttttattttcatggtaatcattttgcttttccgttttcagcttcatctctgctgattgttggcttgaggtgtttgttttgcttccacgctctcagcttggctttggaattgcgatgatcagtcaccgatttgactatttcgttgatgaacatttcaaagcgcgcaaatggacaatgggaccaattgtaattcaacgcaaaattggacagaatggagcaaaggaaatggaaattgtcaacaatttcaatggaaaagaattgccaatcccacaaattccattgccgaaaaaagtcatcggattcggaagcattacgatcgagtaaaaatgatttgtaaatgt

SEQ ID NO: 8633 - DNA, 937 bp, Heterodera glycines
  misc_feature (85)..(85): n is a, c, g, or t
gcaaatcaaaatcctttcaatgcttttttaaaaattttcgaatttagcatttttgataaaaaacggtgtaaattatctcttattngttggtgaaggatggtggctttcattttgtttacatgtatttaaaccggttttgaaccaaaaattctcaattcaaaaatttggactttcgtcttttggtcgaattcgggtccgggattcggaattcagatttgtttctctgacgcattttccgggcacggattttttttctccttttcacaacaatcaaaattttctcgctttcgggccacctattcctttatatatggcattggtaaattaatttgtaattggctgatgaatcgatgcccaattattatggagacggcggcggatcagaaacagcagaagaaagacgaaaatttagaccatttgaacggggtcaacttcattcttcttgaaaatgctttgggtgagcagcaaaaaggaggccttaattttgtaacggacagacagtacagtatatatctgtacaatactttcccagaaaaattctcacaaagggtgaaataggcaccaaatgccataaaaattgcctaaattgcttagaatcacattttagtatttttaaaattaatttttgatatatcatttaaaaaaaattgattttttagggatacattttcacaaaatttctataaattttcaacatatgtaaaaatgaaaatatgtacgaaaaattgcgaaatatgtacgtaaaagtccaaaagatgtataaaaagatgtacatatgtaatacgtatggtatttccgggttatgctgccccccgccccccccccctcaaaaaaattccaaaattcgtaatttggggttttcaaggtcgctgatcacgaatatgatatttattttaacagctgatgacttttaatcatagatttgacaaaatatcta

SEQ ID NO: 8634 - DNA, 2875 bp, Heterodera glycines
tctctatttattggtacacatctcgttttttcggacgtttcctcagtagtttatgactttagttataacctgataaaattttgaaactcataacttttttctgagatgtgtttgctaacaaattagcattcgcttagaaaaagattttccatttcaaaatccttttttagatactaaatttgttcgttttggttgggtaagcgagttatggctgatcaaaataaaaaacagacaatctgcggaggatgaacgaatggtttttgaacgcactcaatcccagctaattgcgaagccattctcattcggtcgcgcaattccccccccccccccaccccctccaatcttcggctcataaatccatttaccacacaagaaacattggccttgaaccaaagaacactctgtccatttgaaaaggaatctctttcttcctctgagagtttgcttcgaataaatataatgaaacaattaattattctgtgcttctcctaactatcaatgcgtctttggctattcgttctctcaataattcttcggctccctccccatttttctcaacacttccgccgtgctcacaaatggctgtgtgacggttgcgtcggcagtcgtcccgcgcaccgcaagcggcggagtgttggcatacaaatcggagaagagcgcttccggaggtaaaactgaaaaaacaacaaaataaggtggaaacaatgaagcgccatgccttcgtctgaaagtgcgactttgaccgcctcgtccacctcctgacgcactttcttgtcaatgtcctgcggggatggaatgaccattgatttgtgtattcattggcttgcaaatgctttcctccccccccccccggccacagctcgtccacctttaattcctcctcagtgacaagtcccgccgtgacaatgcgatctttgaaactggtgatggggtccctgctcttccgcacttcctgtatctcatcccgagtacggtagctgcagaacacacagttacacacattcacagtacgccatttcccttttcattcattcacctcgtcccggggtccgacatggagtggccgtagtaccggtaagtggccaattccatcatcagtgggccattgcccgcgtcacagtactccttggcccagcgagtggcctcgcggacggtcagaacatccatcccatcgacccaaatgccaggcacatagtcactgggaattggagaaacgcaaacatcgtttacaaaaacggaaattaatccatttggccgttcccccatttccccgctttacccccgcgtgtaataatcggtcgaggcggaggcacggtccacgggagtgcccattccgaactgaatttgcaagacattcccaaaatgacgacgacaactcactccgttattctcgcaaacgaaaatgcacggcaatccccacagtttggccatgttcgtcgcttcgaacagctgtccctggttagccgccccatctccgtaaagtgtcaaacagacgtttttctggctgcgatatttcatggcaaaagcaatgcccgccccaatcggaacttgtgcgccgacgattccgtttccaccgaagaagttcttggcgtacatatgcatggatccgcctaaatgaatttttgtcaatttttaccgcctataaaatggctaaaaaccttttccgtaaacattcccagcaatgcgtcctgaaagtgaattgaacttagaaccagtgctactctcgagactgacctgtcagttcggccaaaatgtcctggaccgtcgcgcccatcaaataagtccatccgtgactgaaataaacgaagcgataataaatgatcaattaattattcatgtgagtggttgcagttctctaatcccggccaaccgaccatcggtaagccgtgatcacggcatcattcggatcagtcgctgccaccatcccaacggcacatgcctcctgagccaaattcatgtcatttgttggccaaggacaaaagccaagccaaccaacttgtccggagtaaaggtgacagaagccacggatacgcttttccttgtacaaattgttggccgatgtcttgaagggatgcctttgtccgttgtctcccattttgcattccttttcccccctccctcacctccatccgtcggaccaattgcatttttctgtaataatccaacgcctcatcccgcgtcagtcgcacctccgtcgaaggacccgaatctgtgacaattgaaaatgaacataaaatggaaattaaaaaggaaatgctaccgagtttgaacagtttgtagggacgcgtttggagggtcacttcgttaacagaagaaaagaaccgaaaggcagcggactaaaaggggggaaaagagcgacacgaaaaggccgaacaaaccaacggatgtttggaaaacgaagtcaaaaatatcatagtgttctgctaaacaaatgctaatgaaaaacgaaatgaaatcaaatgaaaaatatccagacgaggaaacaaaggaaaaagtaagccaaacatttgcaaaattttgcgccaatcaaaaaatttgttgttgtaatacgcgtaataatcaatcgttcaccacaaaagtaggttctctttttactttttctgttgaccattcatcatcgaaccatttttacaagttaacaatgaatgaatgaacgaagacgaaatcgatgagagagagaaaggtcaaaagagggggaaagaacataatacaaaaaaaaaaacaggagaaatcggtcacaaaaggtaaaggcatttgttgaagtcaattattcgtccgctttcagttgcgactgtcccttttttcctgcacccatttcaaaatacgcgctttgagttctttttctaaacattgccaatgcataaatcttggctta

SEQ ID NO: 8635 - DNA, 3034 bp, Heterodera glycines
cccccaaaattaggaatttacccacctgagcaccaattttaagtgaaatctcagccaaaatttcgacttttgaggccctgtaactcttgaagaaagcaaaatgcaccgttaaaattaaaaattcacactagaagtcgaccctgctctatccaatggtatatcatttatatgcattttcctagttacagctcggaatgttcccttggtttaacatccccacgaatcccacccggtctcagttcgtcggtggtgagtggttgtcgggtgaatggatttgtcgggtcgctgagcaaatggcgcagaatgtttttgcgatcgcaaatctgtcccgagggcagttcgaccgggtcgctcatcatcgtgtagacaagcgcatctcaaaaaggcgaattattccggggaatatcactcgcgccacacctttgaactcttcgggcacttcgtcttcgaattcctcctcgaacatcattttctctttgtacgctgcttctgcctgttccgccaaatttgcaaacaattccaagtggttgatcgtaagaatgttcctcattttaaatctttcaattatcgtgctgaatgcttccggggtgtacgaacgctaaattggggagatcagagaatgtctaattgcaatttaaaaattcatcttttccttttttgggggattgcgtcccggcaaataaaaaagtctgaaataggtcacctcatcctgcgcaatttgcttggcgaacatttccgagcccaaattgatgtagaccttcacaatttgctgtgtcaatgtgcgcgggtcccattcgaagcgatttattgcgtcgtgcactttcagttgcgcacatttcggtccacacaactaaaaaagccgtgcattgtttgggctttctttttttggcttttcccttccctccccctccagcccacctggacgaggttgtggttgagcatcgccgcaactctttccccaagcgcttcgttgcgaaatatttgcggcgcgtcgctggtcagcgtaacgaatagttccatggtgtcagtgccgagttggatccacattttgacttgtcccttcgagtctctgagttggtccgtcttcagctgctgctcctcctgactgagtttgtcccattcggtctcattgctcataacggattcaatgtcgtggatcactttcaatttgtcaagcgattcgtcgagaagaaaagttgtgtcgttgagcaccatgttgatgaaacgaacaaaactcggagaaaattcactgaatggaaaaataaaaaatataaacaaaaaaacagaaaaaacacccggcgtattggaccattctgtcgcgatgcgacaaatcactccacatgcatttgaaaatgacttgaatgttccttctgatattaaacttgtcgaaaaattcagtgtgtgaacctaaggttttgggagcataaaggagaagaaaaaagaaaatcggaccagttgtttcaacggccgaataaaatttgacgagggatgggaacagtccttcaacagcaagagaatcactgacaatttgacggtaaaagacggatgcatcatggttaaccaaagggcacagcatgaaaagcaaatcgacgacctgaaaaaatcagaggaacagagcaaaatgttcagaaaagggaagcgggggttttacctttgaaccaatgaaagggttctttatgctctccaagttgagaagcaaatgaagaacttgcttcggaaagtcggacaaattctttaagaaaatccgactcattttggacttgctaaatggaaaagtaaaaagtcgaaaacaaaatccaagcaaatacctgacgagcaaagtgagaaactcgacggcaacttccaaataggtctcggggaaagcgaagaagcggtcaaagtccggttggaattcattttgaccactgaaacaaaaataccaaattaaagcagaaaaaaggaaggatccttacaaaacaggcataatcgggtggagaagcattctgagcagtttgttggtgaaaagcacacacatttccaccaaattggggtcgtgcaacaaacattcgtagcaataggcactgagattgaattgctaaaaggggcaattgtcaacaaatgtcagtaaatcagcatcaatgttcgttgccttcagcatttccttggcccttctcattgcgcttttaatgcgtgtgacttgcgccgggttggcactgtttcccaatgcgttcattcgttcctccatttcctgcactctccgccgaaggtccgaaaggtaaaagcgtttgaggcgtgaaaatgcatttgacatggcatttacactaaacagaaaagcaagagaaaatgccgaaaaggaccaagagccaatccatcgctttctcaccttatccgcatgaattcaatgcccaaatagaaacattcggtgttgaaatttggcacatatgtcaattccgctaaaccaaaaaaaaaaaaaaatttttgtaaaaaattggctgtaataaatttacctaattctttgcgataactttccaatttttccgaatccatattaatacgtgattcgtcggttgtgtcaatgcgacacttcggatggaaaaggtaatcgctttgcactttctcaatgacaattttgtcggatagcaaaaggatgacggagaaaacgttcagcacggaagtacaatttgcaagttgagaaaagtccgcgtggagttgggacaatttgcgattggttgtcaaaatgtgaaagaagtaatccaaagtttggtgacgcgtggaactgttgacgaccaacgcatgcacaacggagtggaggttgagctgaagcggggaatagcatggcatcgacagaaggaaacggaccgaacggccaaccaaaggccattcgacggaaagcccgaggggaggggggggggggggttcgacatcatataccgaactgccgatacattcacagtaatttcaacaaaaaaagaatgtacaatatctcacaacaaatacaataatacgtaacaattttataaaagctatcctttcaacaatgctaaacacatcaaaa

SEQ ID NO: 8636 - DNA, 1241 bp, Heterodera glycines
ctcctctcgccaccctccactcgtcgaggtgccttctccctcccctcaccccacaaagtcccttcaggagaaggaaatccgatcggtgatgaatggccaccattttctcagccgcctgttcgccctgcgccgcttggcactctttccgtcgccgcttggccccggcggcgcttccgtccccccgcgcgtctcttcgcccgcttatccgtccgcttcctcctcccatcgctccgctgctttttctttgcttcccatcgcttccgttttcgccactctccgcgttaataacagtcaaacgtttggcgacggagtaaaactgttgagaatctccgaattgagtcagaacaaacggagacaaattgacaagcaatttgtgtggacgggagaagaaagcgatgagaaagtaagcggcgaaaggaattttcaaagtgtcggcagacactcccaattttaaaatttgaatttacaatttgaatttccaacttgacctccgcctgctgaatttccctaaattattgcgttgtacctatctttccccccccccctcagatgaccaccattaatttcgtcgatttggacgcctccgctacggtcccccaattgttttatgagcttttgtttggccgtccggaacatttccgtgcccctttctttgctcaagccctgtacagcctccgtctcagcgttccgtcctcagtttcccggcccgggcttcagcaagtgttggcccggatcaccgccttctcccctttggatttgcctctgaattactctctcctgtcgcccctctcggagtgtccctttagcgtcgtcccttccacgggtccctcccccccccccccttctccctttctttaactttgacttcccattttaggtgatattgtcgtcacccatcctttgcttaacactttttctgtcgaatattgtatgaatttggtggcaacagacaaaaaagggatgcaaacgcgagtgcccatacaaattgtgttatcagaagaggaacaatcacaaaatgggggaggcggaaaagtcggagggacggagccaaaggaatgtggcgtatttgaagaggacacggaactattcaaacacgaattcaaaaagacacaacgccaaaccaccgacgaaacgaccggcgggggaagtgcggtggacgggaagacgacagaaaaggaaacggaagagagtgagaaagccaagcgaaaggggggaaaagccaagggaacgggggggggggg

SEQ ID NO: 8637 - DNA, 3619 bp, Heterodera glycines
ggaaagaaagaagaacaacggttatttataaaggtcgagaaaacacaacaacaataactgatcatttgttaaaagcaattgcaaaaatcgcaaaaattctctttgtgtcgcgtcacttccgaaaagtcataaaggcggaactaaagaaagaaaataggcgaaattttgcaaagggaggaggaaatgaacgttttaggctgattgaacgaagtgtcggctgacggagggcttaaacaaaagcaaatggcaattagtgaccggaaaagcgatggttttaattacccgccaccgaaaagcgaaggcggactttgctggccggcgagttggccaaagcctgcggatttattcgcaaagctaaaagtgccaatgaacaaccaaacaaacaaaacaaagaacccacgcggagaatcccgaactgagtggtgccggcgcggctccccccgcgccaatccctcccccgaacatcgatttgcctccaaaagtcgttccgcccccgaagggactcgcaccgaagccaccggaaggagggtttggggacgaaaacggagagacactgccgaaggacgcaccgccgccaaaggcactcggcgcagcggcaccgccagcgaaaccgccgccgaaggacgatttgggagcagagggagaggaaaagggagaagcgccgaaaggggaagctgaagtggaaacagaagaagtgcaagcaaagaaagcagcagaaccaccagcagacggcgaaacggccaaagagccgaaggtgggcttggaggacggagtgccaaacgacgccgaaccgctgggagtgccaaacgaagtcggaggggtgccaaagagagagcgccccgaggtgccgctgccttgggccgaggcaattgacccgaacggattccgacccgcaccaatcggcgtggacgaacccaaaccagacctgtggaaatgttcgaaacggaccgttcttggggcagaacgtacttcataaaatcgaaggtcaccgcctcgcgtgccgcatcagccgcttcgtcgtccattccctcctccgccacattcgctttttcagcgctttctcccgtcggttggctttccctttgcttttccgtgccctcttctccccccgtcaatcccttttcggtggcttggctttgtgaaagtatcgcaactgtttctggtggcgatggtatcgctttttcggtgggcggagtggccaaaggcattgccactttgccgggcactttttccattggtttttccacaattggtgtctcttttgaaaccgcttctgttggctttggagacagagttgaaaaagacaaaggcgtcgatgagattggcacggcatttcgcagcgattgccccccattcttcgcagctttcggcgtcgatgtctttttcaacggggctccttttgaaaagtgatttaacccaatcaaagtcacactaacacaaagccagccccgagtacttttcggtgtcttttctcgactttgggctgcaaaatcgggggattggacgccaacggagaccaattggggcttcggcggagaagccgcctcggaaatccgttgggccaatctttgatcagcgaccgattgcattggcactgtttggacagcctccgattcgtccggcattttgagagaaaaaatccgcttcacttccacctcgtttggtcttttctttaaaaatgtcattagcatagctaattaattgcaaatgctcaccattagatagtctcgcaagttgttttgcaattgttgcaaattgcttttcgtctcgcgaatgaccaaatggggacgaccatttcccacgatcggcagttttaattgttccaattctaacgcacaaaaatcggccaaagggatggaaatttgagtcaattttttgggatcagtcgccgacgaggcgaatttccgcccgaccgagcgacgtatttggtgaagccgtgaattcagtttggcactcattttcgcgatgttttcattaatttggatgatttttcgttgttcaattggcccaattgttgtgtcttccgatgttctatgaattttcatattttcagtttatataagcctccttaagcataatttttttttttgcttttctgaacccaaaaaagttttaactttttgttaaataatttttgaacttataagcactatgtgtcaaaatagcatgtttagtatttttcgccaaaattgccaattgtgcattttcaggtcaaaatttttgaaaaatttgagggatttagtcgtccgatgcctttaggcgccgccggagaaactttaaatttataaaaagttagctatttttcatttgggatgtgatgggaattcatcccttctcccttggttgctggcgcggtttatattaataaattcacctcgggatttgctttttgcgacacccttcgaatctgtccatcatttttcgcgcttttttcattttttccataatattttcgtattccctctcaatcagatggagccgtctttccttaaacagttacacgtccacactatgcctgacaatggtggctcttaccatgtcaaatgacggtttgttcagttcggccgatgtctctccttccctcagggccgccaatttgagtccattcagaaattccattttgtcatttgtttccacacaaagtctgtccagagaggaaaggctctgtctgaaggagtgcagcaactccgtcttgatgttgtgcagttcaacgagaaaccctttaacggtcgtttcttttctcggtgttttcttggccactgactgacccgtgtccaatggactcgcacttttctccgcttcgcgtcgcaattggcccaactgcgcaattcgctccgtctgctcgttccgcttggccgtgtattcggttacgcttttctccaacgctctttccaacgcggcgattttgtccctttcgcttttcagtttcattttctctttttccccattttcttcctttccgagtgttttttcctcaattcgatttacgcccctctaaaagcatttgtcttttgattgaatgaacggagaaagccaaacaatgtgttcctcctctctttgcatcgtttcgatattcttcgtgggcatggaattcgcctgtgttgtttcgtcttttgattgttggtctgtggctgttttttccgccgaattctcaccaattggcgatttcccaaactttgcatttttcatttcaatttgttcaggtgctcttaataagaagcgtgaacacttgaaatggaaataacgacaaaattcaaaacgaacgaatcgaactttgtgagcaaaggcctttcattgttcagcgaaaggacggcgtaaggtaacaacgaaccggaagagttgaggaaatggacgaacggaggagcatttcggactgatttttcactcccttctgaatcagagggaaaggaatccatccgaagcattttgaaggaacctccgatcggaatgggcgtcgtggaagagaaatccaaagcgattcccagcggaaaagtgtctttgttgttagctgtgagtggcatttcgatgtcgaatgtgtcgagttcaaatttcacccatttgtcgcctcggagaccaaaaacgacaacagagggcgattcggcagagagaacgaacacct

SEQ ID NO: 8638 - DNA, 2240 bp, Heterodera glycines
ttttagcatatttaaatcagggacccttgggtttggagttttttaaaaagttagggtaaaaaaatttaaaggaattaattaacaagtgtttcatttttggtatttggattttatttatttttatacattattttgaaaaatctaaattatataatataatttagtttaaagaaaatttatatagacctaaaatatcttctaaaaatgaaactttaactgattattaatttatatatcaatttcatatttaggggtgtaaaatcgtaaaatgttaacaaaaaaaggtacaatattaagccaaatcagtattgagataaaaatttgtaaaatagaagtaatgtcaagaaaataaataaatcaatttggagacgaatttgagagaaataattcatttcatggtggtgaacgataaaagataaatttttggagtctagtttgaaatgggaagtcttgataatacaaaaaaaatttatccaaaaaatgggggcattcatctttacctatttccgccaattttattacttttgggttatgataatccaaagaacggaagcgaatgtccgtaatatccgaatctccggttgaatgcgtctccaatttgtgaatatgcgaacaaaaacacgaataaattttgttttgtgggccgacgagaacacaaatgccataacgggacgaaacagcaatccatcgtttcgattctttgaaattcccaagggtcaaagggtcgaagattttcgtgcgacgaagcgccctaaactgaaggtcctaaaaaacatgtcgtgtaaagcaaacctgtaaaaaagacaacctctatggtttcgctgagctgctctgccatacgaacaaaaaaaaattagaattatgttgattaagttattgtcaatctacagtataaaatagttatgtctaacttattttacttcggttacatttctttacaaataattaattaaaattagaaggcattgggaccttgccacaaattacggcattattccaaagtttggttgtgaggtatccttcattttatcgactgttatacataatgagcaaatggattataaaatcagaaaagaggcgaatataaaggttatcaaggtctttcggcaccttccttcacttggcagtgagttatttgattagtgcgaattgttaccatcggcaaggtatgaaaatgccgaaacgtctcacaatcagactatttaggtggagaataaaaaattaaatcagaatttagatcacatcacgcaacaaatattttaacatgacaatgagatttatgagttttcatccgagagagaacttctctaaaagattaaatttgccatttgtaaaattctccaattctccaccatcaattttataacatataaaaatttttttggtatctcttgggttttcaataaaaataataatctgtacataaaaattccaaaaagggatgaaaaaaaacaaaaaataaagtcaattagggatgtattaggactgaccattggttctttttgagtatatgtagagagagagagagagattattcaatgaaaagtaaatcaaatagaaatctcatactaaattactaaaacatttaactatacatttttaataacatgatttgttgtctaattgtacggttgatcagtttatcgcccctccgcggctgttgaattcaaaacgttgcggtggggaagggctggtgccgctgtaaatggcctgtgctggcgtagaaggcgtgttgccgtaaggcgtgtttgagctaatctgttggctgtgagtccacaattgggcgggactccgttgggaatacgaatctgatgaaagttggtgatcagcagaagaagaggggtcgaagctgagagaagccgaggtatgttgagaagcggagggaagttggttgtgagcagagactgaagaggaggaagcgcagtgcggcaccgctgccgagtcatttcgcaagtgcccatgggcggcgaagtgggaagacccgctggacctgtcgagagggagaaggcgtcaagacattggattcaattctctgttcattgtcagtgcccccaccccaatcaaaaacctaaatccgagacacgcttctggcgccaacctttggagagatgggacaaataaatagctcgagagagcagaagtcggttcgttttgtttgcccagtaggaattgtctcccaagttcaggctgaatgatgtccatggacggggaattggccgagggcgaagtcgacgagggca

SEQ ID NO: 8639 - DNA, 1757 bp, Heterodera glycines
aaattggtcaaaattagagtagagcgggaccgggaattttgggcttaaccgggaccttttcgggttgaaaaaccgggaatttttggctgggaaaaccgggaaaaaacccgggactggtcccggtcccggtcaaaaccgggacctcggtactcagttgtccgtattttggtcccgatcccgctctactctagtcaaaatatgtcggtgggggtcggtttagtacggccggtttagtacggccgttttagtacggccgttttagtacggccgttttagtacggccggtttagtacgagggtcagtttagtacggccggtttagtacgagggtcggtttagtacggcaagctgtttttgtccaaaatatattctactgattttttccgaaaaaatgtttaaaattaataacctaatatatttatcaataggttaacaacgaaaaaaataacaaagcattgaaaattacggtcgctttttataattagcctaggcttaagccaaacgcttaggcctactctaagtaatttttcgaattgcctgtgtatgagttgttatgataattatgtttaacatagagtgccacgggaccgggccaggaatccccggtcatccgaggtcccggtcccgaaaaaaaatcgaggtcccggtcccggcttctcaggtcccggcaagtcccggtcccggttttggcaaaaattcccggtcccgtggcactctagtttaacaacgaaattttagttaaaaaagattactgaataccggacaaaaaaaataggtttcctcttagttatttggacggctaaaataccacggaccagggatggcacggatctggtttccgaaaattttttgagcctcaaatgccatccctgccatggacacaaaatgtaatggacgcgtaaaatgtcatgggacgcgtaagtgtcgaaagtactcagtgtctaattttttagagcatggagagctggaaaaaaatatgtatttacataaaattgacccctacccatgagtataccaaaaagaaaaaacattttaattcctgtggagggattgaaaaaatttaaaaatttttcgagataaagattttgacagctttcatggttgaataaagatttgagcattcgttttggcccttcggaaaactgactcttttgactttcatgttggcgcccatctctctctctctctctctctctctcctctttctctctttctttctctctcttcctcactttttctctctctctcttctttctctctctctctttctccccctttctctccccctcatcccgctctctttctccacctttctctccccctcatccccctctctctctcttctctctctctctctttaatcttccctctctctcttctctctctctccgttcactctctcgctcctgcctctctctccttactctctctcttctctctcccccttcactctctcccttctcgcttaaaaaaccccgaccctcacatttgtctcacaattattcgccatttttttttgttgcttattcaggctttgcagcatttttggtccaaaaatcaccttaaaaatttattattcgtatgtacaggtttcggatttttttcaaacattttttgtacatatttagcgttttctcacatataatttgcagcactaatcataatattttctcaaaaaatatataaaatattaataacttttcattaaaaaataaatcaattcctattttttttaaactttcggatcaaactggcatt

SEQ ID NO: 8640 - DNA, 1533 bp, Heterodera glycines
gaatttgtagaacctttttttcacaaattttttgaactaatcctcaaattaacattttttagcaagagctaaataaaatagatttattttcaattttctaggaaatatcaaaagaacttaaaatttcatgaaatattttgggctcgaatgggctgatccggaaatttgtgacttattgtgagacagttccccttaaatttgagattaaaaatggaaaagtcaactggaattctaattatgcctaattaaccagtacagaattggtcgaatcgaataaaagtattttatttatttttttggcgaaaacgtttagcagatgtgaatttgaaagcctaatatttcctagagaagagagctaatgctaatttgtaagggctgccatctttaatttttttttcgaaattttactttctccaattaatattttttaatagctaaattaaattgatctaatctaaggtgttgttgcgcaatgaatgtgctaatggtggccgaaagcccattttggcggaggcaatcgccaaaattttgtccaacggaaaatgccacactcggaaacgcatgacacaatttattaaaattaaatttaaaccaattaatttaaatatttttcccattttgccaggatggaacggcgcctgctcagtgtctgagtacaaaaatcgtttaggggcaaacaggccaatttccggatcacttccacctgtgggtatgtgatgtgtagttgtgggggaatctctttttgcctattttaggtacatatttataaaattaagtgcctaaaaatatgatcaaaatgttattctacagtcatggtcatatggttagcacaccccacaaattttttataaatttaatttggcagcatccaattcattggaacacaacggtaaaagagtctcgaagttatacgccatttttgggaatcatctagctcatttttctcatgtatatccctttcatttagtgtggtatttacagtcccagattaaaaataatatctattcaaagtgaataccattcccagattaacgagcatttgaataaggtgattttttgtaatttcaaatttttgtctattttaaatttttcacgtaaattttcacgtaaaatgcgtgatggcttaaaataaaaatttttttcgtgctcagcgcataaaattaccctagcaaaaaaatttaaaaatttaagaaccattttttctaggataggaaaatgcgctgattacgaatctaagctcagattttgcaaaatcagtgattttgtctgatttttcatcaagtacttgattttctccaaaaatttaaggaaattggcttaaaaacccatattcaaatattgtagagcttaaaaagagctttcgaatgagctattgaatgtcttgagaattcaactttttaattttaaacgattttttgaaatttaataacgcctttggggtcatataagatggggggggggggggtctggggttcgatcccgcttgactgcagtttattttttatgatacttggtgaaaaatcatagacaaaa

SEQ ID NO: 8641 - DNA, 932 bp, Heterodera glycines
ggagaagaatgctgcttccacgagacccaccgcgataaataccactaaccccccaatttaaaaaaagagaaattgtatctctatgtatgaatgtatatattgtatgtccatatccctgtggcattgtcttgctgaatgtaattctcccacaaatatttgttgttctatttatctatgccatatatatgtgtattttaataattgtaatatgtttgtcctgtttatccatgttttatggtcatttattctcattgccgaataaatacatttatatgaatgaatgagtacattttaatatgtgaactttcgattttttgttcggtccgggtctatgaattggtcgaaaaggatgacatattcgtgattagcgaccccgataaccccataaaacatttttggattgcaatttaaaaaaaacgatgaaaaatcatagacttgaaaaaaagcatagattagatgatgtcatatgacaattctgatctcatattcgtgatcagtggccccgataacccccgagtaaaggaataatcgtaaaaaaccgcctttttattccttttttatgggaccagtaaaagtcagtattaccccaaattttccatttccattcagattgaaaaatgaatcctgatcttcaaatagctcaaaagtttttcttgtgtaaagaaaacaaaaaaaaatgtcgcaacgatttttctcgaattgcttaaggttggtatttgaattgctgtttattgtgttaatttgctgctgtttctttctcttttctgcttcattctctcatcctcttcctcccgcatatatcatcattttgacaaaaattgcctaacattataaaaaaaaaatgagtattgaaacgagggcgccaaattcaaaaatctttttattcccgactgatcaaatctaatcaaaagactgatcactgattttacctg

SEQ ID NO: 8642 - DNA, 5400 bp, Heterodera glycines
tataacagcaaaaatgaaactttaaaggaatttttttccccccacttttcttttttgtgtgctttttaatttttatcgctaagttttgctggtaaaagtttcacctcaattggcccttgaaaggatgagaaatggtaaaaatttgtgtggcgatttaaatcatccaaaatgacgcttatattttggcgagttgattctcccccgccccttccgacgggcttttgatctcgctaaaacaagctcaatgcaatcgtcggagcggctgggaattcgcttcccatttgctctcttctgccactgactgtgggcggagaacggggagaagcggacacggggcaccgcgcgctcttcccccccccccccctccaaggaggacagaagcgcgacgagccgcgccgcttcccttgtacgatcaataaaatgtgtgccgtgggcagcagcgagcaaagcgttggatgagtgagtgagtgccgcctcgaggcggcttaagcttcccagcggcgatgtgctgtcgccgacgcccgccgcagcccaaaacagcgtaaagcacacacaacaaatacagcctttattcatcatcaatccattgctctcatctcacagcccatcggcagcagcagagcaccacggccttttaggccaaacatatcatttcgcaagaaccatcccccgaaaaggcaaaattccctcaaccaataaaagtcggttggctttgaattaattaaaataaatgagactcagtcgttcaattatggaaaggaaagaattcttcattggattattaattatttgctctcattgtcagtctgatgaatgccgtgctgctgattttctcatgccccactttctttgtttgagccaaaaatcaaattggcataatttttaattaagatttattcaaaattattaataattttatttgtgcacaattttttgaatggatggatctctccggcagcatcagcatggacagcagcaatagaaatgtgccggatcagcccggcacgtcggctggcggtggcagcgacgcgctgtccagcacaaggcagcccagtctgatctcatcactttggtcattaattatttgggaaacaataaatcaaccaaattgattggactattatgaagttgggggaaatggtcgaaatatttataaaatgctttttgctgacattttttctaattttgcctaaattttcaggtcaatccaagtgcaggttcgttttatattagcgaaatttttcaaaaaaataaataatacacaaaactttggatttctatttttgtacgttaattaaaacaaattgactttgtgaggcggagggacgaaggacacacccaatttaattttgggccccatttaataataaagtttgtggcaattgaattttgccattttctgtgcttatggcaattcctaattgcctcccccctcttagcatgaggggtccaactcggacttcccaatggagtccccgaaggggtcgttgcccgaaattgtgcaagcgtcctcctgctgccacttccagtcggcccccggcgggcggcccaatgttttcgctgcacaacaaacgatcggtgccggaggggacatttccgcagatcagcaccagcaactgatcactgctggaggcggtgcagctggggctgatcactcgctgttgtcctctttccaacaccagcagcaacagcagaccgcctcctcggcgggagtcggcccaccggacggagtcggctgttccggctttcacatgttgcctccgccctacggcaacagtccgtccgtgttgcgacccgtcaaatcgctttcaggttcgaattgcgccacccccccccccacccgacgattcacaagaatattttattgatccttttttttgaattgttagactaagtagcgctttgaaatgataaagttttggcaaggaatgaaaaagtcgaccaaaacggcacaattcgtcgaaacatgaaaaacaaaatttaattggttaatttatgccccacgagcaaatgttgaattgcgggccattatattgcaaacttctaaattccttattcttttacatcaaattgttcgtgtttttgtccagatttgagttcgttggctgctgccggtggtggccaaatgtgctcttcgcaaccgtttggccaaatttgtccctattcgccgccatgcgctggccataataatgcaactgctaacagtcaatatggcacgatgaacagcagcaacagacggctaaccgaaacgggcattttgtacgggggcggactcagcaaacagcagagggactcacaggtgatggacaagacaaatggaatgggacaaaagacacaaagggacaatcgaacggagggacaaatggtcgaaaaaattggaaaaacaaacgctgataatgagacaaaagaaatggaaaggaatcggaaattgaaattctcagggaattgcttttaaaaattatcaactgacaatgaaatcctttgggttttaagcctttttaggttagtattttgaaatatatttatgcaatttgaaacgaaattacaataaattaaaaacacttccctatgaagcgacacattacaatttaaatgtttatattttttgtgaaattgtacagttaagtgaatattgtaattccaaatttcgtttccccggcggcgactttcggcatcatctaatccctcaagctcctaaacttactttaaaaaatatttctaaacacaaactttagtcattttgttgacaaaatctgttagcaaattgcgcacaaattttcaaaatttcactatcggcgccttttggcaccgccggccttctgttttttaaattttaatttatacatatcattggccatttttataatgctaaaatgttttcgtagcctttacacagtgaacattttccaattccgaaagaaactaaaaaatttatttcgtactttttccttttcgtttttcaattttcttatttaaaattcgatttcggcggagtcctttctcttcatttggttcaaaattaaaaaactttccactcgttttttttagatttgcgattggcttcagacggcgatgatggccatgagagtgggcgaaggcggcgccgaagggactggcggaagcgaaagtccgcccgaaatgggcggcacgcaatttggccagccgaggccaacggcacaaaagggggcggaacagcagtgaattggaagaagagagagagggcagcagagagaagggaaagaacacacgaaaggagagggagagagaaagagacgacaatcccagagaaaacggaagaataaaacccaaagaattaaaaagcacaattagcagaggaaaataactcattcattcattcattattcattcattgttccccattttgaggggaatcaaatcgctgacaattttagaatttttgattaattaattaattgattaattgattgatataactaatcattagggctgccaaaaatatgcacgaaaagtggccaaaatatgcgcataaatatgcaaataaagtcgtgaaatatgcaccaaatatgcacaaaaatcgcaaaatatgcaccaaatatgcacaaaaaacttgaaaattaggggtgcaaatccaataaaaaatttttattcctcataaattttatcgggttttttttgcaattgaaaatcaataatttctcaagattttcggcactaaagctcatcctattgtctgccaaaatttacttaagggatattcaaaacggaaaatattttacgaaaaatggcaaaatatgcaaaaaatcggaaaatatctacaaaaaatggcaaaatatgcaaaaaaatcggaaaatatgcacaaaaaatggctaaatatgcatgaaaatgtaaaacaagccaaaatatgcaaaatatgcataaaggcccaaaatatgcaaataaaagtcccgatttttatacgcaaacacaaaaaagaaagtgtttttcgtactatttagagcatggagaagccaggaaaaaaatatgcatttgcatacttttggcagccctactaatcatatattatataataaacaaatgctaatcataaagatttgctccgagtcggatatcaaatgggagggggggtgtcttctaaagttatggaaattacgaaaattttttagaaatatgatttgttagagcgacattgggatagggagttttgggaaaaaccgtggccggatttaacgggactaatgtagagttgcacggtaatcggtaattgtaaaaaaaaccggtaccgctactgaccggtaatacaaaaaccggtaccggtaccaacttttccaccggtaacggtaccggtacaaaccggtatttccaacgtaaaaatttctggacaaaatttttcaaatacaaaatttttattcagttttcgcgcgagtgcctgttttttagcattagaattgttcagaagtatatgtatattgagggtgaccaagtttttttcaaattcaggataaagaacactaaaattcagatgtagacctcaaaattcagattattgcaaaacaaggggtcagcagccaattttccaattttgcgaaggggtctctggtcatgtaaattaatgtaaatcaatgaccttttttgctttcaacaccgcttttttcgcggcacgtttttctcaagacttttggggaacaaggagggccggcggtgccgataggcgccgccgggaaaaattttgtattttttaatgcgatttgttaacagaatttgtaaaaaaaagaccaattgaataatttttgggtttttaggatgcttaaaatgaaagaaaaaaagttggaatattttttttaattaaaatttcaatgaaaataatggtaaagaaaatatgaagaatattctatcccagtggggaattgaacccaagcgaaaaattatgaaagacagaaggtttaaccattacactacatatgcactgataataaatgaaataaaatttaattttttctcaaaaatttcttcttcttcaccaatttcctactcttttctcgaccagacccccattcttaccagtgcaaatttttaccggcggtaccggtactagacaaaccggtaccggtactttgatttttgaaaaaaccggtaccggtaccaaaaaaaccggtaattaccggccagtaccggtaccggtaccgtgcaactctagactaaaggcgtggaacttggttttcaaccagaatccaagaaattttttagaaataattagttattttataaattagaaaattaaattaaacaaaattgttttcatttaattaaaaaagcaaaaaatcaaaaaaaaatgtaggaaatgaattttaactaaagcttcgagtcccgaattaatttgcggccgcaaaagtacttcaaattatcattctttttcagttt

SEQ ID NO: 8643 - DNA, 899 bp, Heterodera glycines
tataatttttaaagagtaggatagaacaccttttcttaggttttcggggtcgctgatcacgaatccggcatccatttcgaaccccgaattcgaacaaaaaataaaaaaaacaatttttaactaaattcacattttttgcataaaagcgatgcaattcgaattaggggctcgaactgggtcaaaatgccggattgtataatatagattatcattctttttcagctggttatttgccttcaaactcgcctcctcagggcgaagttctgattcacggggccaatgtcgcgttgggttacttcaaaaatgaggaaaagaccaaagaggacttcgtcgagttggacggaaagcgttggttcgccaccggggatattggagaattccgtaagcgatcgactccaccaaaagcattgacataatgatattattcatttttaggcgaggatggcagtctctgcattattggttttagtgaataatattgtcgatttaccttccattttaagaccggaagaaagatctgatcaaattggcccacggcgagtacatcgctttggggaaggtggagacggcgctgctgaccaatccgaacgtggacaacatttgcgtttatggcgaatcgcacaaggactatctgattgcacttgtggttccaaatctcaaaaacctgcaagtccttgctgaaaaggtaccgtttgaaatcagaagcagtttccgcttctttacaatgataccccagcgcttctcccctcttcagaatgacgtcaatgagccgagtattgagagaatttgtgccaacaaagaaatgcccaagattctgcagaaggaactccacagctttgtttcgggtcttttctttcgatcaaacgttgtcctatcaattcatttccaggcaaattgcg

SEQ ID NO: 8644 - DNA, 1921 bp, Heterodera glycines
  misc_feature (13)..(14): n is a, c, g, or t
agggaggaaatcnncagaaaagtcatcatttgtgcggagccgtggactgccgattcgggaatgctgaccgaagcattgaaactgaagcgcaagaacatcgagaagaagttcgaggaggaaatcaggcagctttatgaagagaactgaattgacttaattgctcctcaagacatatgatatcaattattaaaatggtattgatgaccagtcgataaattttatcacctccgacaatttttgttgccttagattttgaaaaggattgtatcccataattaagtttctttacgccaccaattattcaaattgttaattctctaattgaaatgtgtgataccaatttacttaatgtgcttatatgaacctatgttaattggataaaaacattgtttactcattggcacttcaattttaaccaaaacagaaaaatacatcacatttataaaataggaatggaatacaattttcatttgttgaagaatttgttgtccaatgaacatcgttcaaattcacttcctcccggcctcaaaaagaacaactgtccgtcgctgctcagagtagcggaaacaattgcggtggaatccgagtgctgaaaaagattatgtaagacaaatggacaattacagtgcgtagaaaagcgaaagcgttaattggctcggtgtcacaaaaaaacaattgcttaagttgttaataaatactcaaatcccattattacccgtgaatacacgtgatctaatattgttaacgtttataaattcgttttgcaaacaattgaaaatttcgaattttcggaaaataatcacttagtttgaaattggagaaatttcgggaccaatgattgcagattcaaatatttagatggaaaatacctccgaaaattggacgcggtattgtcgttttaaattggaattggtggggatgaggaatagttctgctcggttggtgctgaacacaacgaatttctcggggcttctcgctctccttagtctgctcctcaattggacaatcgccggttttttattcggctcccctcagcggccgtaaatcgcaatttggtggacggccttagcccgggcacagtgaacgttcgaatttgttcttcggtgagcagaaacaaacgaccggcgcccgtcggattgctcccctcggccgcgtataaaatgccaacaatcggcgcttggtgttggagacggatttccttgaccagcggacattggagcgaacggtgatccgacgcatgggacacagaagaggagcagggggaagagagagagggatgaaaggcgtggatgaacacgacgctgccgtgggtgccgacgaaaaggtgccgcgaatcgcaatcggaagacgaactcgaaacatcgcactgatggaatgtgacgactttgacgagcgaagtgggagtctgaccacctaaagccaatccgtacattcagtttatgtgacttattaatctaacgatttttatcaagatgcggtactatttatcgcaaaaaaaaaattcataaaacatttcaatttttttttcttaattacatacagatattttttggaaaaaattttatggagtgaatgctgggctgggatggagaatcattgttagttcacccataaaaatagagcaatttcatgaaaaaaggtcattttacataaaaaaaaacatactcaaaatgtttggattgaccggtctttgcgcaatttccctttctgctgggcgaaaatttttgatggtcatttcctaaacaaattattttttaccaaaaaaataaatttatttcttatgtttcacctcatttggacgtcttctctttcggaacgattgtctgattgacttttttacacttttgaagcgagacaaaggcccatccatggaggacaattgcatcacatcttaaaaatggggagggcatttgtatggttc

SEQ ID NO: 8645 - DNA, 3470 bp, Heterodera glycines
attgaatataaaagagcaatggcaacaaactttttaagcagacaaaaccccggggggtaattggccggcacattcctcgcttggattggcgactcggagggaagacggccggtaagtcggagatgggcggcatcctccgatgacgtcatgtccagcaacagcacttcattccttggcatatccttctgaaattcatggttttctgcttgtctctcaaaacaattacctttgaattcggcagcccttcgtaaaccaacaattgtcctgctgttcccccgacggcaatttcgccactttgggagtcgacgaatactttttgcacggccaaccgatggtcatcagaataggggtcgaataagccagcctaaatgcaaatgaatctgtgatttctattagcagaaataactcggccgacctttctgacgggtggcaaacaaaaattggcattattttcatcggaatttgcgtctgccggttcctttcttgttaattcttcgttggaattttgcagtaaatttggggcactgtcatcgataaagccctcaaaatcgcgcgcagtgtttagagaaatccagggcttgaatgaaaattcagaagccaaccaaacattgatgacaccattttcatgcctaataataaaatggaaaatgaggtattaaaaagagaaaagcaattgcaaaaacagacccagtgacaaccaattgcaggtcatttgccgcgttggtgttgttgattcgtctccgttgtgcaatttgtccgttttttagtgtcaaattactcctcgagaaaatattcgaagcatttcgctgcaaattcgctaatcgaccaagcaaagtttgggccttttcggacaaagaattgactgtggtaacacaagtcacaggggaagagtgaattggatggagaaaaggaaggggaagcattcgccaaatgggatcaagcaaatcaatcgcaacaatttcatcctcacaaaggacgaacaaaatgtgggaagaatctgcaacatgttgggagggaaaggggaaaaaaatggggaaaaaattactatcattggcgcaaaaaacgcaaaaatccaaaatggcactgtcaaaatccaaaatgagagatttgtcggcacagaaaacggacagcgtaaagcgattgtcgagctcatcgaggggaacaccgccggcgaaaatgacaaattcatcgcaggaactgaaaattgacattttgaaaatgcaaaagagagagcagactttggtgatttcgaagaaattattttggtaatttttgtgcattttttcgttccgaatggccttttgcgctcaatttcaaaccctttctctgaaacaccgagaaatgaataagcgccatcggcatgagaacagagcaattttgtgagtgaggaaatcgtcgacataaacttaacaaagttaaaggcttaactgctcattgccgtttgttaccgtaattggcgtctccgatttgaacgtctgcaaaacctcgtcggaagtaatgtcgtaaaaaacaacaaatgaattgttgaagagaatgtaaagcttcgattggtcttccgagtgaacattcactccgttcacttgcttttgctgagaatcgaactcggaaatgcttaaattggaacatccaagggcaaataaattatataattaataggcagtaaatgctaattaagtgttaattactctttgagagcggtgtcgagaaaaacaacgtgttcagtaagttccatgttgcgcaccaaaagtgcataaatgttgccgattattgtgccttaattcaaaacacttttccttttcaaatatttaaatatccatggaataccaatcagaagggcggactgcccatcggcgaggccaaccatctcacagcaagtgatccgcttcaaatgcctttcattgttcaaatgggtgacagtgagctgatcagaagtgatttgacaccgtacaaaatgctgagcatttgtggaggagtcattgcactgaatcagcaaagtgttcgcacctgcgacaaagtaaagcgcacagatcggcaatttgctgccaaaattggcggacaaatgttgggcgccgtttgaacaaaatctgaaaccaaaacgaagaaaaactagtccagcttaaatataagtaaacatttttagtagtaggaagttagaaaatttcgggagtttaaaatacaaaatgatggaccagaatttatatgtttgggaaattttttcatcccgtgaaattccatacaaaaaaccgaacccatcatttaagtcaccccaatgccttctcagttaaggaaaaacttacatcaaaagtctgccgtctttcgtcccaattgcgatatatcccaattgctcgtccacggacatcgaagaagccttctgagggaagccatgggtcgtcagctaagggaggaaaaggcatttcaagaataaaacgaatgacaaatttatgcctttatcactcactttgctgaagtcgacgaaatcgtcaaaatggtcgctcttcacttgatacgaactgccaatacgagaacgaaggtaacggagcatagcgaataaacaaacggaggaatattcggatatttttggacctaaagtgaccaatttaaaagttaagtgatttaataatgaaaaagattttaaaaaatacaattcacttattcaacaaataaataggtaattaattggttaattagactaattagcataaaaacaattgagctgcaaaatcagtttgcaaagaggtctctttgtctcttttgttttgttttgctttttctctctctctcgctcctctctcgctcactatgggtcaactccactgtgcagagaaaagcctagtactatctcgtcgtttctctttttctgtgtaatttctctctctttggcgtactatctcttcattttaattatgtaaaaaacaacatttacttcatcctgtttaactttttttctgtttgttaaatccacatcaaattttgcatacctatagagcaaaaaactctgcacatttttaacgctcgagttttatttttttacgctccgatccaaaattttaactcaaacaaaattaataatttcttttcctctccttttggcgtactattttcatgtctctaacacatgaaaaaacaccaaattcgaaaattctaataattttggttataagggtacaaaatcactttgaacatttagaatcaatagaaaaaagaataaatttagcattttggttagaaagagctgcctaggacttgagttataacatgataaaagtttgaaattcccacaacttttttctgagatgacaaattacttaacattcgcttagaaaaagattccccttttcaaaatctttttttagataccaaatttgttcagtttagttgggaatgaagcgagttatggcagatcaaataaaaaatacaaaaaaggcattttccgagtgtaaattttgaaatagcgcgcaaaaattacgcca

SEQ ID NO: 8646 - DNA, 2044 bp, Heterodera glycines
cataatgatggtttttaaataatgacatagcaccttcattaccgtattcagattgatttgactgagttccacgggctgatcggccgaccgtctcaggtgcatgccaatgtctccattctgttggaagcgtttggcaatgaaacggcggcggacgacgaattggcatttcatgcgggtgccaacattttcattcaccacgttcagctgttgagacaacatacgcagcatgggaagcagcgaagtggcgatggcgaagtgccaattcgatcggtgaagcggcacccggagagggaaataatccgactgttgctgggcgagaggatgaagccaggatggtgggccagggaagggggcaggggctaattagaatattattttgagaaatttttgacatttttaaatgtttaatttacaaaaataaaaaagaaaaaagcattctaaaataattttagaatgaatagaaaaaagcatttcaataataaataaaatagaaaaaatcttttaaaattatttaaataatttaactaatttttaaaatataaatattcatttcaaaaattatttaaatagaaattaacatgttcgaatttttctttttttatatgaaattttgccactgatttggcatcaaaaattattggttttgtcaaggtattggcttgagatggaattgcgcagcagaatttgccagtccgagtttgaaggtgctcactgctttccggacccgacaacacaatcgtcggctggcagtacggtgccggacggggcggcattgtttggcggcttttcaacaaaatttgagccaaattttgcgcgcacttttttgcccggctgggatgagccgcgctttcgcaccacattcaacgtcacaattcggcacttttcggatgccaaggtgttgacgaacacggcaccgatttcgtcttccccgccagcaggtcggcggacaattcaaatttcccgaacggaaatcatcgagagtcccatcaatcggagcaggacagcagaacgtcgccagacaatttttcgatcatagctttttcatttccaaccaaaatgaatcattcttgatagggttcgaaagcgcttctattgaatttcccggaggcgcctatcggcaccgccgggcccccattttacattattttttgaaattttgacctcaaaatggcaaaatcactcccttttttggcgaaaatcggctacaaactcctgtttttttctctccggcgctgaaatttttaaaataacaccggagataagttttttggcccgaagagcaaaaaaaggtcttaaggttcgcccctccgaaatttttttctggctacgggcttgggaccgtccatcaatggtctcaactttcagtccctcctctgcctttctcgagactctcgagcgtcacacctaatcaggtcactgtccccaaaagtgcaggcaccgcttgcgtcacccgttttgccaccactccgccgatgccgttgtatctgttggcatttgccaccggtccgttcactggggtcgaggtgcgcagttcgcgtgccaacattccgctgaccgtgtgggcagcgccgcaggacatgttggccgctcattttgtggccaatttttcgccaacaatgtttgaacgccttcaggaggattttggggtgagcattcgttgaattttttaatggattttataagaaatatttaaattctttattcctttttttaaattttttggcacattatcttaataggtattaaaaaaatatatatctttactttttatttatttaatttaaatatgctaaagaaaaataacaatttaaattgattcttttgcattcaataaagaaggttaaaattgtcatttcaatttagaaaaaaaaaaatttctttttaaatatgtatttaaaaacattttaatttaataattaaacatatttaaagaacttttttttatagtttaaacatatatttacaaataaaatttgtaacaacagaaatacattaattacatttagaattcactaattataaccataaaatattcccaatttat

SEQ ID NO: 8647 - DNA, 2325 bp, Heterodera glycines
attcgctaaatgtaagctaaacttctcaaaaaagactcttttagaaatcaatttaggagaaaaaggaaaaaaaataaatccaaatttataatattcctaaataaaaccaactaaaaagcgaaactttttcatttttgggtttttcacataaatttaacaattactagaattagtttttttaaaattaatattcttgagaaaagatgctctccttttgatttttataaaattatttttaattcaattttccatctctctcaggtcaaatacccattgtccaaaatggacattttcctggccccaaaactgccggtcggcggcatggagaactggggcctggtggtgctccacgcggacgctgtccgcatttcaaccagcgacggaccgttgccgctcggcaccgacgactcgtcgtcctcgtcacgtgccgcgtcacgcgaggagcgggcacgcgagcaaaagcagcacagtttgatgctggtcgaccgccgctcggaacagtaccgggccgagaaggccatcacacacgaattggtccaccagtggtccgtttttacgttggaccttgttttttgatgcttggagttggaaatttctttaaaaacctaattgatttctggttcatacaataattgtagaaatagggattttgcttgttgactaaaatttcctgaaatccaattttgggctcaaaacccaccgtaaaacgaaaatcgccaacatcttttattctaaaaaaaattaaaaaaaaaaaaattaaaatatggaaaattttgtggttcaggttcggcaatttggtcggcatttgggaatgggaagagctgtggattgccgaaggctttgccacttattttgtgttcgactttctcaacgcggccaaccatcctcatctgacgggtgagggagcttgcaataaatgctatgaatctcatggaaaatggcattttttggaaaacttagcgtcgaggctaaagcgagagataccaaagagtgttaagatgccacaatttggcaaaatgacttcccagcattggatataccataaccgattagttgagtaaattttggatatattttcgaaatcgaaatttgaatttaatgaattttttaattaggcaaacaaaatcaattaggaattaatttgtttattccgcaatttattttcgtagagcacgagtattacctacgactaattgagctgatccaacgtcagtccactgacggacgttcggcattggtacgaccacttcggacagccggccaactctaccgactgtttgacggcattcatttgtacacaaaaggtattaaaactaattaccaaaacaactaatgactaattaaggcgataattgcctaaattaaaatagaattttaaatttggatcttgatcaaaatttttgagaaaagctgaatcattttgatttgtaatttttgttttttcaattcttttaggaaaaaaaaaatttaatttttcagtattttttaaattaattttttcatactattatcattaacctaaacccaggtgccgtgatggtcaaaatgctgaaggacttggttgggcctgccgagttccgtgccggcatcacgcgcttcttgcgcgagaactccttcaagtcggtggaccgtcgcgcaatttgggccgcgtttcccaccgtcgctgaccacggcgttgatccggtacggctgaaggacgccatggagccgtggcttgtcaaccgcggcgtgcccgaggtggaagtacagcgaaactatgaggaccaatctgtgcggttgaagcaacggccggccgatcagaacagacacattgtgtacctggacgacgaagcaatgcagcagatgaggatgaactggaaggatgaggaggatgaggaaggaggaagagagaaaaagggggtcggaagaggcgcaggggatgaggaacatgatgaggaagacgtaggagaagattggtggaagatgaaaaggatggatgtaagggatggaagggaccttaaggatgcggatgatcaggatgaagaagggggaagaacggaaagggttgaaagaagtcaaagggatgagaaagacgaagaaggagatgatggatggaaaatgaaaggaatggacggaatgatttatgaggaaggggaagaagaagacggagggaagatgaacgatgatgctaatgaacgatggaggattgaaaaaggggaagggaaaaattacattgatgaggaaaaacgaaggaggaaaagggagggaataaatgatcagccggaagaggaagattgggaaattaggggggccagaagaaagctcaaagatgacgagcatcattcc

SEQ ID NO: 8648 - DNA, 1054 bp, Heterodera glycines
acggaagagacgacaatggcatcaccgcatcctactgtagcggtgagtaacggtaggatgagtatttttgggcgccggcggggaggacgggggcctgaagcgcggcgaaagcaccaccactatcaccggaagaagctgctgaacgcgcacagatcaaaaagctttcatcaacagcagcagcagaaaaagcgccgtgatcggtggaaaactgctgatcagcagcagcgagggcggggagtgttcagcagcagcggctatcggatgaggaaaacggctggcggcacagtgccggttttttcctcatggacggcaccatctcgacagtccaatgtcgacactgatcaacggagtgcccctgtcgcattttcggtgattaataacggcgatggtgccgaatcacggcagctacaacagtcgaaaacgcggtcttcacgtggtgaccagcaaaagcgacgtgccgacgatgcgcaactgcttggcccgctttggcccgtcccattctcgtactcattcggttcggcacactcagtaaggggccaaacggttcgccaattttggctgctcaacgaaacgctccgctttgtggatgtcggactggacaggacacagcacatgttggcaaacccccactggtaggaattgccacttttctcaaattaataaacaaattctcaaaaccatttaaaaattgtccagacttctttttcgaaattcaagaacatttctttaataagtgtaaaaaagtttcttataatttttacaatttcccaataagaaatgttcaagcacttaccgttatattcctcggaaatttcaccatttttggtgcaaactctaaacaatgtcacaatgttttgaaattccccggcggcgcctattggctaacgaggtgataacagatgaaaatttataagattatgaccattatttgtaacagattaacagataacaatatttatgtattatatgaaaaaaattccctgaacaccccttcgaattccagaaaaaaaatcgagacctctgggaaaagccattctcgacagatttttttttt

SEQ ID NO: 8649 - DNA, 1001 bp, Heterodera glycines
taaaaaaactttttaaagtcagtgcaaataaaattaaactttattggcataatttaattgaaaagaattattttctcgtcaattcattaagaatatcgcggctaaatgttagcttatatcttttgtgaattttctgaaaataaatatccaagtttttttttttgtcattttgggtccaagaaaaactttttgtactgcctttttttgtcgcaacgcattggcatattttgtcagccaaaaaattatgtatgcaaattgaattattatattcattttatgccgattttggccatcgcaagccaacagcagaagcaaatgcaaatatggccttactttttacataagcaattaaacataaataaatacatatgtgagaaagtaataaaaaatatgtattaaaatcgaataaatatacgtaaattttgcgtttataaatttaattttaaattatttattcgttttaaaatgatgtttaaaagttatatttttattgcattttagcgtaatatttcactcttttcgccttcctccgccctcgtctaaactcaattttgttaaaaagaatggagtgaaaattttcggcactttgttgcagtttgtccattgaattctaaccttcgtgggaacggaggggatttttgagcggattttgtgaaactgaggcaaaaaaaggggtgacacacgaaaaagagaggcaacaattgcttttccggtgccaaaaaaggctcaaaaatagcattttgatggatgcttttaaatttgctaaattggtttagcataaaatgaaagaatttcaaagaaaaaaaatgccaaaaagttaattttgaaacaacagaaattctttgaaagtcaaacaaaaacagtttttttttaattaagcaaaataaaaacgcaaaaagcagcgaaaaatgtcacaagaaatcatttgtaagtgcaatattttaaaaggagctttccaaataccgctaaaggggcatttcgcatggattcggaagtcaaaa

SEQ ID NO: 8650 - DNA, 1611 bp, Heterodera glycines
  misc_feature (1557)..(1557): n is a, c, g, or t
atgccattcgcgtcgcctccccccgcccctccttcggtctttccttactttttgccgtgtctattaacaattggctgggccttcgggagcccatgccagaacgaattgtgacgggggtggccaaaaacattttcttcgttattgttgtcggcaccggcaatgcgatgattggcccatagggaatgagaaactgacgaatgcaatcgcaaattgagattaattagagagaaaagcgacaatatacgacaacgacaacgacgatgagtggtggaggttaattaggtagtggcgtaattatagaggacgaagatatgttgctaataagcataataataataatatttgtttgaatgtcatgaaattgctatgtatgtataaaaatgaattaatttataatgcaaattgttgggttgttgaaaagtaacaaaatttcagaatggaaattctcctttatttaatgctaaaaaacattatttgaatgaaaaaaataaataaaatagagtgataatatttatttttatgtaaaatgcttcaaaattcgaaaatgatcaaattaatcttgaaacatttttttaatgtgcaattgtgggcaaacgaagtcaaatcagcaaaatgaaaccaaattgctgggtaatcgaattaatcagcttattcaatttacgaaaatggctaattgtttttatcaatttgctagtcacatcgaaaaattgtaaaaagttaataaactcataaaaaatgacaaacggtgccaggcaacaacaacgcgaagcaattaattggatgatatgtaaaggaattgcgcctgcttttcgcgcattcttttaccggaaaaaggatgaacttttttattagccgtatattcattgcacgcttcaataaaatgggttggcccaattaaaatgcgcatttattttgttttgccggagggggggggggggaatgacgcttaaatgtgactttcattcatttgatttgccttttgatcctatcctttttctcgctgcttttttggcagcggcctttgcttttgcccaattaaacagcgaaagtgtccctttatcaacgggggggggcaattgtcgtcgtccattaaacggtgaaatgctgaaaaattggcgtgtcgtccgtcggtttggtcacccaggaaaaaatgcccagggcaaaaaggtgacaaaaaaattagaggagagagagcaattattttcatcggcacacgaaaatattatgtgccagagaattaaaaggaaacgctcaaaaagttgcatttttggattttcacttttcagggaatgaaagaattattgacagaaaacaaattaacaaaacatatataaacaatcggtcgattagtgaagtcaatgagaggggaaattattattgaaatgtcccttccatcaaaagcagacaaaatgtttttggccatccgttgatctgtcgccaaataggcgacgcgagagctgaactgtctgtcatcattggtgttgatgccatttaatgtgaatggaagtgaaaggaatgaaaagccgcaataagcagagttggccaaatggcaaagancaaaatcagcttaaatgagcaaaaataaaccagaaaaaataatgggcataataa

SEQ ID NO: 8651 - DNA, 2002 bp, Heterodera glycines
ggttttggcccggataaacccgacggttaagtccatccattattataaaattttgtgttcgcttgagacatcgaaaaatttatatataattttcgccatagtttaacaaatctcacatcccatttacttcctaaatttttacttgggtttaacaataaaataattgtaaaaaatgaattcaaaaagaatgtaaaaagtagcaaaaatgaataagacattttacttccatgttaaataaaaatacgaaccaatcacagatgggtcagtgtcaggtaaatgaaaacaataataaaggagaaagatggaaatgatcacaatcacagcagtgaaatgacccaagaaaaacataaataatttacactgtattaaatactggtcgggttgttcggtctgcgcattttgtggtcaaaaacagaaacattatgacaatgcgtggcgatttttggaatttctaagtgcgaatccttaaggggtgggggacaacaaaaatatacacaaacaaagggcacagacccacggcatcatacagtgtggatggatggacaatttatcaaaaacaataaatatgttgtgtaatacccatgtcaggaaatagcattgtttacagacattagaaatgaaatgtcagtcagtcggtcaatcggcagagatcggactaattcaaaaaggaattttgtgaataagcaaacgaaaatcagtttaattttgagtgtttcctatttagtcaaatctctgaaacaatcagtggagggatgacgagttgagcaatggcaatgaatgccgagaagtgttcattatggtgtccgtcaaattagccgttgttgtcgtttccgctgatgatggcgttgacaaatgttttagttgcgttgcggcggatgttgagaatggttgtgctgcaatggctgaccagcactgattgaggaaacgagcaaaaagaacgcgggacagtttgagcatgacgagggtgccgagttggaccagaagcattaggtagacgacctgactggtctaaagggaaaggcatcagaaacattgccttatattaaggagggggtggggttgttaaacgaattttagaatatataagaaaatgataagatttctaaaatatttagtccttctattcatagattaccgtccaaagtccatccatcgttttcccctcaaatgctgaatgggcggagaccggcattgaatttgcgctgtaaggagcggctgaagtgctgtgcaatggcgaaagggttgtgcccatcattgcatcactgagaaggcatgcttaaaaacggaatggcatagcccgattattttaaaaaattgcccctttttcaaattaaataattatgtaactcttccccaaagtggttaatgttttggtcaatttctcaacatggacacaccttgttcgcctctgcagtgcgagtcgcttgcactgtacccgtgcatgggggaaagcatgggccggtagaaaaaaccaccggtgccagtcgcttggacagttgtttggacagattgaagctgttgggagagacggcgtacttcattttgcaattcggtgatctgtaaaacccaataaataatatcattaaaaatatttttggtataataattaatagaaatatatatttgagaggatggaatggtataattatgctccgtatttggccaaccagctaccttctgtttcatctccgtctccactcggttggcctcctgcttggccatgcgttcggcttccttggcaatgccttccctttgctgtttcaattcgttctccgcccgcgccgctccgttcacacagcgcctgctcagctcaagcaaatgctcactgctcagcgacatgttctgctccaacactgtcagtcgcttgttcagtttcatgaacaccgactctttgtgtgttgaactggtacccggcataggagtcaaattaccttaacaattatgtaacatgccatttcgcccgagaaaactttaaaaatataaaaaatctaagttcccttat

SEQ ID NO: 8652 - DNA, 499 bp, Heterodera glycines
gatttgccttttgatcgaattcctttttctcgctgcttttttggcagcggcctttgatttttgctcaattaaacagcgaaagtgtcccttttatcatcgggggggggggggggggtaattgttcctgtccattaaacggtgaaatgctgaaaaattggcgtgtcgtccgtcggattgtcccccagggaaaaatgcccagggcaaaaaggtgacaaaaaagtgagaggagagagagcaattattttcatcggcacacgaaaatattatgtgccagagaattaaaaggaaacgctaaaaaagttgcatttttggattttcacttttcagggaatgaaagaattattgacagaaaacaaattaacaaaacatatatagacaatcggtcgattagtgaaagtcaatgagaggggaaattattattgaaatgtcccttccatcaaaagcagacaaaatgtttttggccatccgttgatctgtcgccaaatagccgacgcgagag

SEQ ID NO: 8653 - DNA, 1317 bp, Heterodera glycines
  misc_feature (1306)..(1306): n is a, c, g, or t
ctccatctccccctcctatctctccatctccctctcctatctctccatctctccctcctcgtctcccctctcacgtatcccacttattctcctcgccctccattcatttcaatgtactcacttgtccggagctctcaaaactgctgcaatttgtgcgtccgttccttttcccttggtaagtacaaaattatgatccaattcaatcggttttccgtctttcgtttggagttttttctcttcccgaaagtcgaattctgtgcctgaaacggtgagtatttctccggttggaatctgatcagaagaagtcggcgtgaactaaaggaaatggtttaaaatggatttgaaatgggcaaatcactcgcccaatcggcggccaatttcagcgaatgttcgcggatgtccccgtggccagacaaattgaaataattgtgctggacgatattcacaggacagggcaaatccgaagtggcctcaatgtcctggccaaatactcagattatcagtggcacagttcgcccccctttttcggttgaatttttgcaaaaaagtgaatgtccgttcatccctcctcgtcattttttagccttgtctccattttctcaccattcgtaatttatttgcggtcagccgataagtgacggacactcgcaaatttccggggaaggtgccctctccgtcggcactttccaaagagagacggacgcccgagggccatttggccgcggcattgtcacacaacggttccatcttccacacctttgttgagcttttgctttctcatccaaagtcattggtccccgtgaaaatttacaaataatgcttttgattgacattaacttatttttatttaaaattttaatttaatattattatttaaagtcatacattgagattaattacttccttttaatttgccattgcccccccccgtacttttctcccaaatgtctctgtccccccgtgcaattggtttttcccttcgttcggtgtcagcaaaaattcctttccatcaaccgtgaatctaaatgacttttgttggtggctgctcatttccatcctgctctgctgctgatcactctgctttttaacctcgctcttccgattcgattcgccactcttcccacaatggcaccgaagaaagggctgtgctcgacgtaattctctaaactgtcaaatccgaggaccaccgaccgcagctgatcctgaggcgttggcaccagccaatcgcggataattgcaccgaagctgatcactttgacgaccactccgctttctgagcggagtttgcactcgaaaacatcttggncttggaaagag

SEQ ID NO: 8654 - DNA, 3715 bp, Heterodera glycines
gtgaaaggaaagcgaaaggggagggggggggggggaaggggacggacactaattaatcggactgattgaatgagttaatgaattgttttgtttgcattgagggagaaaaggggagtggagaagcaaacgaactgtcctccgaaattgaaaaatgataagccaaatgaatgaatgatgttggaatggaatgcgagttgaggtgttttcctcccttttctcttccctttcccatttcccccatttttcttctcttttcccatttctcctcttcctttgtcccttattttattcccttccattttctatttcatttcttcacttcctccacctttaactatttattttctcatggacaaaaatgccgaaattggtccatcattaacaaatggccgcatttctttggctgtcccaaattgcgtatgcattcgtttttgttcctttctctccctttctctcttctgctgattggtttggtctcgcccattcagctccatctgtcctctgctgcttctgatcactccgagtcgtcctccgccactctgtttttgagtctgatcagttggttttgcgccctcgggggccttttgcttggctatggaacaagcataatcagtgacagcttgcacttcatgacagccgaccttcgtctgaacactttcaggcaataatgcttagatttgcttgcttttccaatctaagcaaagtcagggcattaccaccgcttctcttttggttggcggcgcatttggcgcattggcggggggaaaagcggccgatttggtcggccgacgacgtgccatggtcacattgtgcttcttgttcatcgtcggcaatttatgctcttcgttggctccgacttttcccgtattttctttccttagtaattttgagcatccctccaaaattcaaaagttgcttctctccgcccgcatttttctcggcttttctctcggcggcttttcctctgtcgtcccaatttttctctctgagctttctccgtcttcaattcgtgctcaagttgtcacccgtagcactttgaacatagtcgctggtcaattgctcgcttttgtcgtcggtgcccttttgggctccgtttgggaggaacggtaaggcgacggattgcgcggaattgcctaaattgtcgtgatttttgccaattccccgccccccccccagattggatatttggcgatggatgaacgctgtttcgctgttccctgcccttctgctgctctccgctttgcttctgttcgtccccgaatccccgcgttggttggtctcttccggacagatgggcaatgcctttgtcgttctgtgccgaatccgtcacaacgcggaagaagcacgtgaagaattggcggagattgcacagagccaaacggagaaaagcggcaaagaaaagctcaccttttcggcatttttgtgggatagatggcttcgaaattgtgtgatgatcggtaagaaaagccaaacggatggacaaatgttaaccaaaaagcaaaattcgattaacaggccttggaattgcactcatccaacaaattgtcggagtttccgctccgatgtattacggcacaaacattttggaacggtgcggcatggacatcgaattggcaatgattgtcaatatcgccatcggggtgcttcgtccattccacccattatagctaattactgtgctaattatgccaagatcgtttccttggtgtcaatggcatttggcatttggctgatgggccgttgcggtcgtcgtccgatgcttttggtgggaatggtcggctcttcgctctcccatttactggtcgcacttattttttggcttatgcccagcggaaatgccaaaggcgtagtggtgctgcttttgctgctgctcttctgtgcttttatgcaatgcgccatcacttcggtataatccgccgatggtcggatcggaaaccatggccaattagtttcggacagtgcaatttaaaaatagcgaaattctaatttattatgtccaaatggcaaggattttatgtaaaaatactagagtgcagcgggaccgggaattttgggcttaaccgggaccgggaccttttctggttgaaaaaccgggactttttgctgggaaaaccgggaaaaaaccgggactagtcccggtcccggtcaaaacggggaccggtaaattggacaccggaaaattggacaccaagcggaaaattggacactgtcggaattttggacaccaaaggaaaattggacactaaattcctcttttaaaatataaacccaggaatttaaacactcaatatgcacaataattgatcaaatgtggcaaaaaagtgtacaaaattagacgatgattgatcaagatgccaaaaaatgtacaaaattgcgtgatgattgttcaatgtaccaaaaaatgcgcaaaatgggaactccataaaaataaaaacttttttcgttatgaagttgtccgtgtccaggtcccggtcccgctgcactctaaaaaataccaaatcaaaattattttaaaataattttattttgatttggcactttttcatgctgctcgagaatcttgaactaatttgccttcgtttctttgacatcactgaaatttttagccatacataattttttgcggatattttactgtcggaaacatttggcacttttaaattttaaaataactttttctttctgtttccactggttaaggtcacttggtgagtggattgatttgattcccttggcgttccgttcggccttttgtcaccgcccctccccaccaattgccattaattaataattaaggttcattctcgcggagatttttccgctgcgtgtccgtgggatcagtgagtgtttgatcaattgcgatcattaaaaaacattggcattccgtctttacctctcttagccatgggtttgtgcagtgccatcgtttggatgaccaaattcgcttacggccttttcttgcccttggcaatggatttcctcggcatttctgctacctttctgctgcttctccttttcacttcactttcaactatttttgtgtggctttttctgcctgaaactcgtgacaaaacattggaagagatggagaaacagttcagggaggaagattgggcagcactgaagaggaaagggaggaagagaagcaaagagacacgagagagaactgaagacggagagagcggagagagaagctaagagacatgagagagaactgaagacggagagagcggagagagaagctaagagacttgagagagaactgaagacggaaagagcggagagaagctaaggggagaaaaagaacgaaaaagtgcaaaaaggaagagaagaacaatagaattaacgtccatcccaaaaattaattattgtaatttgttgctaatttaaattagtttccttatggcattctgccttttaaaaataacgccttaagcaatgaacgaagcaaatggacaaaagcagaaaagaagaggaaggcacaaaaccgaatagatccttttcttcgtataaacaaagtattgccaatcattgagcatatgtttcagcagagaacaaagaaagagagcaaaggcactgatcgattaatttcgatcggtcggtcctttgattgctttatgcccttccgatcttccattattttacattccttccattaaattcgcttttttgtggttcaattaaaaatgcctgcaggggaatacgaaaagggcac

SEQ ID NO: 8655 - DNA, 732 bp, Heterodera glycines
  misc_feature (67)..(67): n is a, c, g, or t
gatgaaaaagtcttctcattgcaggacaaagtctgcgcactttgaccattgagtcgcgagacgaccncaaagtccaggagatttgccaattgttgttgtattggctgaacgatgagttggcggaggaacggattgtggtgcgcaatttgcaggaggacatttatgacggacaagtgatccaaaaactgactgagaagttggcacaagtcaaggtgggcacgggcatttggccaaggaaattcaaaatggtaaattattggcactaaccaaaaaagggatttgaaggacaatgaaaaaaaaactaccgttcaatgtaaagaaaagcacagattgaagttccggaagtctcccaaagcgaagaaggccaaaagcaaaaatggcgcataattgtggacgcattgaaccgaacgcttcacgagggaggcggaggacagagcataaatcagccggggggacagccaaaatggacagcggaaatgatccacgcgaaggcgagacggggaaggaatgagaacgactgatcagaaccaattaatgatcagagggacgggagattaatcagagggacgacggctcatccaattgtttagagtgattaatggattttatcgccagagagtggttgctcaatgatggttattgaccaaagtttaggacattgtggccatccttcaccttctgatcactctcgcccttcattaccgggcaccgattcgcttcccgaacaatgtc

SEQ ID NO: 8656 - DNA, 3075 bp, Heterodera glycines
agtcgaaatttaaaattctacaaattttatcatcttgactcaagactttttccgccactgtatttggtatcattcgaaagttttacatgtttagaagctgtttctaagctattgcttatttgttagcgattatacaattaataaaaagttataaatgaaaattgcaaaaaaatataatttaatttttgaatattttcttaataacttttttgcatgctaaaaacttttgtttttaaagctaatagagcatttgaagggctttcgaatgatacaaagattattagatttggtcttcaatgaaaaaagttacaacccaaaaacgcgggctgccgccaaaacgacctggtcaccttgatgagttcagactcgctcggtttggccggcacggttgggccccaccatgcttttccactatagcttttttctttgtcatctaaatccaacattgttggtatcattcgaaagctcttcactgctcaaaagttcatctttagtggtgcattttcacatctcgtcccaaaaaacgaggcgagaatcccaaaaatggcgagagttgtcccatccctggtacacatattctttaattttaccgatattttgtttgctccttgggaactgctttatttcatcattgcttttttgcgcccgaatgctttttttgaacaaaaaattttttgcaaatcatttggtaaattcaagcaattggacaaccaacgttttattcgaacgaaagaatcaacaaaaaatttcggaggaaaaacgagaacatcaaatcagtttcctattggtgagatcgatcatttctcaaaaataattatacttagtctatttaagggttttcggggtcgctgaatatgaattatcatttatattgcccatttcttaacattcaactcaaatataaacataaaacagcacaataaaatttaaggcttcttgtgtattcgaacgaaataatcaacaaatgaaagtgagcaagagcgtttctgagagaaaataaatgaaaatgagcatcaaatccgtttacattactgagatcatcgacaatctcacaaataatcactcattccgctgattactgggcccgggagtcgtcgagaacatttcatcgttgctttgacccgcttcttccgttggtggcgacaatggcctaaagaattaagtgcaattttgaattatttaaagaattgaaatgtattgctcacccattgcattttttgtcatataagcattagggctgcttattttatgtaaatacatatttttttcctggtttctccatgctctaaatagtaggaaaaacactttattttttgtgtttgcgaacaaaagttgggacttttatttacatattttgggatttttctacatattaaatatgtacatatttttatacatattttggactttttcgtacatattttgcaatttttcgtacatatttttcatttttttacatattttgaggatttaggatttttgagaatttatagaaattttttgtaaaaaatttaaaatttttttttgaaaatgtatcactaaaaatcgatttttttcaaaaaatgatatatcaaaaattaatttgtaaaatattcaaatgtgattctaagcctattttgtatacatattttatttacataattcgcaaattttcttacataaaattagcagccctataaataaataaatgttcccaatttccaatttcaaaattcatttgtctttttggcaaagtgtttgtcccccttttcatttgcataatctcctctaattttggttattcaacagatgtcggcaaacattgctaagaaataagccccggttaagcagctaatagtaagaagcattgaatcctttctgctgtttgttaagccattgagagttcatttgcattttttcttctaaaattttctaattaatgccaataattttaatcatttccaaaaagtgaaataatttcaaataaatatttccgcaatatatttttaatttaccctattatttcctcaaagtattaatttgccattgtaaacatatgtgcacatataataaaataaatatcattggagaccatttatttcttttttatgattctaattttaaaatattttgaaagataaataccgtaaacagtgactaattactgtaattatggccgccacaattgcgtcccatgcgccccaaatgaaacaacaaaatgtgcagattgctgaagaagaaacattcggaaagacaaacgacgaaatgccaaacggagcacagaagcagcagaatggccaagcgaaggagaagcaaaaagtgggccaaacggcgccggtggcacgtccgctgacagtgaaagattgggactacgacgagaggggccaatgcggaccaaagcattggctgcgcattgccaaatgcgaacatttgggtgccaccttttatcattgataaaaaaatgccaaaatgatttttgaaccctttctcaggcgatcaccaatcgcccattgacttccaactgtccaaaatgcgcgtccatccgctgaacattcacccgctgtgtttggtcaattttaaaaagcctttggctggccagctgatcaacacgggctgtggaagtcggatttattatatgaaattttaaaataacttaattatattaaatcatcatttagtccaattccaacccgacccacagattgaaccgcccgaaatttacggtggcttattggaccaaaactatcgcttcgttcaataccatttccactgggcacagaatgacaatgaaggttaataaacctactattctttatttatgtaaatgattttcaagtttgaattttagaaaaaatggcaaaattcataaatttaaattaaaaaaaaattaaaaaaaaattagggtctgagcacacaatcggtgggctgcgttacccagccgaacttcacttggtccaccagggtgtcaagaatccggtcagttaataaaaaaaaacattttcgacaattaaaaaaaatatttgcccattttttcagtccaaattggccgttttgggcattttcctgaaattggacaacgaatcggagaacggcgaa

SEQ ID NO: 8657 - DNA, 910 bp, Heterodera glycines
cgaattcgaattatgaacacatttaaaaaaaaaattgtaatgataaaaaagtgtttccgggggtattcggggccgctgatcacaaatatgatacagcgatatcatcaattgtatttgaacaaatacttcacaaattgaacaattcaacaaaatgccataaaatgaaattgggtaaaattggcgccgaaatcaattttcgcatgttatgtgatacaaatagaaacgcacagtgtgaatctgatgtttttacgatttctaagaatttgttgtagccaattatttcaactatgaaccaactggataattttacgaccaaaatgctttatgaaaaattggcattaggaaatgatcagtttgacgagtggcttaaagagaggcttgttacatgccaggcgtacgtgtccccagtgtggaaatgaaatgggacgccgccaaccccgccaaaacaggaactatggattgtggaagttcacaaacgcacaatgccgtcgcccggaaatgggcttcctcataggcaccttttttgccggctcacaccttactactaagcaagtgtttgatttgtcatatttctaggcacaggaaatgggaactagcgacaaatgatgcgcgaaatagacataggaggtttccataattagaagcttttgtgaagttgctccataataaatatcattagggcctcaaacaattgtagactggcgtaattttttccggaatgtatgcaccgaatttttcattcgccatctatgtacggtttgttggctgtcgtccgcctctccaattccaaatctgttcgcttttgtccgttggtctgcattttgtgcaataaatgtgaattttgttgaaaatttagtttttgattttttgttcgaattcgggtccgaaatggatgccggattcgtgatca

SEQ ID NO: 8658 - DNA, 1767 bp, Heterodera glycines
  misc_feature (31)..(32): n is a, c, g, or t
  misc_feature (84)..(84): n is a, c, g, or t
aatggaagcgctgaagaaagtgatcgattgnnagcagaatgccgccattgacactgaacattcgctgtcctcaaaattgccgcncaattgttgccaggaaatggcttcttccgcggaacattttgtgtcttcgtttgtccgttacgaggggtaaaagccatgccaaatttaatttataaattgaaaatgttctaagctccctgaccacaccgccatgctccgaaaatgtcacttggacagtgttcactgatccgcttctgatcaccagagagcaggtggaaagggaaagcagcaaaaaaacaaaacaataaattaatgggattaaattaattttaaatggttcaattaaaacgccttcttaaagaacctctaaattcctattcaaaattaattagatctaagcctaagctgtgtaaattttaattcttcttccagcaattatttcgtatatttttctttgcccttttttatttttttaacactttttattacaaaaaaacgttgcttgatttttgtaaatttcagatgtctctcctccgcgccctaaaagactgtaaaggcaatgtaatcgaaaagaattacaggccgggtaataatgaattgtaaattattatttaattgaataaatttaatttagttcaaaaatgttcaaatgatcgcgaagtgctttttatggccgcagcggcggacgattgagcaaaatgtgaaaaaggaaaagcaattcgaaacagaaatttaataataaatgtaaatttgagattagcaagtgaattatttactggtgcttaaatataaatatttctaatagaaaatgaaattttttttaatatttaagttgttaattaatcacgttcgcttaataaatatttttgtaatgaaattaaaaaatagattttgttaaaatattaacttttttctgtattcgaatcaaatcatttagtgttatttataaagctgtaatttttaatagtctttttaaatgaatgccatactttaagtggattcattatttgatttattttcaaccaaaattaacccaaaatcttaaattgcttattagagcctatgcattttctgtttacattacaaaattgaagatttacttttttgtttgctttttctgtttaacaatttaaacatttcattttttgtgtcttatgaatgaattcgactgacagatttagttactaaatgtcaaaaaagtggaataaaaatcattaaaaaagtcaaagcaaaaaaataaataatatttttactaatattttttggtagcaaaacaacataaaaggcctatctaaaaataaaggttaaaaaatgataaaatgtggtcaaagatcactgtcactttcactgtacaattttgaacacattccatcggtgggccaatgtttcgacttgtgcttttcgccaattagtaatatcatcatcggatcatcaccaaacaaattcctttttttccgcccgcttttaattcctcattaatacgaatcataataccaatactaataataataataataatataataataatattttataataataccaataataatgctttgctgcttctgctgcttccaattctgtggtaatgggcgactgttctgtcctgtgatcgatgttttttttctcccattttacggcgtccgtttttcccgccatacaaaagaataaattcgcccaattggccttttcccccattttccaacgtcaaaagtgaattaattaatcaaattttaaaaatgcgaaagaaatgacatcgaaa

SEQ ID NO: 8659 - DNA, 2024 bp, Heterodera glycines
ttgatcctcaaaccaaagggtaagcgaagtacagtgtctttatctgctgacgaagtgtgcatttgttggttctgctgttcaaccccaacaacgttttgttggtttgtttctgattcaaatcctaaaccatcctccacggtttctgacgaatcatcagaagagtcaacgatttcaccattcaaattaagctaaaatactttcttttcttcatcgtcaaattggactcacctgttggttttgcagcgcatcattctcaacaatttcttcgttttgaccatttcttcccaataaaagttcaatggcaacagtcggagaactaaagaaagagaaaactttcattgaaatttgaaacaaacgaatattaattaccccgttgtgttaatcaaattgcgaattgtctcactcggaatttgcggaaacatttcggaaacttggttcaccattgctgcagtctacgaaggacaaagaatgattgtctaaacaaagtgatttgccacctgttcatcattgaatggctcgaaaagataacgcatccaccaacgagcaaagcgattattttgtggcgaaaatgcttcgaggaaaacttgcagcccattgtcttcaatgccagcgatgttttgttgggggcgcgtcaaattcaatgccaatgttttacgacaaattgcacagctcgagtcctgctccaaccatcgacgcagacaatgttcgtggaaaatgtgagcacatggcaattttcgtgcacttttcatcggttgcctattaatgccaaaagaaagcgtaaaaacacactgacaatgaacaacaaaacacaccagcaaatcgtacactgatcattcttcaacaaatcttcctctgtagcagtctcatagctaaaaattcgtacatttcaatgaaaaaatgcttttactgacttgctgttaatgtgccgcatgagttctttttgctgcaaatacttccgaattttgcccgatattcttctatagtaatgctgcgcttgaaccaccaaaaagacgcaacagtaagtgattgccaattgggagtagaatatcatgtgcaagtaattggcaaactcgagacaatcccggaccatttcgtaagccaaatcgaaataatgggcagaagacgaatggtgactcctttgggcattggcatcgactaacatggacaatttgagcagaaggtgcatcgactgcagcagaagcaaagaacactgaaaaagtggaaaatgttaaaaacaggcaattaattgcccaattaataaaagaaattacgtcggctgcaagaaacaaacaatagctcagattgatgtaatttttgatcccgaaaacaaaaaacaacatcagcaatgatgaaacacaaataattgatgaagttacgaagagacgctggcgcacagaattattcgaaatcacattctgagcctcaaaaatgaaatattgtgtaatatggaattgtaaataattgaaagtacatttgccagtcttaaatttgccaattcgaggagaaacaaacacaaggcttgtagcccaagccaaggagtccaaatgctaatatcttcgaacagattgtgttgggaaatgaacaccagaaaagtcaatttagcagagacaaaacggcggaagaatttcctcaaagctgaatcctcctggaaagcattaggtattttttgttttgattcaccaaacaatgtatcaatgaattttggtccaccaaaattttgacactttttatgaggtaaaaaagcacctgatttgacaaagcaccaaacatcaacaatatcaacgactttccaagcaaacagattacagcacagcaggtgtttatcatgaccttaaaccgaaaagaattgagggaggaaatcactcactaacataaaacaggaaccgatgccttctgattggagcagtaaaattcaggaataggaccgtcggcagattatattcattcgcaaatgatccatcgtcacgtttttcaaaatggccaccactttgaaactgttaaaatatgtaatttttaaaaattgt

SEQ ID NO: 8660 - DNA, 1377 bp, Heterodera glycines
aaaaaatgtgagtccaatcccgcagcggtatcggcaaagtcggtttttggcgggatcccgcgaggtctgtgaattgcattttttgaaaattggaggacattatgacaaaaatatcgttaatgcatcgcggaccgggtcagtttagtctggccggtttagtctggccgttttagtctggccgttttagtctggccgttttagtcagagggtcggtttagtctggccgttttagtcagagggtcggttttagtctggcaagctgtttttgcccataactcttaaaatgtttttttgtcaattataaacaaggaaaaacttaaaaatatctatgtttagctacaatataaatgaatatcccaattagaaaataaaaacaaagcgaaaccttcagtttggcaccgcctttttatagcttcaggcaaagtaaaccctaatttttttttcacgttttttctccatagaaggcttcaacgggcttttgcttgtttatatccaactgttttccgcttcatcaacacaattcgatatgagaaaagtcaattgatgcagacatcgcacgatgcatcgcgttctacactttgtttgaagcttctaacatacatttttgtgacttttttcatgactttttacactttttaaggcaaaatttgactttttgtgatgaaaattccgaaaaataaatcaatcttcgggacggaacttaaatttcttataccataagggctcaaatgacgggactgaaaaataaaaaataaaatataatctggcggtataacatttttgaatatttttttccgttaaaattagtcgttttaaattactttcttcgaagaatgtttaaaacggcttttgggtttaaatacatttggctaatttttcaggactttttttgggtttatttagtgcttttttggcatttttatatgactttttgctcattttttcatgacttttttgcattttttgtgactttttggcattttttatgactttttcgtgactttggcgatttttcatgactttttaagtcgacttttttgagatttttcgtgacttaaattcccatccccaacaataacttcgcagaaaaaatatgcaaaatcataaatttataactctactaatcagtaacgtttgggtggcggaatttttcgtcattgaacacaccgagtcaattatggatccctaattcaaaaagtaaatgaatggtatggctgtgcttttggtaaaagtcgggaacattggtcccataaaaaaaggataaaaatgctcattttaagcgattctgagcagtactcaggggtattcgaggtcgctgatcacgattctgatatttatttcgaccagatttcgaaccccgaacccgaattcgaacaa

SEQ ID NO: 8661 - DNA, 2917 bp, Heterodera glycines
  misc_feature (1778)..(1779): n is a, c, g, or t
tttacgctgtgatggatatactggggggataacaggtctatttgccagagagcctcccatataagccgcccactgatcggagtgaataatgcaataatatttgtttgagcaaatttcgagtgaaataacaaaaaaaaaatttgttcgaattcgggttcggggttcgaaatcggtcgaaataaatatcagaagcaattggatgtacaagagaaaagttgaagcttcgaatttttgaatttctgcatctcatcttcgttccgccatcgaacggttgaaaaaattagagtttaaaacctaatacagaaaaaagacgcggtcgatgctacgagagctgcactgatttgtgaatgaagaagtccgagctttcgttccgaaaggcgcaacgctcaagaagtctgatcaacgcagaataattttaacatgggcgtcctttccagcctcccaaagatcagcgcccaaataatgataggcccaaactcaaaattgctcaaaaaaaaaacggttggaatgatttagaaaagtgagaaaaatgcaaattaagggcgcgcttgacattttcatgtaaaaaatcggatactgaattgtccattttcgacggggactcacttatccattgtcaaaacgaaggtaaaaaccataaaatccaaatttatttggtatcaaaacaacggttttctgcatataaagccatttgagaatggataaaactattttttaaatcccgtaaatggtaaaagccggggctcgtagggcctcggtcgcgaaaaagcccatgtgggatgggctcgaaactccgcactttgtccctctttgcacgggttgttatttccagcccaactttaaatattcgtctcttttaaaataaaaggcacgagaatggcataggcatttcttgcatcttctgctggcatagtgtaacggtggatagcgtttgggctggtttgtagcaacagaaagggcttcccataactccgattttggaggatcagcccatcgttgtcgctgatgtcaccaggaagaatcttgaaatttgggtcgtagttggaaatgtcagtaccttttttagactgtcaatggtcttttctgtctcactttgatgtttttgtttttgattagcctttggacagccggactcaaaggctcgtaaagaatgtttttgtgtttgttgtccaatttgaactccgagagaatatactccactccgagttcctgagcttgtcgaagactgagcattgctcccccaacttgcacaatctttccactcgctgttcgaatgacttcgatccctcaaattttggttgggttaccttttcatttcggttaacactcgaataaaaaagcaaaaatattcgaattataaataaattataaaataaatgctgcatatcgtacagcaagtgcatgccgtacctctgtgtttgaggatttgctcccctgccttaagccctgtgattactgtgccttttgcatcttccattttggtgcccaaataatgaatttttctaatgtattccgtcccggccaaatcgatgcacatcgttgcgctaaacaatgaattaaattcatcaaaaaaggtaaagcacagtgaaagtccaaaaatgatataggccaaaatgatataagttgagctgtgagtggggacgatgtcaccaaaccctaaagcatttagcagaaaacgacgaaattcggtcagaaaaaccaaaataataaaataccgacggtggccattgttatgaaacagaaataaaacgcttcgaaataagtccatccctcccatnngtggaagaggaaaccgccaatggcgcagtaacagaggagcacgaacaaaaccatgaccacgggaatgcgcagttcgtgcggcgtttcgctctcctccacgtccgcctcgtttatttcgttcagatttatgcttcccgctttggtcatcgtcgagacggacgctctttcctctgaatgcttttcgattaagacaaattgcgcggacacttggtcttctgttgctccttttacgagtccaatcagaaagcgaggacagtcagttgttgttggactcataaaggagagaagaagccaattggggggcggggagggcaccgtcgtgggaagaggcggaagcggtgcggtagcgagagaagcggcgcgattgcttacggacctgaaaagaagagaaaggaggccgaaaggggacgacggcaccttcgtcttaaaagtgcggtaggttcggtagagaaaattcagaaaatcggacaagaatttgccaatgtccgcaattgtcaccagaagtaaagggatgccgaaaagtgcaaagcaaatgcacgcgattcggccaaactcagtctgaagctgacaaagttggcatttccatttgaaaagcatcacatcgctttagccccctccccaaattttccaacgataccatcgggacgagatttccatatcctgaaaaggataaatgggaattttttggactaatttgattgctttggaccaattgtcgtgattacggtcgttgcgaagaataaactattcgcataggtccacaacatctcggccccgtgggttctgttcagcaaatgcctttcattcgtaaattgatttcggcatgcggaaaatgagtgggcaattaatttgtcaaaatattcttggccaagtccgttgaacgattcacgcgaaataacattctgaagtcgatgaaaaggtgtcgattgtatgcatttatttgttttagggacctcttctgagtgtgtgagattccaaatggtgtcgtgaaagcgatctctgagcgcaaaaagttcttttatttctcggtccctcgtctaaatttgaccattagctaactttggtctcatttgatggcttaccaatatttcatttgatgcttcaagataatgctaaaatgaagactctagagatcccc

SEQ ID NO: 8662 - DNA, 2496 bp, Heterodera glycines
ttcattttataataaatattcattttgcttattttttcttcattcgaataccgaattccacctaaaaataataaaatataaaatttaaatttaaaatttaaaaaaaatcatattttaattcaaattttaattgaatcacacttttgtcaatttcaattccaaattctttttttccatttaatgaatgttttttggtcaatgtccaactctttcgcaaattgcttctgttttccttttcttaaccttctgtaaatctcatcaattcgttcaataaattcttgctttttcttttcataataatttttatcatttttcttaattttctttaaattaaattcttttttccatttgtaaattttctttcgactaattcccaattttacggcaatcttttgctcaattttagtccgaacttttgccgaatattttcctcttttctttattttttcctttatcacatgaaatttatgaacaatttcgcgtttttgctgatcattgaattgttcgttgttctgatcattgccaattgaatcttccaaatttaattcattttgatcattttgccaatttgagttttgatcaatttcccatccttggccaaatatttcaacaaaagttggccgagtttttccattcaaatcagataatttatgaacacacaaacatttatcggttgaatttattatgaatatcaacacaaaaattaaaataacaaatgccatctctaaaaaattgagatttttaaaaattaaaaaattcatttggttttattaaaagcataaaagaatcttagtaaatattttaataatccttttttaattacggaagtttttaaaaaatatattttgttaaatcataggcagaagaaatatttattttattttcatttacataataaaaatttggataaacatttctttttatgtaaatatgaaaaaataaatttgccaataatttggcattttatcattgaaaaagaccatcatcagaagagtagaaaaattttaaaaaatcaatttaaagttgatcagtcaaattccttcttcactttataaaaaatattttttccccatttttgttcgttagaaaatcataaaaatcaaaaaaattaaaattggcactgacgaatttaaaaaatgtcattaattgatagttagaaaactattaatgtaatctattgaatgatagcataaagtattattaatttggttgaattttagcaaagttatgaaattatgtgttttacattttttgtttgttttcctaccccttgtccggtttaagaaacgcccttagtgggcggaatttaagaaaaggcctctagcaccatagttctaagccttcaggtgctatgacgttactcaaaaaaccattaaaataaagtattttttgataagtaaatttattgaaaacaaccttcaaactcactggttcttaatttattccggcccaatcctgatgatttcaaatttgatgcctggaggtgtataaaaatacggaaaactcataaatgccgaacagatttatttggatacgaaattgaggaagcccccgaccatattctccttcctacaactttcgaagactgtaatcaaatggcaacttacaaaaaatgtgaatttggtattttttatcaggggaaattggtcaaaaacatacaaatatgaaattattggttgaacaatcatggtggaaagttggaatgcaaaaaacagaatcagagaattgtttgttatcaaaaattagtttatttggtacaccagggttagaaacttgcgtttacaaaaaagatgctaaaataaatgggacatttgtaccaggaatttggatgtcagaagataacaatcgtgcactagtttttgacaaaaattcaaaaaaggccgaagcatgcggcgaaaaattgcgcgttagtgcgcaagggtttgcccttacggagaaaaccaaattttaattaaaaaagaaaacgataaatttagttggctttttggatccaattaccatgattatcaaagaaaatagtaaaattcaaacatgcactgaaggacaattcaaaactattttgttaaacaataaattgataaaaattaaccaaatgactggaaaatataatcatatcgaagaaccaactatttacaatatggaccaaaaagtctggaacgaagaaaaactacctattttcccattcaaatattcaaacaactaacacttacaaatttaacaaataaacaaattgacatgttggaaatgttaaaagaatttagaactagtcgtattatatagataacagacccattgagcaaagagaaatttggacgtcaactcaatttcgagattcggcattattccattttttaaaatataattcctaaagcaaattaaaattttcacaatgtaatttattcagtaaaatttttaatttcagaaataataagaaaaatttttaatttttcttcctttttttaaaaaaatcaaatacataaaataaattttaattgc

SEQ ID NO: 8663 - DNA, 2716 bp, Heterodera glycines
tcaattatcaactaattgtgttaaaagaattgaaaatttcggcccagttttctttgccatcagcagaaatcatattcaattgaccattatgaacagagaaggctacgtatttaaacatttaccatcatcaaaaaatcccaaaacgaattcttcttttttttgtaaaaactgagaaaaaagagattaagaaataattaataaggataacggctgatcagttgatatcagccatttaagacacctgctggccaaccttactattctcaatttttttttcatacttttctagctttacttataatgatttacatatcctttttatatatttacataaaatccaatgttttaaaaaattaaaacattatgaaaataataaaattttctgcctatgatttaataatattttttaattcctttagtcttcccataaaaataaattacatttaaaaaagaatgtaaatttaaaaaatgattttgaaaaattccttatttatttttaataattaaaaatctgaaaaatagatttctttagatatggattttgattttcatgttttaattcttatgttattattaataattagttcaactgacaaaaaatttgtgtttaaaaagaatggaaaaactcggccaacttttgctgaaatatttggccaaggatgggaaattgatcaaaactcaaattggcaaaatgatcaaaatgaattaaattcggaagattcaattgacaatgatcagaacaatgaccaattcaatgatcaacaaaaatgtgaaatggttcataaatttgacgcaataaaagaaggaattaagaatagagggaaatattcgccaaaaatttggaatagaattgagcaaaaaattgcgaaaaaccgggctttcttccaaaaatcccctcttttcctattcattcgttgctttatagacgaatttctcgatttcggttcggtatggaaaatttacggctccaacaaataaatttccattttcggcggtccattattttaaggcaggaggaggccggatgtcgattgctgtcaccggtaaattttttgaaatttggctaggtttttaacagataattgtccaaaaaataataaatttgcgtaaaattcaaaagttccaaagtaaaatacttacattatccaataaaatttattattaattttaaaaatcaaacaaagtttggtcactatgcccaaatcggaacacagatgaaaacactgtttttaatccatggcagtcagcagaaaaacatgcgttgacaagtaaagtaattcgccctcacaataaatgcaaaatcaaaaccgaccccgcgaaacaaagaaaattggcaattttacgaaatgcccttgttggcagtttttacgaaaccacctaacaccctttaaaacattgactcggaaagtaaattttggtcatttttgaacaaaatctgttaaaaaatcggttaaaattttatttaaattttctattagtattttattgaatgtatttgatcactttttaataacatgaaaaaaatcggtcacttggaatgacaaaaattttttagtgcctaacttcaacctggacctggagcaagcacttccggcgcgctgactcccgactgggcattcctgagggtaggagtaccgtttgacgtgccgacctatcacaaactattagaaaaatgatttatcgcgggaaaggatcaaaaacttgggtaattaagccgaaaatgggtgggggacgggggggggaagtggcgaacgacagaaaatcggggttaaatgtatgccacaatgagtggtgtggtgataagaaaaggtacaattcttcttccctgaggggagacaccgctataaaaattgatgctttgagtgcaatttgctaacagatttgtccaaaaattgcccgaatatttctcagcatctcataaaatcacttgagcgatgggggcagatatgcaaaatctaaatgggaaaaaatgaacaaacgaatgaaaagataaatggcagttttcaacaaaaagtctttaaatgatcgttaacatccacctatgagagggtattgaacatgagcaaagaataaagaacccacgagaataaagagttactaaatcgggaccgggtagggctattgaaaaagcctggcatccgggtctggacccggtcgggaacccaggcccatcaaaccctacttcacagatgcatttaggtcggtctgataatctcattttttattttttggatattctaaggaagaaaaaagtagaaaatgtatatttattgtaaagtgaagaaagggaattcaactgacaaacatttaatattcccaatctttaaaaaaatattctactgatgatgatgatgtttttcattataaaatggcaaatgattggcatttccttttttcatacttacataaaagccaatggttttacaaaaaataaaatattataatttaataatatgtttgcataaataaaaaatggtattaaaaattttattacaaatactttatttactcttttaataaaactgaatgaaattaattaaaatctgaaaaatagattttctttatagatggattttagtattttaattgttgtgttattattaataatcagttcaaccgacaaagctttatctgttgataatttatgtcaaaagaatggaaaaactcgaccaacttttgctgaaatatttggccaaggatgggaaattgatcaaaa

SEQ ID NO: 8664 - DNA, 1031 bp, Heterodera glycines
tgagaggaagaaacatttgtttggtggtgaatttgttggcccaaaaatgtggcgggcattacacgtgaaaagcatgatcagatgaatgattgatcggtaaaatgatcggagaacatgtcgtgcttcccttcccttttgggtgttggggctaagcgactgatgagtgtctttgttttttcgatggtcagatcggataacgatcaaacaatctaaggattgatcgaacaatatggtttggtgatcagagaaagtacgaaagttatgtttgaccagaacgggaagtgatcagaccttaatggaaagacattttgagagcttaagtcgctgatacaataaatgggagtcaaaatgcgatcattttttgggggttttcgttgatcaaagcggcaaaaactaatgtgatcggaccacagagccttctcattgatgagtgagtgcttcttctagctttttgcaaactcaaaaacgaccagaggtaaaagaaaagtgagggatgaaggagggatgaaggagggtggctttttttgctaatgtgatcagagccgagtgctttcgactttcattcactcacttctcggaggagtgatcagggcggaaataagcgatcggattgggccaaagggatgtgggaggttagaaagtgatcagttgttgttactcccacctccccgccccccgagcagagtaattagttgagaaaatttatctattttttgcgtcactcaattgtcgagagttcaattcttggtcttgggcaccgattcttggaagaaatcaaggtcaaatgtgataatttattgccgatgggatggcctgagaaattttctgttttctaaaacttttgcagatttaaactgttttcaataaaaagcttcttttttagagttgtttcttctcgacctgcaaggaaagaaaagtcgggaatcggggaggaaaatcccccaaaaaaaaaatgtcgggaatggcaagggaaaattttcaaaaatatttaggagcaactcttttgtcgtggaataacttttgcagaaaaa

SEQ ID NO: 8665 - DNA, 1868 bp, Heterodera glycines
ttctgtgtataaaataaatactgatctttttccgttcattttgtcccattaaatatgcgtctcccccccccttaatttgttggtttttgcttttccccctccctccgcacaattaaatggtaaaattggtgtagcgttttttggggggagtgatcactttgtgtgctccttctcctccccactgatcaaatcgtcgtcatccctttttatttaaaacgtaaatgcaacatcaaattttttgtgtgtgccgcccctaattttggcgcgtcccccgcacccccccccctccgggcgtaattgggcattttgcattcattccttgcgcagtgaaatgggttacaaagattaaatggaatccccgtgtagcaaaattattgggacggaatttcgatcaaaaaaagaatttgtgaaattgagcggaacagattgacagacagacggagcgaaaaggaaaaggaacacgggaaaagtgggtgatcagaaatgtgatcttaggacggggaatgatcagcagatttgcaaaagaagtggtcacgattaaaacgaatttgataatataaaaatgaaatctgaaactgtagagtaaaatgctcagcagaaagccgaataaaatgttttttttaatctgagtgatcttatagctgctttgaaacgtgatctgagagtaacgcaaatattgagaatgacttgttaaatgaataataattgacgtataatgtgatgaaaaaatggacaaatttgcgaacagaaatgataaatcaattcgggttggtttggtgacctaaagaagtaatggatatgatcaaaaacaaaacaaaaattgtttaatggtgatcgcgatagataatcagattatctcaaaagagattaatgagatttaaggcgatcagtcagtcggagcaaaataacttttatctcagtgatcatagaaaaaagtattttataaaattttgtagaagtgatcagattaagctcgtcggagatagaatttgttgttcattaaatgatcacgtcagaggggaaaaaaggtggacgtttggacgttaataaacaattaaataaattattcgcgagtctcaagcggttttgatgggtccgaggacacttcgaaacgaggtcccccgaggagacgacgcgaaacgctaatgatgaagatgatgatgatcgcaatagaaaagtggacgatgaaaatcatttgaatggaggtgatcggactaacaaattagtgaaggggtgaccgggcaattaatacaatttagaaaatgggaaggctacaaagagtgagatcagcaaggggggggggggtaattagtgagaattgaccaagctaattagattagcaattgtgatgaaaaaggtcgagagtcttcaaaaattttacgaaaatttccaagattatatgtatgttgttgaagtagtgattaggaaaaattgttttaaggcaaaaggacaattgaacaatttttaaaatattttggcattaacgcgattgtttttttgagaccatccccaattccccaaaattcggtaaattttcacgttcgcacaaactcaaaaatattcccattatatcaaattgctaataaaaaaatggtaacattttgggtaaaaagttatgggctgtatgggattgatcagactgataagaaaaacaatgaaaagtgtttatgggtaaaaaagaccaggaagttgatagaattttgagcaacaagttattagtcagggattctgacaatctgtgctggggaaaacccgaatttagggtaagggatgagtttggtgatcaaagatgaatctgatcagaagatacattgaatatgttaattgattaaaataatcgaaattttaggaaattttgtttgtcatgt

SEQ ID NO: 8666 - DNA, 2116 bp, Heterodera glycines
  misc_feature (134)..(134): n is a, c, g, or t
  misc_feature (195)..(195): n is a, c, g, or t
aaaaaaattcccatgccattgccccaaaaaatgttttttaaatgacagcagcaccgtcattaatatggcaaatggttaaattgggaaacaaaattattttcctctgattaatgacattaatcttctttttaatntaacttaattttatttttaggaattccaaggcaatcatttgtttttaaattatatttaatntagtttacattttaaatttattaataaaattaaattatgctcattccccaccttcaaattgccggcagccatttgctgctgttggtaaatttttgccgcgtgtgagcttggcagattggcgctgatcagcacggcgctggccagcgggaaggaggcggcccggcgcgagccgaacccacacgacgaagagggcgcggaatggggcaaaatcacaatggcagttgcgtcaccttgggaatattgatttttaaacaaaattataagaattttttgaatttcaggttgacaggagtttttcgagaatttaaggccccatcttaaaaaaaattaaagaaaggttaatccaaaaattaaaaattaaagaaaaggttaatccaaaaattaaagaaaaggttaatccaaaaattatttgattttcactttaactttgattaaaaaaatcaatgaaaataggtgtcaggcagtccggcaggcaccacagggaaaaattttcgattaatatttaaaaaattcaaaaatacttaatggaatgtaatttcttcgacccatacgatgaaaggaatattttgataaaatgcctggacttcaaatcggtcgaattgtaatgccacacctgacattggcgggtgcgtgccaatgccatcacgtccatagccgtcggaagaatggtgaacttgatgaaagctgaaatttttttatttgatcgaggcaatttacactgaataagctcaaggattttttcaatttccaaagaaacatcgtcagggcatttcaattggacttcaaaagtcgtaggcaatttaaaaaattgaattcgaataattttttataagattttacttgaggtaatttcaaaaaattttgccatgcatataaaactgccaaattccgcacttaaaattccgtaatatattttcatttgcaatattttatttttgcatttcgccttaggcgtttatcaatattttcatgtgatgaatgaagcattttttgccccgaaaaatgatggcccttcgcccattttcaccgttcactttcgctgtcccacggcctcggcgccgtactccgaacgcactcaattcccatcatttgttcggtggacgacaaaaaaaaatttgagagaacctttgttggcgttgtgttgttgttttttttattgtcgaagcaaaagaagaagacagagttaagatgaattatttgacggtgaaataatttattttattttattgcgtcctaaaaatgaataaatatttttttggcgcgatgaatgtaccgatcgattacacaaaacggaatgaattttggggaataatgaacaaatttgtcataaatttttgtctaatgaggatggaaatgttttaaaaaattcattaggaaaaaattttaaagcgtcgcgaaaattaattttaaaaaagtaattttaaaataataataattattattattaatggaatgatcagagaatggaaaacgagaggattgaaatttaaaaaatcaagagaaagttttttagtaaggaaatgactaggaagtaaaatttcgagaatcgagtcgagcattgagttcgaatccgtgaccaggaattaatttcctaatacccatgagtcgaaattgagagcctcttaaaaacccgagaaattttccggtctgaaaacagaaatcgagaagggcccggtaatcgagaccaaaaccccaaaaggtcgggaatttctcgaaattaattaagtcaatgtttttgctaggaattaaataattttttgggagaaaatcccacaacaaattttccacgccataaaacattttcactttcatttatgtacattttctgccctttctatgaacgaatagaccattattgaatgagtggggtggtaaaacttccgcccccctcgccagtacaacagccccaaaaggggtgacc

SEQ ID NO: 8667 - DNA, 1341 bp, Heterodera glycines
gtttgatgcattaataagggtgttgcaggcggtaggatgaatcatcatcagccgacagcagatgtgatcacacgagaaattgtagtgatcagtgatcatcaccgttcatttcggaattatgaaaagaaatttaaaaatagtatgagataccgatacttcttgagatagttccaaatcagaaggaaaccgaaaatgaaattagaattagcaaaaaataatactgttttttcagtaagtctcccagatttaaagaaatttgccatcttgtcctagaaaatttttgaattttttgtcaatctgagtgttcttactttttagagtaaattgagtcccttcggtagaaaaatggttgaacactataatattgaatttaataatgtggaaaaagatgcaaattagacccaaaactttgcttttgccctcctgtccataaaatgcctcacataatcaatttaatagtggaaaaattatgacaaaaaaaattccctagcgaacaataaaaaaaacatgatttttatgaaaatgaattaaatcggtgaaaaaaagaattcaaaattgaaagaaaattttcatatgcccttatttaggggggggggggtgtaattttatttttattgctttgataaggaatttcaaaaaagaccaataatagaggcttaattattttagtggcaaaaagtgaaaaataatgatttgtaatcaaaacttcagaaaaaaatagttagaagatgactgaaaatccgtatcttagatatcagtattctttactgggcttggctatataccattataaaaaacggtgtaaaatgctctcaacccaacccaccacaatcgacccaacaaatgccctgcactaacctaacccactttttactcgatgcatttaataattggatgtggtggtgatggataactgagatatccttatcagagacagaaatcgtcgaaggattgtggcggaggaggcataataatttctgatttcataatttgggtactttcactttaatagattggatacgatttttgaatgtgaaaattatgaaggttttaaaaaatgttcaattttggttttctgttccttcaacttttacaaacggatgtgatgcgagagcaaaaaacggaacttgtggttgaaagtgggataaaaaaggcacatgggagaatttaaaaaacgatattttagtgtttcattagagcattccatttttggaagggccatgggttcgggtcccaccgggtgcacgtaatcatttatctctacagcagaattgactcattcactgctcatctctgtacatctctggaaggcctagaaaatcaacaaactcaggcaactat

SEQ ID NO: 8668 - DNA, 871 bp, Heterodera glycines
ttttcctaaaaaaaactttctcataattaataaaaaatacttgttggcttattcgctttgcaaaagagaaatgaaatcttcatagcttttaaaagattaaccaaaattcagtatttcctgaatttttgaaaataaacaaccccatggggtttattcaagctagtacagtatttaaaaagatgtaatttttgagtggaatcttttaaaatttcgatttaataaaaatcaaattatctatgcataaaaagctgtattcttttgaaaaaaatatacaaatttaattaactagaaaaacttctttcacattttattaacacaatttttgggaggctttttggcgaaagagaaaccatatctgaaacagaccctgccattgctgcacttgcatgtcgcaagtcgtcgcgcattttgtcaagctgtacaagcagctgaaaatagtacattcaaaattcccttaaaattgtatatttaaataaaataaaaaacttttatccatatcataacagacaataattattaattgtaaaagaaaaaatattataacaaattttatagaggctaaaaaaattccaccatatttttgaactttttggcgtgcgccttaacacctggcgccaagcgcgcccactaccggacgcccaattttagctcagcaaatgagcgtatcaaatataaaaaattaagtccaagatgcccggagaggagaaacataaataaaatatgtataaattgtgttgaacctaaaatattatatgctcccgccggcgggactcgaacccacagaaattccaaatagtcaaatgccttaaacgactgagccacagaggaacttgccaaagtcttaccgtatccgttttgtgcatcatcgtct

SEQ ID NO: 8669 - DNA, 2920 bp, Heterodera glycines
  misc_feature (90)..(90): n is a, c, g, or t
  misc_feature (2859)..(2859): n is a, c, g, or t
ttcaaattttcataaatattatgccacactaagacaaccctaaaatgcatttttccaagaattccgaccctcggcacggcaatccatatntgacagagcaccttgatgtcggtgatcaaaatggcgagttccaactcctcgtcctcctcacagtcgcgcacacggtcaaaccgttgtgcggctgtcagcagccattgttcggctgccactagattgttggcactgaaactgccgactgtttttggtggtgccggcttttcctttttggcactttcaatggcaactacttgaccaccatctcgttgaattcgccaattgttttcaatgagctcccagctttgtgcaattctaatgtaaaatggaaatgttattttatataaatttatttaaaatctaaattaaattaggtatagacctaaaaattcagaaaaaaaatattattatccttatttatttttcaattaatggagaattccatatttaaatatttttaatttattttataaaaaaaataaaattaaattgaaaacatgaaaattcggaaaaatataaattagccttatatatttccgattttggcagaattccatgtttataatcatttttaccgattttaatattttgggattttgattttttatataaaaaagtaataaatatcccaccaaggatgtgtcggaatgccgattttgccgagattttttgagggcgtcggcacacatccctatatccaccacccaaaatctaatattcagaaagatttcctacactctcataggaattttacgtaagaaaaaaaaaataataatccgagtttattaaatattatttgatttgccgttaaaattttttattttatttgaattatatttattaaatatgtaagtttttaccttagcattatcttctcaatggccaggcatgcattgagcacttcacgtggcctttcttcattgtcagtaagtgcacccaaaattcgaatttgcgcaataactgttgaaccaatctcaaggccttcacgcgttaattcagctaattctacaaaaaatttaaaaaaaaaaaaaaagaaattaaagtctaatgaaacataaaaaagttaaaaaattgctaaagaataaacctttaaatttttatttaaataagagtttttctataattaaaataattttatattctcttaaaagttattcttatttttgggagttaaaagtgttaaaattaatacataatgtaaaaaaaatagcaaattaaatataaattaaattttttctttaaataaatttttgtttactttttttctctttttagatttaaaaaaatcgagcacatcattttattatttggtctagcggttaactctgttcattttgtctgtacaaaattcgctggttcgaatccggttgactgcgaactgtgatgtttgttggaatagttcatctgattgctgattgatgactaattttcgcccctatctgagttcgcaattttttctttttttaaaaatttaataataataaaattgttaaaaatgtaattaaagaaaaaatcagcaaaaatataaaattaatatagaagtaaaaaaattgttttgtaaggaaaaaatggattagaaaattaaaaaaaaaaattaaatttaaagcggttaaaattcctttaaaaataccatcaataattctctgtaattcatctggtgattgaattgctccatttttgcataaacgagaattggccaattttgctaactgtaaatgaaaaaagtaagaaaaaattaataaaacttaaaaataaaattataaataaaaataaatataaaaataataatttaaaattgtattacttcttcatgcttcaatgcgatctcataaagatgttgagtgtctgtcagaatatatccccggattgataattgccttaaaaaataattttaaatttaattaaacatatattttaattgaattataattaataatttgatttaatttattcctttaattacatggaaaaattcaaaaattattattttttatataatgaaattaaattaatatatttgaaattaaattaattaatttttaatatttgagtgatggacctgctcaagcttttccaagccgtggccaatccgtccgccatcgcttcataaatcagaatgtcgtccggctccgtttgttcagtgaccagtttttcagcccgtcccagaagttcttcgacctaaaaaataaatatattatatttattttcaattatatttaaacatttaattaaattcaatttgcctgctcctctttgccaagcagtcgcgcgtaaaggtcctcatggagcagcaacaattgcccattctcgcttggatttgtgccaatttggagcaggcccggctccatctcgtcaatgcgcaattccacaaagccgacactctgtccaaaattcaaaattttaactcaaaattatcaaataaatttttatgttgaattaaatttagagatagacattttcagttggcataaccgagatttctcgcccgattttgttttctcgagctaaaaaatttctcggattttgggggtcttagttctcgattaaattctcggccacaattttcgaaataaagaaatttcacactttggaaatattagtgatctccgagaaccagaaattccaaaggccttaagactctctcggacagacaattaatagaaaaagccgtattttaccctaacaattgcgacaacaattgtcgaatggggttctgccctgactgcaatggtggacattgtggtggtggtggcactgctcgccgactttggcattatgttttgccgcactgttggcattgtggcaaaagaagattccaattcaacnccagccatttatttattattaatggtaaaattaataaaaaaaaaattatattaaaaaatta

SEQ ID NO: 8670 - DNA, 2969 bp, Heterodera glycines
  misc_feature (93)..(94): n is a, c, g, or t
  misc_feature (174)..(174): n is a, c, g, or t
acatgaacaaacaaatgtttaacattttttctaaaatattgtgaattttgatccaatgaaagtgcattgaaccatatgttatttttcaaacanncataaataacaattttatgattatttgatcttaaatgtaaacccaaatttgtctcataaatttaaatattttttgaaatntaaaatgagataatttaaaaaactgaaaaaactcttgtctttttttttgcttaaatgaaaatgatcatttttagaaatatgtttataaaaatgtaaaatgtacactatcattaaaaataaagggcgttttaatgaatttggcctcggtttttggcacgtaaacttcaaaaattggtataatttaggccctataaactctattaaaattaaccatgacattttgtgtataatttttttcatatttaattttttttgtaaggatgcattttgtgtaaatatgaaaaaaatagagaatgaatgcatttttcgtttttattatgtttttgtttaggaatattgtgcaaaaaattgaaaaaatatgattgtgtttttttttcgagccgaaaacataggaggtagaagcaacagtatctaaaaatattttttttgtagttttttgcaggtatttaggaattcggagttcgggaaaaatagagagatcccttaaatagtcgatttaaatttggatacatattagatggaattgtttgtaatgtgatgctcatttgctctctaaatacattttgggacgacaatttgtccattcctccgcttcttcttttcgttgaatgtcccccgatggcaaaaatgcttcatttattggctaccattgctttaaccgccggcccaattgatgagggaagagacagcaaagcagaacgaggagaggaagaagaagaagctgcttgttggagttcaactgatcttttagtcactcacataaagccacagcgggagggaaaagcacacccatcggcgccatcactctttttcttttcctctcgacatcaaacactattccttgagagagtaggcttactacgcccgaggcaatatggagggttgttaatcaatatggaaatagaagccaatttggagagagcactaaacagacagacaggcagggcagacagacaagcagcggataaacaacgccaaaggcaatcaatcggatttatattttattgttgttgtggagattgatcctgaagattaatccgtgtcttatgggtgatcggataaattggaccaaaagcatcttttggtcgaagaataaatggacagcatcgaagttttaatgaaataatggtcttaaattaaaaggcttatttgctggcacgacttttatcatggcttataatagcactattgttttggtactgaatttggcaaacttttattagaaatcggatatgggtcagactcccctatacggtgggtgctaggtcggaccgaatatagtctcagtgtcaataaaatatttaaatctaattattttaaagcaatggttttttgcttgaataataataataattttaaaaattttcaaataacaataatgaatttggaggttcaacttttcttcaatgtttttttcttcaaatattctgctcgaaataaactgcaccattaataaatgcagaataattttgaatcgtaacattagtggaaaaggaagggatgaagaaaaatttatggggaaaaatgcatggaatttctggagaaacgaattaagaatttaaatctacgaaaatattgggtgaaatttcagaagaaaattggtagtttttttttctaaaaatgaaaatcctctagtaagcttacttgccaaccaatttgatggatttaagatttgaaattaaaattttcatttcgatccacactgagaaatattttcggttcgactcagcacgctcctatactacccgtacaatcggaaaattccgacctctatttttattgtatgaaactatataaggtttttaaatattttatcttttaaattttttaaagaatttaaaaaaacatttaaaaaattgccatttttatttccgagtgcgataactttaaaaataaaataaattcattaatttattcatatgaattccacatattagctcaatcaatcaataaagaaaagtgattaagagaaaacattctcttatacaaatttatatatgaataaaaaatttgcaaattttcttcatatttatttaacattatgttgttaatgatgaaatttttgaatattttattttttctgtattttattggcatttccgtttgtgtgcagctggcgccgtcttatacatgggactcaagcagttcagtcaacaatgtcggcacatttggcaactttttggacgacctttttaccgaatatgccaaaagcgagaaaatgggttggttttcgttgaaattacgtaaaaagagtaattaaataaaaatgccacatcgcttagaaaaccccgggagtttctggcataacaaattagcacgtcaaattatgcattctttgtgttattcaacagctttggttgccggaaaccaattttttgagaaataaaaatttatcaatttttttctggaaaaaataaacaaatgaaaatatcagcaaaaaatttaatttattatttcccatgtcaaaggtttgagtccgcttgacagatgctgaattattttgattttttcctcaaagtatattagtccacctcgcaacttttttttctcttaatttacattatttttttatggcaataagaaattttctctgttcatttaaaaaaagtttatagatctagtatgatgttggaattttttgactttattttttggggtccaaattgaaaaaattaattctattttatttttatttttttattccttttttgtaggttattttttaggcatttatatttttaaagtatttcttatttttttttattataattgcaggcttaattaaaggagaaaaa

SEQ ID NO: 8671 - DNA, 1620 bp, Heterodera glycines
tgtccacctatgatgaaaactaaagaatttaaatattttcttttctatttttaaatttaatttcttttcagaatatcacttcgcagttgcccgattctgtgccgtatgatgcggtggacattaccgagctggtcaccatttgcatccctttctttctgtacgccgtaacagtgctgaaaatggtcattgaatttagcaatcagcccacgtcgagcccaagtaaaaattcacggcttaaaaatcaaaaaacaaatgcttttgcaaaaactctccattatgttttaacatttttgaaaacaaaatcgatttttcttcacacgaacaccgtattttctctaattatatgcccgcgtaaattatttttgaacttcctcagaaagggggagttaattggagacgggtaaattaatggagacgggcatataattagaaaaatacggtagttcgtttgggtgtggttgtagtcatgtgccgtgatttcttgtgggatcagccaattttttttgtcgattactttagtcaggactatcatcataaaagggtcgcggtaaaattctaagagaaatacgcaactaagcttaaaaccgtaaattaagaataggttaaaaaaggaccaaccacccctactgctggctctattccggctaacagaaagatttttttcaaaaacgacaattaaactcatacaaatttattggacgtgcttaattatctccctcattcagtgcaagttgccattgtccttccggtcggctcccaaggcaacaaggaggagcgtgccaagtttgttaatttgatgcaggagcgcactcggctgttctccatgtgtctgctgagccaagtgccctactatttgtcccatgccatttaccaatcgttgcgtttttttaaaatcaaccaagacacacttcaggtggtacagtatacgctgaggaataggaaactaaaaatctgtaggagcaactttgtcccggccaaatttagtgttccaaaacttttcataattgaccaaaaaatattcatagtcgaatcactaaacaagctttattggcctgccaaaaattataaaaaaaatgcctctggattgatcgggatttggacggaaccccgactctggattcctcccgatcatttttccaaaatacttgtcaatcattatgccaaaaaaattattcccaaatttatctatgatttaataatgtttagattatgggcatcctttggcaactccttggcacaatttttcacgtccaacagcccattttgatgctgttgctcagcagggatctacgcgaatcggtgcgcaacgatttggcacatttttttcgaatgttaaaagagcgcctgttttgaagttgggtgtcggaaaatttcgggccaggtcgttttcgcgccgtcgttttcgcgccgccgttttcgcgccaggttcgttttcgcgctgtcgttttcgcgcgggggtcaatttcgcgcccgcgcttttttagcactaaaattgcgaatagatgacctaatggaaatctgattagagattggttatcaacggcataaagtttctaaaaaaaactatatttttcaatatatctgatggataattatctactcaaaaacaacgtgcctccc

SEQ ID NO: 8672 - DNA, 1346 bp, Heterodera glycines
  misc_feature (47)..(47): n is a, c, g, or t
  misc_feature (54)..(55): n is a, c, g, or t
  misc_feature (80)..(80): n is a, c, g, or t
  misc_feature (90)..(90): n is a, c, g, or t
taaaaaaatgaaaaaatagtgctaaaagggaaaatagtgccaagttntcaattnnaggggatctaaatcaaaatttctgntcaaaaattntggagatgaatgttgagaaaatttttcatttattagggggggggtagattttcagaaatttttttgtccattctttgggggtgtatttgaaaaaatatttcagttcgattcttaagggtgattttcgtttttattgaatttttgttaataattttgggcaaaacgccaaaatagttaaaaatagttttttcaaaattttttaaggctttttaggctctaaaataaataactataaaataggcacgagtaactcgaaaagtagcttaacaatcaacaaaaaaatgtttttcgtgattttcaggtcaatgggagctcagggaaaaataggttaaatcctaaaaaccgtatccctaataataataataataaagcagcagcagaaataataaagattgtttttgtaattgacgaagcaccaatagcgccgagattaaaatacgggaactaaaagcatcaacgagttgtttggtggtaaatgtgcttctcgctggcgacttcagcaggggtagaaggtacccccgcgaaggcatattttaggctataaaaacagcaaaaaaggcactaaaaatggaaaataggctctaaaaatcttaaaatttaggggtgtaaaatgacaaaatttattcaaaaattgagataaataatttttaaaaatcaaaaatttataaattagcaaaacatgtaaaatttaattttatcaggataattttaattttaatgggttatttataaaaactttttccattctgttcaatacttttgcaatttcccatatttgttatttttgttaagaaccttatgaaaatctctacattaataaatatattttaattttatcacagttcgtaaataatttatacacacttcaaaaacacagaatacatattgataatataagattgcgatgatatgctacggttggatcgaatgtgcatcaatttagctctgaaaaacttggattacgtttaaatttggtttaaatttttttggaaatttatcccgaaatgcttgccgatattccgtgctaaaatcaatataaattttttattgaaatatttaattttttaatttgcctcgtgaaatataaaatgggtccattcgatgtcgcgctaatgttcaacagaattgcaatgattacttgcccaaaccaagcagtgatcggagaggcaattaaatacttgatcagagcaatataaaataaaacgattaaatagcccccaatattcactgtgatgatacaacaaagagctcgaaaa

SEQ ID NO: 8673 - DNA, 2491 bp, Heterodera glycines
gtcatcagcttaatggatctatgaccactgggaaaagagaactgttagagaaatggtgtcgatctcttggttgatcagagggatgtgatcgccaaaaaagtcggcaaaatttgtttttattttttggcataaaactgtgtttttgtgacaaaagtgttgaagaggcatcaatttttgggtacttttctttatgccaggcgaggttttccagacaaaagcgcatccctgcttttaattatcttaattgaatgattctaaaatgctcacactttgtcgatttttcgttaaattaatttatttttccctcggaatttgccataaatttcaaatgaaaaaatattctcatttgttccaattaaacaatttgatttttttagttttttttcgggtcaatgccaactcgtacaaaggcaactcgtacaaaggcaactcgtacaaaggcaactcgtacaaaggcaactcgtacaaaggcaactcatacacagggcatacaaaaaaaaattctagatttttcaactaaaacttagaatttttagataaaaaaaactaagtggattttttaacctagaaaaactttttaaaacccttaaattttcaaaaaatttaagaaattaaaaaaaatcagctgaaaaattagtaaaaaactttaatgaattttttaaaaatttttttaggctaaaaaatccatttagattttttttatctaaaaattctaagttttagttgaaaattcttagaaatttttttttgtacgagttgccatgacaccttttttctacttcttgggatttttattagttttttctctttttaaggcaaaattgaaattgagcaaagaaaatgccaaaaaataaatgttcgattggtgaaaaggcaattgaaactaacttttttgcatttttcgtggtcttttggtgtttttatgacttttttagacgagtttttgaaatttttcatgacttatttccatctcatcatgactagggtcgcgatttctagtgaaaagcttttttttttttgctcaattgttttaaagaaaggagctcaaaaaaccttttctatgttgaatttttcgattctgatgtcactatccgtcactagaatcactattttgggggttcgtcactaaaatagttaaaactcagtattttggcgttttgtcattccgagtgaccaagtttttgccagcggccaattttccaatttggagaaggcgtccggccatgtcaatcgatgaccttttccttttttgtgatcaacaccgcttttttcgctgcgcattttttccaaaaatggctaaattttgcgcttttatgtcaattttttaagaaaaaaatggcttgatcccaataaaataggaaaaaagactgtgtttaaaatgataaaatttgtcgaaatgtttttttaaaattttctctttccctaaatttacatcaacgattttttgctaagactcctatttttaccagtgcaaatttttaccggcggtaccggtaccgatctctttatttttgaaaaaaccggtacttgtaccggtacgaaaaaacggtaattaccttgccggtaccggtaccagtaccgctccactctagattggaattaaccaaaccgaaaccgaaactgagtgaaagcgtcaggtgacagctaagacattaattaacgcttagacagtgctgaacagctgaaattaagtttacttttaagatcgttgccaaatattaattataaagaacgaaaaatttagcgaaacaagtgccaatttgtcagagaaaaataaaattaacggtttctatgacaaacaattgggtcccaaatttttcatttcaacttcagaaaatcaaatgaaagaaaatcttttttagcacagtcataatattggtgctacactgtgttaatttaaaataaagacaccctgttttttgggagtttgaccatttcccatgaaccgatcgagctgaatttttaactgtacgtagcaattctgaaaatattaagattctaaaaaggagaaggcgaaatgacgatggaaaaaaattttatgaattttttcccgaaaaaggggtgttaatttaaaatagagacacttgataaaaacgaatcaaatctcaacaactaccaaaaagaaactgataaaacaagctaaataagaaagaacaaatcttttttcacatttctatttcttttgcagacagaaatctgtcttttggggagagttatgttgaattttctaagttttcaggagaaattaagggccaaaaggcttaaatcgcctctaacatttgcccaaccgaatcaaactgacagcaatcaacgctaagataacgtacagacatcctttaagcattttgtattcattttatgccataaaaaaggcattaaacacaaaatttatgcgggtgaaaaaatacgaaaatctgagtaaattcgaaaaaaaaattctagggggttggaaaaaattttccgtagaagatgattatgacgaacagaaaga

SEQ ID NO: 8674 - DNA, 2238 bp, Heterodera glycines
ccaaaatgaatgaggggggggggggcggcatttgccgaattgaccgctgtcacagtcactttttacgatcacatttctgctgctaatgttgcctttctgctcccatttaaaagccgtgtcgccctccgtttgcccattttccgtgccattctctctctcccgatgccctgctcgtcctcctcctccccctcctcctcttccgccgcttcgttttcctccgttttccccgtccctttccccgcttcccatccatggaatcctttcgcttctgccgccccttttgtcatcgcaattggcagtggttctgtgtgcgtcaaaaatggcgaatgtcgccagtacaaccaactgaaacgacactaccacgagtcagcaccggtcgcagcagaagtgccatcagtcgacgagggaatgaacgcgacggacaaaaggagaaagaaacgcggaccatcggcactcgcaactctttccgcccttttgctgcttggcgtggcgctaattgtcagtttggcattcgtcgcgtggacaatccatcggatggtaaacgaaaagaaaaggccaaacgatgccagggaaagtgggaaaattgaattgcagaacgaacagcacaaagaatgtgcggaagcgatgaaaacacaagcggaacgaatcgaagtgttggaaagtgcggtgacaaagcaaaaacggacggaggaaaaggaaacggaagagccaaatgacaatgggaagaaaagccatggtaagggagggaaaagcaatggtaagagaaaggaggaaaagcctggtaagggaagggaggaaaagccatggtaagagaggggaaggccatggtgagaggagggaaaagtcatggtaaggagggggaataaattacagcggcaggtgtcagcgaatggaactgccaaattcggaccaaatgatttcggcgtttttagacaaaaaacgccgcgacaacaaaacttcggctgagcagcaaattgtcaccacgcaaagtaacaattgggaaagcagtggtgaaatgataattgtcacaattaaaataaataaaaattgacagatcgtcgccaattttcgcagcgaaaacagccaaaagaattgacgggaaacggcggcagagattttgtgatttttatgaagggacggccaattagcggaagacatttcatggcgcaagggaaaaaagcaaagtgaaagaaggcaaagggagaacaaaaaacaaacaattttaattgtcatttctcattttaattttaatttttcatttttatttgtttaagattttatttttcaatttaattaatttgtaaaaggaataaatcactcttttatttgtcaattgccattttgtccgataccaattgacaattttgcatttccttttgccattttgtccgttccattcaaacgtattcctccgtcctttccctcgccgttctcttcggcggaattggctctgccgggaacaccgtctgatgttgctgatgctttcgtccgttttcgttcttcctaaatgcttctccattgtcattctctcctccctcccccaatttttgccactttttctgtccattttcttcctcaaaattgccatttgtccatttcaaattcgtcacgtttcgccctctcccaaaatgaatgtttttggcgttatcgtaatgccaaattcgattgaattgcacttcctgctgggcacacattgcgctgattttgtgccaattttgacttccttccgccgctgtttccgtaagtaccgtatttctttatttccctgtgctttaccgtttcggaattccttttccaaatttctttcggcgttctccgccgctgcgttcggtggcgtcggatgcctttcttcgtctgctgctgttttgtcacttttgctgacgtttatgcacttttttgcgtgccttttatgcaaaaaagtgccaagatggacgagttgaatgatggccaaagtgacgagcgaaagaacggccaaaagggcggagggacgcgaaaggcacagaagcggcggggacggagcagaagcggcgggggaagtgggagaagcgggggacgggggcaatgcgaaggctgaaattgaatggaggacccttctggccaactccttgttctctgatcaccttcctcggcttcttcgtcgcggtcgtccttttccctcccgttgctgccttttgcttttgcccccagcgcaatgactcggttcgaaggtgccaaaatggctttctttggtgggggggg

SEQ ID NO: 8675 - DNA, 2188 bp, Heterodera glycines
  misc_feature (2124)..(2124): n is a, c, g, or t
ctttgtccaccaccgctcgtcccccctgcttttccccgccgcttttcctcctcggcttcgtccgcttcagcagaggggacttctcccctctgctgctgttcctccattattgtatacgatcccgaaatggttgcgcttttctgctgatgaactttcctcggccgctccttcgcttcctttccccccacaaattgtgccaattcggcaagtgttgccatcctcgctgaactttcttcgcttttttcccgccttcggcgtccacgtgggccctgcccttcgacggtttcctctttctcccaacatttggcctaaaaagccaaaattaggctaactctgacaaaagcgatcattaacagcaaatgatcccactggtgcgcatttttccacacaaatgctaacggagcagcgaattcgcactctccgcgacccttcaaaacggaacactctcagcgaagtattaaagcttttcccgtcatttcggggccgaacatttgtgccgaacagttgggcagaaaacgctcgaggggcaggacaacttgcaatagcgggccattgaatgatttatgccacaaaaggcaaatgaaagtgccccacccattaaggaaaagctgaagtggctttggctcgggtggttcgccgccaattcgttcggcttcgcatttgttgaccaaaatgtccagtctttgtggaagagggaggtgaaagcgatcactttgccatgccaaaagtaactgatcactcggagtggcttttgcgaatgtccaccgtaattccaattgctcgccgagtctcacgacgctaacgaaaagtccgtcacggagaagagccattcgcagccggaatttatatccagacgacaaatcggatcgaattttggacaaaggattaattgaggaagacaaaagggcgacatttttggagtcattttgatggaaaagcgaattttgggggaatttggaaaagtcacagaaaaaagtgaagagacgacctgccaaaagatgtacaaattcaaatggcaaaagatgctttgtttgactttcagacctttgcctttctcgtttttctgatgtaaaaccaacacaaattgccaaaggtcgcttccaaagtgtcttccggggcatttactcttcgtcccatttttatgtgctggacgagggagacggagagtctgtgccgggaggaacacaaactttcggcattttgaaatgggaaagcgttaatattacggtcattaaggcattgcgaaaatggacgttgcaattggtggcgtggccattcaaaaaagcgacgccggaagagggaaaagcgaagtgaaagtgcacggcaatgccacgagaaaggcatttagttcggataactgaaagggaggggagcgggaaatgccaatcggaacaactgttagcaaagaatgaggcttatctttatggaagaagccctcttccgatggcaatttcacctggtttcgtaccatttttggtcccaatttgttcctttttctcccgctgattctttccttttatccattcctcagtctcttctttttctccctgctggtcctctttataatcttcataatccccttccccatcatcttaatcccttcctttttctgcttcttcttcctcccccatttgatcagctgtgtgttccacctcctccttccacttaccctcctcctttttctcctcctcctgttcattataatcttccctttcctcctcctcttcctcctttttctcttcttcttctttctgttcctctttcccctttccctcctcctttttctcctcctcctcttcattataatcttccctttcctcctccacattttcctcctcctcttcctcctttttctcttcttcttctttctgttcctctttcccctttccctcatcctttttctcttcatcttctctctgttcctccttcactttctgctcctccttctcatccacttcctcctcctcctttttcttttcctcttctttctcttcatcttctctttcctccttcgcctttttcatctgtgccaatgtgcgacttgccaaagtgaacttcgcccgaaggaccgatgaaacattaaataatggaaaaacatcggaaaaagtgccattcttctgtggnctatcgctaattcttgaaggagcgcataaattatcataataattggcaaattttgccgcatgga

SEQ ID NO: 8676 - DNA, 1259 bp, Heterodera glycines
acttgaaaattcgaatttactcgacttgcgccattatttggtgccaaagaaacattcaaagcactgccggggaaaagctcgaaattggcactttcagagcactttccttctgcggaaatgaccaccctctcggtgcttcggatgcacattttctcgtggtaatggccatttgagagcggactcagctcagtttcgatttcagctcggccctctgctgtcattcctctgattcattatgttagcaaattcccttttgtttcaaaacccccgtctctttcgtctttgggtgtctcccgtgccaaaagcgtcccattggatgccggattctgaactgagttggcattgtcccgagttagccgagtgtacaaaagctttgcacggaaagggcgccccgaaaaagcgattttcctaatcaaatgctattgcattgcaaaagctgttgctattcgtccgctttgcccactgtgcattttcgtcgacatttttcgctttcgaattgcccttccaccaccaattctctcgtcgggtcaattcgaaaatgttcggagcgtatccaaatgagttcggcatactccgggcattctacttaagggaggggaaaggggacaaacattcagtgccgcagtcagcccgaacaattcgataccatcgtcgcaaacgctctcaaaataatccaccggttcggtgccttttattttcctgaagtgcccttttccgacgctttttcggtgttcgcggctcaattggcaaatgcccgtttcgtaaaaataagtcacctgtgaagagccaaccaacaacattctgcagcaactgtttccctttttaaatgaccaaccgatcgacagtctgtcctcagacggcgcttttcctccaaacaaatggccaaacaatcggacaatttgaaaacggaacggaccttcaactgatagttggactgatcaccatcagattcaacattacttccttaatattccaggccaaaatatgctgtggaattctctcaaataaatgtggagaagggcacggcggaaaatggtcatcgccgtcttgaaaattgggaagaattggagaaggaaggggaaaagtgagggagcaactgactgctgctgatcggcggaaggcatatccgctggaagtgcgctcggctgtccctttcccttggcttttgccctccctcctccaaattcgttgtgccattgcctttcccgtggctttcgccttcccttttggcaccttttcttccgtcgtcccttttcccc

SEQ ID NO: 8677 - DNA, 1490 bp, Heterodera glycines
  misc_feature (57)..(57): n is a, c, g, or t
  misc_feature (199)..(199): n is a, c, g, or t
taacaaaattccgtcctcccttttctgcttccaattcgatgccatttgcttcgttgncgccccctccgttcgcaaatacgcccttttggcacattctccgcttgggtgacgcaagacaaattcatcagaaaaggacaacgaattgcccaaaagcggatctgaacaattaaatggtcacagggcaaactaaaagtctgcncaatggcaaatcaaatgccaaccatcggcggatcagacagagcgattgccatttttaaacccggcttttatgtgtgtcaatggaataaatttcgaaaataataatccctttgctgactcaccaggaaaaattctgggattatttgttatcgtcgcattgtgcagggaaaagaaaataaataaaaagaaaatcttatccatcagcagaatagcgcctaataataatcccattctctgcagtgtttttggtgcattttgtcaccacagcgatcgctttttcccaaaattcattgacctctttttgagattcattcccccaattttgtgcatgagttgcaatattcaaaaggaaaagcaacccatctcactctctctggtgagttaccggtttctgtctttgtcaattaccggcaattccgctttgagattcgctttccgttcaaaaaattcacataaattcaaaaggagcgtcttttacgggttcatctctaattaaataaacaaaatgacaaataacaacatggcttaggctgcttctttcttttgctctttctctccgtcctttttctcttctttctctcgttcgcggttccacgagtcaagtccttaaatcagagcccaattacaacaattcccttcctccccctctcctcccgcgttcgttacctttcggcagcgtcgtgtcctcatccattgatcctgtgcctgccacgaactcctcataagtgtgcttctcggcaaaaggcctcggacccaacaatctgtgaaagtgaaggattaaagggaaggaaacgtgtggctaactcgatcatgtcctcccttgccaagatttccttctccaacagtcgaagagcaacctaaaaataagaaaaatgaaaggaaatgaatcatacatgcacaaggggtgtctcagcccaagggccatacaacggacgattgggacaggggggtgtctcgggcccgatttttcatacgaaggtcaaatttttctccgtttttgtaaatgcttatggtctctcctaactatttctgactgtttcacgaacccgttcgatctgttccaccttcgacatcaaaagttcgcgcgttcgccgcagtgccgcgctgaccatgtcgcgcacctcctggtcaatcagctgagcggtagcctccgaatagggcttatcgaatgccatttcgccaggctccggagtgtcgaaggacaccggaccgactttctcgctcattccgaatttgaccacctgaaaccaacgtaagacaaaaacaacaatgattttaattattggtgaaat

SEQ ID NO: 8678 - DNA, 4087 bp, Heterodera glycines
ttatttatttttatttaaatttcatttttcccggcggaccctttccccgctcaatgctcagttcgtcgtgttccaaaatgcgtgcgaaatcggactggcgccaaaatgcccgctgtgccatcgttcgtgcgatttgctccgcctcgtcgctccgatggacacgaaagttcaaatcgccaaaccaaaagacattggcactttcgctgcctgttaaagtgccgctttaatggacaatgaacaattgcgaaatctctgctcttttttctcaccgtttttccctgtccgacaattaaagttgaaagaacggaccattttatgatagtcgaaaatgcgactttcgactttgccatcttaggcacaaaaaagaattggggaaactaaaaatgatggctaaaatacgtgtcaaatggcacgcaatgaacacacaacggcactgaagcagacgaaagcaaatgccaatggcacctttggtacgaaaggggcgggcgatgttggagccggcaacaaaacgatactcggggtcttgagaaaaagccaatttaaatttgatacaatgaggcaaaatgaataaataatggacgagaagtgaacagggcgaggcgatgacggatgaaaatgacgagcatttgcgaccatttgcggacccaacagaactaaaagggcatttgtccatttgccaactccgccgaatgtttggaaacggaccacgcgatgagtggcgtcgagagaatggccaatttgttggacaaccgaatcgtggaactttctgagatggcaattcgaacatttcactggcacaaattaatcaaacaacagcgtggacgggggcacttcctgcagagccaacgcgatcagagaaggcctttccccggggcacatgttggagaagagggagttcagctggggcaaacagcggctggccttggggggggggcaattagcggaggacaaataacggacggaacggacttcaaagaaaaaccgaaaaattgaaattaaatattaccttcccagcgatattccaagtgaagcacatcacctaaaaaaggcttcattccatgaactcatttcattttccattttaaaaaggacggggatggcagaataagaccaaaaaaacaaagaaaccccgctgttggtgcaattaccgaaatagcgtcttctccgctgtccaacagattcctaagttccgactttctcggcaaggaaacgccccccggaccaaagactttggcactgtccaattggcaagggcatcaatttgcaaattgacaacaaagtggtcaaacccgaactggcgaagttcaagttgaaagtcctcctcgctgaactgactgtggaactcctccgccctttggttgtgttgcgtaagccgtgaagcggacgaccgtggcctcgagttggaagttggactaaacgacggatgggcaaagtccgtctccccccgctgctcttccattccgtccattcttttcttttcgtcgatgtcttctctcaatcgaccatatttgaacatacacacgaataaatttgaacagtcgaaaaattgaactacagacgaccgaccaaaatacagtagtttacagtactattattatccgaagaagggacggacagaaacaaagcgataaggacaatttgaacggaagtcatttttaaataccttttgaaaatgcaattccttctttagacattaaaaattactcatttcactttttgtttttgtcgtcatgccaacctcatcccttcccttccctctcctgcaaaattggatagtgaaaattgaaaaaaaacggggaaataaaacgccaattcatttgaatgttaaacagaatcactttatttaatcagttaatcaagggagggttaaacttcggcaaattacatacataattttgatgcaagctaaaagtagacttaatatcaaggaatataaaatttatgcttatttaaaatcaaaaatcttgtgatgactcagcagccatattttgcaacttatatacaggacctagagcaggttaatcttctttttactgttttgcccaattaacacctcacaaatgcatttttaataattttaaatacccacaaatttgaggaccctttcgatgtgattgattttgtggagcgtttggcgtggcgaatgagcaccggcaaagactgtgtggacgcggcctacctgaagaacaaatttgaagaggaaattggaagtttacaactgctctctgaccaattccaagtttggttttccgatttggcgaactcccgttagaatggccaatgaattggccattcattcagagcaaattgaacacactcgagcagcagcaaaacaaagacaaaaccgactatttggactctctgcagcgattgcatgacaaaaatggcgactctcttgaccaattgaaagtttgtatcgcttatttttgttcatttcggttcctctaataattctcaaatttgacaattttcagcaactcgacctcacaatgcaaacggtggccgcaagggtcgtccatttgggtgaccaactcgaaagtgttcgagccttttcctcccgtcttttttccacttaattttttaggtccatgagccgcgtgctcgcgcgtttgaagccttgcaactgatgcggcactttgatgaattcttggcggatcagccactgaattcggcgcttttcacagacccggacagagtcattaaaagaaacaaaacaaaaataacaatttaaaaaaaattggttacaattatgctaatttaaatgaaaccatttgtttaagctgctcgagtcggcggaagtaatcgcaaaattggcctcaatcgcacaggaattggacaagaccaaatttgctgcagttcaattacgaatcgcgcacaaatacgatgaaattgagcaacttttgattgaggaatttgtccgatcgcatgacagaaaaagaatgcgcgaaattgcgatgattctttcggaattcaaaggttttccgacgaaaattacacaaacattttgaaattgtcatccaaattgtgaaggattttcgcgttgtgtggacgcattcgttgaacggatacaatcggttggcccacgttcccccaatgtcttcgaggacatccaaaatttgtgtgaccgcgctaaacccatcattatggagattttcttgagttcgcaatttgttgtctccaaattgctgttgaatgttttccatgggaaattgcaggtgaaaaaacggaaaaggaaggggaaaaggaaaaacgaataggaaatttattaaattaaattaaaaaatgaatttaatgacgaccgaatcgggctctttttaggaagcagttgtggcgacattggaggagaacaaaggcaacccggagcagtacctggccaatttacatgagctttacctaaagtatcattgtcgttttggaaaaagtcgatttccctttttgaatttaggacacacaaattgctgggccttctgcaggagaaattccgcacgaattcgttggacccccaatttttgccgacgctcactcagtcggtgttcggcccctatttggtcacatatgcaaaaattgagcacaaattcatcgccgacaaatgcacttttacgctccgaaagttctacgagtccaaagggcaccaaaaacggagtattctctcgagcgggtgggcatgcaaagcacaccccaaacacacggacatcatttcgaattcagacttcaagaactcaagtcgcgtctgctgacagcggaggattttggtggcgaaacttttctttccgaaatcatagcgataaacattctgcaggagtttaagaatgccttcgcccgctgttcatcggtacaatttattttattccaacttttatcccccccccctcccggtaaagagcagataaacatgtagaaatggaaattctaacaaaaaataagtcaattttgggacaacaatgggaatttcgcaacgggataatctcggaatggtggtgtagtccctcaaacagtttctattttcacttaatttttagctttgcaaaaaaacggagtctcttgaactgaacacagtgctttttgacatgcttctcaaatttctgta

SEQ ID NO: 8679 - DNA, 1655 bp, Heterodera glycines
  misc_feature (84)..(84): n is a, c, g, or t
gatgacacaattcaccccggaataaggtgggtttgtgctccatttcgtgctctcattaaattcattcggtgttatttcgtaatntaaacctcgcccaagcaaaaatatttcttttatttttcagtttgactcattcctggtacctttctgattctgaccatcaaaattcgttactttttccgctgtatttgacaattttctaatagggacacacaaatagaggacgcattgctccgaaaaagggaccaaactctgcgcaatgttgaggaacggataaacatcggtgtcagacgacagctgaacgcggtgatcgcctttgtgcggcacgttctgagcacgtctcaacgcaaaacggactttaagccggaggaggacagctgcgagataagcgccgcatgttctggcgtaaactttttttagcaaaatgggggatgaaaatatttaaaatgtcgtaaaaaggtggtatatatcggaatcagatttgtcaaaattttgaaattttacaaaattatttaaataagtgctatatttgtaaaatgtgagcaaatatcccccatttttctgtctttgcattgtaacaaactcttctattttaagacatgctcaacagtggtaaagtatttgaatagagtggtgcaaaatgccgacaaatgcggcatcaaagactgcgtggacggggggaatttgcgcgttatcctcgcggagctcggcgacaatttctacgccaccattttggcccatgcgctgtccttcgcttacaatttggccggtgcgatgcttttgctgtgcgacgtcagcacgtacaagtcggtggggcgggcataaaaccaggctattattatttcccattagaaagtgcattagcgcctggggaattgccgagttggagaaaaagttcgacagtttgcacgcgttggccaaccttttggtggtggtccccgataatttgccggaggcgtgcaattcccaacttgtggtgagcagtgaaaagccttggggattttcaacgaaaattcaattaaaccgatcggtctttaagaaaaacgtggaccgtccgttgatgaacgaatttattcagcgacgccacgactacaaatcggctaaactctttctgaacacttactgaaaagtcaatttactaacaattacggtggaagtgcaattttcttgtctttttgatgctgtgatacattttcaattataatttatcttcggaggaagaaagaaccaatttaaaaaatatattttttatttttttgtatttatttttttttataattatattgatttaataaagtttggttttttctattttattttgtaattctgctatacattatcagatggatgccatttattgtaacaagaaataaatttttcagaaaaccgttcagtgatatgacattttatggttcttcggcgctgccaaatggaacgaagggcccaaatgccgacgactttttgtacgccaatggcacagattcaatcgccgcatcgaccgccgaattgtcaaaggacgaaatgtttgtggaggatttgttgcacgcgcacgaggccaagtaaacgctcgaagctggcgaaaaacgggagagtaaaaaatgggcggaaattattaggaatttattttcattgtctgaaatttctccccaaaaaat

SEQ ID NO: 8680 - DNA, 693 bp, Heterodera glycines
  misc_feature (599)..(599): n is a, c, g, or t
  misc_feature (603)..(603): n is a, c, g, or t
  misc_feature (677)..(677): n is a, c, g, or t
  misc_feature (686)..(687): n is a, c, g, or t
cagctcaacaaccccataaccggggtggggggggggatttgccgcaattaaagataaatttaggaaaatttgccccccccccccgataggtgcagttcatcctcgaattattttcaatttatttgaatagctcaaagaacagcagcggttgcgcgtggcgttcaacggcttcatggagcagcagccgagcttcgtccccacctacaaattcgacccgggcacacacaattgggacacgaggtgtttttaggtggctaataaaatacgttttacatacaatcaccccctccccacctttcccctaatcgtttggttttttaaaccattttttgtttttgagtgaaaagaagcgtgtgccggcgtggtgcgaccgcattttgtattgggtcaaggacaaaaatgtcggcattgaacaagtgacctacgaatcggcacaccaaggcaagtgcggatttgggaacaaaatgttggcggaacattcataaattcggtgaaattaaacccatttagttgtgctcagtgaccacaaaccggtgctgagcacattcagagtccaagtgaagaaggtggacaggccgagaaggagctcaaagtatgancagncaaagaattattcaaattggcactttagaaggaatgaattacttttttacagttgtagagggaagtggacaccnatgcaggcnnatgcaa

SEQ ID NO: 8681 - DNA, 2144 bp, Heterodera glycines
tggtaacatctggacacacctcattggtgctcgaacttacacgctttttattaaatttaaattgttggtttaaggcctttttgccttttttgttttggagctttggtttctcactcggcctgacactcatatccaatttcaagcatgttttttttgaatggaaatattttctttttcaattttaggagaagctggttttctcttttttctttatcggtgccattctttgtctgggcctgtcattcacctttcatactgtttcatgccattcaaaaccggttgtgcgtatttttagtcggttcgtttttaatgtcatttatacatatatgtaaacgttatacacataaaaaataaacaaaattccttcatttagactcgattatttgggtatttcgttgctaattgttggatcgttcattccttggatttattatgggttttattgtcggcgtgaaccaaaagtcacttatattgctgtatgttttcaaaaaaaaaattttttttgtgaatactgatttttttttactttcaattagatgatcggagttctgggccttggagcagtggttgtttccttatgggacaaattcaatgacaaacgttacagaccttttcgcgcaaccatcttcagtctgatgggattaagcggtaaatgcttacattaacaaaaattcaggaaaaaaatatggaattttgtgtctttttaaggcatcattccgacgattcattttgtgtatacggacgggttccgtcagttggttgctgagacttccttttactggctggtcgcaatggccgtcctctacttgttcggtgctcttctctatgcgactcgaacaccggaacgtttttttcgtatgcggaacaaaaaattttaattttacatataaaataatttcagcgggaaaatgtgatctgctatttcagtctcatcaattgtttgtccatttaactaatttttgtggaattaatttgttaccatttttttttttgaaggtttcatctttgcgttgtttgtgcggcattcactcattattatggcatcagtgaggtaagcaatcccggaaaaacgggagaagtacccgagtcaattttcaagtcccaatcccggacatttcaaaatttctggctctaattaacttcttttttagatggcgatgaatcgactcactggcacttgtcacattagcaccccgtcatcttcacatattcacactgaactttaggcgggcagcaagcaaattttgttgaacaatgtgtgataatagaaagactattgtatttggatgaatatgtgttgcctttgcctgctgtaatctgtgctgctttcttttgctgcttatatataatattatattgtcatgtcattgtagcagtataggaaaccgaataaattagccccgaatttcttcggacaacgttaagaatagacctgtcaaaaccatgtttttttcctatttatgcttgccgccggtcgtgcatttttgtgttccaaattgcatcaagttgttgttctaactctccaaaatacccccccccccccccaaatcattgcaaatttctgggaaattttgccgttggtagcccacattttttgaaagaaattttctgtaacacatggaggacgggacaaaatctcgccgcaaaattttcaaaaaatttttttgattcatctgttgcgcaaatttttgaaaaggttttcacattttctttgaaaattttttttttaaatttctgtggcgaggttttgtctcggcgaagcgagattccgggcggcgaaattttgggggtgtaaccaacacatgcgaagaaaacaaattaatgggacacttacaatttatgtttctatagtaattgacaatgcacatcaacaattgatcgccccccgctctaattgaggttcttttctacatccttgtgcgcttacagcttcttttggaggacattcagtttgccttcagcacataaaaaatggataaatcatcaaaatttaaataaacagaattctcagacataggtaatcatttctttttttccaattgtttgaaattatattccaatcttccaaaagacaagttggtatagaattttgttctatttctgatcggactactcaaattttccaaattaaatttcccaacact

SEQ ID NO: 8682 - DNA, 1296 bp, Heterodera glycines
tgttagaaggatatgattttaggtagctacctattttttattaaacaaattacttctgtaaaaataaatacaggtacactctagatgttgtcattttggatactcgacgaaaatttatgtggttgcagttgtgagaacaatatgaacaaaagttgcgccataatgtgaaaaagtcattaagaagaaaggtaagtagaattgtgaataattttgtgagatttatttacaacaccccccccccccctctcggactctgtataacatggaaaaacaaatttatacgatcacgtatatttcatagcactaaatttgacaatgttttgtcagcaaaattaatcatcttccgctataattgtcattccttttctacatctttgtgctcacagcttcttttgaagaacgttcaatttgccttcagcacctaaaaaggacacatggtcaaaattgaaataaaaaaaattctcatatcaacaggatatatttttttgataccaataaacagtgttttttgtccctttgtaataatgtttgaatgtccctccagacttaatggtatacatgctatgaatgtgtttgtctgcccggtagagacgggattttaaacaaaattctggatcggatttgagaactgcctcatgaccggatttcgggattccgatccgagtgcattttttaaatatgcccgtgctccggatcgggatacagagaaactcggactgaataccttgtctcattcagtctctctagtggcccattattgtttgttttgttttttgtcaaaataaacatacgtaagcgacggcgctcctccagcttctcattgagctcgtcgttgaagtgcgtctgcttgaacggacgcacattgtcaaggttcagcatcacataagtcggataacccaaaatggacacacagcaaaagaagaacatgccgaaccgtttctaaaattgcaaggcattttgtactggtaaagctcaacaaatggaaaacggaggaatgactattatgaacattggagtccaaaatgggaggggagtagtgtaagtcaggattttctcggactccttatccgggtatgcttgatttttagtcctgaaatcctgtccgtgtgaaattctcgaatctgccccaaaatttttcatttttcctgacttcaattaacctatgtaatggtaatcctttccatatttaattaaaaatgggcccggtgcggtgagacataacaatggcacagcagcgtccataggtttttccgtttttgaaaatagcgccagcataacaaacatacaggaacactc

SEQ ID NO: 8683 - DNA, 1889 bp, Heterodera glycines
gaatttgggttcggggttagatatagatcgaaggcggtcgtccgattcttgattagtggtgcggaaagcctatggaaacaactttttcacgaattcaaaaaaaaatttttttttatggctagtaaagtgcataagtaccgaaaaaagcaaattatacactgaaatgccaggtggtaggaaatttaacaaaaaaagttctcaagaaaattccaaagtggaataaatttttatgggaattcattcattcgcctaccaccggtgagaaaaaataaacaaaacaaagcaaagcatcaaaaaaacgagatctgtggttctgatttttcgtcataccttgtgcatattcaactcaaaaggtccttggaaacaattctgctgacaatcaaatcggataaattgtcgctgttaagctgcggatgaatgtccagctggtaaatctaaaaatccattttttacaaaaaatttgttaatttttttttgaaaaaagcaaaaacgatattcgggattctctcatccgtttttttgcgagttaaaggtctgctaaaccaattagtcagaaattcgcaatgcgtcagaccattacccatccagtgataaattagcatcggcagttcaccgaaataatacgccacagtttgattaattacctgtctgattagtgcctcgtcagcgttttccctcaatttttctaatgtcaccggtgtgcctttgatatgtttggcggcttcacgcattttcttccctttggcatcatcaaatattgcaaccaacagagcacgggttgtgccagcaatgccaaaagtggccaacgactcgcgaatattacgattgggcgaaagacagtaaatcagttcagcagacagtgaacctaaaaaatgaaaaaaaatcactcgaaagtgtcattttcgggatcggcatccccgaaaacaccctagaaatgtgtttttacgacttttataaactataaaaatttatttaaaaaaggtgtgtagcaccatctaaactattaccctcgagacatttttttatagcaattttggacgaattcacgtacgagttgaaagttggttgtgagcggcttgaaaaagtgcacgattcgctgctacaaggagtataaaaggctcaagtacctgtaaataatataaattaacagtccaatttgaaagtatgatgaattacgagttctgcgcgaatcaatgcaatatccataacttttacaagatccgctaagtctgatgcattttccacgttcaaaaactgaatgtattgtagaaggatacctaattggtaaataaaaccgatggacttaccaaacaaagacgcaagtattttctttgcgaattatcgtatgggtcaggcctcaattcaaataattttgagatcgcagtgttcatctgcagggatgggatttttagtttttcatttttttttctgttgcttcgtttcactgagaagtgcacaaaaaacacatttttagtcgggaaattctcattttaatgcaacaattcgttcacatttttattttaaaaattgatttttaatatctttaaaaaaacgattttttaggggtacattttcaaaaaaaatttttaatttttaaaagtcccgatttttgttcgcaaacatgaaaaagaaagtgtttttcctactaattaggctatggagaatgcaggaaaaaaacatctacataaaaaaagaagccctgattattagcatagcagggacttttcagttacatttaaaaattgagttttaaacgatttaaaatttgagtcatttaaaaattgagttttaaacgattaaaaaaattgagtctaagcctattcttttgcaccgtcaaaaattggcatattttacatggtgtatatctttgcaacagatcacaacatgac

SEQ ID NO: 8684 - DNA, 1375 bp, Heterodera glycines
gcatttttttttgtatcattcttccttccatttaaaaataaaacccttaatttttggaaagatagtcattttaatacttataattagttttttggtatttcattaaaaaattttcattggggtggtcattttgaacactcaagctttaaaacaaatgtacaatttgataaataggtgcatgaaaaaatgaatccccaaaataccatatccccgtacaaactgtacacataatatggtgcagaattctcaccaaggaatccccgcctctgatgtgatgcacagttttttacaattgttccaatcaaccattttcagtgcgacgtcaagaaggcggtgccacaaaacaaacgcaatggtggtgctggtgccgcgtcgttcattcgtggcggcaacctgatcatgcgcaacgcgtacattggtggtggtgcggctgcgcaccatgccagcattggcatgggcggtggcggcggttcaatgcgaggttcttctcatcatcacccgcagcaggtgggggacgctttttatttgttttttcattttttgtgttaaaaaaaactcattcattcgctaattcatggaatggttattaatatcctatttgtgtacggaaaactttgattccatgatccgatttggtaagggaatcgtgtttccaaacactgtcatctttttttcaagggggagaaggttgggtcaaattgaatggtttgaggaaccttggcaaattcggtgttcttttggactcagttttagtttttttgttgttgttgacaatgtgttttacagggctgcacgcaattacggattttacggaaaaaaatacggtgcttttttgggagttaaaattttactctattatcccccgcataattaaaaggtatatataattaataaagtttttttcattccagcaaatgcccatgtattcaaatgcgtctgccgcggcatacgcccaatggtactacaacgcggcggccgctgctgcatacggggccggaggatatctgtcataagacatattagtctaatttatgatttcgacccatcaacgattgatttttcttttcatcaagtgcttcattttcacccgcgtattgatgagaataaaaaagttatttgtgagaggaaaccagaataaattcgttccgttcctcgcccctaaatatggcgctaattcaccaaatgcaccccagggttttggctttttctaattttaatacatcaaatcttaaattattctgacatatagtacgcaacaacaaaacaaaaaaaaactaatttaggagagataaattggatgtccgaaaatttttgagtggtttttttcataagaatttaacaaaaaaaaatttttacatttttagcacacaccgat

SEQ ID NO: 8685 - DNA, 3285 bp, Heterodera glycines
  misc_feature (3265)..(3265): n is a, c, g, or t
tgtcacttccttttgccattgacttttcttttttgccccttttttggcacttttttggctaattttcccattcgattccaatgaattttctgttgcttccattctttctatcccatagtccaaatgatttggctctttatttgcttgcttttgttgatgctctctctgctgatcaaatggcggttcatctttgatcacagagtgtgccaatttaggtggcatgcgaatgccaaccacacccatttttccaatgtccaattgctcaaactcctcctcttttggctcatgctttacatttttcaatagctgatcaaaaactgctgctgctgcggttggttcagttttgatcaacatttgtgccaatttgggtggcatgcgaatgccaaccgcacccatttctacaccaccgtccctttcttccatctttacgcgattggtcactttttgtcctccgtttcggccaacatttgccttctgaacgttttttgcgttgaaacaattcttccacaaatcactgaacaaatcgttttcttcaccaccttctccaaccccaaaaatcccattaaaagtggcgaaaaatatgagaataataattagtaccattatcagttttatagatgataacttttttctttctaaattaataaattatttaaaatattaattatcatgtaactaaactaattcggtctcgagatttgggactttattttcgagaatcgtgacaaaaagtattcgtttttttgaaaatctttacataaataaaaaccttggctgactttggcactaagacaaaacaaaattaaagccaatgggaattttttttgatattattatgtaatgcttccaaacaggaaaaaagactaattgatggttacatttcgtcattaattataagaaattgaatttttacgcctaatttaaatagtcattttccgttaattaatgggcatgcctttcatatgaattaaagctaattactgcattttcttcttctatttttatgctttacatcgtaattaattgatggactggttccgttgtgtgattatatttacgttttgttgaagaaaaaattataaaaaatgatttaataggcgaataaaatttcgttgaattacttaagcatattcattttttgttaattaatgtgtttttcatgtgaattacatttgatgattacacgcactaattaacaaagtatggtgagtaagcactaattaaaacaaaatcattatccaaatttcctgacagcaattttaagcaaattcttttttcagccaaaaaatacagaaattaaaaataataattattattataaattttacttttcagaaacttggacaaaactttatttttttatcaaataaactttgtttttgccaaattaactctgaatgcttaaattaaataaattgatatgatgcactcttgatagctctattattttagaaaattctaaatattagtttgggtaacaaaaaagttatttccataaatctcaaaaaatgattttttaattgcagttttggcgccgcttaacttttttaaaaaaggttgaaacattttaattttggctaataaatatggaacatattggctttcataatatatctttgcttaattgatacaactttaaaatactcaaaatctgttaataaaacgcacataaaccaaaatttccaaggcgactcctgtggcacggcctgccctaatggtgctgggacgttagtcaaaagccatcaaatggaaaatttttgacagaaaattattcataacttcgtccaaagtgaatcaaattttaaaatcttgttagctttcgatagctataaatgttttctattagcctgcaaagtcttaaaaaaattcattaagttccaaaaaagttatgaccttagaaactcaaaaaaaaagtttttctgaacattttgatcataactttcttggacctgaactaaatttttttaaattttgcctgataatagaaaacaattatggctatcgaatgaaatcaatttttaaatttggttttatcaaaaaaattttcatttgatggcttaatattaattaaaaattttatttacctatttttatgtctattcgacggtttttgtgcctatttaatgcattttgcgattttttctgcctttttaggtgtctatttctcgcttttttgtgtcaaaaaacgaacctttaacaatcaccataatttgagaggaattttccaaaattatctaaatacttcttttgattaccttccttttttacctattttgcagtgaaaaaattgtgtctctgactcatcaaaagggttataaattatatggactaaaaaacgtcaaatatggacataaaatatggactaaaaaggtcaaaatggtcaaatatggaccaaaatattgactaaaaactgccaaaaaaaataacgaaaaaggtgtttatattccatatttgcttcaacagacttaaaaatacaataaactaccaaatccagcttcacaattccaaaccaaatacatctcaaagtttctaatagtctcattctgttgtcagcaaaaattttcggaagcgaaccaaataccctaaaaaattggcaaaatttcgaaaaaattctcattttaggggagtgtatttttgaaaaattaacaaaaattcgatctttagggggtgtatttttcgcctttttccatttttcttgtgaaattttgtcaaaaatggccaaaatatggactaaaaatgcaaaaatggcgaaatatggatttattcccgaaaacccgcaaaatatggatttatatggactaaaaaccttcaccaaaccaaaaaattttaacgtagaaatgctatttttagcccctttcttcatagcatatgcgcggaaaaaatatgttaatccatataatttataactagggcaaggaattatatacacatgaatattttttcctgaactgagggagccatgaaacgtacgaaaaaaacatatttttagctcggtttgaagcttctaggatattccatatgcatattttgcatatttgtgcatattttgcgatttatgtgcatttgtgcatattttgcaatttttggtgcatatttgatgcgcatatttgagcatttttcaacaaatcctattaaaacggctccctctattaaagctgccatttgggcctctaatgaccgaaaaattttcaaaaatatcttttatggggtatttcataataaaaaatgtaacttttttttaaaagagggaatttattccaaaaantagtcagaaaaaagaaaatt

SEQ ID NO: 8686 - DNA, 4062 bp, Heterodera glycines
ttgggtatttcataataaaaaaatgtaacttttttttaaaaattggaaatttattccaaaaatagtcagaaaaaagaaaacttttcattttttttactcaatttcttcaaaataaatatattttacttttattttgtatttttggttctaaaatgactattcatactatatttagctattttcgagattttatgcttaaattcaacaaatttgaagaaatttataaaattttgccctcaatttggaaaatgtgcatattttgcgattttatgtgcatataattccttggccctatttataaccctattcatcaatattaatgattatatttcgtttgcaaattaatgtcaatgtgtgagaaagagaaagagaaaaagagagacacagtggtacggaaaggaagagaaaagagaatgggagacagaaggaatgaagggaaagtgagagagcaatggagaaaaatattaggcggacaaagcaagacaaaaagagggagaacagagataaagagagcgagagaggtaaaagacgaaaagaaagggaagaagtgagcgagagagaaatagagagggagagagagtaaaatggtaactgcgataacaaaacaacaccgcagctcaactgttgatcactttgatcaaaaattaaacattcctcatcctaaccactgttactcataagaaaatgaattaatattttttgcacaaaaaacaataaaaattgagaaaaataattttattaatttctccccatttttatttgtaaaaagaagatggcacaactgttcgaaaacattggcgttcgacgcaaagctgatgacaaattggtgaacgggcaagaggcgctaaaggtcatatttggaatgtatcggggaacccggattgggactaggccggattttccagcatcccgattttttgggtccactgaacaccattaattacctaaatgccatagctcctggaataaacaaatggaaaagccataactttaagcatttttaacaaactaaatcattgtctattagtcggaaaaaattcaaaaaattgcgctaaattgtggaaaaacgtttgaaaaataaattttttgagttttttagtcgtatttttaaaaaattagcggaaatttcgtaaactaatagaaaaacacttatgattatcgaaagataacaagaaataaaaattttttgctttgtaacgaaatggttttgttaaaaattttcatatttgtgttttttaataacgaacatttcctgtggtttttaagactcaacccccactgacccatttttaaatgtcccaattttccatcaaaatgcccattagcttaataatgcaatcgccggtatttagggttgcgaagtggtggcactttatttcagtgcccattggtgtccgccgtgccgcaatttcacgccggtgctcaagaaattttatgacgaggtgtgtccgaggggatgccatggccaaaaccaaagttcatagcacaggttcaaaagcacggcagatttttaagcaaattttcaatgcaaaaatttaaaaaaaacacagatttatcacaacttttcggcaattctatagagtatgagtcgaaaaattaaaattttttattgtcaaatcaaaggaaaaggagatttttgatttgcaaagattttaaaagggtcccccataggtcttgcaacaaaaaacttatttttttacccctattctgatttttgtgtcgtcccaaatctaagaggagcaatagaaaatttaaataccccaaaaactcggcatggacacttagaacttggaaaatgccaaaattttccggcatgcagttaagcataagacattgcctgactttaccgcaatttttaataaataggcttaattaggcgctgcttacttttaaactctttgaggcatacaatatatttaattaattaatttctgtccattcgattttagggataaataacaagtataaaaaactattcaaactcgggaacgacaaaacaaactgaaaagtgactaagaaaaacacattttttcccggatataaattaatttttttccactttttgcaaaaaaaaaaaaatttagttgaaaaagtcgccggagacggcgcactttgaaattgtttttgtgtcctttgatcgttccgccgatgatctgagcaactatttgcgcgaatcgcatggtgattggctgtacattccgcttggaagtgagcacatcgagtaagtggaggagggcattcgtgtgtgcccttttcaaggaaaaattttgcaaaaatggccatcacaggaaagggaagaaattgggcctcacgaccaggatgaggatttttaaaggcggaaaattttagaattttagttgataattttaaaaaatatggtttttctatgaaaataattaagattaatgcaaatgatttgttttcctttgttgcaattgaaaaagagtgcaatttaatattctttgaaagaatgaaaatataaagcgatttttggcttttttcagcaactttaggatttttttttttgaaaatttaaaaccgatccttcgggttgaagagatgaataggagcgttaaaataaatacacaatttttttttcatcagctaagacttcaaccatagtcagaaaactcaggaaagacagtaacaattgaaaataggtaaaataaaaattgccatttctgatcaaatttttattaaattcatttatttaaaattggatggtgtaaaacaatttttaacgaattcacaaatctacagaacattgtccaaaaaatttggcatcagtggcattccggcattggttgtgctgaagcaggacggcactttggtcaccaaggatggtcgagcggatgtgcaggtggaggacaatttgttgttttttgatgatttttctaacaaaattggacaatgagacgcggaattgaaattttccaaatttgaagggttgggggcggtcgattcagtatcgtagcaatttacacttggctaacttccagaatcatcgaactcgcaaaattaattaaaaatttaaaaagttgtggtcaaaaatttaaaaaaaaaaaattttttttttgaacatttatttggtcgaggaatttttgtaaatcaaaagcaaagcacacagatgtgccgactttttccttcatattttgtttattttttcacttggaaaagtaaattcctggcccctgttgaagtcccggtcctgacttttctggtcctcgcaaattcctgcccttttttccttaaattcccggttccgtgacagctctaaattaaataaaattttctgttaaaatttctattagctaatagtgaaccattagagctatattatgctaatcagctgcataataaaaacaatttggaacacgcgatatgacttttgaacaattaaaatgctaattgcgcactaattacaaagactaatttaatccattgcatcttttctttttttctttagaacctatcaccatcaaatgcaatggccaaatggcgctccggctaagagaacacccctttcactggggagactgatggaagaaaatcaaaaattttgatatggatggacacattaatacattagtagtgatatatcgaaaactaatttttaaatatcaaatatataaaatttttttgtttttttatacgattctctggtcgttttcgaacatgaaatttactattttctaagtccattcgtgtaaactcagaaaacctcaaaaacaatttcctcaactcagtaccgaaattttctgagaatccctactgcaacgatttcactaatagaatattggaccgacaaaaaagtttttaacttggtttacagttctgatatgacttataatgtctatttttgcctaaaggcgagttcaaccgggcgtttgcgtcaccggagaagggcaagatctaaaagattggccagataaaagtcaaaacaattgcgaccgccgaggaaggaatgtccaagattgcattttttgtcgcattgttgatttagtcaaaaaaaatcatattttggtttcataactacattttatgatgtttaattgcatttta

SEQ ID NO: 8687 - DNA, 4745 bp, Heterodera glycines
tttagctaacttttcttggaacaaaatttcaaacaaaattttattatttttatttatttttttgagtaatatataagctttaaccccacgtccaaaaattcctacgcatttgggttacttttttccacctcatttctgcaaattatccacatatttcaagttcaaatgcggaactgcttcctgcttgttgtctgctgctgttgacaacttcagttgcaattagaggggggggggcttttcccccgggggatgcttttcctccacagccctcgccaaccccaaaattatggcttaaatcgcgtaattcttataaatcatagtaattaaggatcaatggccaatgtcactttgtcctcgcttttattgtaaaatcctttgcttggatccatcagttccttaaacattgtaataaattaaaatttaaaaaaataattatcttaatggaaattcattataattagtataattagcatttaatttgcaccttcttgttcacgcataaggtataagcccaaccatttctcattgtcagtgcttccatttttcttttcaatttatgccaatattttccatggaagcccatttatgtaagtgacagattcgcttttacgttcacttctgtcgatttctctcgcaaattccgacactttttcaatttccatcgaaattattccattggatttgtcgggatcagaaatgcatttctcctttttatcatctttcactgtgacatcaatggccaatgtcactttgtcctcttctctgttataaaaaccattgctttggtccatcaattccttaattaataataattatgccaattaaggaattatgtacaattgacactcaacaccacgtttaaacagctgtaagaattgactaaataataaaattgtcacttttccatattttaatttttaattttgtagtaaatataaatttttaagcgcagcttggattattaaagaatgaaatcatagcgtaattagtaatagtttttcaatttttaatttaataagcccaaacttcccggttcccaaatttctggtcccaaaaaattctgcttaaataaaaggaaaaaatgatcagtcaattaggaaaggtttcaatttaaaaaaaaagtttaaaaaatgtttacgtaaatcctaacaaaattaatgcaataaatccaagtccaaaaaattgtaaacattgacctaaaatggtaaaatttgaattgggtttatgactaaaatgtttatcattgaaattcggtactcaaaaatgagagtctgctaaaacagctccgacaattaattaattcatatatcagtagttttgaaagtataatcaagaaaaattaataaataaaaaaacaggttcatcataggatggaggatattcaatgggcatttttccccaaatcatattgggcatttatgtttcgtcctccgttttgcttctttcacagtgaaatcgatggccaatgtcactttgtcctcgctttggtcgtaaaagcctttgcttgggtccatcagttccttaattatgttaaaatttaattgagcactatttatttgaattgtcactcacagcaaatgaaatgtaattggcatatccccagctgtacgttttattgtcaaaaacatcgtcatcgagttttctcctgaaatcctttacgccgctctttagagagacaattcgaaagtttgccgaacatttgcaactccaattttctgctcaatatcaattaattaattgttgttaatatatatattaattattagtaattttacaccttcttttggagcatcacacaaaaggcaaatgcccaaccatttctcattgtcagtgctttcatctttcttttcaatttgtgccacaattttccatggcattcctttgatgtgcacagtttcgcttttacgttgactcccaattatttcacgcgcaaattccgacactttttcaatttccattgaaagtgtgccgttggatttgttgggatcggaaatgaatttctccatttttggctcatcaacagttatgacatcaatggccaatgccaatttgtcctctgctttgttgtaaaagcacttgttcgagtccatcaattccttgattaaccataattatatcaattaagtaaatatgttaaattattactcacagcaaaagtaattaaaaatccaaatccccggccgatgtttgatctgttgataacccggtcacacaatgtccaaattgaattctccgcttcggtcttttctgacacaattcgataggttgccgaaataacgcagttccatggtcctcctattttaataatgattatatttttaatatttattaaaattggaccttcttttgcatcgcacaataagtaaaatcccaaatatttcttctcatcagtgtcttcggtcttttttcttatttctgcttcaattttccatggaaatccatttatatacacggcatcactgaatctgcttctcccgacagactctcgcgcaaattccgacattttttcaatttccatcgaaagtgtccctcttcggttgcccttggctttgttccaattaaaaattcgtccatggcttgggaatttcgacgagtacagcccgggcactccacgaagatacagaaacggatgggaattgaactgataaacgccgagcacttcttccactgttaacacaccggatggaactgtaaaatttcaacataaattattctgtaggcatcagtttttttcggccaatttcacataaatttgaaaaaattctgacccccctccttgtccatgtatgaaattcaagcattaaaggtaaaatttcatatcaaccaaaacaaattcaatttaattttcgatttcaaaaattttaccgacgcattttgcaaaatcctcctcatggatattaggaaaacgaattttgaacagtgcaggaccaagtacggaacgacgatttcccgaggagcattcaatgccattctgacgacatttttcatcggcccaacggagtgcctaaatagaaaaaaatatcgaaattaaaaaatgaaaataaaaaattaaattgaaattacagatttccaaatttcaaattcattgctgagcaataaacgatcactctcgagaagattgcataacattttctgatcaatttgcaaaaattcatctgattcgaacaattggcccgcattttgacaaatgtaacgcaaacatttgatggaaaaatccttaaaaaagcattaaattatcaaaattatacaaaaaagggataataaaaataatagaattaaaaataaatttgtctttctcacctccagttcgaaaatgagagcctggtcatatgctaagaaaacattgcgcaattcggagatgggaatttgcaaagatggacgaataaggccagggatattgtactttttggctaatttacaaaataattaactaaataatttaaaaaataattcacctgcgttgagcacagccattgcattgtctccattcaattcgcttaaatcatccgtgtaaatgaagctcaacatcactttgaacgctgctggttcaacgtcggggacctcctccaccacagagcaattagcagagactaattaaaaataattagggaaattagcagactaattgaaaataattagggcaattagcagagactaagtgaaaataatcagggcaattagcagagactaattgaaaataattagggcaattagcagagtaaaaacaacagagatgaggctagtccaatatacatatatattaatttgcttatgtgttcataattcatccccttttgcttactctttcctgcattggtaccatttgagttttctttgtccgtttggaacatcgcctcaaaaacattcgaagaagcaatcagaatggctttgtgagcatgcacaagcttaaaatttaattttaccgtaattaattgtctaaaaatgtcattcgctaattagaccgtaattaattaattgtttattaatttcacttgcctcttttttgtcactttgcccaactaaaaaatgcgcatcgacacctttggccgtgctcagcaacaatttcattcgatccgccaaggtgtccggctttgccatccccattttgtgtccactgtctacagcgaaaaatttgaacaaattaatatgaaaaaaaaataaataataataatttgaaaattctaatataatctccaaatgtacaagcaaagaattttctaccgtatccgccatgtaaagacattttttgaatccgttccatttctgtaattcgcatttgttgcaattcctcggttggcgtcagactttcattttggtacggtgctaaaattaaatttgaaatccttagtcaacaattttactataataattactccaattttattgcttaattaccctgatcagaagtaaattcggcaattgttgaatttggtgaaaaagacatattggattcccgaggttccttttaggggctaataatcacaaaagtcaaatttatgaattcataaaagaataattattgtattattttgtaaaaaatgcaccagaagagttaaatgaagaaagatgggatggttcacttatatttatgatggacggcggcgagcacataaaataataattcacggcaaaacggtgacccaaaaaagaaacaaatttgaattggattttgcttatcccccaatattcccatttgatttttatttcagcaaaatgatgacccaaaatctgatgagagattttct

SEQ ID NO: 8688 - DNA, 1835 bp, Heterodera glycines
ttaaattgaaattacagcttcccaaatttcaaattcatcgctgatcaacaaacgatcacgatcgagaagattgcacaacattttctgatcaatttgcaaaaagtcctctgatccaaacaattgagccgcgttttggcaaatgtaacggaaacatttgatggaaaaatccttaaaaattgcttaaacttggatcatgaatccacactagttcgactaatttcgaactcaacgaacccaaattcgaacacgagccagcattattaaaaataaatttgtttttctcacctccaattcgaaaaggagagcttgggcatacgcaaagaaaacattgcgcaattcagggattggaatttgcaaagatctgccgaccaaatcagggatattgtactttttggctaattagggaatccaatgattaataaattaaataataaaaccaccggcgtaaagcactgccattgcattgtctccgttcaattcgcttaaatcattcgtatagatgaagctcaacatcagtttgaatgctgatggttcaatatcggggacctccacatcagcagggcaattagcaggggctaattgaaattaattagggaaattagcagaagagacaaaatgaagaacaacatacctaattggtattttcccataaaataaatttttttttaccattttccggtctttctttcttggcgtcaaaacggaacattgcctcaaaaacatcggaagcgctcttcaaaatgagctgatgtgctggcaaaacctttaaaaacgtggataattaatgaaattgcaattgaaaaataaaataaaatttttatttttaattaaactcgcctcttttgcgtctccgtcccccaccaaaaagtgcacatccgaatgctcacccgtgctcaacaaatgtttcatccgatccattgacgatggcattttatataaaaaaaaattgcactcggaaatttgatcaaaatttttgtcttcggtaattagctctgaaatgaggcgcatttataaaagggataaaaatataaatttaaaaaaacgaattttagttttaccataatttttgatacatattttttgaaagccttttcaaattttgaaaaatcgttggccaaaaatttgctgaaacttccatattgtttaaaaaggtatttgccaaatttatggatctatgccaatttttccctctatttttatgagttttttccccggtggtgccggtcaaaaaaatgaaaaacaaaacaatgatttttttaaaagttgcgaaattatcagcaatatttgttttatgaatatttgtttcgttttgtttttgtgtttgtgtaggagtggagacagcgagaagtcagacagttcacatcgaaagcattaaaaataatcgatacacaacaaaaaaatttagaccgcagggggagggttagaggaaaattcagcaggtaaataaaacagagtttccatgttttttttttcaaaataagacaaaatggctcaaaaactaaaattcggaccccaaaaataagatttttctaaaactaatagtagcgtgaaggaaacgcaataaaaatatgaaaaatcgacttaaaacaatattttattagcggaaaaaccagggctgccaactgaaaattttcaaaatcagcatttggcggacaaaaaatcagcattttgaaaaatttattcaaaatatgacaatttttggtcaatttttatgaaagaataagttttggaaggcccggcggtgccgatagacgccgccggaggaaaaatagaaatgttgaccatttttaacaaaattttcactgaaatttagagcattttacactcaagaaaac

SEQ ID NO: 8689 - DNA, 2155 bp, Heterodera glycines
  misc_feature (105)..(105): n is a, c, g, or t
ccgtaatcgtccaacgctttgccgaacatttcgccgtcgttggcccggtggagcaattcaaaggaatggaccaaggccggcttcaagtccaaaaactcgacattnaacaggcgacactcgccttaatatggagaactctaaaaataaggaacacacgaacaaaacacacgttggacacacgcgtaaagagtggcgtaagtttggcgcaatttgtcgccgagtaaatgcgaaagttccatcctttaatttgcaaacggaaaatgcaaagtgaaagaaagggcaattcacaatgccaaactgttcggctccaatgccaattgttccgtcacatttttctccacttctaacaaacgtcgtaaggccgagaaaaatgcgtcggaaggcgacccttaacagtaatttataattcagagtgatcagtggacgggatgagtcaccctgctgattgggtagtgccaatgccgtctcctcctcttcgtttagggaatatttggcgaaaaattcgtccaaaaatgcattcttggcacccaattcgcgcttttccgtctgcagaacggctgttctcttcagcaactcgcgcgtcttttccttgttcgtttgaatgcgttcagtgagttcgcagcaaatcgaattcatcgaccgaatttgctgtacaaatccctgcacgcggtcattcatctgaattaaatttccaaattgtattttcccacattcgccgttgctccaccaccttttcaagctgttccaagtactgttggttcagctccagctcccggtcctccaataccattctgagtttttgctccgtcgtttcggcatccaaacgcaaattgtcgttcaggtaatttattgtcgcaatgaattgctgaagagtaaaacactaactcaacaggagaaaacaaaatgcagggcaacttcgaaattcagtcgactttcccctcccctcctcccttttcctcaatttcccccacctcatcctcatccaaccgagcagtcaaaagtgcatctaatccacctctttcgccttctaatgtcatttaaaaacaaaacgacttaattaattgccaattaatgtccgcttaattattaaacgtaaagtaaatttgaaaaaattaaattccatttataaaacttattgttaaccaattcttctaaattagtttaattatcattttacgccaattatagacaaaataaaaggacaaactaagcatctttgttggggattctatgattaagggacaaaaggcacagaattcggggaaatgcacgcggaaagaattggagagcaaaaattgaagggaagagaaacgaaagtgaggcacagaaagacggaaaatagcgattaaattcgaagttaatttggcaattccatcccaaaggatgatacattttgcatcccatccattaaaatcattttgcccggtaatttgccaattttcaggggcaacgaataccctaagacggaatgaaaagtcacatcacaatccatttcccgccaaattcctccggtgcctctctctctctttggtaaaagtttgttcaaatcggtcttcgcgtgtttcgcagtttctcaagccgcgactgcaaatggttattcgtctctttgctctcctccaatgcttgttctttgtcccgtaactgaaaaggcgaattaatttttggacgagagcttttattggataagggaggtccggcgtggcgacagtcgctgccggcaaattttagaatttgaattaattttttaatgctttttggtcagaaaataatgagttaataaaaaaaaattgataataaagataagaatcttacattaaaatagatattttaaattcttaacggataaatcaaagcacacccaaaatttaaaaattgtcccggcggcgcctatcggcaccgccggcctccctattcccgaatttttttggaaaaatctcgctgaacaaaagtttgctccatgtccgtccgattccctttggttcacctccttcttcagctgtcggttcgtcttctgcgtctcttccgcctctttctccgcctgttccgcgtttgttttgtaccttttcagttgcgtctccgtccgcgacagcgacccctccagcgcactcttttccctctcggcctcctgcagtttcagcttcatctcggccaattg

SEQ ID NO: 8690 - DNA, 2397 bp, Heterodera glycines
actaattcgtcactgcttgtgcttcctgtggcgttgtgtttttcattttggcgtcttctgtggttgtacaatgccttctccgtttcgtcaatttggttgcgcaacttccgattggattcgaccagcctttgaaccttttggtctaccgacgaagtgccgggcagtgccttttcaatggccgacaaagtcacgtgggacaacaaaatggggtcgaatttgctgacagagaaaggcaaatgcaaaatatcggccgacgacttacggcgcattgtttgttgattggctaccggtggatccgttcgaattgctgggcaccgccggtggctgtagcaaatcgtcgttagggtcctgctcggcaatgacgaagccattctcctgaaaatagtgaccaatttcgagccgaatttccaactcgtaattttcccacgtgaatcagtcgatctctttgcgatatttcgcttttcatctgctggtgctgcagttggagtgcctcgacggtctttctgagcagtttcaactcctcgctgatctcgcgattctcttttgaaaccttaaaaactaaagggaatgaagcaaaagtttggtaaaacctgaaaaactgtcacgtccttctcctccatttcgtccttgagcaagtcaatctcgtagagaagtgccgatttttcgttgtccaattgtgtgtacagcaacatcgcccgttggtatttgttttccaattcggtcaccttttcctaagaatttataggctaaaataataattcgtaattcgaaacccatatttaaataattcatttgcttctcctcacccaccaaattgtcattgtcggccaacaaatggtagtctttttggtcacccgcttttattgacttctcaagacaatccatgcgaatttggcgcgcttcgtcgcgcgcctggcgctttttgttggagcgctcttcggcctaataaaacggaagttagaaataaaaaataagtcgaacttttcttgtcgatttgccattgctatagaaaatctgccgaaacattctttcttttggaaccaaccccatgggaatttgcaaaaccttcacatttttattgagcccattatgttgaaaatgtgcaaaaagggggaaaagtgataatttattgcctcgcgggatatcctgtcgagcacatgctcctccatgaaggaactggccggcgcacgacgccgagaggacgaatacgaactcatcgggaggggagggcaattattgcttaacaacacatttatcattttgaaaaatagtgttaggaaagtgtaaatgaaaaataaaagaaaaagtttataattaattaccggagaaaaaaaagtgtaatactaccgatggtaccccccccccttttttgatagaaaattttttttcttttaaaaagccttgaaagcatgcttctgagggtttttaaaaagtaattattagagcacggtaaaaaaaatgttgtagaggagtcaaagttttgcgggaagtgatcgggattcacgcaaaaattaataaaataaaaacaaaaaatttttttataaaaaatttaattttgacgaatttagtagaaggatctaggtacataaaaaactaattattagcatgcaaatgggtaaaacttaaacaatccgatgcttttcaaaaagatattttacatttcctctgtgtttgggacaaaagatatcccaaaagatttatgtatatgaaaaaaggaagggacgttaaacttaagcggaggagaagaaatttaagactctttaaaacgtgaaaagagagacattctcacaaagaaaaggggaaaagagagagtgattgaatgtagaggagagaacggaaaagaaagagagcgaaagggaattttaatgggccaaattatattttaaatgataggcaaaggctaactaagaagggatgagtttggtggggagaaaaagccacggcattcattccgtgcagcaattatttgccaatgcctccgtttattttattcgaaagaacttaagggaaaagggaaaggcaagcgaatccgtcgatttaaagacggatggatgagaagagaatcgaagaaaagcagcggagagaccgatgggcgggagaagcaacaggcgcccgcttattttgtccactttaatgagagggaagcgaaaaaagggggagggaaatccgaaagtgaaaagatggaggatgggcagtcaatggatggatgaattgtccaactcaacacaaaaagcgaaagtgaacatttggacgacagacagagagagacagacatttgaccaatcaaaggacttttgagtctttacacttaagtcattcactaattacctacttcattgtctttacatgcattttaatagaatttcgtttaaaaaacatctcatgcaaatcgatctt

SEQ ID NO: 8691 - DNA, 2237 bp, Heterodera glycines
  misc_feature (48)..(48): n is a, c, g, or t
  misc_feature (54)..(55): n is a, c, g, or t
  misc_feature (96)..(96): n is a, c, g, or t
  misc_feature (106)..(106): n is a, c, g, or t
ccccccccccccacccccctctcattgtgaactctttccccccccctntaattnntgttcattttccattgtttgttttcatcctgtggttgacanatccgcttcnagtatcttccgtttgaccttgatccgatttttctatacaacattaaacaaacggaaaattgtttataaaattatcattttttgtccctcaggcgcccctcaaaatgaccccccaatttcgccatcaaattcccttgcttttctttctgttattcacttttttcgcctctgcaaatggcacttcgaaatgcgtttgggtcgttcacaaattttattttttaaaaatgaattttgaaatttaaggtccgcggcgcactccaatgccatcgcgacccgagcaaacatcagaatgtggaagtacgggtcattgaccgggacggatggggcccgttgaaggtgttggaccctgacgacatgatggggtgtgccggggttaaatgttgtcaacgaccgattgattgtttattagtgttttcaaggggaagggtgccattaatcgatgcttaattatgccaatgctttttagcgtgtcttttactgagcaggacggcacctttcagctcgacggttgtggcaacgacatgaacttcctcccgggcgtggtcagtgagtgccgtgacactgtccctccgttcctttgcccatgcccatccttcgttctcccccccccctttttagcccaatttgcccgaccctttcgttcgcattttgcatttctgcaacagcgaagaaggcgaaaccatcgaattgcccgaattccgaatttttgtggtcattctcaaattgtttgtgctcaaattggcttttccgcttcagccggacacttatgacttgggcatcctcgtgttggaccagaagactttgcccaattccaccgttaatttccccgtgcccgagaacccccgtcgacgcctgcagcaggcaaaaagaccgacggaagtcggcactttggacgaaagcaatggcaaaaagggggcggaagatggggtgagaagtgaacggggcaagaaaggaaaacaaattcgaaatttggacattccgatgaattttttttttggataatgtgaaattttggaattgaaagtcggccaatgaaaagtttctgaaaattattaaaaatcgcggcaccaccttttttagtttgtgactgtcgacgcgccaaaaagtcacaacgccaaaggcctggacgaccttttgccgcccggcaaaacggtgaccaaaacgaacggcgatttgttgtgggagacgcaatcggtggagatggaggaagtgccggccgaatacgacacgtcgatacggcaaagtcagcagcacaattgggaggaaggtaagcaaaacgaagaagccaaagagaacgacagacacaaaatgcgaatgttggcattttgttgcttcacttttcagagtccaaaggcgatggaaatgaaaggaaaaattggacgaagaaaaagcaaccgacgaaggaagagaaaaagaggaaatgatcagacagactcactctgctgtgatggcatttcctataaatatcctaattacccctccccgcttttctatggaatgccctcaaccgaccgacactttgtgcataattttttcactttcactatgaaatatacacatatacagtacatatgtattcaaaataaacagagaatcgaaaagagtgacaaatttctgcaaaatataaaaggcatttcaacaatttttgttacggtattgtcgtcaatgtacggtacgctgctgttcggcctttctttgttttcttccaattattcttgtgctttgttctgttagcctccgtctttttgcaaatcatttctcatttccatagctttgtcttatgcgaatccgtccaatccttctccattttctcaattcgtcgtcatttgtccgtccattcattggccatttttttgtttttcttttttttccattggtggcaaaatgcaaatgaatggggaaagggaggcgagcaaaacgaatcagaagggaacagaggacaaagcgaccattttatggaagtcattcattcatttgggtccatccatacttttctttttctgatcattttcctttcctttttctatttctctacaaagcatttcagtttcaggtccctgtccttttgttcatttttctgatcatttctctttatggcttctctctttctctcctctctctttctttctctg

SEQ ID NO: 8692 - DNA, 3193 bp, Heterodera glycines
  misc_feature (3080)..(3080): n is a, c, g, or t
acgctttcccgtccgattcggatggaaatgtgccgtttttgacgtcgtcttctcgggcactgcaatatgttgcgagttcccaatcggcatccgtgtccagaatttgcgaaatgagctttttggcagctgatgccgatgcgaccgcttcagacttcagcagaaacattgtcaacagcgctttgagcggattctcgatcttcgtgagcccaatgcctgatcggtcaaggacggcatccaagtcggccacgaccacatcggagcagcatttgtgctcgtctccggcacatgccaatgtccaagaaagcgttttcggctcctcttcttcctgaacgaccgaaatttggtcttcttcttccagattcgcttctttttcgctcccgttcgcgtccacctctttgccgtccatcttttcctctacattttcttcgttttcgctttcgttggtctccgcctctttgtcgtccgtctgttccgtttccatgtgctcctcctcaccgcctaaaaatgcaattgacctcaattgcccaattattccgtccggtttagagttcaatttttcttccccatacaattttatgttttcttgacaaattaatccggccacacttatcagtccatttaaaacattcttataggggtttttccctttcggcattgtacaaatgttttgcaattcctttggtacgcgcactaatcgttcaagagggactgtcattggattaccgtatggattatcggacgggattacggtcgccgtcgatttattcaattccgtaatacgaaatgggccaaaatggttccacaaaatctttttatgtggtgatcgaatgtgggacccgggaaaaatgaccataaccctgtctccgatttggaatttgttctccgtgacttttgcttgtgcgtcgaagtgttctttcatttttgcacggcttatttgggaattttttcgcgcttcgtccactaattgcattagggactcgcgaaaaagttgaatatacgtattttggtctattgtgtagagcggatttacggcgaattttaattcgtgttccaacggaaagttggctggttttccgaacattaaatgatgtggggaaatacccgtgacttctgatggtgtcgaattataggcaaacactacaaaaggcagtctttcgtcccattcccaggctgaataagtcgactttcgtagcattcctagtatcgtctgattaacgcgctctgttacaccgtttgcctgaggatcgtatcctgaggtggtcgttctcttaattttgagtgtttttgaaatttcctccaatgtttcgttaacaaactcctttcctttgtcgctatgaagctttttcggcgttcccaagatacaaatgaagttttttacaacatttttcgcaatcgtttcggcatttttgtttgggatcgcgcaggccacgaggtatttcgagaaatgatctactgccaccaaaatgtaccgatttgaagatgctgcgggtccaatcgataaaatatcgatacaaaccaattccaacggctcctttgtctcgactatgttcaggggaggctcatttgatcgtggttttcgtgcatgtgcacaaactctacaacgaagtgccgcccggatacactctccgtacatatttggccaaaagtaaagctccgagagctgacgaaaaattttttttccgctaaggtgccccgcacaaattcccgagtgcctttctcttatcatcatttccctgaactcttttggtacaaaaagctgtagttttccatcgttctcattgcggaacaaaagtccgttgattaacgaaaaattgtgcaaagatgacaataatttttgtcgatcgcgaacgtcatgcggcaaaacacgtttttccaaaaattcatagacaaacgccaattcgctctctttggtcttttcaacccaatctttcctctgttcatcactcaagtcttcagcctgttcggcgacctgattttctcgaatttgcccaatacgaaaaatttcttttgaaattgggatttccgcttttgaattttcactttccacgttttctgttgcgttaagcaatgttttggacctagaaaggaggtcggcaagtatattctttttgccaggctggtattcgacttgaaggataaaacgggaattcatcgccatcaaccatttatccacacgactatttccagtctcgtttttgcttttgaacattgaaacgagtgcacgatggtctgttatcactcttgttggaatcatagtgataaattgagcatatttctttgtgccaaatctgatggccaacgcctcaagctctgttgggcagtatcgcgcctcatgccgattacattgtcgtgacgcgaagtaaatgggtcttaaatttccattttcgtccggctgacaaagtatggctgctaaaccaattttactggcatcggttaacatcacaaattgccttttttggtcgtctactgctgctttgaaatccgggaaataaagcattgcgtggtccaaaatgctcttttttagtgctttaattgcgcctaattcaacttccttgatttcaaacttcacgtccttttttaggagacgaaacagtggtgctgccaaagacccaaaaccaaaaatatatttccggtagtaagttaagaatccaaggagtgaatggagttcttttttactggttggcgttggaagttcaatgactggtttgactttgtccatgtccatttttacaccttctcgagttaagatatggccaagaaatggaatttctttaacggcaaaacggcacttggaaattttcagtttcaaacccgcttcatcaattcgcttgaaaacttctcgaagatgctttaaatgttcactccaagattcagaagcgatcaaaacatcgtcgatgtacacaaaaacagaatcgttaatcattccttcaaaaagacgcgtcatgaagcgttggaaagttgcaactgcgttgcagaggccaaacggtaagacattgaattcgtgaagtccgaattccgtcacaaatgctgtcttttcaaccgattcagggtccattcttatctgccaatatcctgacatnaaatcgatgaccgagaaaaacttttttccgccgagcgctaacaagggctatatcaatggtttggtaaaggaaatgcatctttacttgttacagagttcagccctctataatca

SEQ ID NO: 8693 - DNA, 1655 bp, Heterodera glycines
  misc_feature (1630)..(1631): n is a, c, g, or t
ttggccctagaaaggaggtcggcaagtatattctttttcccaggctggtattcgctttgaaggataaacggggaattcatcgccataaccatttatccacacgactatttccagtctcgtttttgcttttgaacattgaaacgagtgcacgatggtctgttatcactcttgttggaatcatagtgataaattgagcatatttctttgtgccaaatctgatggccaacgcctcaagctctgttgggcagtatcgcgcctcgtgccgattacattgtcgggacgcgaagtaaatgggtcttaaattcccattttcgtccggctggcaaagtatggctgctaaaccaattttactggcatcggttaacatcacaaattgccgtttttggtcgtcaactgctgctttgaaatccgggaaataaagcattgcgtggtccaaaatgctcttttggtgctgccaaagacccaaaaccaaaaatatatttccggtagtaagttaagaatccaaggagtgaatggagttcttttttactggttggcgttggaagttcaatgactggtttgactttgtccatgtccatttttacaccttctcgagttaagatatggccaagaaatggaatttctttaacggcaaaacggcacttggaaattttcagtttcaaacccgcttcatcaattcgcttgaaaacttctcgaagatgctttaaatgttcactccaagattcagaagcgatcaaaacatcgtcgatgtacacaaaaacagaatcgttaatcattccttcaaaaagacgcgtcatgaagcgttggaaagttgcaactgcgttgcagaggccaaacggtaagacattgaattcgtgaagtccgaattccgtcacaaatgctgtcttttcaaccgattcagggtccattcttatctgccaatatcctgacatgaaatcgatgaccgagaaaaacttttttccgccgagcgctaacaaagtgctatcgatgtttggtaaaggaaatgcatctttaactgttacagagttcagccctctataatcaacacaaggcgactttttctcggtaagcgtacgggacaggtctatgttttgctttaatcggtttcgcattttcagtgtcaatgcgatgttcgaccatgtccgtctgtgtcaattcctcctcacgaattgcgaagatgttgtcaaattcgcttatcaatcgcccgagaggtaaaaactcttgatcagacatgtcttttgcctgacttttcaaacattcgagaatttccatgctttggcacttaatttcattcatttttggtgtcaatttaagattgttcaccaacaatggtgagccaagcgaatcgtccgcctctgcgaaaagatttgtcggaaacaactcgacaattatttctttttcgtcaacttgcacgaattcaattgatgaattcacaattggaacggttattttccctgcggtgattttcccaacggttggctcaaatctatgcaaacttttctcattcgacgatgtgacaattacttctttgtcattccattcatttccaactgacaatgttaccagtttcattgataacggtttgagagtcgtttgataaagaattcccacagacttttcctttttcggnntgattcctcaaaattgatcatttc

SEQ ID NO: 8694 - DNA, 4563 bp, Heterodera glycines
tttcacttacagtttgcctccattaacttcgccctggcttctttgttctcccacagtttaaccattgctgtacccccaattagcttctccagcaatgcaatggcgccacgcttgtggcgtactgtatccgatataccgtttcgcactgtgcccgtcactcggttgactacaaagtcccaatgggaactttggagtactgtacgcattgaggacaaagtttcttcgcgagtgtttaaaaaacattcggtgggcgactgccaatctgtggatgggaagttcctcttattgaccagataggtcacataggcaatttggtaacaaattatgcggaatttttcggcatgccaaaagtgcagttgcacagccaccatggcacgcaatttggcccgtgttctaataatttccgtgaaattagcagggttaatcaccactttctcggtttgatatatgatcgactccatcaatttgatgccgagaaatatctctgcttgaaaagttgtgtccgaatcggtggaggaaaacaacgccaaatagaaaaggtccatctcgtggacgtcatcaaatcttgctgaaaaaactgggtttgaagcttgttgatatcgacaattaattgagtcccagaaacagactttaaacaagaaaaaaaacatttggacgaggaactcggaaatgaaggcttttggaaaaaatcaaaaaataataaaaatgtaaagctaggcaatgctggttggtgtgtaaaaattgacaaaaaaaatgctaaattttgcagaactttgtcattccccccctctgatgtttgagtgcttaaagggcctgtcacaaaaatttaaaaactagaataagaaatttaatcttcctagctataaaacaccgctcgactccttcaaaaaaattaccatattttttaaaaattggcattttgccaaaattataatttataaaatcaacaaatttcttgttcttctccaataagttattcagtacaaattcctgcgtcccttcaaatgttggtgactttaagaaaccttgaaaaatttctaaaacatttttcatttcctcgcaaatggaattgtcccatttttgttctccttcagtggggaatggcgcatttagctaaaagtttggcattgtcctaattcgtttttttcaaatttaatttaaaaactcacttttccagcaaagttatatgtaaaatatgttctccagctttcgctttcattgtataaattgcgatttgaaatgacatacgcccaaaaactttttaaatagcaaattttcacaattttttcgtcaaaattttcgggttttcccaagagaagcgttttttgggccattatttcaatttcaattgccacacccttttttatttgctttatgattgataagagttggttgatcagtgatttaagttggtaatatacggtgttcacctccaacaattttttatcacggcttgaaattggccgatccgccaacatcaaatgttggtagcagctgatcaagtccgaatcagcttaataatgaaagccaaataatcaaaacaattatgattaatgaagctaatgacaattagttggagagtgttttgaaaatttattacaaatttgattttggcaaaaattcagcgaattaataaattaaaaatattatttaccatccgaatcaacgcatctttcgttttctgctctaccactttcgcttcctttttctcttccttttttgtctcctacttcatttatttcctcacttttttcttcttctcctttttctccatctgctcctccccgcttttctcctttttcttctcttccttcactattttccactccattttgttctcctcttcctttttcttctcttcctcctttttcttcaactgctcctcccctctcttcttctttttcttctgcttttcttttttctcccgctggttccttttctcttcctttttcgtttccttcttcatttatttccccactttttccttcttctcctttttcttcaactgctcctcccctctcttctcctttttcctttttgtctctttcttccttttcatctcctttttcttccctttttcgtgttttttcgtcttcttttgttacctttcttccttcactattttctcctactttttctcctcctccttctacttctccattggctcctcccctctcttctcctttttcttccactatttctcctcttcctttccccttttcttcatcgtcctcttttccattgttttcgttttcattcctctgctgcttgcttcctttggcattttccattaaaatttggtatgccaatgtcatccgtggtatcattttttgaaggcgttgttcgttaatgaaaattgctgaaattttaattaaattaactaataattatgaaataatcaattaattaattctcactcacttttaactttgtccaaaaagtgttgctcattttcgatcagtccttccatgatttcgtcatgcattgtcaacagacttatctctgtcgctaataaatttgaccgattttcttcacctttttcaattacaatcacttgggcttcttcgggaaaaagtttgtctttgtcacttcttaatgacataatttcccttttgtgtgctttttttgccgctttgtctgtcgccgattcgctccaggcaatcaaatccatttgaagttcaattttaaaaaataaattctcaagatcgggctgcatttcctttgtcaatttgtgttgcctttttttgaacctaaattagggtgaactatgatgaacaacccgcgaagaaaggggttaaatcatctgacaatgggtgtcatgacaactcgtacaaaaggaaactcgtacaattgcttaggttaggcatagcttttaggcttaggcctaagctttaggcttttttgtaaaatctgagttttgcttttgtatgatttgtctttgacccttgacaatgagaggtttttgcatcaaagaatttttggtgcaataatgccaaattaaacaacaatttttttttgcttattgcgctaaaaatcagcgcacactcgactacggctgctacagtaggtggggcgagactccgggctccggaagaattccgcgcgtgatccgcatctgttcccatttaatcttttgccccaaacgttgaaaggtgaaaaagcaaagcccatccctggtaactttgctgcagggatgtaacggaattgcggccggatttctgattatttttcttgtaaaccaaaatagaaaaacagaaagtttttcaaccaaaaaaattattgaaaactaagctatgccgggtttcggggtttggcccgctcaattccaaccccagagatcgatttccatccaccaaacactaacaaattgttagacgagttccgtccaatcgtattatgtaagcctcgggaaaggccccgaaatccctaacttaccagtgataaaatgccaaaaaattggccataaaaagtgctctcgtgtgaacatctgtttcactgtcactgtccatataatttagataatatttgacttgtaattggcttatttcgtctgttgtcaaatctgattttaattaggaggcaattaaataattatttttatattacggtaatattcaaattaaaatataatatattcattcaaaaaattaaaataaaacattcaccggaacggaacacctgcgcaaaactcgcatttccttgtagtaaattatccaaaattgcagtgccttttaatggtgaggtgaaaaatgttctcagtcgatgtttggcccctttcatttggccaattgaatgtgccaaaaagcgactgagtgcgttttggcactccgctgattggcacacggtcagttgagtcacaatttcggaatgttccaccattagttgatcttttgccctccataaaagttcatcggtccgttgaagggcaaattcgtcgtaaattatcaaaatcttttcatgtttttccaaaattggaattttgttgtataaatcggccaacttgtgccaaaatttgtaaattttctcaaaggaattttcttgtacattcgttttaatttgcgcacaaatttcgcaaaatttttcactccaaatttttcttatttctggataaattttcttcattgtttcgtgaccctttcgcccttttagtttcatttttccaaatgaattggacataacaaaaatggccatcatttggtaaaaaaatatccttgttgataaatccgcttcattttgtcgtactaaattcgcgtcctttttttgcaaaacttttacatacaaatttgccaatcttttgtcagtgatatctaattaaaataaataattgaataaaatttgttctgctaaaattgctattttttgggatatctatgaaaaactcattttaataatccgttttaaattattggctgaaattaacactcacaccctcccacaagaaatttattactctaattaccaaataacatttcaattggtcggaccaattcattctctccaaaattcatgccaaaatgctgttcattcttctctttatttcattattccatcacatttcatcat

SEQ ID NO: 8695 - DNA, 3450 bp, Heterodera glycines
cctcttcttcatgtgttgttgttgttggctccgcccctttgaatttttttcggtgtcgactgctgtttgctaattgcgctaagcgtttgcattaaaattcgcgcgcgctcgtggcatgtacaccacgcacatttcccccgggtatatatgcgttttcaggcgcaactgttgctccgtggttgggtgcatgtcgaccaacaggtagccaaacggttcggccgttgcgtcctcgtacgcttccaagaagtagcgtagcgccccgcccggaaacagttgtgcgccgaggttgcggatctgaagtgcgccggccgggttgcgcatcaacaccatgtagtgagagttgttgcgcgctatccgaagctcacgagtgaacagatgctgcgtgatgagcaccacgctgacgccccagttgtgggagccacgggtgaacaccgtgtccagaaagctgcagcgtagaccgccggacatcaggtcgtccagcaccaacaggagccgtccgcccgtagcgcgtgcttcccgctccacatccctctcctcgggcgctccatggcacattctgatcgaatgttttccctccgtggtgttgctgtcacttgaagtggtggcggtgttctccatacgttgtagccggagcacattgtcgttcacttccccataacagtagagcacgccagtgatagggccttcactgaccatcaggtcaatgtgagaaagaaggcggtccacccactgcgatttcccgctaccggtgcatccggcgacgcacatggtgaacgggtgcttgaagaacattttcccttattcggttttttgcgtccctctgtatttgcacacacacacacacacatatatatataaatatgtagataaaaaatttcttcctccattctactaaacccccacccccaaaatggattcattcggaactgtcgcctggattctgcgaccaacggctcagacgacaggcactgctgtgggctcaatggagtacgaagaggaggaaaacgggacaggaaagttggtccacagtgacacagctactgtcaccacacctaccaccgccgagtttagactggaaaaagaagccccctcctccgagaaggacggtgctgaagagggcagcggcggccacggcacactgctgttcatcgaatccgatgatggggaggaggaggaggaggacattgaagacacccccgtcgccacagactccccctcggctacgacggcaaccgttgtggatgactcttccaacactgttaaaggggtggagcagcgctccagtgagcacagtgacatgacgaacggtacgggcggtggcggtggaagcgaaggcgcaaaactgctcggcgggggagaggaagaggaggtaggtggaggccagctaattttctacccccccccctactgtttgtagcctgttcgaatgccgctgctcaactacctgtgcgcgttcaacgactgttcaatgaaggagcttcaactcctcttccacagtgtccacgcgcgacagcgtatggtggcgcatctgcaacaacactgccgacttcataccgcgcatctgaaaccggcggagcgtaacattgcgctccactgtcacgacctcagcgtgcagaacgccaaccggacgttcgcctgcggtggctatctggagcttaccgtaagtcggtgagtgtgtagaaccagtcatggtgcggccttctgtccaggttcgacaatacttcttcgccaaacacgggctaaagctgaagcacccgtacatgccgtgcatgatcgagttcgggggcggcacgcacgcctcctactatccgtaagcggggggtacgcaaaaatgggggaagtgagcgtaaacgccttcagcctggagctcgtccatgtcgtgctggagcgtacgaagcgcgctaaacaggaggagacggtgaagcaagaagagccataccgtcgtgaatccggcgacgtggctccgacaaagtcgatggcaatgccggaacgacattgttgccgctgttgctgtcgatgcgctaacaactagctttttgagagacatggtcattgtagatttgcgcgcgtgatcacgtgacttattgtgctgttatagtttttgtgcactttttttgaaataaatttgcaagcccatggatttgtagatgttgaatactatccgaaacagtacggtcacatttacattttgccaaaacaatcggccaactgctttctcgcacacagaattccgtgcgatggcaacgcatggcatctgtacggagtacgcgccgcgacgcttccctgccatcgtgttacgcattagaggctacaacagcggtgacgacgccgttgagcccaatggagtggccacagctctgctgtttcgcagcggacgtgtcgtcatgacaggtgtgcgcgctcccgcgtgtggtctttgctcgacagtcaacgtgatggcccatcgggtgcgccaccgggttggggcggcgctccgtggggctggactctcagccgctgcacgagccttacgcataggggaagtgagagtgcggaatctggtgagcagcgtacgcttgcccttccgagtgcacattgaacgtttgtacaactcgttgacgagccgacactcggcaattgaccaaaaccacgacgacaatgttctcgccgacacccaatttgtcggcgtgcgcagctgccgtctggacttctgtgccttcccagcgctacgttgcacgctcagcatggcactttcagagtcacgtttgcgaggacaacaacaacaaccgcagagcgtggctccgccgatcgccgtcacttttctgctgtttgtcaacggccagctgattgtgaccggtgtacggagagtggagcacatcgacgaggccttacagaacatggagacgatggtcaacagaagcacttacaggcgatagtcgaaactcccccaccccctccccccataaagtgcgaccacactttcacttatatttttgcgcatacatttaaaaaattatccaagtaccaaaaaatcaatctcatcatcatcatcatcatcatcagtgtcgctttcgtccaagagttccccatcttcggcttcctcctcctcagcattgtcacggtcagcgtcgtcgtcgtcgtcgtaccagccaaacggtctggtgaagtaggcatttccggcgccgccgccagcctccctctcgtcaagcgcaacgaccagccctttggtgtacacgggctggtacagcttggtgccgcggcgcgtgaacacctcggcacgcttcgtacgcacgaagcgggtgcaggggacgggcactcgctgctccgcgtcaggcatcctgatcgggggtagcatacacacacacacacacacacacacacacattccattgttatcccacccaccccctcgtgctcaccggccgaagaagttgagcaccaactgacgcatgcgctccaacgggagcagtt

SEQ ID NO: 8696 - DNA, 3457 bp, Heterodera glycines
ctggtgcgcttctgatcactactcgaaaaatgagtgattgaattttcactaaaaagttaagcctaaactttttggcctgtataaaaaggaattaaaaatttttaaaaatttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggcctcgtggtgggccttcggtgcaggtcaattgtggaggctgatgcttcacaaggaggaattggtgcaacaatcagccatcaatttcccgacaaaagtgaacgtgtcattgaacacgcatcatgcactttcacggctgcgcaacaaaattacagccaaatcgaaaaagaggctttaggattggtttttgcggtacaaaaattacaccgcatgctctacggcagaaaattcactctgttgaccgatcacaagcccctactggccatcttcggatcaaaaaaaggcattccaatatattcagccagccgacttcagcgctgggcgttaattttgtcaaattacgaatttgatattaaatacgtcaacacaaaggcattcggaaatgccgatgtactttcgaggctcatcgcaaattacccgaggccatcggaagacatactcatcgcaaacatctgcaacgacactgattgctgtgttaattttgtttttgaggcaaaaattgagcaacttccgatcaccgcgaaaataatagcggaggaaacagcaaaagacgaaattttgcaacaaattagcgctttcaccaaacaaggatggccacaaaagctgaacgacattaaattgtctccttttcttccaaaaaagggacaaatatccgaaatcgaaggatgcctcgcctacggtgaacgaattatcatcccttcgtcactccggaacaacatcctcaaatcattgcattttgcgcaccccggcattgtgcgaatgaaagccattgccaggaaccacgtttactggcccggaattgactcagaaattgaacgagtggtgaaacaatgcgaggaatgccactcagcggccaaaaatcctacaaaagcgacccttcagccatggaaggcagcaaacggagtttttgagcggattcacattgatttcgccggcccgtgcgctgacggccaaacatacctggtattggtcgacgcctactcaaaatggccagaagtatggcaaatggaaagaacatccagccaactcaccatttcaatgctcaaatcattcgtgcatcggcttggaattcccaaagaaattgtctccgacaatggaagccaatttcgatccgccgaatttgcacaattctgcaaagaattcgacataaagcacaccttcacgccgccgttccacccaatgtcgaatggggcagctgaacggtttgtcgacatttttaaacgatcaatgaaaaagtgccgtcaagagggaaaagattggcttcaaaaagtgcttttggcgtatcgcacgacaccaaacacggcactcaacggccattcgccagacgaacttttcctaggacgccgcatgcgcacaagaatcgcacttgtccatccggaaaaacaaaaactccagccaccaaacttggaaaattttcaacaattccaagggcagtacatcaaaaagatggaaaaccaattcaacataaaacatggagcaaaatcagccattttccaaaatgaggaaccaatttatttttggaatttaaaatacaataaagccacttggcttccgggaaaaattatcgaaaaattaggcacatctccgacgtatcgcattttggcaccgacgcttggccgagccattcatcgtcatgccaaccaaatcaggcgacgtttcccaattgaattggaggacaatgatcaagttgtagaaaatgatcaaacccaggcacaaaatccgcaacaatcgccgatcgcgcacaaaccgcagacaaatcgtcagcaatcgcctgctcaaccagttcttttgcgccgatcaggaagagtcaaacaagcacctcaacgactggtcctggatccgacaaagcctaaatacggcttaatccgatcatgaatcccaaatcgagggacattcgacttaaggagggaggtgttggatagggatcaaagatcactttcccatcattgttatcgacttttcccctccccctttctctgtcttacattatttccattgtcttcctctctgcctatctcctccacatttctctgaccccgcgtctttataagggtgcccattccctcactcatggctctccgctccattcattcgcattggacatttttattattttattctcctccgtcgctgcactcctccgacctcatcaatttgtgcatttatttttatttgtgtttattaataaattgttgatacacaacagcttcctttcccccttcttcatcctcctcattctcattgttagctttttcttcttcaatttgtacaaaactgaattgttcaaaagaactgatcaaatgtaaaaatacataaaatgatattatattattaatttaccattttacttttccattggaaataaattcacttattcattgatattctgttccatcacttactttttcttatcttaaattattcaatccggttttatgaacgaatattacgcgcaatatgtgcgagtgatgttcgtacacacattaattattatttgctaatgtcccaagcgacgcatccataaaatttatgtctcattccgcgcatcgaaatgaatgtccggcgataattacagccatcgatcatcaaaacgatgatgaaaaaagtgcaagcaaataaaaggcactgagtgagtgacaataagtgcatttatcatttgttgcgtgcaattgtgcatcattcgcttttttttattgcgttatcgtatttttaaaggtgttctgattactgtactatttctgatcagtgatcaatcagaaatcaaatgctattcaaaatctgagaaaacattcacttttttggtccccagggctgcttttcctccctttgtttgtcctgtcaaatcattcgttttgtttttaatttgcccctttttctctcatcagccaaataaatctcttttattttgtccctttcacttttattccctcccttttttcctttgagttggtccattaaagaggtgacaaaactcgtttagcttctccccaccattttcatcatttcctccccttttaactattttcctctcttttaccgattttctccgtttttatgtgctcttctctttttctctgcttctcttcctctgttttctatcacttccctttccctttctgtcatcttgtgttttactgccaaccgactgactgaagagag

SEQ ID NO: 8697 - DNA, 1883 bp, Heterodera glycines
tctagagtcggggtcaattcttaaataaattaattcattttagaattattttacctttatttaccttaaattaaattattattattatttcttattttaaaaattacattttattttctttgtcaaaatttgtccatgaattcccttttcttttggacttttttccatttttgtaattcaatttcctccttggccaaaaaatgttaaaaggagaaaagtgaggaaattgcatagcaacgctcgccgtgagctgtgctcggctgtttggggaaattattccttttttactgcgttttgaattgacttttctcggattatttttcttcaaattaaattttcataccaatttatttttagtaatttccgatttgtttatttatttatttgaatttgcttccgtacgtaaaatattttggccaatatttacgcattattttgtacatttccgatataaatatttgcacaatttgccattttcggtatctgcgggtccgtccgccgtcctcgtctttctccctgtgttatcaatgcgctgctaaacgggtgaaatgctaccgcctccgctgccgccactttaaaacaatcgccgctattaaaattgctaattacccctgtctttatcatcatactattattttattaatattgttgcaaattgactcatcgctgtaaaaataaattttgccgtaaatgctgaccaacaacagtcggaacaacgacggtagcaatagtgccgctgcttttccttctgctactgctggaggtacagtagcagtacttggcgatgccaatgcgatgaatactgtagaggcggcaacggtcgaagaggaggacagtatactgtaccagatggaacgcaaatacttttgttgtccttacgatgaagaaaaggagcaacagttgaagaagacgggcgaggaagaagacactccgtatataattgacattgtgggacaaatggggaattaaaatggggaattatccaatttaattatatttgcgcagttcggcagcagtcccttccaatttggcaattctccgttggtcgcggcgcatgagcgcgtgttggagttgctggtgctggacaatttgggcattctccgcgttggcccgttggaccgttttgtcggattggccaaaaatgtcactgagctgatgctgagcgacaatcgccttggctgggccgaggtcggccaacttttcggggcgttgccactgctgcgggtgctcaatctgagcagaaacaacgcgctgaatatatcgccccggggcgcggaaatggccgaagcgcgaacactcggtcagaagaggggagggacaatagccctgatcagaatctgatcagttggtggtccgaaaccatgccaatgttttcctcaatggtcacatcgcagtatgaccaacagatagatactctcgatcattgagttattctgttgtcccttcggtcatttgatcaaaattgtccaaaaccatgacgaaagtgacatatactttgttcgatgatacggcgcctttgatcactgatcaattatgaaacactcctaaagtctactgagtccctcaatcactctgatcaaacctgctgatcagatactgcttgtccatgatgggccatggccatcatcgccgcctatttcttttttcttctcagatgtgctcattctgaatgatctttcgctgtctttcgtcactctccgccaccttttgcctttcgcgcccaacctcagagagttgcacttggccaaaaatcatttcggcgacatttcctccctccccgcgtcgtcgaccgccccaatttcgcactctctgcgcgaattgcatttgaatgagtgcgcactttccaattggtgccacgtgctcactgttttgtgccattttcc

SEQ ID NO: 8698 - DNA, 1781 bp, Heterodera glycines
attaattaccattattttattcgtttattgccttttctttattttttttggcattgttgccacccgtactttttgtcctctattaatttttatttatttttatgcttatttttgtcctttttattcagctgaatgcactatctctgaacaacacaatgctgtccaattgggaggccattgagaatttggcggcaattcggcatttggacgaactgagggtggcaaatgtgccgttgttggccacttattccgaggaggagagacggcacctggtgaagaaaagggaattcagtaaaactgaaaacaaataaatgccaattaatgcattttcagattattgggcgacttcgttcccttaaactgctgaacggctcgaaaattggcaagtcattaaattcactcatttaccagtatttgatttggaaagcttaaattgcattttttttttctcttcagacgaacgtcagagagaagaatcggagcggtaaaaattaataataatattaatattaattagctctttttactaattatttaaaccgacaaaaatactttctttttcaaaaatttgatccttttgcagctttttcattcgctattacgctgagggagaaaagcgaccgctgatttacgagcagctcattgcggaacatggcattttggagcagttggtcaaggtggacctgacgccgaaaagccatgcccgggtgagttgaggcggcgattgtccatcagcggattgatcagtgttgggaagactgatcagaatactcatcagacaaggcattgcaggtgctgatccgctgcgaagagtccgaatgggtccgttgttgggttcgtctgcgcctttccggcactgtccacggactgatgcaattcgcggagcatctgacgcacattccgctcaagtgatcgatcatctgatcagtctgcagcaaatttcccgatcactttggcagaatgatgcgcctcttctatatagaaaggggaggaatcgatcctacggagttgcgagtgccgggcaaacagttgcgactgttgcacattgaggacggcgacgaatttgtcgtgcagtcaaaaatgattctctgtgagcgaccacggcattagacgttgttggcattttgtgcaaaaaagcgagacggatggaaaatttgaaaatattcgatgaggcggtgaaaaattacgccggaggaattggcaataattcattaattacccaccaacaaatactcaaaaattcaacaaaccttctttcttggcttaccgcttttaaatggctttaataaagttttgtgaatttgtcggttgaaatgaaaattttgttttgtaattaaaaaatagtaatttaaaatcatccgacagataattaacccaataggaaatatttgaccaaattggtctttctttctctttacacttacattcgttgtatgtattataatcacacatttacaaatccacataatatgtacatattatatatgtattttacattttcatttgaaattattttaataataaattcgtgacaacaaaatccgatgacaggaactaataaaactgctaaatgaaggacaattaaaattgtttatttgaatgtgagtggtttggtttaaaatctatcgtttgagctgctcttatttttaattaaaggattgttgtggggtacacttcagttaggcgctcacggttgggcgccagcacgttttttcactataacttttttctttgacatccaaatccaacaatcttggtatcattgaaaagcgtaacatgtt

SEQ ID NO: 8699 - DNA, 1036 bp, Heterodera glycines
cgtaagtgttctcctggatgccattctcgacgaggtaactgcgcagaaccatctctatccattcgtagttgggtcggtcgtaaaaatccaggcggtcctgaaaagagggggaaattgaagtgggcataatcggataagcgtgtgtgaataacccacaatgtgttccaagattgggcccagctgtgccgggcatccctgcaacaggtcggacagggcctttcgtcgcacttccgatttgtggcttagacggcgtcttttcattttacctgtctgaaaatgtatgaaatatactcaaaaatgtccaagtgccctcctcccactcacccggtgctcgctcctcacacggctccatggcagtgaaccggtgtacatgtcgaccagcatgtagaaccaggactcgatgtcgtctcctcggcagtagtcgcttctcgcatgcgctgagatcgatgcgtacatcggcgtcccacgaaagtgcgtctttttcctctgccgtctatgtttaccctgtgaaaaaacaaaaaatcataagttcttaaaaaaatgattggggggggggggggagcgatctcacggttttgctgctgatgaatcggcgcgcaagtccaaagtcgattaagaagatccgttggcgctcattggtttcccgtcgtccaattgcggcgttctccggtttgatgtccaagtgaaggtagccgatgctgtgcagcgtcttcagtgcgtggagtagctgaatcgacacgccaatcgctgtcccagggctgaacattccgcccgccttcttcaggagactgtaaagcccacgtccggtcaatgacatcctgaaaaagttgtggcaaaacttaattttgatggcataaggtttcaaacggcactcacacaatgtagttaaacgacactttttttccgcgttttgcatcccgttgaacgtctcggccatcgtcaaagcagcgacaaaagggctccgcgcctgctccctctcgaagaaggcccaagtgaggggtaattttagcctgtaaaaagtggatatatttaataa

SEQ ID NO: 8700 - DNA, 747 bp, Heterodera glycines
ttcggatccgggattcggaattgttcgaaaaggatgccggattcgtgatcagcaaccccgaaaactcttggaaacatgttttcatgactatgaaacaaaaaaaaaatttcgaaaaaaggggggagggacaaagcacagtatttattaccaatatttctccccaaaaatgtgttcgggttccctcgcgtgtcccctctcctggttcacaatcagtagaatgatcttattttttctgaaacaaaaaatattttaattaattttttttcgcttccaggaagaataatcgagtcgactggaaaaaagaggtgagacgaagctaaatggttcaaattaaaaaaaacaaaattgctttttagcgaattacgaaccaggaaacatttggccaaatggtgagtttttaaatttgtatccgaatcaaacaagtcggctcttggttaaaaaaacaggacttcgaactcgaaccaggagagtcgaaattcaaattccgccaataaaaaattttcggggaaattctttactccccccccccttccctctgtttcccgaaaaggaaataaaaagtccaaatctcaagagaaaagaaaaacacatagaaaaaccgatagcggcccgacaaatgcggtcggacatttgcggccaacgaaacgccaaattgtcattcctttttcaaattaattataccaaatatttttatttaacacattcaccaattattttgttcaatgacttataataattttcaactaa

SEQ ID NO: 8701 - DNA, 2652 bp, Heterodera glycines
  misc_feature (5)..(6): n is a, c, g, or t
  misc_feature (54)..(54): n is a, c, g, or t
tatannagtcattgaacaaaataattgggtgaaatgtgttctatctaaatattntggttaattaatttgaaaaaggaatgacaatttggcgtttcgttggccgcaaatgtccgattttcccttgggccgcaaatgtccgaaaatggcccttaagaaacgggccgcaaatgtccggaccgcaaaagtccgaccgcatttgtcgggccgcaaatgtcctataaccgttgatttttgttttgtttttcttcctgatgaaacacatacctaaaaatttatttcaacaaaaaaccaaaggctgtccgcacaatgatgcatcatcacaatcaccatcactatcaacggggtggtggtggacgaggtggcggtggtgctggtggtccatgggcattccccgcgtcatatcgcggcggtggcgttggctacaacaattatcaccttcacaaccaacagcaacattattactaccaacaaccgcaacaccgaaaccactaccacagcaacaaccgtttcggcacgcaacgccattaccaagcggcggcggcgacgacgggcgcgccaccggcacaacaccaacaacaaatgcagcaatagtgtagtggcaaaaaaagtgccaaacaaaagatgaaggggcgcgtggagaggatggggactgaatttgttgaaaaatgagcaaactgaacggcaacgaatgggcagatagatgacagattttggcattttatttgttttatatggaatttgtgatgagtgacaagcaactgaaaaggggagggggtcaaaaaagcgaaatttttcttgcatacaaattttccaaaaatccacaaaatttggtataactctttaaaaatgataaaaatttcgaacttttctggcggcgcctatcgccactgctgccactatatcatttttttaaattatacaatttttttattattttagagatttattggaacttttttagtaaattcagaaaatgttcgttctctcacatattccatatatgctttgcttttttgcaaatttaggagatgcgtttaattttaaaattcttaagacatttaagcggtaaaatacactcaaaaaatttttttttctctagaattatgtcctattttttttaatgagtgtgtggcattatttactcaaaatattcaactaccattattgacttcatttttttcattcgaattttgtatgtgaaccctttctaatagttcattattattattcattatctaacctaacacccaaattgtcccaaccattttggcctcattttgtttcttaaatggaaggcatttgccaaattatactgattgaaatttcctacgattattttttttaattgattgattgattgtatcgctttcgaaaaattatcttaattgatcacaacaacaacttttgttaaattgatttaaatatggagatggatgaaaacataaagtttggttttgtttgtacttacaatggcacaataatttttatttggctatatggcaacaaaattgtttttagtgggttaaaaattggttaaatttcgagaaaaaaaactgaaccttctcagtttttttcaaaattttctatggtaattttaggcgcagaaaacgaatctgacatttattttattaatccatttttgagttacgactaaattttattcattagcgattaacgggagaaaggattcaaaattgtgtggcattttattaaaaatgataaaccatgccatctatcacaccagtatttattgggtcgactcaagtgttcatagaccagtgatagattataaagtccatttcaagctgcagttacagattacacggcaatctttttaaatttatttataatttgcctcctgtttaattaataattttgaatttttcacgtaaattataatagagaggggtaggcacaataaaggtgccaatttataaatgtaaaatactttgaaaaaaatcaaaataaattcatcatttgtcgagcggatccgatcccatggcaaatggtcattaaaatggaagtgaaaattacaataacattaaactaatgtatctttgcttgtgtttttgtttgatctattttttcgggtgttttagtgaaggcgcgctgtcatttcgtcccgcgtcgtttcgtcccccaagccaaaatgagtcatttcgtccccaaatttctttttatttataaaatatttagtttttaaagtgttaccactaaaaatttttctgggtttagttaaacaaatcataaatttacgaatttagacgtatgatgaatcgtaaaaaaattgaaaatcttcaaaaatgtcgtaagcgcaagtttttggataacaatgacagtgaaaacgaaacgctatctgctgatcaccgtgaacaaaatgagaacaacaacgaccgcgacgatgattttgaagaacacgccatcgtaaacttcgaacttggagaaacgaaaagaggaggtgtctgcatttggtttaatggtgagaaaaattttttcaagaaatattttcgtttttaagggttccgatttacgcacaaacaaaatgagttgtggagatgcagtgtgcgtgactgccctgcacgcgtaaaaattgtcagcaaaagtgacaacggaatgtccggttaccaaatgcaacaagatcacagtcacttg

SEQ ID NO: 8702 - DNA, 3301 bp, Heterodera glycines
  misc_feature (62)..(62): n is a, c, g, or t
  misc_feature (84)..(84): n is a, c, g, or t
  misc_feature (94)..(94): n is a, c, g, or t
ttcatctaatttctctgtgtttgtaagtcatgtactcttttcatgtcttcattttctttgtncatgtatttctttctctctgtntatgcttgcncaatacacactctttctttcatctaatttctctatagtgtctgtgttactctttttatgccttccaatttctctacactattttcctcaactttgtttctctatatcttcaattcttcacttcactgacaattaatagtatcgattgaccctggagacgaggttggcaagcattgctctatatttcgccacttgctcataattatttttcatttacaaattacttttttctaatttaccccccccccatttaatgattctaactgcagtcctaacatgtttattctagcatttatttaaaaatcgaattatcgaaataaatgattaatatgtagattaaaagaccaaaatctctttttaattttaagatttatcggaatgtggaattattgagattttttggctaaaaaatgctagggaacacgggcagacattgaaaatgtttttttaaatttaaaataaaaatctttaaaaatattttcattttgtgatttttaaaaatagctatttaacaaaggaattttatgcatcaaaaaatttcaaaaaacaaaataatacaattcaaacaaataagattaacatttttaaattggtgtagaaatcttgtacatacctaattgtttaggaattaattaattttaaattttatatgaaattgttttacttagattagaaattaaacttgcattaaatatttaaatacaattttaaatatatacagccacagcttaaatcaactatatgtattgtggcttcagttgaacaaatttaaaaatgattgcatctaatttaaaaatatccagaaacaaaattaagccaatcaaatgaaattgttttggaatttttcgttcccaattttgtcgtctacaaacattcaccataattattgatcaacagtaacaacacacacaaaaaaatacagtagtccatccattcataatggacgatgattacgacaattatgtgccccaaatttcgaccatggactacagtctgttgcagccgggcggaagcggcggcggcggtgccacgggcggtggtggcactgccggcatgggtggtagcggtggacagccgcaacagcaacattttttgtacgatgccgggggcgggggttgcggcacagtgatgccacccggcgcggtgacagcatcgggcggcagagcgggcctccctcccggcagcggcggcgggcacccacaatttggggggcacttcggtgccgccgagtttggcggtgctatgccaggacaggttaatatgcctaattgtaaagctaaggatggcttatattagtcaattaaacgataatatcggtgcggaggcgggggaataaatgacatgacaaattatatgtgtgaatggtggacaaactttgtatattggcaactcatgcaaaatatttttttgcccgaggggccattcgaaaatttaattgcttttagtgtccgatggttgcctaataagcacctcgtttaatttgaaaatttaaatatattttgttttgaaacaaatattcaaaaaggctctattcagtttatgcgtccgatcaatgaccatcctcactttcttaggctataacatttttttttctttcttatttgggcaactaaatcatggactaataacaatagacaaaaatcttcatggctatactcggaaaaagctaaattcatatgttccatattttttaatttttctataataattattattatttcttgcatggacgcctaaactgaaattagtgccaaaaaagtacaatttttatttaaaataaatgttttcaatgcctaccaatgccatccataacatactcttgaaaatagaaaattcgatcatttccacccgtaggcttacccgcctggctattgtgtgccgccctcaatggcaccaccgccccatatgcaacaaatgatggcacaccgccagcagcagcaacagcagttaatgggtggcggtcagccgcagtttgacccgcgctacggtggtgggagtgcagcggttgtgccaaaaatgtccgccgctgcggcacaaatgatgtcacagcatcaacaatcaacggcggcttctggcacaaaagcggggaaaagcggtggcagcaaaaagggtggcaaaaaagcgtctgccgccgccgctgcagcggcggcagccgcagcggcagaagcagcaggcggtggtgccgtaacagtgatggaccatggaggtaatcaagcgccatgcgccgcggtaggaaagggaaaagccgtgatttgccggcttccaagcgcgtcgttttgtctcatgcgtcatttcgtccaccaagccaaatcaagttaattagtccggcaaatttcccaattttttccgctttaaaaagaaaatcaatgtatttaatcaaaaaaaaatttttgggaaagacaaaaattgaaataacaaacattgagatcaataaattctaagtgatatgcaaaatgattgaatattttcattattccttttaataaatacttttaaattaggcagtaaattttcatttaaatttatttcgatgtaatttcgggggttaatcattgaaaaattatgttaattttttaaaataaaaaaaaatggggcaaattaactcattttggcttgagcgacgaaacaatacagggtacagagacataatgatgctaggacgaaatgatagggcaccgagtggtcaaataaatttgaaacaagcctagaggagagggcaccatcaaattacaaggcttttgtgccatttgcgtatatgccaaaatcggggttaaaatttaattcgaaatccgaatccataaatttgtcataaacaaatagtttttttttttctaaagaaaacaaagaaagtgtcgcgatgagaattcaaaaatttattcattatcaagggcaaagagatcacatggaaatgccattgacagatgtgaaaaagggttgaagtgataaatacgtaaattaaatatattaaaaaaacactgaaatatgtaagaaatacatattacataaataaaattgatagccctgatagcaaatcccaccgtgggatctcacaaagtgtaaatgcggggcgggattttgcagggatgtggaattggcaaggattaatcccgtgcgatcctgtcccgcaacaaattttaattccaatcccgcagcgggattcgcaaatttgaaattgcctatcccttttccgaatccctttcgctgtctt

SEQ ID NO: 8703 - DNA, 984 bp, Heterodera glycines
  misc_feature (945)..(946): n is a, c, g, or t
ttctaaatagcaaagccaataatcttttccagcaattattttaagtgcaattttataatgtgtgttttgaagtttcttaaattttcaaatattaattttttttttaatataaccaagtatgttggcaaaaaaaaattaaattaatatccaaggtttaatattgaaaaaataaattttcataccaaaaaaatatgttttgtaaataaattgaaataaaaattaataaatttaaaaaataaataaataccttttaatccataattataatgtatctatgtaaacaaagtaaagtcagggcaaagaatgaaattaaaaataaataaataaagaaagacttttaataaataataattatcctaataatcaaatgaattcattaaaaaccaattaattattaatattttgaataatttctatcaaaaataattatttattcataaatattttaatttaattgcttattttttaatcaaagtatataaagaagaaatattcatgaacaattcaaaaaaaataaatttgcaatgaagttattttaaacctaatcaaataatattttattattgctgtaaaaagatcaatgattattttcatataatcgtaacaatacattgtacttaattaaataaatgattatttattacaattactaagtactagagaccggaccgggccgggcccggtaccggtttttaccgggcccggaaaccggaaccggtgatttttggaaaaatccggtttgaccggttttccggtttgaccggtttttgagagaccgggcccggaaaccggtcgttttttaaaatgcaacccggcccggaaaccggccttttggaccggttttgaccggttttataatcaagccaaaaatgtttctttttgttcatttttctttgaaaatgtctttttggcataatgtttttaatttttttttgtcaaatgtcnnagtgaattttttattcctaaatgttgcttctttataat

SEQ ID NO: 8704 - DNA, 3327 bp, Heterodera glycines
gagagatagaagttgaagaaaaaggatgaaagagatggggagagagaaagaaagagttagagagggaaacgggagagaattggaaagagagatagagagaagagtgatagagagaaaaaagtggagggtgagagagggggaatgagagataatgatagagagagagtgagggagaaagagagatggatcgagagagagagggaaagagatggagaaaagaattatagagagaaagagaaggagggagagagaggtgggatgagagagagagagagagaagagtgattcagagagaaagagggagggagagagagagaagagtgattcagaaagaaaaagagatggagagagagagagagatagagagagagagagagagagagagataaagagagatggagagagagagacaggggaaaaggagaagagagagagagagagaagttggagagaaaggaagaaagagatggagagagtgagagagagaaaaagagagaaaaagagagagagagtgaaaggcgagagagttgagaaagagacaagagtgacggagagagaaagagaaggagggagagagagagagaaagagagggagagagagtgagggggaatgagagagagagaaaaagaaaagtcatagagggagagaaagagggagggtgagagagagagacaaagagagatggggagagagagagataaagagagatggagagagagagagggaaaggagaaaaaagagagagagagagagaagttggagagaaaggaagaaagagatggagagagtgagagagagagagagggaaatgggagagaattgagaaagagagagcgagagatagaagagtgatagagagagaaacgtggagggttgagagaggggcaatgacaggtaatgatagagagagtgagggagaaagggagacagagggagggaaaggagaagagagagagagagaagttggagagaaaggattgaagagatggggagagagaaacagagagtgagagagggaaacgggagagagttgagaaagagacagaagagtgatagcgagagaaaattggaggcttgagagagggcgcatcacagatcatcatcgagagagagtgagggagaactatatacagagagatgcatatacagcaatatggatagcatatcggaaagctttattcaagctatattaacaagcagaatgtcaaaacaaatttatggtcaaaaagttggaaaatttggttttttgaactcttctgatcataacttttttaagccttaataaaatttttcagaattttgcaggctaatagaggacacttagagctttcgaatgatacaaacaaagttgaatttagttgacaaagaaaaaagttatagccaaaaatatgctggggccgaatcgtgccggggcgaactgaggtagaccgtgttttacggctattctctacgtgtcttatttgtttttattaaatcatattcgttatctttttcggtacaataataaaattgaaaaatattaatatttgtcctttagaaatggaacataaaattcgatgtataaattttttatttcttaatgataatcatttctttgtcgctgcctctaccgtcattatattatttttttgttaattatatttactaatttattatttacagccattttctttaattaatgaaatgtagagaccggaccgggccgggcccggtaccggtttttaccgggcccggaaaccggaaccggtgatttttggaaaaatccggtttgaccggttttccggtttgaccggtttttgagagaccgggcccggaaaccggtcgttttttaaaatgcaacccggcccggaaaccggccttttggaccggttttgaccggttttataatcaagccaaaaatgtttctttttgttcatttttctttgaaaatgtctttttggcataatgtttttaatttttttttgtcaatgttcaagttgaattttttaattctaatgtttgcttctttataattattaaataatgtcttttttgtttagattttatgcaaatgagtcttatttggcaaattggcctatttaaaaaaacgtccaagactacagcaatttgtctcgagtgccaatcaaatgaaaagccgaaatatgaattcaagctcaccaaaggaacggtcaaaagcttgcacacccatcttcactgctttcacgaaaactccgaattctctgaaaagctgaatgctcttgaatcgaaagctgaaaaggagaaacaaaaacagaagccaatctcagactttcagtcgtcctgcggaccgactttttcggactgtaattcagccaaatttttttaaattatttaatttttgtttcagcacaactctcctcgtttgataagaaaattcttcattttttggtgacaaaaaacatttccttcggcgctgtggatcaccaaacttttcattctttatttccccatcaaaaagtgaaaagtgaaagtttctataggtgatgagttacattaaaagttatgagaaaattacatttttgaaattttcagaaaaactgccttgccaattgtttaccaacgtgtcagacataaaatcaaagatgaattaaaagaatcagcatttattacactgacaactgattgttggagcggaagcacttgcaaccttctgtggtacattattactttgtttattaatcatcatgggttttactgcagcctaaccgcgcactcaatttctaaatggaagtctatgtcacgtgttttggcaattacggaattttctgaatcacacacagggaaaaatatcgcgctcaaaattgaggatttattgctcaaatggggtattcctaaggaacgtgtgcatgcaattatctcggattcagcagccaatatgaaaagagtgataatctaattaattttctttacacttgctcttatttgcaggcatttgttgagagggatgaaaatgaaaatcgaattttgccgatgccaaacggaccttgcgctgctcatttattgaatttggctgtacaggaggcgttgaagagagatgaatcaatcagcagtttattggccaaaactcgtcatattgttggccgtttcaagcacagtaacactgccttcagcgaattgaaaaaaattcaaaaattactcgatgccccttctcatactcttttgcaggttaaagttaattagaattcacttaattttatttatttctaatgtcattcagatggtatgtgtccggtggaacagtgcgcttacaatgtgtgagaggctgatagaacaaagggcggcaatcacacaatatgcagtcgacaaca

SEQ ID NO: 8705 - DNA, 766 bp, Heterodera glycines
tgaggtttaaaataaggcggagtataatttaaatgctctactgagaagagtccaggtgtatataagccggccaaatctttgtttcttgtaaattttaccaaatcattctcctcactttctcaccacctcttgccatggctattaatatgagtgacaaaaaatcgttaatcaaccaaattctgggtgaggctgatttgaccattagcacgagcggcataacagtgagcggaccccgtctgtcaaccccccgctttattccttttgatgagagtggccgatgccgctcatgtaaagctacagaggttgaggtagacacaatgacaacaaaggagggtatcaccttgtggtgcacccgagtggacaaaacgcaattcatccctttcgatgtcgtctatgatcttcctgggcattgcttcttccgtgtaaaaaataaagcgagagtgttcaatgtcccatacagtgatctatcctctgacacaatcagcaccactaccaccaccacaaaaacaacaacatcaacccaaggcacgcagactgaggagcaggagttgaagcgtaaggccaaggttgcgcttgacttggtggaagcaggactattggctgacgctatgcaggacggcgcgcggtggaagaaagcaaagactgcaattaatgtgcttggcaatcttttgttggctgagtcgttgagcaacaacaacaacaacaacaaagccgacaaaaaggatgaaccccctgtgaacggaccatcaacgcaaccaattgtcaa

SEQ ID NO: 8706 - DNA, 4487 bp, Heterodera glycines
tcacatcatcatcaatttgcggtggtttttgtcactcaaaatttatttgagcgaaaaatcaaagttgctcgtctgtccgcccaatacctcgtactgatgcgtgcccctaactccctgttgtctatacgcaatatcggagtacagcttttcccgcgtcagcttgactttttccttgacgcttatcgcaaagcgacagcgcgtccctatggctatttgctgattgacatgcacgcttcgtctgatcccgcgttgcggcttaggacaaatatatttaaggatgaacaagacgaggatgagggaacagtggtgttcattcccaaaaatggggcaagttaaaaaacctcaacaacatgtaaagattggtcaactaataaaagacaactccaattggctgtgtgccctggcgaggacgaaatcccagaaaaaatgtaagaagttgatactcaaagcaaacaccgaacaactacttgcactggtggaaatttgtttgaatcttgtagcttcacggttccaattgactacccgtcagacaaaaagattaatgccatatgtgcacactgttcgcaggatgagtagggcgagaagtgagcggggcgccaggcgtgctattgtacagaaaggagccggatttggtggactattcgctgcccttttgacgcctgttttgatcgaattagcaaaatctgttgtatccaaaaacgcataaataccgcgcagtattgtatgtttcatatgcattcatccaataaatggcaaacaaatttgttcttatcccgcaagaaatttaccgaggtctcacctcaatgtcggagacgggtgacattaatttggatgctatacagcacgacttggtccgttccaggggtgaacgaacacatccctccacaaaaaatgtgcactacaaccagcagcttaggcgctatttaaaaatgcggagggagcttacagataggccgtcaaaagttgagctgacgaaagggataagtgtgctgttaagaagaggtggagaagatgaagatggcgaagttgtggacactccaccccgacctcccgctccaccacctcctcctccaccgcgtggaccaagacctcccgctccccctcgtccgccaccgcctgggagacaccctccgcgcggaccaagtcctccagctccaggtccctccccgccaacaagtcctccaccgcgccccgaacgtcctcccagacctagtagagcttctcggagaggtggtcgtctggagaaatggtggaaaagtcgatacaatatacagcgacggcagccggtggtgcgggaccttctagcagaagcagctgctgccccattgcccgaaagtgacgatgaagatgactatatgttggagagtggattcgcgctgccagcgccgtcacagtactatggcgatttgcctgtgctaccagacaatgcgaacgaaattgaggagatggacactgctcagcacaggattgccaccagaagaaaattacaaaaggatgaggcaaatgatgatgatttacgaaccaaaagatttttggtttatcaccgttcacctccacggctcccatctccgcctcgatcgaaagaaaaaactgaaccaagaccacctgcaccgcgtcctaccgccaagagagaaaaacaacaggcaaagctggattggaagaaaaccgaacaccctactccagcgcctcgggcgaaaagagagccagaacttaagctggacccgcggccatccacgtctaggcaagccgggtacttccctccctaaacgccgaaaatcaaaccaaaatatgagcaccaaccaacaaaaaggcccgtaccataccgtatcccggaaagagaaccaaaaattgaacgaactccacagcagcagcaacctcctcctcctactgctgtcgtcgaagaaatgccctatgttcctccgcctaggagggggaccaaacgcccccaccccgtaaatgatgagaatggtgaggtgcacataagaaaacgggtgaggcaaccgagtagggtaagggtacagtattcgccagagccaggtccatcgacatcagcacaagcttatgaacaacaacgacaacaacgtgaactgtttgccattccgtcaaatcagctgaccaagacacagagaattgagcgattatacatcaaatgtaaccattatgcggatcgtatgggcgttcggggaaatacaattaataccgcaaacggcaaaccgtttgcgcatagcaatttgcgaatgaccatcaagtatataatagaccggagagcgggcagccccaccattaaaccaccaggagcgaacctattggaagagcttaggcaggacccaattttgtattcatggacggccccaccaaagagaccatcgcagacccgaacggaacgggcaatcaagaaggaatttcgcccgaaaaaatggagctgatcaacaccactcttgacaaaatgtacaatgatccatcatccccagcggcattcgcaggtgttacagcgctgtggaaagaggcgcgaaagaagattaaacatttacggaaaaaggacgtacagcattattttttaaaaaacgccccgcttccgtaaagatgaatttgtgcgaatgagcagagataagggacaatttgagaagggatatttaccaaattatggagacgaaattctcgagattgatgaggtgttgaaagcggtgcgtccaattcgatacaaattgcgggatgaacatggtgagaaattcaagggcagcttctatgagcaggagttggcaagcgtgagaaaggacgcagagacaagctaccgtatcgagaaggtgtacaggaagaggaaaaaaacggacgggaccacagagatgcttgtgaaatttattggctatcccaatcgggagtgggttcatgagtcccaacttgtataaaagcgttcacatttttcaatatttatgcagataaacaatcatgtcaaacagtttctttgtgtttttgcctagtaatgtgagtgattaccctgacaatcagccgaataaattccgtgttcggctcccaaaacctttagattttaacggctcgtgggtgtgcggactgcacagtatcagttacccctactcatggtcaacattggcacattggatgagcaatggattgacattcacttcaccgaccgcagagcgaccgatgaggacagacagcgagtgatcagagtgccggtgcctaaggcatcgcatagtagggttgaacaactgagagaatttttgtctgtcactttgaggaatcatagcggtgcaaaactacaacctctccctcgtgaggtggaagagaatcggaatcgtactacaacaaagcctctcggctcgccaccgcctttgaaaatacagaaaagagatacggtgtttgacgcgaatagaaaacagattggccctcctccattgcataatgaaaatgatgacgatgaagaaattattgaggagtcaccacctcatcatgaagaagatgatgaagggccgattgaagagtcaccacctcatcatgaagaagaagatgatgaagggccaattgaggagtctccgccgcattacgatgaagagcaaaatgatacagtaacagctcctgtcacaccaaaagtgccggtacaagcgcctgtcacaagccctgcgaaaccaacaatagtaaaaacgccagttactccatctgtaacaacaccagcgcctcccacaactgcaaagccaccagtaaccgtcccttctccaaccacaaaaccgataacaccgaccctactcctaccacgaccacacctactccaaccacaaagtcaacaaccagccctccacctactacaaccgttcctccagcaatcacaaagccatcaaccagccctccacctaccacaaccgtccctccaccaatcacaaagccatcaaccggccctccatcaacagaaaagccaataacaacggtgcctgcaccgccaaagacaacaacaacaacaagtacgccagcaataagtgcagttcctagcccatctgttaagccgacgattccggtaccgccgtcgtgttggtactacggtagggtcggaggcgctgagcactgggcaacgcgtgctggagcgagtcgggaatgagggggtgccatttaaagaggcgcttgtcagtgagggaaagcgaggaattgataccgttctcgacaaaggaggactaccaaaacagtttggaagcggaaaacggagtataaaaagaaagagaacacatctacctagtcatcagacactaattggacgacctattgtaaaacaggcaaaaaaagcgtattcgatcggacgcttttggactttattaattaaataaatggctttccataaaatcgacaacgactcggtgaactcaatcaccaatgcattggactttttccgtataccctctacaaatgtgagcgtctcatcatcaaaagtgtttgagcttctgcctagcaatccgcttaccgacacaccttaccatttcaaa

SEQ ID NO: 8707 - DNA, 3838 bp, Heterodera glycines
  misc_feature (3797)..(3798): n is a, c, g, or t
tcaaaaagttaatcaaaaatttatgattcatttgattcacttatatttgaccgggctcatttaactcagtttgttctcataaagtgcattagagccaatagcaggccaaagattctaaattctgagctcagctttgaaatcagtatttttgccccaaaaccaaaaagaatttttttttcccggtttatcaatttcaaatatttccaattaatatatgattggtttcgtttggaggcattatttacaatggcaatgaatgagactgggttagaacatcattttaacaagctttccattggatttccctttatttcaatattataagctttggtcagtcagacagctttctaaaaatcaaggacttgaattcgtatttcgtccggtactccttccttctgtgtcctcacttggcgtaaaatgagacaattttcattggttaatcgtcactgctcgtccgtatctgttgcttgttcactttgactttcggcatcttgggcgtttttccgcacgatgaacaagtgccaatgcttcggatggccaagcggtggccaaatgcctgttcacgtcctcatctagtcaattgccgaagatgctctttgcaccaattgagaattcttctgctgtccaatggttggcaaccgatgaacaaatcaaatcggtgattaacaagtaaaaggtgactcaaaaattttttgatctatttaaaagcatatttgctttaaaaaattattcaatgattttcatcaaaaattttacctttttttgcggcacgttttttcaaaattttttaaaacatggcgggggaggtccggcggtgccgataggcgccgccgggaaatttttgaaaatttcagtcaatttattaacaaaatttgtaaaaaatttttaattttttgaaaaaaaaattcaaaaaaatttccgaaaatttccgactttttatcaaaaatttcggaagtcggaattccgactccaaaaatgtcggaaatcggaattccgtgccatccctgttgtggatctcttggtagccaccaaacaatttttatttgttcgtctcatcgagactaattttgtattgcatatttcagttggagaagggcagatccaaatgagccgatagttggcacggtgaacaaccgaaaaacgagtggatgttgttgatgaaacttttgccatggagttttgggtcacttgatcactaatccggcaccatttcgaccaattttccgcactttctactctaacccaatgaaatttggatttattttttcttccaattcttgtccgggattcggaattggtcgaaacggatgccggtgatttaggatcactgtgatcactaatatggcaccgtgaatctgcagaattgtgacggaaaaacggcattgatggccgcgtgttggaaagaagcttttacagtactcaaaaatgcaacgttttgtctctaaaatttcaggacagtctccgcttatgcaagctgccatgagcgacaatttggaggcgtgctgtctgctggtggaggagtgggtagcagaagtcaaccaaccaaacatcgaaggcgaattcacggcactgatttgtgctgccagccggggatatttggggcggaaatgccgaaatggtggacatatgttggaagaatttggaaaaacaaaatgatttgcccattttcggttttaataatttacttgaacggagagatcaagaagtgacaaaagcccgcgagactcccaaccatcgcattttgaaaattgcaaaagacagttccaaatattttctgaataatttatttacaataaattgggtaaatttgaattttcactgcacgaatttcaccccaaattaattttttggtgcctttttttgcgattttggtggcttatgccgggctttttgtgtctttttgacttttcatgccttttccgtcgctggaaaatatgaacaaaatttgtaaataattatgtaaatttataagaggaggaatatttaaaaatatttaaatcgcttccaatatttataattaagagaatgtttttgtctgggcagaccaaccgtcgcccagacaaatcgccgccccgacaaacaatcatcccgataatctatcccgataaagcgtgacccagacaaatccacccagacaaatccacaccgacctatcgtatccggacgaatcgtggggcagtaacataaaatatatcaaaaaaaaaccagtccataaaatattctaaaaattctttatactcaggtgaaacaatccattcatgcataaccaatacataattagataacatgcctttttttgcacattaattccgacatttctatgttgacttttattatgcttttaattgcattttttggctttttttgaaaaatccttagcaaaaatgcaacaaaaaagaaaaatacacccctaaaaaatgaaccgaaaaaaaatttaagaaaatacaccccctaagaagtgaaaaattttctcaaaaattgatcgccaaaatttaatttttgttttttgttgatatctctctcattttgtgttttgctccacataaactaatccatctccaaattggatatatgaatattttttgtctgtgtgtgaatgtttgctttgcttttccatccgctgtcttttgcttttgacatcatttccttggcccattcattcattgcttccttttcctgttcctgtcccgtccccagctttggcattggcatgctgtacttttcacctgccatccaaacaagctaatggcaaaaaaaatggataggataaaaagcctgcctcaattaatttgtttatatcatacgaaaatatatttttcaaatttttgacccaattttgcttttactcttaaatttatgtaaaaatttttaaaaaattcaaaattttcaggaataaaattattttttgtttggaatttagatttttccatctccaatttatacaagttcagttgctttaaagcaaatttgataaattgtatgccatttttgcaaatattttttatttggataaattttttgaaatgtattcaaatgaaaggtgaaatggttggaaacgtaactgaaaatgaagacattgtaaagaaatatttgaagattcccgaaacaaaagtaaagggaccgttcacaaaacatttctcaaaatggattgaaaggtgattagaataattatttaatttgaaaaataatcataatttattttaatataagtgactttttggccatttgggctgttcttggccaaattaaggaaattgagttgcataattacttaaaaataacagttcgttcaattaaaatataaaacacccatatcagggatgggagccgacgccgtcaaaaaatttcggaaatcggagttccgcggcacaaaaaatttcaaaattttcgacaatcgaaaatttgaattccgacgcacaaaaattcgaaaaatttctacaatcggaatcacattcctgatccattgagatattctatgtatcatggttaccgtggtaggacgtaaaaaatgtcggcattcctggtttcgggaggcccaagtggcatgaaccgaaaaagattgtggcattaggcattaatctggctcaatgtttttgagcaatgagtactcaatgtacgattttgcgtcatccgccctcggatcacaagccagttacggaggcaaaactgggccggaacagcgggtggcaaaagtgccaattgtgttcatccacggaaactcggacggcgcactggcggacggtgccgaggaatggcccaaggatggagtgccaacattgagcactttcaccgcatgnngtacacgacggccgagctgtacgccatcacatacggggac

SEQ ID NO: 8708 - DNA, 1465 bp, Heterodera glycines
aggtctgtaaaataaaaatagcccaaaaatccgcaatttttttctctatttaataaattttatttcatctttttatcatttttttgtaaaaagttataaaaataaaagtgattttggaattcgggaccaaaggggggtgcacatggtttttgagtggaaaaatttttctcacaaaaatcttccaaaaatatgtcattagggctatttgaggctgctgatcactaatctgacatcagatttcagttattagatcgttaagccctcagaatccctgtgtgattggggattctgcctcagaatccttgcgtatagagtgatgaatcccatccccttaaacactcttatgtggatggtgaccatccacttagttaatgatatgtggatgtgggcttggtagtgttcagcgaccgaatacggactggatccgtagtccgtatttttcgatccatgtgtgtttttatggacttacgggttttacgggttattgagcccgtaattccatcatacaccgtgtagttaggtgctcagcccgtaacccttacccttatccgtttattcgaaattgatctctaatagtgatgaagatgcttgaaaacgaaaattttccaaatttgtgaccatgattttgatcgaccacaatactttaacaatgatcaatgcttaacctcaagactcgaccgaaaacgaagactcgagacacggattaaggttttaagacgcgagggcacgaatttctccaaaaaattttggtcaaattctctggcgattatgttcaactccccccggcagattatggcatttttggaaatttttcggacccggctttcgcaattacaatcgcccgaattatgttaaatccataataaacctatcttcattagatctgtgaactgttcaattctgctccgacttcggcgctttgttgaagcagtgttgatctacacggatgccgaacaaatacacatagtcgcgcactcaatgggcgtcacattggcacgaaaagtgatccaaggtggatcggcacatattggaggtgatggtggtgacgagaaaagtgccagccctaacaagtgccatcttggcaatccaattcggcaccgtgtgcacacattggtcggcattgctggtgccaactacggcctctgtctgtgcacggcaaatttggctgtgctcagttcacccgcttgtaacaaggagaccggcttttggacacattctgacggatgtgccgccgccatgacttataaacatcatcaaatggaaagaagaagacttgaagagaagaggcattgtgatgatgggaaaagcgtgggaacagaatgccaaagcaaggaggaggaggaggagcaatattccaccgtgttgcgggagctgaacgcgccggacaaggccaaagatgccatttttgtggtgagtcatgagcgaaaatgcgttcggcaccgtctgtgccaccatgcattttttt

SEQ ID NO: 8709 - DNA, 1258 bp, Heterodera glycines
  misc_feature (163)..(163): n is a, c, g, or t
aaattatatggattaccatatttttctgcgcatatgctatgagaaaggggctaaaaatagcattctgcgttaaaattttgattttgtgaaggtttttagtccatataaatccatatttgggggttttcgggaataaatccatatttcgccatttttgggtttntagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcatttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacacctttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctaataattaggcattttaatgtaattttaaatgttggcacataggcttagaatcgttttattgtatttatattattttaaatgttaataatatcatatttattttttgttaaatttatttaactgaataaaatattgtgtaaagcataaatcgtcgtcattattgattcttctattaaactgtttgattaaaaaaatttttatcctattaaatagttagaaaattttataaccctacaaaaatatgtaaatgtatgttttaagaaaagatcctcgttttttctgtttttgtcactcgccctacgaatttcaattcataaaaatttatgagtttcgctcattattagccttagaatttatgattttcaatgctttctttttgccggcgccgcacgctaattaaaaaacaacaaaaaactagaaacctataaaaaaataatttaaaaatgataattttgagtttcgttcgttggctcttagatttcgatttttcaaaatttttatttgttgaagtctcgccctaaattttttttaaaaaacacactaaaaaacgataagatttttagtttaaaaaaaag

SEQ ID NO: 8710 - DNA, 4884 bp, Heterodera glycines
cttttgttccacaatggcatttttgaacggacgcgctttggcattctgaaattttttcattaaattaaaaagtgtccaataaacgaacaaataacaaatttaaaaagcttttattttttattcaaaaattatggtttacgaaggactcgaaattggccttttttttactattcttgaatgtctaaaataaggcgttgaaggaggtccaaatagtttgaaaaattttcaaataaataatggcaaaattttatgaaaagtggaaatctaaattgtgcaagatgtgccaacaaatcgtaaaatttctaaaggggggggggtcaagaggcaaaagggggcaatattttaatttttaaaaaacaatattttttggccttaaatttcttttgtgagctgggtagcccaatgtagaaccaatgactcgtcttttttgaattcggtctctctgcagtctcgagaccgaaatcttttttacaccaccaaaagattggctttttggcaaaattaagaaataaattttgtttatttgaaaatcggaattttcgaatttggttatattcaaggctttatgcctttttttgcttggttcaattcccttccaagtagttgattttagctctttatgttttgtatatttttgaaaggattagtagtttccttaaaattttcaagaaaataaatagacaaattttgatgaaaatctgtttgttaacaagtcggccaaaaatttctgtctctctttttctcacttcaattttttcctcttacaagaatgtcctccacccgttaatttgattaatttacaataaatcacttttttcgtaaaatttttaaaattcttttttttacaaaattttcacaacaccatacacattaaacaacacagcacttttcatttttgcacagcacgcattcgaaataattgattctcacgtggaatcagatcagcagtccatttccgtggttcaggaaattattctttcaaattttaaattttttttttgaaaatttctaattttcatcacttcgggcaatggagcagggtcaccgcaatatggcaacggaagaccgtcaggcccaggtggacagggcgcctgaaaaagaaaaaattttcattttttttttgtggatttaagtaaaatgggcatacatcgaggcctggcaagccctggaaaatgcaaaaattatttacaaaattaaaaattgattaataaataaaaaagtaattgaaaataattgggttcaaataaaatataactttttatatttgattaaaaataattaaaaatatttaattaaagaatttatgaaaggaatcgcaaacttttctattaaaatttattatttattttaaataaaaaaaaagtaacaaatttatttttaatttcctttttaaaatatctgtaaaaaattagtctttactgatataattttccttatttttatattattattaatattattttttaaattcttcaatatttatacaaattaaaaaaaatattttcaatttttattttatcttttaaatgcattttgatcatttacctggtcaccctttggccctctgtcccctttggtgccgggtgggccaagtgggcctgtgtcaccctttgggccgggcagaccctaaaaattaaaaaaaaaatttttgaaaattttttcgtacaatataaagaagtaaaaaatggaaattttggaaaacacacgtgcaaagagaaaatttaaggaaaaatatatatttacacttctcccatcgacgccaggcggccctcggagacccattgggcctgggaggcctagaaaatatgtaaaaaattatttttacatattttttcagctacctggcaacccaagagttccttgtggtccaagaggtcctgtagaatttttttattcttggtttttagttataatgccaacctggtggcccaggtgggcctggcaacccgggaaggccaggcggaccctaaataaaatgccaaaaattaaaaaaaaattgcattttatgagtaatatataattaattaccctcgggccaggaatcaccatctttggttgaccatttcctgtgaagacggtcggagtggcaggaggcgccttggatttttttttagagatttaaacattataatggttgatttttataaaaaatttaggtttttgacgcccatgaaaaattctgttatttttaaaattatttttgtcaagacattccttggcattttgttcatttgaaaaggatttttaggcaattcattggatttcaagaaattggcagcaaaaaatctctgagaaaaccctaaatatggttccaaatcgagataggaggccaaacccgatggaatggatttttggaaattttcttctttttttttacgggttgtccaggcagcccgggtaggccgatgtcaccgcgttcgcccttttcaccgccatggccgggcaggccttggagcccgggcagaccgcgtggaccaggcggaccgggcacagtgtgaatgccgaacggatgctgggaaatatgttttataattagagacgggaaatttcaaatttatttatttaaataatttctttatagttatggctgggaattatattgattataattctcaaatctttttaaatatttacgaccaaatgccgaaattttgaccattgttctaaaaattatagggacttcaatcccgcgagatcccgtgggattggccaaatggtcgggagggatcccgattcgggatcccgaccgaatcccgcccaatcaatcccgattttggaaaaaatggcccttaaagcttgataccgtaaagcaattaggcaattacggaagtggccccttagaccaagcaagatcaatatagtaaatcttcctcggctattacggtagtggccctaaaattgtttaatacagtacctgagcctggctgcttaggttgcgcaacagttgttccttcagcatgggcaacagttgttgcaccaatgcatgttgttgtcgctgataattgatgtcgtcgccgtactgtgcctgccgctctttgctatacggtaattcttgctcttgtattgctgctcccgccagcagttgtttctggtttttgtggtgttgtttatggtggtggtggtgttgctacaatagatatacgccacaatttttgtgcatgacaaaccacaaaacagtgtgtaaaagtgtgagaaagacagtcagacagacagaatacggaatgccaaaaaataatttaattactgtacctttcgccctttcttgcccggttgacctggcagaccgggcgggcccaaatcgccctggaaaagggtaagtgtcgagaattattttttataaaatttaggacatttttcattaaagcttttcagtccgtaattatcgcaatcaattaattaatagattcaaaaatgtatgtaatcgataattaattatacaaaaaaagaaaaaaagaaaagcttctatttacctatttgttttagaaaaatttattattattttttttttcgcttttttacaaaaataatttaattaaacaatcaatatttttagaattttcgaaaacaataccattttaatccctaattaaatttatttcaaaaatattaaattcgctaaattaaattagaaatcttcaattttaagcgccatcccacccaccttttcccctttgggcccagacggcccaggtgggccttgaagcaatgtgttggtgccaccgccaacatgtgccaacattgacggggccatgcctggcactcccggctcgcctttggcaccctgaaattttaaaattatttaaaaatttttgactttaaaaatcaaagaaatggaaggatagtgaaatcggaaaaaagaaagcaccggcactccatcacgacccggcaacccatcacggcacggctggtagcaagttgccgtgccattgttgatgttgttggcattggatgaggagatgtgatggtatggggggccaagagggggtgctccaggctcaccctaaggccgaaaattttttgaaattaaaaaaaagtggctctactgggtataaaaaattttaagagaaaccccaaaattagtgtatagaagaaaattattcaaaagaaatttaaactttttaattttttttaataattttaaaatttattcacgtataagaaaaacagtttttagatacccgaaaagaaaatcaaaaggctttttgtgaaaattaaaaaaaaaatagaaatggaaattctgagatagtgaaagaatttcaatttttttttgtttgggcaatttttcaaaggctcctcagaaaatttgctgaatgaaattattataaatcatttttacaaattgtgcaagttctttaattaacgctggattaacaaaaaacaaaatttttcatggaaaattcgtgaaattccaacaaaaaaaaacaccttaggccccggaaaccctcgcggcccgacaaggcccggctgtccgatgcgtccgtctcggcctggcaagcccatggaaccctttaaaaaagatggacagaagaaagtggggaagaagcactgacagaacacaaaagacacaaacaaattaaaacgaaatgggtaaaaaaataatattaatagaaaattattaaataaagaaatatttcctaaatataaatttattttattatttttaatacttaaaaagaatttttctaaattttttgtttttataaaaatatgaaattattttttaaattaattagttactaataattttatataattgttgttttatttattattttttcattaaattcatgtaaattttaaagattttttatttataataataataaaaataataattttaaaaggttgaaaatattatttcatgcagcaaaagttaatcagcga

SEQ ID NO: 8711 - DNA, 1373 bp, Heterodera glycines
aaaaaatcgtctaggaatatttatctaacaaatttgtcgggaaagctgtataaattatgggaaaaagctttttcaaggaaaagctgaaaaattttcaatcgcatcagaaagcagcctcaaattgttcaacaacataatgtaaaaaaatattacgcaagaaattatttttagatcctttttagaaatggtgcataaatttttattgtaaatagtcacaaaaaaacttttttttactcgcaatatctaccagttatcatacaaaaaggcaatagttaggctttgagatataaaacaatcgtctagaataattatctcaacaatttgtcgggaaagttgaatacatttcagttgcaataggcatattggctctatacataaatgtagagcaggtttaaaatagaggaaataccaaagattaaaaaattggtggttatgagcttagtctggttggtctggtcatagggtcgcagagagtggagatagatctttttgttgatacatttgaaaaagtagagctagggtagatctattcgaataacttgaaattcgttcatatgtcctgacagccaatcagctgatgataggtccaggtccatgccatttttcggcaacctggatttttcctggacctggattttcctggatttttgtccaggaaatccaggtccaggtctaatgtgaaaaaaatccaggtccaggcaaaaaacgaaaaacctggattttcctggacaaaattttagaatttgttattttaagtgaccgatgtttttttcaagttttcaaaaaatgataaataacttagaaacacattattattattaattagatatttttagaggtttataagcaattaattgattttttcaaacatttttttgattattaaaatgagtttcaaaaaatccaggtccaggtctggatccaggtcccgaggagcctggatttttcctggacctggattttcctggatttttgtccaggaaatccaggtccagatccaggtccaggctttttcaaaatgtcgatctctagttaattctctaacgaaggaaaagccacacacgatcgcatggacaaaacccaatttcgagaaagcatttcgtatcacaaaaaatggtatttatattatatcaccacgagaaaattcagcaaaatttgaaagaccactttcaaggacgttttcaaattcaagaacgtccttgaaattttttgatccgttttctcctttggctttaatagcccaatcaaatgtatatctattggacaaaagaaaacagaaaaaaattcatttaaggactcaattacctgtgtgccttggtcgcctttgggaaataaaataaaaaatatttttaaataaattaattcttaaatag

SEQ ID NO: 8712 - DNA, 1733 bp, Heterodera glycines
  misc_feature (118)..(121): n is a, c, g, or t
ttggctcagcgagcagatttatgtctgaggaacagctgagagcgaaatgcggcagagaagcggccgctttttatacgaaaatgcaacggaaaatattccacgcgcaattcccagtggnnnncggggaaaagaacgaatgtgaaaagacaaagcggaaagagacgacaaacgaaagtggcagcaaaggcaaatgaaaagggaaaatgaaaatgaaaataaaagaaataaaaaggggggggggtaattagggcaattaggcaagttaaaagggaggaaacgaaagggaaaaaaaggatggcaaagtgcgaagtcggatcatccattatttatttgtttgtagtcccttcaacaatggctgtgactcaggcaacaatttttgtgacatcaaaggttggcttaatcaatcaaaatatttgaaatgccattcttactattcttttttggaaataatttctgcctgtttttaatagaaacgaaagaaaacagtggcgagactgagtgagtttaagctgaaattaacgggaggaaggaggcggagcagcaccgacagcagcacaaccaacgcaacgaaagcacaaaagggaagcagaggcagcggcacagccaccgaaacggtgccaacggagacgacggcagcgactgcccctccgacacggcacccgccgctttcggcccccgtctcccctctcccctcttcaagtgctcctcttcctcccccgtctgttgctcctgcttcatcctcaccatcgagccgttcattttctgctgcttcgtcccgtcgttttgcgtctccgtctcccgtccctctcccttcgctgcactctttcgtcccctcgccctctcccccgcttttcccttcctcctctcccattgtctcttcttctgcttcttctgttactcctttgcccctcctccgctcctcctccccctccgtttcgccatcctttgccaattttgtccctttttctccgttttttgccaatgtctcttcttctgagcggaatcgaatcattcagctcctcgccgcccaatcagtacctttccgctttgcttcaatggttgaacagctccgcaaacggactgagtcttccgaaagtggccctgctttttcgttcccttctgatgaaaatcgtcgtcttccttcttcctcttcccttccgccgtctccgtctcttcccgtctcttcccttcccttctccgtccgttctttctcttcctcttcccttccgccgtctccgtctcttcccgtctcttcccttcccttctccgtccgttctttctcttcctctcctccccctccttccgctgcttctcctcatcctcacctttattaccccactgttcctcctcctcccccacttccttcctcttcttctcgccctctttctcttcctccccactatttctcctcctcttcttccttttcgtcccttccctccacactctcttcgtccctttttctccctcccctcctccctttcccttctcttccgtccccctttccctcctcctctccgtgggttattaaccaattcaatgactttcatcaaaaggacgtcccttcacaagcgttcttcttcgaaggttcgtccttcttctttgaaattcaatttttagaattcctttcatttttcagttcttcctatcgatgacatcatttacaattgattttgaattctatttatttatttttattgttattttttgtgtaaaatattttgatcaaatccatc

SEQ ID NO: 8713 - DNA, 1409 bp, Heterodera glycines
gaaaataagccctgatcagtgatcttctgattaatgatcattggccattgtgatcgcttatcagtgctcttttggaaactgatcagcagaggatggaattttgaagcaaatgcctaaatttttggcccttaatacgtagaaataagcacgaaaaaaaattgagttttaagcttctaggatgactttataatgcctattttttgcttattttgattgttttgtgcctaaaatgccatccccactgatcagtgattgatcgttggtcactgatcagttatactcacgggttctccgtttggaaagtcccttaaaatgaatcagaattaaaacagcaaagcattcagtcggctcgaccgaccatctctcgacacttcctcgctccatgcttgacggaatgcctcctttttaaacggttttttgtttgatttttggcacttttcccttccgctccccccatttgagtacccttaaactccaacgatccgctctcgttcaaatactgaatgaccgtctcgcaatctttcgctttgtcgccctttgaccaatccaggagaagcaacgggaaaatgttggatggaaagaagcgacgtctgagtttccgttccgacagatcgaaatcgaaccaaatgccaccggagccgtcacggaaaagagcctcaatggcctcactcaccgactcggccaaaaactcataaaatttggcctttcttaaattcactcagttcgaaaatgccgtttctttcactgccattaaccgtggattttccaaatactctctgaaaaagtgtgccattatccggtaattggccgccattagcacattcaaatccaccggcacaatttcattggtccgaatgccttttcgagtgtcttaaaacagaaataactgaactgacgcaaattgttgttggcatttcaacgcacatgccatttcctcgtcattgtcatcgaaggaaaaccaacgcgtctttttttttgggggggggaaggggtggtaaagaggtaattggcatttatgacagtattttttggcaaaaataccgaaaaatccatgccggactcacaagcactgtaaggggcgagcaaaagagaaactgtgtaatgccacagcagcagatgattagttggttggtcacctgtttgttgaggaccaaatgaactccaagtcgtcccgggaggattccatggcgaagtaataatccaacataagactctcaggacgaggacagttggccatggtctgtcggaagtgcgaaatcaaatgggaagaattcttggccggaaatagacccccccccccctccgaatgccattcgacctcaaccgctgaacatttcgccagcattttttattcttccctaatttaaattgagccactttttggcactcactctgtactggtaagctat

SEQ ID NO: 8714 - DNA, 2519 bp, Heterodera glycines
gcgccggtattatttcggccaaaaatgtttgtcgcccgaagcttcgtaataatctctgaccattagggtgaacacgggaggctgtgaacggcgactaaaccttttcgggaaggggggaggggccaaattggcacaagcttatgctaatttaaaaatgccagctaaaaatagttggcattttgcattaaaaacggatgacgaacacggactgaatgttgcccgagttgggaatgtgcccgcgcacttgcagcacgtgggccatgttcagcagcactccgcgcgccgtctccttcatctgggacagaagcagtcctctgacaatccaaaaggtgtcccaatagtaataccttaaggggaggggggggggaatggcaattcaatcgcaaaagcgcacatttggaccaaattgccggggatgagaaaagtgtacggcacggcgaggaaagggtaactgaacaacaaacaatggcacgaaatgggcgagaagggggggggtgaagcattgcagtgatcagaaacaaatgggaaaagcaacggaccggtcgggatgttcaaagacgtcgtcaacgaaacgccgtgccaattggggccaaattttgtgaattgcggtggcgaacattctgaacccggcgcaaaggactgaatttactcaatgcaattcgacttcatttttggcgatgtgattctgtcaagaaattccaagtcggccgtccaatctttcacttgcgcctcctccaaatacggccgatcgtcgaagttttccttgcaaaagcggcgaaaatcctcccggtaaagccttccctgctgatcaaagctgcttaaaacggattggcatttggcaaattcctctgttcggtgctttttccatttgcttttctctttcgattgttttttgttttgtttttgtccacctgtcaaagtttttcagaatgacttccgcctcaaatcgcattcgattgcccgggcattcgttctgaaggccgaagtaccaagctgcccacataatcgccccttcgcagtaaatctcccggtaatgtccgatacagatgggctccgagcagttcactttgacatggtcacgcgtgaaaacatccgaatctttctgaacatcggtgaaaaatgcaagccatttttgacgagggattggcattttgccaaatgccattctccgaaagaaaagtggccaaactttgtggaagaagaaagttgaaccattgccaccacttgagaacaatggcagaagagagatcaaaagctggaaaaagaaacagtgccgtggcattctgagggaaattggcataattaatggaaagatttttaattgtttagcgaaagagaattgggccaatgaatggcggcacttaagcaaatgaatgagaatggaggaaaagcacttcacaacagaagaagccgaggaaagcatttggaacacaaacattggctttgatcgttcgtttggagtgaaaagaattgaaaattggcaaactctgccgattttgggggaatttttgtcaaacaaaatattgttaacggcaacttttttactcatccgacagacacttcttccactaaaacatcaaataaattgtccaagaaaaacttcacccctcctctccccccccccccgccaattagtttcttaattcaattagcaggcgtaaaacaataaaaaaatgagttaaaccaacggcaatttatcaaatataaatatgaaattcaaataatcaagcgattgtcgtataatgatgggtcatcttcaaattcaatcaacttcagcatcatcatcatatcttgggccaatttcgccgatgttcagccattcgttcgttggcacccgtgccgtccaactgaggtcggtctgtgccgacaccgacgcgcacagcgccgcctcgtccatccaacaaaattccgagtcaattccctcgtgggccagcaacaattgttggtgatccgttggtgttgggtaatacgtttgtgtggcggccgtattttgcgattggaggagcagacaaacgttactactgctgaagggggaaaagcatcaaacggaaaagggggggggtttcaatcttgtacttataaagaataaaaggtgtagagcaagaaaggggcgcgcctgttgtcaaccatgtcttcgttcacttccagcaaagttgcgcgaatgcctgcacgaatcacatagtccacccttaaagacacactgataaagtgaatatatttttttgtttttttgaattaacccatcactgtcgcgaatgatgcaaatgcgtgtctgcggcgacatcggaagaccaccctaaaatgtgcgattaaaccggtcaaatcgaagaggtatgccttttttccctttccactcggctccaatttgctacggtccacgcctctctttcgccctttgctttcattgcttttgaccgacgaagtctttgccaacgacatgtcccacaacacttgggcaatgtttttgcactgatcccgcatcaacacatgggcttttgtccaacgtcagcaccacaact

SEQ ID NO: 8715 - DNA, 3042 bp, Heterodera glycines
  misc_feature (2696)..(2696): n is a, c, g, or t
  misc_feature (2894)..(2894): n is a, c, g, or t
  misc_feature (2946)..(2946): n is a, c, g, or t
gtcattagtttatgggtgagttcaaaaaattataaatttcgtttataacctaattttaggacgacgagtatggcgaggttctattattggaattcatgagagaagcggagagccatggcggggagattttgtacacggacacggacagtatttttgttaggcacgatcgggatgtggagccgatcacgacggggaaatatttgggagaaatgagcgaggaatacggcggctatgagattgaagaatattgttgcggaggggcgaagcagtacgcactgaagatgagaaacaatcagacgggggagatcgaatacgttatgaagattagagggattacgttcgatgtggacaacaggaaaacattgcactacgacacattcagggagatggttctgaactatgggaaaggggaggtggacccggcattcttcgtctataagaatgattttgggtgagtttttaaaaattatttgcttcattaataaatcaatatttaggccgacaagggattcgaaagtggtgacgagggagaagcataaaatgtacaggccggtctgccagaaggggatcatcgatgaggagcttaatgtgatgccatttggattttgttaattttgtatttttttttgttaaataaagttgaataaaaattaaagtgatattaggactagcggggtggaacggtctaaagtgaaggcccactcctgttagccgtaatatttttataaaaaatccagcagttcaaggggaaaatagcatctatgaccgttattctggtacatagttatacatgggagttgagggaattgtagcttgacacggtgtctcgagtagagatgctgttcgacagtaaccccgaggaaacctcggtaggcaaaaagcctgttggaacctctaaatgcgatgtcatccggtgagataaactgattgtgcctaaggtgtctcgttattagggcgtgtcttctcaaaaatttcaaattttgtttcttccgctgtcgtagaatttctgataattcgtgaggttcgcaatcgttaaaatcgcataaaatttcaacgagagaattcatttttttgagcaccagtaggcattttcatattcgttgcaaatccttatataccattacctcaccgccgtatgatgaatttttaccttttctctttatttttaaaattctgagaaccgaaatacagatgatgaccactaccaaatcgataattgacaaaaaatatacccaaatatttgaacttgaaactttaattttctcaaattctttgaacacgacaaaattaaagaattcactatttgtgtctgccacatatttgggaagtatttcgtttgagtcaaatcgatctttgtatattttcttctctttaattagataaatttgtccctcaattattagtaagtcggtaaatgatgatggcatagatccgatcggtttagtaataatttcggtgccattatgatgtgtccataaattctctattgtactaatgtcaatctcgtctattcgatcgtctctgattacaaaaagtcgaccatcaatatgatcaaatctaagatccccactgggaaaattcctgacaaccatttcttgactccctcttgttatcgaagtttcatttgtcttttcgttttggaaaattaaataactatgatcgttgtaataaaagcacgcccggggccttaattgtcgaaaatcctggtaaagcttaacattagttggtccgctcttttctattgaattaatttcttggattgataggctccaccctgaaatcagattcctatttatcgtacataatctcgagcgatcgaatccgaattgtctttcatttaccgaactctttgtcatagtgagatacttgtcgtcaaaaagttgtgtatcagaaagaatagtaaccctttctccactgagttgaccgactatcgttaggagaacaattaaattaaacattactgacaaaattcttaactaatatatcggacatcgggcgaaccttatatagaccatcaatgacctcacaataaaggattccggagcaccgttgtgttaaaaaataaatgcaaaattgaccacacgcatctgagaattgatgttggacaatacgttcgttaaagagaattcgttcgaataggttaagatatgaacttaaatcttcattgggataatcgcccaatgaatcaaaatattctatttctgtcggcgaatttacaaaacaagcgacccagtgttcacctattgtgcccgcccggtcagtattcgccacaaaacagtacggaaaatgcctgtccttcaattttggcatcttgtcggaagcaaaaaccccgataaaatattttcgggttgtcggatgtttggatagaaatatttcaatctcatgagaattcatcatatgcttccgtcgctactgagcacacgattagcattaatagatagaatcgaatcaaattcccccagaactatcatctcatacccgccgtcctttataggctcattaaactgcaccttgatgctggtcgttccgtttcgaatcaattcaaaaccagcggtatcctctagagtagaggtcatcgggatgctgaagaagcaccaaccgtcttcaaattcttgtatattgatcgacattgtcctttgatccgtcgctccatgcccgcagctccagatatcacatcgtctaacacaactagcttncgaactgctgatttagtttctcctatcctacaaacttcagagcagcaatatgcggcggtaccgcgtggcgaatacatcgtcttcccactatctgcctatatgcacaccttcgactacgacgcggctagttctctgagctactgatttcataacgcacagacatgcggctcgacgtgctctctaagcgtatgtctctcngtgtaattcacagtctacgcgcgtctgggacacacaaacatccgccgcatcngtgtatacacacgtccctcctgcgacaccacatggtctcgagtatacagaatctattagtgctagagtacgactcacggaagctcgacacctcgtc

SEQ ID NO: 8716 - DNA, 1335 bp, Heterodera glycines
  misc_feature (93)..(93): n is a, c, g, or t
agaggtcatcgggatgacgaagaaccaccaccccgtttacaattttttgtatattgatcgacattgtcctttctccatcgtccatcccgagcnccgtatacatgtcaacaaatgctcgaatgtatttgtttctatcaaaattaagagaatagggtgacccggggaaaatgtttccattcgcttcgacactgatagagcgtattttggcatgttcaaagacgaagggtgactctttaggatttccggtatacgcaccggttgaaacaaacccgacgattaaacgtctcggaacaatgcttgtaaaaacattgtgtgaaagatcagaagtgccacgcgggatgaaaagactcctgatctcaatttttctcataggatatttggccggggtggtttgtagctgattgcttattatgttatttaatgactgggtaacatctactgtttttacataaattctaatatcgtgtatgttaatacgatatgtgtgcgggttcactatgactgcatttccggaaacatatggcggtgccataattagaaaatcatcggtgttacggtgtatgctaaaaatcacgtcagagttattaagcaaaaaattgggctgacgggcgagatcaaaattaagtttcaccattgtttcacattttgcaccatcagcaaaacgtgacgctctgtttttaaagccactgtttgtataatcatcctggtcgacatcgtcgacataatagcaggacgcttcacagagaccctttttgacatcttctgaaaatcccaattcattcatcatatatgccctaaacgcatagtaaatgccggaatcataagactaaacacctgaaattgacacctttaaggttttgacaaagctgtgcccaaaattttgaatgacaccgacgtgttggtcagcttcactgtccttggtaatcggaatccaattgcttttgtcttttctctcaattgaagttgacaaataaagaaaagttttattgagatcgcaaaactgattatctgaaaaaagtctaaagatatatggcccagattgatttattgctgaaagagggagtaattccctaatactggatttattaattgcaacgttcgtcggggggatatcaaacagcgaaaggcccccctcgagaccatcctcactcgccttgtctattttcttaagagttgacattttttaattatttgtgttatttgttctatttatacctttaaatgaaacttaactgatcaaatacccgttttcgattcttattagtgatcagggccttttttcctttcccacattatgtaacttgtcagtaaagttagtcaacccctgtcttgaat

SEQ ID NO: 8717 - DNA, 7026 bp, Heterodera glycines
  misc_feature (2447)..(2447): n is a, c, g, or t
  misc_feature (2461)..(2461): n is a, c, g, or t
  misc_feature (2502)..(2502): n is a, c, g, or t
  misc_feature (4772)..(4772): n is a, c, g, or t
atatgtaaattaaaattaaataaaaataataaataataccccccctcagaaaaaaccaagacattaggatgaaaaacagaaagtggaaatagttaaaaaatatgaacaaatgaaaaacgaaaatggcaaaatgaaggacagcgaaattgccaaaaaactgaaaatttgccctggaaaattattggagctgagaaaggaatttcagcctaattataaaagtaacggcggaataaattaattgtttttaagtgatgactgatgactcatcctaatttattttccattttctttcccttttttaaaaagcgcgtgctttttcaatggaagaaaaacaaaaatttattcaccaatttgacaaaataattggcaaaaaggagcaacaatcggtgggacgaaaggacaaattggaaattgctgaaagggtgggcattaatttgagaaccattgacaaatggaaaagcgaaatgggcttaaaaggtaaaatgggaaaaggaatttaaatcatattatttaaaattttaaatgaaaagttacgaaagaaagtcaaagaattgcccttgtaaaagaatactacagaataaaaaaggaagacccaaaagtgccgacaaaagaaattgccaaaagtttcaatgccagcaaagcgacattattttattggaaaaaacaatttgacaagaataattatgagtcatcatcatcaccggatggaccggaacaattaagctggtaaaaagcttctgcatttggattcccgttcactgcccgcctctctaattatccccaagtcgaaattccgtgccatccctggttcggacggactttctgccatggaaaaattttgtgttttttggcagctttcttccaaatttatttcacctatttttactccaatctttgggtattgtaaaatttagatttaaaaaagaccaactgacggcttttttcttacgtgacgaagacgaagtgctgaacaaaaaaaaggaatttgtctttttatatttgctcaataattttcaccttttcttcggtttcgcctatttgaactaacggcacttctcactttcaccgattcgtcccaaaattttgcttaaaagataagggagacacaattaattaattgaatttaaattatatcaataaatgcattaaaataatctctttttcttaaaaaattaaaccaaaaaaccaactaaatttttcatgtccatttaaaaaaaattttaatccctcataactttcctaaaaatgctcagaaggcaccaaattttatcattaaaaagacagggaaaagctaaaaataaataaataataaaataatttttttttgaaaagctttgaaacattctttcttctattcttataacaattcatctccaaattttttcatccaattgaaaatattttgatttgaaatgttcaaaatttttgcaatttccttttcacttatttttggattttcttttttttattttccaataaattttgattttttccattttttctttctctgttattttattccgaatttcgaattgtttcatccattctaattattttatgaaatactccgattttcttaccaatttcggcataattttggttccattcttttctcgaatattttcttttttattttttgcttatattcgtttgtcagttttctgagttccaaactttttagggcacagattagatttaaaatttttatttttacaaaaaattcaaaatgcgtttgaaataacctagagccacatcagctaaaagagagagtaagtggaaatgaaaaagaaatgaaaagaaatgaaagggagtcattagaaatttgtctcgcataccttccttatttggcgcccccacaaagtgtccaagccacgaaatgtccaaaagagtaaaaacccacgaaatgtccaaaatttttcaaaatttataaaaacaaaatgagtctaatttaggatttttagggtttttcggggtcactgaatacgaatataacctttatattacccgttgcctaaccttaggcccatccgaataataaaaaactcaaattcgagacttggacattttgtgggtcagcgccttatttacataccatcttttattatacacggcgattcaattttgggctccaagtacaaataagtttattatttatttagtaatcagaacgccaaaactttgcaaaacttaaaattttccggggattttcccttgcaaaagcacaagagccgatctcgagttagaaaatatactttcaaaaaacaaaatagaattcgatagagggggtcaaactatgggcctatgcaaaatttgaagaaaatttgaacatagggaaaaatttttcaactaggtgaaattttcaataattttaattcttttttagccaagtccacaatttaagggccaaaccaaataaaatttacaatattctccagaattttcccttncaaatgagcataanatggttttatttgctctagtattcaccaagttataagctanaaaaattccataaaattgtcgatgctgtacgtaactaactcttattgaaaataattttttttgacacgaaaacttttattaataaaaaatatttctgcattcttctttaaaagaagaaattgaaattaacacttgcacttggagatcaaaaccaaatcgaaagtgattgttttttatttgtgtgcatgttttagtgaaaaatacctacctaaattgttttttcatgagtgaaaggggatgagatttgaattttgttaaaagtcgaattgatgatataacaaatattttgatttttcatttgtttattctatttgcaagaaaggtaaaattttgtgattttgcttcttaaatacggaaaattaattttctccctgctaaagggttttatggatcaattaatgaaattttagcaatttttagggggtgtcgtaaacatatgaccatgactatccatgagggttttaatgaagtgaaacaaggcccgaagcagccgagaaccccccccccccccaaaaaagacaaggaactctaataaataagaaagaaatgctgtaccaatagaaaacgctaaatattttgaaatagaaagacgattaaaatgataaaacacaaccgtccgctagtaataaaaaaaggaggtgattttgttttaaaaaaattttgtgtcaattcaaggtgcaaatcgtacaaattttcaaaaatttcactgtgctgcttgttggcaaaattgcaataaaagtgttaattaattatcgaatgaagttagtgccgcggaaaatacttggattcaatggacttcctttgttgggattgtctcacggtttttttgatcttgatcccgaacatcattttaggccgggctcatgcccgaggcgccttaaaaaaagtttattgaaaaagtggattttttaatgtaaactattaatattcaataaattagtctaaatatgtctattaaataaatatgcaaactcgaaatcaaattctttgcttgagtatcaacctatgtttcagctggtcgctctttttgcggccaacggacgccatattttcattctttttcaatttaattacacaaaatttattgttttaatttgttcaccaatgattttctgaaaatgaattcttaattaaataaaattatttttcagcaaatttttcaatcctttccactggtgaatcatttcgtttctgtttattgaaagcatttgatgaaaattaatgtatgacaatgctttttttgatttatcgcttcgaatcgtcccattttatattcatttaataaacaataattattttaacaaaaaatgttaacattttcaaattttatatttttaatgtgttagtagacacatgaaaatagtacgcgaaaatgagagagaaagaaatgcaaaattttcatcactccatttttttttgctcttaaaacccctgagattttcttcgtgattttttcactatcgaaggaaaaagaaaaattcataaaaattgttcttcttttacaatttccaattttttgtgttcttctttctaaaattttgggtccggattggaatgagaaaaatatcgtggttcacgatccaggtcgtgatgagaaaaatatttgatttcaaatcggttttggcagaaacgcctgatccaggcacaggtattcaaaaataccgagccgagctttacaaacaatggtttcaatccaaagtgctaattcctatatatacttttttattttcccctgactttccgatgacaccgaaaacttaaatttcatattttctgtaaaattccagcacacaaaaaattccaaaatgaacgcaaacaacaaattgaatatccgtagcagcagccttccagcggtgcgtctgctggttggcgttttgctgggctttttcatggcattggccatttctccatccaacggttttccacgcgctgccgcacaccaaacgaaggcatttgccgaacaaacggttaagatttttttttttgctgtttccacaagaaaaatgctaagtttttccttattactatggtcgcgatttttgttacgaaaaatctcgtaatagtaaactaaaatagtgaggaaaatgccattaactattttagtgatgaagagccaaaatagtgatttctagtgacctgtttaactcagttgggccggcacgtttgggccccagcatgtttttgcgctaaaacttttttctgtcgaccaaatccaacaatcttggtatcattcgaaaatgtaacatatttagaagctatttctaaagagngggttgcaccccccgaccccgccccgaccccgaaccccgacatttttggccatttttcggggttaaccccgacccgaaccccgacgcttccaaccccgaaccccgacccttaaccccgactcggggtcggggttaaatatacacccctaagaatggcatttttgtgagagaaagtcaagaaaatttaaacaagttttgaatttttgaaccattttgccaaatttttattaaataaagaaaatttgctttcttatgacatgtattgtggtgtattggttagtgcatgcatcacactgacattactgtctttcataagttcaataaccattgacgttctcatttttaatttatttttttgtgattaatactagagttcgggtacggaccggatccgtatacggatttttacggatccgtagtccgcattttttgggccaatacggatttttacggactacggattttccggatttttagtccgtaatccgtatgggtgcctagtccgtactcttggtccttatccgtattttctcaaaataccgatctctaattaatacattttttaaacaaaattatcaataaaaatagccattcttggcataattgttaacagattaaacccaaattttcaaaaaatttttactttcgttgaaatttaaaattcaattttcatgactaaataaatcatgaaaacaatatatttcaaaatattgacaaaatatcgaaacaattaaatttcaaaattcgcttggccgagtccaaaaattcgtaaatcttattaaaaaaattggctcaaaatcgaaaatattcagcactttttgggcaaaatctgttaacagcccatgcaaattttcaaaaattttcccggcggcgcctatcggcaccgccggacccctttctcatgaaaagtctttagaaaaagcgcgccgagaaaaaaagatggtttgaaaaagaaaaaagtaatcagaaatttttgatcattttttgaataagattcacttttttcaaattgccggatccgaaaccggtttccggattgggaaaaatttaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttattataaaaaataaataaataaatataaacaaataaaactttattatggaaattataaaaaattttgactatatggcataaggtaaaaatttaaaaaccccggaacccccgaccccgaacttgctgaccccgacaaccccgaaccccgacttttctaaccccgacgttcgggggtgcaaccctaggaaaaatgtttgaaaacataattttgaaaggagagcttttgagggttttcaaaattccaaattcgatagtgccttaaaaaaataatttttcattcttctaaatctgaaaaacatttagtctagtggctataattattcgtgcattacagaccttcatttgtgagatttggtttttaagcattctaaactttttccaaaaatttttagagctataagactgtacttgttaatacaataattctaaatgagtcgaaatggatgtcagcaaaataagtttcctgggtgtatttttcaattttcttctaatatgtaagatatgtttttatgtgccaaactgtcaaaatcaaaaatagttcggtgaaaatactatttttgggcttatctcgccaagattaaatgacaaaaaattttgtaaaaaataaaaatccgggctctactcataattagagatgggatttttaggttttacctattttttttttgcggcttatttgttagtatgatgagagaagaccaaaaatagcattttctccgaacaattttcgatttagagcgactttttagcacctaaaattacctaaaactggattttcggtcaatagcacctattttggcatttttcgagttttagcacctattttggccttttccagaaatttcatagcaaaaatgcaataaaaacgaaaaatacacccctaagaatcgattccaaaaaattttaaaaatatactcctaaaaattgatcaaaatttcagaaaatattcccctaagaaatgaaaaattttctcaaaattcgtctgcaaaatttatttatttattttcttgtccagttgcaattgagagggcgaaattgataaaaaaa

SEQ ID NO: 8718 - DNA, 1903 bp, Heterodera glycines
ctgtgtactcactcatgttctcttacatttttttaaaagaaaagaaacggatggaaaaccgaaggcatcgtcggccgcaacaaaaagcgtcgtcgccccaaattgttttccccatttccatttcccctttctcatcatggcgattgccccaaattttgttgttgttgctgctggcgacgttcctcggccatgccaatgccatcgccgacgccggaccatcggcaacggcgtcctctgccatgggcaacaaattggtcaccgcttcgttggacgccaactgggcacacacttcgctggtggccgagacaaggtttgtttggctgctgcgcaggatgccgtacttttttgtaaagcattgggtgccatggaaagaaaaaaagtcaacggggcagggtttacatttttgccacgcaattttcaaaaaaattattcgattggcccatcagaaaatgcgtttttaattgcttcaaaatttcataagattttctctcaagactaacccccacacacgaaataaatctttttgaaaattaaaaaatcccattatttaaaaaatgattcaatttttcagaaaataaataaatacatatccatgggtgtttgttgcgtttcacaagttttttttgccattttagtgaatttcttgcttccgccgacaattcggcgttttggcgcttcatcgacgcgttgctggacgagcaacatcgctcgggcaatggcaccggcacaagtttgtcctgctcatcatttccaccattttctaggcgaattcaaatcgatttcttcatttttttgagctatatgtaccccttttaagatgattttttggctctaaatttgactcagggaacttgccataatttcatttttgcgtatttgtctcacaattacccaagccgaggcatgctcgtatgtgttcgccggaagccaaaaaagctatttttgtattggctaaatttaataaaagttgcgactgggaaatttgttcatatgcctgttctttcaaaaattttgaaaaattaccagcgattttttgggaaatttttttttgaaaaacattaactaattcatcatgaaattttagaatagcttgtaaaattttccaaaatttttttccgttaaatttctagtttgaatttttttgttaatttttttgacggagttaaaatgagctacttcctctattttactcctcaaattgcttgcgtaatctttttgtgtttcccttttctacagctgtcacctcctcgccaacaaccgcaaagtcggtgacgacaacaacgcacgaggccgagctggacatggcgctggcgagtgctgccgcagcggcacaactgcgccacgacgacgacagcgacgcgggcagggaaagtgacgagggtggcggcgatggcgaactgcagctgctgcgcttcgcgctcgcgctgcgcctgcactcgccgcgcgtgcacctgcaccggcaaattgcgcgcgacgtgctccggcgtgatggcgccggcgaggcggcgccggcacagtttaaggtgctgccggaaattttattttttttttgaaaatttgactatgatttgttaacagatttttcacaaaaaatgaccaatttttgcgattttgagccaatttttaaggaaaatttctgttagtctttaaaattgcaaaaaaactccactaattgtaaggtacaaaaaatggttggccaaaataaataaacaaataaaaccccggaatattttgctctttttctggcacttgtttttcgtggccgcattatatgttggaaaatggggaccaaaaatgacaaaaacctgtgagtcactaaataaatcgaaaaacaaattcaagaaatttctctcaatgtggcgcaattttaagcatattatgcaattttttgtactatttagtt

SEQ ID NO: 8719 - DNA, 4972 bp, Heterodera glycines
  misc_feature (4328)..(4328): n is a, c, g, or t
  misc_feature (4415)..(4415): n is a, c, g, or t
ggcaggtcccacaatgagtatcctgtcgtcttcaaatggcattccgatgctcaacctgccaaacatgtgtatttgactggttcatgggacaattggcgtaagaaaatccctcttgtgaaatccacccacgatttttctacgattatcaatctcaatccaggtcagtgatttcttgttatttattttttcttgtcaatgctttcgttaaggacgttacgaatacaaatttcttgtggacggtaaatggatggtcgatgatacaatcgcaaaaacagacaatcaggtgcttttccgtcgttttttattttggtttcatttattcacagatgggaagtcagaacaatgtgatgtccattgatgaagctgattttgcggtggcttaactttcccttttttcatctttaactccttttccattgttaggttttcgatgccctcgacaaagatttggcctcctcaaatgctggcgaggcaatgcgttcgatgaattcgacgggtgcacagccatcgcaagacacgccaaacgatcgcgagttggaacgtcttcgcgaattcactcaacaattgcccgaccgtcgtgattttgaaaaagctgcaaaccctccaattcttccgccgcatttgcttcaggtaattaattgtgcaacttaaacggaattttgaaacttttataattgcctcattataatctcaaaaaattgttcaagaaacatttacatttgtgtccatcattgtatactagcattacttttgtttgttaaggtttttcttttaatttaacaatatttcaaaaatcttatgccttttatacatatttcgcgctttttaagagttttttgtttttattttatttcattaaccggaaatcaatgaaggattcgccatttcaggttattctgaataaagatactcctgtgcaatgtgacccgaatgtgctgcctgaaccgaaccatgttatgcttaatcatctttatgcgttatccattaaggacggagtcatggtaaaactttcattccatttattatctttgtttcaaaaaagctgttggggaaaaaatttagggaaccatttaaaaaatggcccatcaaattatgattattttaacaaaaccttataagggcggcaataatgctatttatgataggcctactcattttttcagaaaatttttcttaccctattggacttttgaaaattacggatgcaccccaaaatttcgccaggacataattcgccgaagaaatttttttaaaaaaatttagaaattttcaagaaaaaaatcatagaatattttttatggaaattcaaggaaaattattgaaaatttttttaacgatttttggaaaaattttcgaaaaaacttactaatttattataaacttcaaaaaaatcgctgaaaattttttaaattttttttcttgaaattttcttataaaaaattctaagatttttttcttaaaaaatttctaacaataagtttaattatttttgcggcgtaatttcggcggcaaaattatgtcccatccccaaaattaccccaaaacctttttggctttttcagaacaccataaaggagatatctgatcaagtgggtgtaaaagattttcgatcaacataaaagttatctggcgggagtcttgtgactcccggtcccggtgttttgtccaagaaacagggacctgcagtccggcaaaatcccggcgtggccctgatccgttccgggttctaatcatcgactgtatgcttctttgcattttataggcgccaaaatgactcaacttaattttacttaaactttacaggttttgagtgcgactcatcgccatcgcaagaaatatgtgaccactttgctatacaagccaatttaactgataccacctcgaaatgatgttgacggggttttgtattttgtatattcagagagaaaatttattataacgacaaatcaacgcacattttcattcgcgttatgtttatattttgtgtccatcatttcattgtctatttttaaactatttttaagtgggatgtaaattgactgaaagttacaatgagtcacttgaccttattttattttcatgcaataatataattggttcacaaaaaatgttcaattaatcttttgttaataatgagtgcttcccaaagtgccaatacattccgttcgaatgcgccgttggttacaggagtttcacctcatcagggtgggcattggtcgttttactattacttccttttccaaatttcaaatcaaattaattctactgtgtaattgtcaaatgcataggtccacctggcactttgatcacaattcgtggcgaacgatttggagaggatgccaatgacctcgtgcgctcattgcacttttaatgtgaaaatggttttatggagtaggttgccctggtcatctgcggcaccgattgtcttgcgactgccaaatggaaatcctcctccaaaattgtggctcgtttgggcgggcaggcaaagcgtgggcccggggacattgtgatggtcactcgttcgggaggacgtggccaatcggcggttcaattccgagtgttcatcgagcagattgggccgttgcaagagtcagctgtgtgggtggacgaggcaaagacagtgccgggccgaaatttaattcggaatgtgcaggagggcggagatccggaagacgcacttgggctgggcatcgaccagtccgtttcttttttgtcaccaaaaagcgcctcattttcagacaaacgaagacggacatcgccagtctgatcaaactttttcctgatggaacgggcagccgaaagatggaaaatttcagccccgagtggtatttgctggagaattacaaattggcaaggtccctccctctcctccctttttttcgtttttttttttgctttttgcatttctttccatcgcttttatttgttgccatttctgttcagtgtttccgatttgaagcgggggatggccaatttggagaagcaaatagcgcatgaggaagaatgttcgaaaaatgtgcacaaggccaacctcttccttttgatcagttgtgtggacgcactcacttcactccactcaaaaattcagtcgaaatcgaccagcgaagattggccaatcagtgcgaaattggcagaaaaagtgatctgaaataaatataaaaatcatctttttaccgtttgaattctctctcccccttttttccttttaatgtcacttttatacaaaaaaatctgttcttttttatttaaattgaaggtcgaaaaggctgcaaaaacggcggaccgtctcttccgcgatgttttgactcggaaagaccacgccgactccacgcgaaatgccctgtcaatgctgacccgattccgtttcattttctttcttgctgagtccattgaaacgaacatggccaaagtgagcgacatccaatgaatgtaaaactttattatttcagggagaattttcaacaattttgaacgattacgcacgggccaaagcactttttaaagacaccgaagtgaatttgtttaaggaaggtgagcaaaataattgggaagacaaatgtatgcctaattaagttatggcggtgctcgacgaaaacattggaaaacttcgcgaatgcattcgcagcaaattgatggacatttccactcccttcgaagagcagaacagactgatcaaattcctgaaaatactcgaccccgagtcggaccccgcctggtacgcactgaaaacgcactaatcgaaggcattccatttctgttcagggattgcatgatgtcttacaacgggtggttggagaacattttatgggagttgcaaatccattttcatgggaaatgtaaatgctggctttcatttggcttttcctttttatatttcaatgctttagcgatggaggcgcaccaacggacttccatggcttatgagacggtcgatgtgtctgatcttttatcggaggaaaacaaatcgcctcaagactttcgccatgcttttgttattgaccttttgggacttcttacagaaaaattgcaaacattttggaaaatttctcaaaattttgctgtgactggtcccaccacttccgctgctgtttctgcgcttagtcagacagaggctgaccaattccaagaacggcaaatggacatcgatgtgagttgatcggactttgtgatcacttttggaccgaccccttcagcaaatgttgaccaacaccatcaacgttggctcgtggctgttgctaaatgcgttggtgcctgacgcactgcccgagtcggtgaacaaacaatacaaagaccgattcgtgcaatggcctcgtctcagtccaaatgcncaatgggatgtcatgttcccctccataaaaactcttcggtacgttcaattggtcaataaatccctgcttttatttcatttgaatttnaagggcctcaataaaaactttgactgaatgtctgagccgttctcaccttcagccgttagtcgaactttgtacaacggtccgtctcaaatgtttgggaatgttagtggagaggggcaaagaaggtgggcggtaaaagccaagcaaatattatgcatttccaacgtaagccatccgtttgtttcattgtcagccgttttgctgcttggtgcccaagagaattggcgcgtcgatttaatggccgacccgccgcgtacggcgctgcccgaccttttcgagacggaagtcaacgaattggtggctgatgtgaaagtcatcctttcttccaacaatttccctggggaaattgacctttttctaaaggagcgttggcgacaaatggtgcctttttggcattgtttttcgtcttccatttgtgaattgtttttagatcatcgacctttttgccgtccttttgctcggtgtccgcgactgttacgaccatttgctcaaattgcgtcgggagaacaaacggcccaacactttgttggacaatgtgtcattggaagtgttgatgagga

SEQ ID NO: 8720 - DNA, 4294 bp, Heterodera glycines
atagggcttggatttttaggctctaaaaactgccaaaataaaggtaggctttaggctctaaaaaaaaaccccaaaataggcactaaaaaatgggaaaaaggcactaaaaaacctcattttagggggtgtaaaatgacaaaatgtattcaaaaaagtaaaaaaattcagccaaatcagtattgagataaataatttttaaatcacaaattcttgtcaagaaaataaataaattttggagatgaatttttgaaaaatttttcatttcttaggggtgtatttttgaaaaaaaattttgggtcgattcttagggatgtatttttaaaattcccaaaaaatcaattcttagggggtgtatttttcgtttttattgcatttttgttaataattttgggcaaaacgccaaaataggccaaaataggttctttcaaaattttttaggctttttaggctctaaaaataaaagcctaaaaaataggcactaataactcgaaaagtagcttaacaacagcccaaaaaaacatgtttttcgtgcgtttcaggccacagggagctcaggaaaaaataggcttttgcctaaaaatccgagccctagtcatatattgagggtaataattagggatgccaaaaatatggatataaaatcgctaaatatggccataaaatatggaccaaaaatcgcgaaatatggacataaaatggaaaaatctcaaaatatggaaataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaataaaaatatggaaatatggacataaatcgcgaaatatggaaaaatatggaaaatatggatatagaaatccatcctacaagcttcaaaccaagctaaaaacatgtttttcgtgcgtttcaggccctcaacagtccaggaaaaaatatggatatccatatgattggcatccctagtaataattatacaaaaagaaaaaataagtcgacttaaacagtaaaattttaaattttacaaattttatcactttgagtcaagacttttttccatcgctgtatttaacccaaagagacatcgtactgattaggcccggtctctatcggttaaatttgcacgtttcgcgaagtgcccatttttgcacagtcgcgaaacgcaccatttttacaccatttttgcactgtcgcgaaatgacatagcacccttttcacgaggttattccccctccccaagtcccaaaaaccccaactcatgggatcattctgttttattgccatggaaattccctatttcgatattttaagataataaattcagaaaaacgcaaaacttcatataaatttgaagggctttgtatttttttgaaatttactaaaaaaaaattatttttttatttttgtcaaaaattctcccatgaaccacaaattctcgagttttttgggtcaaaaatttttttcctaaaattctctggaaaaattcaaaaaaattttttttaatttctaaagttttttcttgagaatttctaggtttttcgaatgccaaatatactcttaaacttgaaccacttcaaaaactttgcaggtttaagaattatatgaaagaaatggtcaagcgattcactgatgtcaaatggcttgcgcgtggaataaagtgaatttgccttcctcccccttaattaattaatgctttttaaaatatttttttgttttgccaaagtatctttcattcctccattttggcccctttcccttttttcggtccgacttcgtcccgtgtgacattccgccccaaatgtttcccacggccaccgtttggtccgctgaacgtcttcggcgcgattacgctaatcatttgcgttctttgcccgctcaattgcacgaagcaaagagagcccatcgcaaaaagtgagcgagcggcaaaacttcgaaatttaaaacaaaactgaaaaatgttgttttttaatgcaggctcaaccaaatcggagtgttcaagcaaatttctgaatggctcggcgaattggaaatgcatcgccgcattatttttgaccaatggaaggcgcttcagaagcaaaaagtgtgcaatttaataagaaaatatttgataaaattaaatatttttgttcgggtcgggatcactccgccgcaattttttggcgcgagcttttttggcgcagccgttttggcgccctatataaaatggtttttttttgcatcgtaaaatttttttcaaaatttggaaataaccctgtcaaaatcagttttttcctgctgtgaactaccatatgacgtaattttgctaaaaattaggcaaacctatcaacacccttgaaaatccactgaatattaactttggaccaaaatataaaagttaaattaggcaccaaaattctgtagcattgctagcaattgtattagcatggtactttaaaagaaaattacttaaaattatgcacaaagaaagcaaattaaaattttttgaaaatttttaaatttttaaatactggcatcaaaaaagccattttttagggcgccaaaatagccgcgccaaagtgggcggttccctttttattcatacgtgaaataattggggggggggattgaaaaaaattagtgtaatttatcacaagggaaccacacgaactgtgtaaccaggggtgcgatctgtcctggtttggaggtagcgaccaaaacttgttctgattttttaaaataaactgataattttgaaaaatttatggcagaatggcactattttatcaagaatacataagatttgtgcaagtcctaattttcgaccccaaaatctgattttttgggcccgatgtcctgattttgaaaaattttcgatcgcacccctgactgtaactaactgagtttcggtcggctgaatttcggcggctgagttttgtcctgctccgcatgaccccctccccaaatgatcagaaaaatcggtcaacgtttcaaaaaacgtgagaaaatatttaggttttaaagatttataaaaaaaaattctaaactcatactagagaccgtactggacaatccgacagtaaactaaaacttaaaaaaatattttcgacatatacggactatttcctaaaaatatattcgagtcaaaacactttcgcaaacttaacaaatttgaaaattaaaaatacatgttaagaaacaaaaaaattagagcttacaaattagcaaaatttaaaaaggataataccgtattaaaggcccgcatcgatccttaattagccaattccgctttatttaccgattattaagttgttttatgaaaattaaaagcagaagacagatattagaatttgttgtgcaagactttaaatgaatcagcaaaaaattctctatcaaaagtttcatagtttttaatgcaaataatgattctttttgttaagacaaaggaatttgattaccgtgtttggtccgctcagatgctcagtgaacttgaagagaataatgcgcttactgtgggttattttagttgttttgcatttattttttcattttttagattgaccattagcaaaaaagcaaatgcttcttcctctgatttcgtattacaagggattcttttttatgaaaaacgcaaaagtatagctaaagtatgtatgaaatatgtacaaaatgtaaataaaattttaaaaatggttattttttagaaaaaaaattcctcgtaaagggtgaaataggaacaaaatagcacaaaattgttacctaaatggcgcagaatcacattttactattttaaaagttaatttttgattgattttttaggagtacatttaaaaaaaataattttatttttcacaagaaattactataattctcagaaatcttcaaaatagctaaaaattgcaaaatatgtgcaaaaaatgtgaaagagttgtataaaaatatttacatatataatatatagaaaacccgtaaatatgtaaaatatataaataaaagttacaacttttgttcgcaaatacaaaaaagaaagtgttttttctaattgtgtaaaatgttaaaattgaatttggcgaaaaactttcgtgtttacctaaatacatatacttttgttccacactgtctttacataaaaaagaatccctactgatta

SEQ ID NO: 8721 - DNA, 785 bp, Heterodera glycines
tatcggcaccaccagataggctttggcttaataatcctgtagaaattgaatcaaaaattgcgtcatttggtcaattttagacaaaatctgttacaacaccacattaaatttcataaaatttctcgcagatgtcgataggcaccaggtatggcacggaaagacttccggtttccgacatttttggggtcggaattccgacttccgaaatttttgatgaaaagtcggaaatttttaaaatttttatttcaaaaaactagtaagttttgtacaatttctgttagggttgctccccgacccctcggggggcaaaatgtcggggccggggacctcggggggcgacatgtcgggggtcgggtcggggggagctcaaatgtcgggggttggggaccccgatcgggtagtgatcaactaaattttttaacaaaaaaaaagcattttttctttttaaatgctcgaaatcttccttttttcactttaaatctcagggccctgtcccggtagggcaaccgagaaccgggaaaaacaagcactggtaagaatggtggtcggagtgtaaaattagtgatgaaaattggaattaaaggaaaaattaaaaaataataattaatatatactttaaaagtaacgcacacaattatgaaaatggtctagaggctagtcttcttgattttctattatcattttttaagaaagcccatacaaattgagcatagtaatctcacttttttgttgaaaatctgtcaaaatttccctcggcggcgcctatcggcaccgccggacgctaa

SEQ ID NO: 8722 - DNA, 4415 bp, Heterodera glycines
acgcaaacggcaaagtcggcaccgtcggacaacagcaggttgggatcgtaacggccactgtccgcgaagggataggaaaagcaaatgacacgggcggaatggccataggacagcaaacggaagggagcgcaatctgagaaaaagccaaataaaacttgtataaaaacggaagacatagagaaagagtgacacaacaaaccgtcggaaaagccttccaaaagttgtgccataatcgcatgacaggcattcatcatcttaaagaggaaaagaaggcaataaagtcggttatttaaatggtcattccaaattatgatttactaattgaaagatacagcatttatccatcaaaacgaaaccattattgagccgtcgtcacgcccatggaacagtttgccctgagtgcccacataaattgtcgccgttacaattcgttcgtcgtcctgaaacactcaaatagcaacatatatatgttaatgatgtacaataataagtccacctcagtgtcgaccaatgtcggcggaggcggcacgagacgagcccacgcctcggaaatgtgttgtttgatggtcggctcataaactgaataaatgggcgaaatgagtagagaagcatgagagtaaatttatgggtggatcaggaatttcggagggagaaaatcaaagaagttctctttttttctcttcgggtcgaaaatttttttccagtgttatttttcaaaatgagcaccagggcgaaaacagaaatttgtagatgtttacgccaaaaaatgataaattttgctattttgagtcaatttttcaacaaaaaaaaatacggtaaattcgatcccgccggggaatttttttgaaaattttaatgaaatatgataagaaaattgtgccagttttcaaaaaatatgtaatttttcttgaaaaattttttaagcatacattgagaaataaaagcaaaagtaatttccttgtcttggtcacaaatggcactcaccgattggtctccgatggcgaatgaattcgttgaccaagaagtccaagttgttcggaatgtgccacatgctgatcgcgccctgctcatcaactcggtaggcgaccaccacttttttgtcactgtttcgcgactcatcgaagaaaaattggacgggcgtaagtgaaggctgaaaacgaaaaaattccatcaatttatgaaaaacatttacctttaacggcgttgaaagagtcccttttaatagtgcaaaaacaaatgcctgctcaatgttgaacacattggtcggattttcgccaaatttttcgcgaatttgcctgccacaaagttttctaaaggtgtgcaaaaaatgttggcataaatttcaaatttttcaattattatttttactaaaagagcctccctactttcgtggcaattggaacaacacaattgtggagtcggcaaaagcaatggccactttgtcaatgtcgacaatgacaccgtccagcgcctcaatggcacattccgacacaatcagctggtccaaagtacttgggtcaattatctgataacaaaacggggctcataaattcgaaaagttcgctccattccgaattttcgcatcagatttgaaaactcgcaatttgtggcaagaaaattaaaatccaatccaaattttagataaaaggcacaattgtcataaatttaagaccaaattttcccaaaactgtccacaacagcagtgtgtacctgccatgaattgccacacacaatcagcatcatgcgaagatttttcggcgaacaaacgatgcttttcacgccgtccgccccagtggccaacactttcgactcgcactcaaacgaaacactcgccccacagtctttggggtcaacattgtgcagggaccagagcttgacaatgccggacagcgaagtgccaaccaagacatctgaaaaaataatttttatgagtggcgaaaaaaaaattaaaattcgaatcttttttattcctttttttaaattcgcaaaatttatggccaacccatcggagtggccaaggcaatggaagcggtccattcgggctcaattttggagcccaatgtgaacagaacgttgagatcgtagggatgcaaaacaatgacatcggcatagtcgccaatgcaaaacagcacattttgggctccatttttcagtgtctgaaatgacagtttttaatttaaatgtgtttttatgaaaaaaccgatattacttgcaaattggtgtttgaattttattaaaaacttaaagggggggggaccttttggtttggaaatttttcttgaaagatattgcctagtcgtgaaaacttgtcactaatgttgttggttttaaccattcataatccctaacccgaattagaaccaaaagtagaaaattcaaatttttggacttcgatatttgttttacaaaaaaaaatcttcgtaaccaaagggtcctccctttctttggtttttacaaaaattcacaaggcaccgatttgcaagtagagccgtaactcgtacataaggcttgattgttcgatgtatgaagttcgacttgacactgtcaatcactcgcccatcgattgaatcccaaagacaaacagtgccatcttcagagcaggtaacaaatttcctggaagtcggtttttagtttcgaacttattattgaattcgaattaattgaacgaaaagaattggaattttcattacaaattaaaaaaaaacatacgatgtgtttgataggcaaattggagaaatgcagctgattgcactctctaaacaaaaaataaaataaaataaaagaaaaataatgagaatgccaaatttcataaaaatctcccaaaatgccgtcatcaccatgtgccaaaaggaccatctgcggttggatccagccgagtgcctcgtcgaccacccattgcatcacttgaccatcaatgctacccgttaaaataatccgcccattttggaccgatgaaatgcgcacaattcggctcttcggcgcttttggaccccataaaacgacggggagaagcaacgaattagcaccaaaggaattaatcctttcggaaattgtcatgaaataatttaagatcttaaaggcagtaaaaataaagagaaaatgagtcattagcagtcaaccaatctaatcgaatttaaagcatatgaaaaagacacgaaaagcattaattaagaaagaaaccgtgatggttttaggtcaagagctaacaaataaatgaataagccgaacgaaaaccggaatttttaaaatttattttgttggcattatgtttatattttattttggcatcacctagccacagttttccgacaaagtttgagcaaaatcgtttaggtacctaattactgaattgcttttctcttttatattaccgccgctatgagttcaaaatttatttttaggtataagagaacaacagtattaattatgtcggtgccagcaacgtccgcaaaaccgatggtcatcgacatcagttcactttccatcgatgaattgtccgttttgcagcaacaattcgacgcagaattggcattcttcaatgattcactgaacgagttgagaaatgtcgccgcaaaattcggccgatgtcaggcgacgttggattccatcagtccgaaggaattaaacaaatcagcgctggttccgctctcagaatcggtacctattttatatttttgaattttatttgtcattatttcctaatacaggtttatgtcagagccaaaatgactgatccggacaaatatttggttgaaattggcaccgggtattttgttgagatgaaccgtcagcaatcatcagaatattttaaacggtgaataattttctgggaaattttttctttcctttagttaaataacaaattcaggaaatatgcctttttggaatcgcaagttgagacgataagccgtaaaataattccggaaaagcaacaggcgcgtcaaacgattgtggcagctctgcagaagaaagtgcaacttgccacttcgaaatagcgacttgcgatcatttttgaaccacatttttgcccattgttttttccttgttacagtgtctataattaaaattggaactatccaactccagcaaattaaacaaatttcattttttatcattatattttgctttaattttctattttatttgacttttttgtagaaaaaatgcgttcaaaagattgcaaatctaatccgaacagtgcttttcttcttcgtcttttccaaaacaaaaaagtttgtctttcaatctttttattgaattaaaaaaagtaaagacaaaattctcagagaattgatggacgagcgtgggaagaccttagatcggttcaagtgacttttgatccacggacaaatttaagcgccgtgcatttgggcagtacgaggtgtgtcgatggttctaaacccccgtaatctttg

SEQ ID NO: 8723 - DNA, 1196 bp, Heterodera glycines
atcacttaagtgaaaatccctccaacactcttcctttactcaaaacatttttcttttctttctttcttccacttcgtttctccaaaatgtgcttcaactgctgatggttttggcgagaaaaatgattggtcacagatgggactgatctgatcaccgcactgatcggtcggccgaccatggctttggccatgccccaaaatatccgccaacttttggtcgtttttgctaattttgttccttcgcccaattccgaaacattcgctgatcattctgcagaatagcagcacaatgtttgatctgctgggcttgattgctctattttacccattttctctggtcatttatcattcccaaaatcaaacaattaaatctctcccttaaatttgtttaattcatttccaaattatccaccacctttttgccccagggattaatcccatcctcattttctgccctccccccccccctccctctcttcccaaccaattaatttccgtgactaattggattccctctcccccccgtccttcggcggattgacgggaaccgaccaacacaacgaccaatcggcccatctccccttctcttaaccccctccccacgcattttgggctcccggcgattgcccaatggagcatcacgcgaagtgctccccgcccgccttgccctcccgccgttgttggctcatgtcttccccagggatttgtcccgtcctatttccccccgccctccgtcgatcacttttacgcggtcgatcacctttcagcaatccctcccctattttagtccttcccttccgccaatgcctttcatccaccaaattcatcgctcttccattttcctatttttcctcctcttctccgtccgtgccaatgccactgatgatgaaagtgccgttgcttcttccccctctctcactccgtccggcttttggctttccaccgaattgctctccgtcactttccacaagggatgtctgagcaccgctttatgccatcagccggcgttcaaattggtgcacacgatgacactgaacggacagaagtcggcgatgagttggcccgtggacggcggaggaacggaaatgctgcaggcaagtgatcagtggagaacggaacgggggaggcggggaaagtgatcaaattgaggcgagagggcaatgatcaatgagtggtaagggagatggacaaatgatc

SEQ ID NO: 8724 - DNA, 3173 bp, Heterodera glycines
ttttctccgttttttctttcctttctcaactttctgtccactcataaacaataaaaatggaaagaatgagcatattttgagcattttatcccttttaaggaccgccaattgcgtcagttcgtctcccattggactgtcggtgatcccgaggatgtgtccgttgcatgtcaaattgcgggcattgatccctcctttggctttgcccgcgtgtgcgacgaaacatcggcacgacgcgtgttccaagaagcgatggtcagacggacagtgatggtgagcaaattgggggggggggagacaaaactgatcagtgtatgagtgatcagaaaaacaattgccgaccggatcgacacaatcattaattaatttaattagtcgaattattagcagagagataaaaatgataggctaatctgatggccatatgccatacaagatttcaaatattactctgccaagcattggatcatttataccgtactctttgttaccgtaccatccgcttataggggataatatgtgcatttgtaactgtccccaaaatatgaaaagcatttcgagccatttgtttgtttgccctcaacaataacaacaacaaccacctgctgctgctgatagaaggaacaaactccttccatcaaacatcttcagcagttttgggtgttgcatttcccccccccccctttccccgcctcactttccgtcattgtccccccgggggatgggtcatcatccttctcactctttgcttccccctcttctcatccccggctccttccccctctcgtctcccccttacttttctcgactcgcttccattgctctccattcattcgctccccgcggagtctcacttttctgcttttctgtcattgttcttccccggtcatccattcctcccttctcccccccccctttcctctctatttgctaataatctctcttttcctcccctttttcgtgtcttcgcatccaaaacaaaatccctttattccaccacctttcagcacaacaacaatgccaacatcgccagcatcgttcgggcgaagcggagagacggcgccgctgcgctttccccgcgcccgccgtccgcgccctctccgccgtccctcactgctgacaatgggcagcactttgctcaacaaatggtcgtggagatgcgcggccgttgcttcaatgccacgttggccgtccgagcccatctcagccgatgtccatggtgtccggatccaaatgtgcacattcacgtggacggatcagagggaagcgcccagcaggtgaggaacgggagaacgacgtgaagcagcagcagggtgatcaatgatcagttggagaaaaatcaatcgataagaagatgaggaaaagggatgatcagactgattaggcgtgatcaggaagatgaattagagagcacaaaattaagaaattatcagcagctgattcgaaaaccagagaagggagaggggcggataggtatactatcagtgatcaactgttaggtggatctgcgaccagatttttatatgtgatttttgccaccaatcacttttccttgcctaattcccccccccccccccaaagggtgccgacgggcgaggaaatgatgcccaacagcagcaacagctgaacagcgccgactcgctccttttgctgcataacattgtcattttggcactgagtggtgccgttgttttcgctttcaccggtaatttttacatttaaaattggcataattttcctttggaattttgttcattttaaggcctttgcgcagtttttgttgcccaacggcgtcatcgccaaaataaaaaacagcagaacaaaaagacgggcggagggaggagagaaagcggcgggggaaaaggcgccggaggcgtttcgtcgacgctttcgatgatgcggggaggaaggcacgagagggggaagaagcgggcgaggaagctgcttagtccgcccagggcacagcagccaatgcccatccctcagcaagacggggagagcagcagcgaacagcagcagacgatgattgtgtacgggggagcgagtcggaggattgccggaggggaggagcacgaggaggaagagaggtgggagaagcgacgacatgggcacaatgttaagggtgggggaagggataggtgcaaaaagaaggaagtgtgggacatggggaccggaaagaggggggggggataagatttgggaggagaaatatgggtgcaaaaaatgacataaaattgatgccaccggtgggtcagtggtcccgatgaaatggacagtgaaatcggagacaaattggagggtttagggggagtgggtgaggagataacatctcgaggagtgaaagacaaaaaactaattggaaattggcgttggacgggggggtgaccttgtcgaacgaattgcgcgcgttgtgacataattacgcccatttcctttcttttcgctcgttcatcccttcaatttgagggaccaattgccaactaaagacaaaaaacatttctttccattgttttgtccagcaggtacgacaccccttgggacaacaagtactgcttggtgccgcgccaatggctgttcgacggcaacggcagtacctgcggcgtggcgccgccggcaccgcttcaagcggccgacgcggcatggaaatttcggcaccctccaacgccgctgcagcgtccctcgccctacgaccattcgtcctttccatgcgacaccagcagtggcaaatacgcaacttgtgccaatttgggcagtgccgtcgccgccgcccaaacgaagtcgccgatgatgggaatgatgtgctcgcagagaacggcggcagcccacagccaacaatcgcaattttacggcacaatgccaacagctgatcagcaaaaacattcgatcggcggaagggcagcagcgatcactgctgatcagtcatcatcgttctgtgccagggcagcggtggtgccgaatcagccgccccctccgccgcccattgcgcttctgtcggtacggcacgcacagccaaaacatggcgaaaagacgacgacgacattcacttcgcccaacacttcctcctcctccgactcgacgaggcacgacgacagcggattggactccgtttaagcgatggaaaagcacagaaaaatgagtccgagtgaagcggggacggtaatccttcggaattggtg

SEQ ID NO: 8725 - DNA, 4472 bp, Heterodera glycines
  misc_feature (422)..(422): n is a, c, g, or t
cggtaccggtactgaccggtaatgcaaaaaccggtaccggtaccaactttttccaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattgagggtgaccaagtttttttcaaattcaggataaagaacactaaaattcagatgtagacctcaaaattcagattattgcaaaacaagggatcagcggccaattttccaattttgcgaaggggtctccggccatgtaaattaatgtaaatcaatgaccttttttgctttcaacaccgcttttttcgcggcacgtttttctcaagacttttggggaacaaggagggncccggcggtgccgataggcgccgccgggaaaaattttgtattttttaatgcgatttgttaacagaatttgtaaaaaaagaccaattgattaatttttgggtttttaggatgcttaaaatgaaagaaaaaaagttggaatattttttttaattaaaatttcaattaaaataatggtaaagaaaatatgaagaatattctatcccagtggggaattgaacccaagcgagaaataataaaatcagaaggtttagccacttgaccacttatgcatatgaacaaatgctttaaatgaaaataaataatttaattttttttttcaaaaaatttctccttcttcaccattccctactcttttctcacccagacccccattcttaccagtgcaaatttttaccggcggtaccggtactagacaaaccggtaccggtactttgatttttgaaaaaaccggtaccggtaccggtaccaaaaaaaccggtaattaccggccagtaccggtaccggtaccggtaccgagcaactctaatttaaaatttatttacttttttcgaactctgtcctggaaagagtgaaaaatgcgttattatgctcaatatatcggaactagtgcgcagaaaaaaaggcatatgcctcaaaagtcgagctctaattattatatttttcatcttccattatcggttttaacaattttggggaggaaataagcaaatcgtaaatttcagtgcattcgggatcactaaatcagattttaacatttttgcggcacatttttccaaaaaacttggtgaatgtgcgaggggagaggtctggcggttccgataggcgctgccgggaaattttttttgaaaacttgaattagaaattagccaaatttttcataaattccctcttttagatgaaaataaagcactatcccaaatcagaacatttcttagaagtaagaacaaatagaaaccctgattaatcagaaaaaaataaattcaaaagaaaacgtcaaccggtatcgaactcataacaaaaaattgtgttagtcttggaacactaaccactaaacaacaaatatttttaaaaatatacgtaaatttactttatttactaaaaatttgtcagatggttaaaaaaattcaaaattgcataaatttttctttttatcccacgaatatgccataagggtgtatttttcaccccgcgggggtggaggtcgcgggggtctgactcgcggggacgggggtgagccaaaaaacctgtcccgtccccggggacggggcggggttcgaacccgttttcacccgaccacaaattatttttttaaagacaatgtgccaagcttttttttaaatttttctcagtgacgaaatgatcggttattgttggaactaacctataatggactgcagttaatcactatttagcattttgatttttgagaaactcattaacaatcataaacaagcacattatgcattaacagttttattcttacctcgcaaaaaaaacaattaattaattatatattataagtgcgataaggtcggcatataaaagatgacacaatgaatcagtgaattcagtgttgggcatgaaacaacacccgaaaattaatacaaaatcataaaaaggtctgacaaaaaataattaaataaaacagcaaaaaggaaaatttaaaaatatacaataataaggaagttcagttgctgaacaaagtaaaaagagagagactcacaaaaagcataagataaaaaatacccgaaaatgaaaaccaaaagaaaagaaaggaataagaaatggagtgccaataagaaaagaatgagcattggacttagccttcggcttcaagtactaagcctagcttcgcccaccccttgtcagaatgattaacaaagtgggaaattgcggccagcagactcgtaaccagagaaaaaaaggaacgagggcagagtatgcgaagatttatctgcttttgtcaaaaaataaaaataaattttcatgtgtcgttttgaaaattaggcggttaggtgccaaagaagaaaaagtaacattttgtgtttgtatcaatatttaatttttagagagatggggaaatttctaaaataaataaataaagtgcattttcacccgagggcattccccccccccccgctcaatcccctctggttacggtttgaggtaaacaatcaattcgataatcaaagctcgttgtctttagtgctcatcggtggaaatttgacaaaaggtctccgtgcaaaagtttttgcctttaaaatgctttgagccaccgcttttttggcgcgtaaggaagccatttcaggtgccatgtaagtgagcacaaattcatcggccaattcagtgaaaaaatgcttttgaaattcaatgcgaagatcgtctgaagcaaaaagagggaaattaattaaaaagaggaagccgacaagcctaattaaatggccattcaaattgattatttttgcatacgttcgatccgttccaaaattgccaagtaaaggtcaatgtttggcagaactttctggaaggaaaaggcttaaaattagcaacaataattgcaaatgcgccgaaagtgttagcttttttgaaaacctaagtgttaagaaaaaaaaactaaatttgctgaatttcctgcaatggtaaagaattgtggttcctatttaacttttttattttggactcagattcagttttcataaaatgttccaaccgcaatgtaaaagggcgaggaaaacgtttcccgttcagcaaaagcggagacccatccattgaggtcgaagtcggaggtgaaatatttgcgaaattggcgcagttcgtagaaacactcgttgatgagttcgtatatctgacaaagggagaaacccaattttaaattggttggcacagtgtttgtctgtccgtttgtccatgccaactgaccctcttcccgggaaattggcacccggacgtgtagccaggctcactcggtggttggcacttcagcagttccctcgttttttcatatttcccattcagcggtctgcccatggcaattgtttcaatgccttaaaaatgaacaaaaagcatatttttcaaattcgcaaaagtcgcataaaagaaccgaaacttactcatcgaaagcgcgggaattccgacggggaaaagttcacagagaatggccaaatggtcgtagcggggaccaaccggtgatgatcagcccctaaagagaaagtcaaataatcatagtacaaattggttgattaaatgtgcctatgatgaaaaatgccaatttgaaactgaagaatgcacctgaaaacggtcgaactccttgtagacgcgtgtcatttggttcacccatgactcgtggttgcgcacataatgcatcgggttggagtggaaacgcatcggaccgtccgcgcctttgaacgccgacgcgccccagacatttctcaaggaaacagaacatcggttagggttgtgaattttgggaaaaagatggaaagcctgattcaaaatacccctcaccaaattagtgggtaattaatttttatcattccttcccaggcatggcatacctaaacggtttcaacgccatccaatgggaaaagggcaaaaacatgtccaagtcttcggcataagaccaaaggacgggttccaacttgtcggtcatttggtagtcggccaattccttctccgtcatttggaccttaaaactgcgcaaattgggaaggcacgtccatttttaattgcattttataggaaaactgattggattttttgttaaatgtgagaatgtacaatgttaccaaccaacatgtcatgccatgccaaaatggtaacctgaaatggaaatggcaaagaaaacagtgaatgaaaatgagaaaagttacggggaatttctctttgataaacgaagcgacacggccgatgtgccaaagaattgtctgaaaataaaatacccagtatataattgagcaattagtaatgataaatggaattcaatattaattagctacgagtgaactatacatttcccccagccaatcgttcccatttttggcgtgaaacgaa

SEQ ID NO: 8726 - DNA, 1299 bp, Heterodera glycines
  misc_feature (31)..(31): n is a, c, g, or t
ttctgcaaattataaggacggtggcggattntgggatcaatataaaaaagtttttttttcgtttttttcaaaatagcattatgagaatggctttagtttgtcaattttcggcgcaaattgcttattttttttaaattaaaaattgaaacattgttttacacctaaatagttgataatgaattagaagcttttaccctgaaaaaactattcttgattaaaaaaacaattttttttgttcgaattcgggtctggagttcggaattgggcaaacccgagttaagatccgttatcagcaccctcaaaaacgcctaaaaattggttttgagcaccaaattaaaaaaaaaatgaaaattagggacaaccattcttcaggattgccgcctggataaaaagaggacactacattaagttaaataaatggtttcattttggatttatattataggtccgtctcattttgtcttctttcttcactattaatagggctcggatttttaggtgctaaaaatccctaaataggtactaaaataggtgctaaaaaccccaaaaaaggccaaaataggtgcgaaaataggtgttaaaaattgaaaaaatctagaaataggtaaaaacctaaaaatccaactcctaactattaataatcatacacaataggcgatagataatgcattcattaaatttaaaaaatataactacctaattaaatttttctctttaaatttcatcaatatttttttaaattaatttattattttttatattcattttattatatttaatttaatattttaaattttggcgatatgatatagtcgtaaatggtcattgtcgaaacggcattgtcgaaaaggtattgtcgaaacggtcattggcgaaacggtcattgtcgaaatgtccagccaccttgcataccgattgagaaaaattttgcgcatagaataatacgtctttattttttgtttatacgttagttcaaatgctataagaaaaacaaattttcgaagactcatatcttttttctaactcatcaaattgcttagcatttgcttagaaaaagcttctccttaccaagagctttcgaatgatattaagtttgtccaatttggttggcaaaaagatccacaaacaatttccaaaaatagcaattttttttggacaaaaataaagaaaaatattcatgttgcacaacggactcgaaccaccaccctttgtccctttactatcttacaaaaaccacttcgccacacatgcaaatcttttttggtacagcagctcattttccggacgctgtgtacataa

SEQ ID NO: 8727 - DNA, 2617 bp, Heterodera glycines
  misc_feature (62)..(62): n is a, c, g, or t
  misc_feature (136)..(136): n is a, c, g, or t
gtgtcttcgggtatagataacgcagcaaggaaaagttgaaaaatggatgtaaaaagacaatnaaatgttttaaggtgtgccgagggtgtgtatttcatgtttgactctattgcattttagccgtcaaatcgatganccatccatagtttttttaggcatagaaactaagtatagtcaatgattggacgcctaaagaacaagagactcaatttttttttttttttttgctgttctgtactcttttttttccggcacgtaatctttaaaagaatttaagccagtacaatttttataattacaatttctcattcattcccattgaattagtgttttcactattccgatatttctatttgtaaatcaattatacaaatggcgacgagtgaattccgtccgtccctccgtctccctcttttacttctgtttcgactcgtaattttccaccaacattcccatgccatgtccgcctgcagcacacgccgcgatcactgcgaaacgcccccctgaagaaaataatcaacgaaatattcaaacttcccccgccccgtccggctttacgcaccttcggcctgcagtcggttcgccgcgtgtgccaacaatcggacgccggtagcgccgaagggatggcccaatgagagagagccaccccacatattcactttttccaatggcaaaagcccaaattttgctttgcgtttcatataattcttaaaccaaaagttgatgcaaaagaaataaagaaaagtgtttgtacctgacagaaccaatcagaatcgagtgccttcaaattggccaatacttggccagcaaatgcttcgtgtatttcgaacacatcgatgtctttgattgacaatccgacctaaagggacatttcccacataatcaatcgcttgccaaaactcactttatcgagaagcttcgggatcacataggcggggccaagcagcagctgatccttggggtcttgggcgacgaacaaagtctcacgaatgaacactttcggccggtagcccttctcacgcgcaaattcttcagaagcgagcaaagctgccgatgctccatcggtgaggtaggaggagttgccagcagtgacacttccgtggggtttgatgaaggcctgaaattcggagatttttgttgtttttgtgatggttagctttgtagcagagagatccaatgactcaattaaaaaaaagtcccttggaaattacaaaaggaacccccccccatttcctcttttaattactgctttcagcttggccatttgctccatcgtagaaacacgaattccgttgtctttgttaactgtcgtccctttgtgtttcccggaggtgacaaacatcggaacctgacaatgagaaatgcgactaattgtttacaattagccgattaaaacggcgaattttgaaatttgagcatcatttttccatgtgtcagaaaatgctaaaaaaatttatttcgggttgggtggaggggctattactcgttccatccctgattccgtactcaccacgtctttcaatttgttctctctaaaagctttgtcggctaaagtatgggatcgaattgcgaactcatcctgctctctgaacaatatcgtttactttatttgttaaatgtaagccctcaccgtctggacacacaaaaagcggcagccaatcggtccccggaattgcccatcacttcgccggttgtgaattcgcttacggccggcaactcgggagagaaccaattggaggcgactgttttcaggtgcttaaatctctctccaaaacttttggccttctgcaaatcgatgagagaaagtcgaacctaaaaaggggcttcgaatgggtaagcgaaccaaataatggaacaaacctttctgttgtaacgaattggaaagtcagagagtaactcgactcctccagcgatgcccgcctttaaatagccagtggaaatcattaggctaatattttgaattgaaacgccggaagaaatacacgcgagagtgaccgtattgcaagggatctgaaagcagaaaatggaccaagtgaccattcgaaaaacatttagaaatcgaaagcacaccgaatcagggaaaccggcggtgatcgcagcctcacgggcgatattgctcgttttgcattcctgaacgacttgtccacagataatgtgtccaatttcatcaaaaggtatttttgttcgctcaaccaatgcttaaccaataagtcagaaaagtacaactaatttatttatacctttaagagcgtgtctttgaagatcaacagccaacagctcacggaaagttgtattcgattggagaaagggagtacgtacagcatcgataagcacagcattcaaatttttattgggcgatgatgcaacagcagagaatttttgctgctgaagtaaaacagaagcgagcgaaaaatgccgcgaggacgaacaattgaagttgcggaaattgcaaagcatttcttaatgtaaccccagtttcgatattttttatattaagatgcggtcgaatatctctctctcactaatttttttctgcttacaattcaattagttcataagcgggagcgggaattttgacaaaaaccgggaccggggccagaaaagtcgggaccgggac

SEQ ID NO: 8728 - DNA, 1781 bp, Heterodera glycines
taagaaatgctgtgcaatttcgacaacttcaattgttcgtcctcgcggcacttttcgctcgcttctgttttacttcagcagcaaaaattcgctgctgtttcttcaccgcccaataaaaattggaatgctgtgcttatcgaagcgatgcgtttgaagtcaaccagcatcgtccaggatgatgcaatcactgaacatggccatgatgaccacgggcatggacaccacgcagtcaattatgggccgccgattacctatgactacactcctataccatctcaaccttataaggcttgtttatttgtttcaattttttgtaatataaaatcagaaaatatgttccagagttttttgggattgctgattctaaatcaaacatccattttgattaattctaagtcactgactgaccagattccgaagtaaaatcgaaattccaaaaaactagtctcgatgatataatctgtttgatttactttgaaaatgctcgagaaaaaattcttagtgacgaaacccggaatccaacatttggccctgagacaccctttgcatatgtatgatctataatattagatttgttgctgaaatttcctttttcatcgggactcagttgtccatccaccactcaaatgaccactggtcatcttctttcactcctagatggatttgtcttaccgaacccaaatgcgaaatttgagttttgacggacccgctgttcggaataggccaaaatggatgtctgattgatgatcatcaaccctgaaaactcggaaaaaggcggtgggggaggtgggcaaaccaaagtattaaccaacaaacaaatgatttgtcgttgcatttgttttgatttcgtacatttaataaattaaattgcagaaggtctataaggaactgaagcagaaattcatcacgtatttggcgatgagcttcgtctttttcatgttttgctgttacgttggctattccactgatgtgctgggacactccgcttggaaacttccgggcagctaccgtaacagaaaagcgattaacgcgcgtttggacgcggaggaagcgaaggcaaaggccggggaaggcgagcaataggaagaaagattgtcaaattgtaggctataattttgttctaattccgagatgtattgtaatagtgcgatcattaattcgttttcgaattgtatttgtttgttgaatgcaacattggacttggtaaggttttgtggcacaaatatgttgtttttctcttcaaagtcactggaattattatttgagcgaaaaccaactcgtactgccctgactcgtaaaatttttcgacaaaaagaaatcgtaataatttttaaagtcgaaattaaacatttaactctcttaaaattctctatttccttataaaatttcaaaaatgatatgattttcatccaaacaaatacccaaacccgtattcgaacaaatagttgaaaaaccaaatcgtattttcactcaaacctacttaaacatacactcatgtcaaaagtattgcaccaaaacatgtatgcacaaataactcaatttttttatttatataaaattctcaaaaattttctgctaggctaacttttgatgctgatcaaaaaaagtcttttggaccaactttatcagatcactccttcatggtgatctgaaaagtcaaaaatggcttgaaaccggaaaaattttcgaaaaaaattcctaggggggtcgcgaaaatttttctgggaaatttaagtagcctatcagatataggacaaaattctctaccgaattgactttgg

SEQ ID NO: 8729 - DNA, 1291 bp, Heterodera glycines
cagaaaaattttcccaaccccctaggaatttttttagaaaattttcccggtttcaagccatttttgacttttcagatcaccatgaaggagtgatctgataaagtttccaagacttttttgatcagcatcaaaagttagcctagcagaaaatttttgagaattttatatcaataaaaaaattgattattcgtgcatacatgttttggtgcaataactttttttccaccaaaaaggggggggggggggtttgttgagccatgatcgattttctcgacggcaaagaaactaatcgggaaagtttttgggtattcattagtgcactatttaatgttttttttggcataaattagacatttttcacctcattcctttttgagaaaatcgttttttggtgcaatactttaacgaacagttaattagtcaacattcgaatgttaaatttgaaaaaattgaatttcgactttgttcgaattcgggacgttttcgcttttatctgatttcctcctttctccctttgttctccgttccatgtcttccttttcccaccagaacttcgaaaatcattttcattcttctgtctcaccaggggcattctttgccgatccgttcgcttagcacacaccgaggcgattaataaattcttgaataaagacaacggccgttagaaaggggcttaagttggggagggagcagttgtgaggatttttgacggattggacagccgtaaaaacggtcttcctgaaaagcaacaagtaaataacccacacccgctctcccccacaatccatcactttccctctcctcccgtcccacctgacttggatcgctcatacattccatcccaactcttcgcacattccctctcgccccctcgtcgattgatctgacaagtaatttcacactgattcatctcactttccgttgccctttttgacccccccccccctagggctttttctgcttcccttttctccctcaaatcacttcccccaatgatttgccccaacttcgttcttttgtcccttttatccgtctctctgttcagttccctttcattagctgataatcaggtcaattttggtgttaattgggcacgcaaattgtcttttggtaaatctttagaccataacagtgcatgggcaaacgatttgtcatcgtcgaagtgtgaagggactgcacgttgaactgagagagcacgacacatttgatcccgatggtggggtgggcaggggacggagggggaggcgtatgggtagaggaggaggaaacggcggaggaagggggacatgat

SEQ ID NO: 8730 - DNA, 2514 bp, Heterodera glycines
ttggttaagctagtgaagcgagtccgccatgaaatcgaattgctgccgccagtgccgctaacgcttcagtcctccattgtttcgtcccgaagaatgaagtgtgcatgagcgcacaatgaacggcaccgaccgcacaaataactccgccgaagcataccattgcacgctgcaactttcgatcggacaaggacaccccaccgatctggaaattcataaacaatttgcgcgagcatcagaaaataatcgacgtggacttcgaacatttcctcgccggaaatgctccgccgctgaaagcaaagcgttaccgtgaagtggacagacgaattttgaggattctggagcgctacaatgaggaaaaaacgcagccgcaaatcgacgatgatcaccaatatggccaaaaccaaaataaccgaaatttgattattgaaatgctcaggggaatttcaagcaattaccaaatgggtaaatgaaactttgttaattttgttaaaactttttattttttctataaatttttgaatatttcttgtcaatgtatctgtgaaaatgaaaatatagcatacagaaaacttaattaatccattttaccctataaaaaatgtttgagacgcaactggcccaagatgcaactgacccccccccccctaccatggaaaaatatgtctcgagttgcggaaatgccaaaaaagcggtttttgaaccggttcaaaactcgaaaaaatggagacggagaaattatttttcaacagaatttatttaatggaaactttttgaaattttgaaggtgtcccaaaaatgtcacgcgtcaataaaaaaattgttgcttttgttaaagaatttctgaaatttatattaaaaattcgaaatacaaaaatttttctatttttgatcagttaatcgaaaaagactgaatcaaaaatgtatgtatagtgcctgtctctaaaattagcgaaggaaaatgttttttcggtaatagtaaagctggtgcccccccccctttttttgaaaaaaatattttttgttttcaaaagaaatgaaaacaggtttcctggggttttagaggtcgctgttcaggaatccagtatccatttcgccctattccgaaccccggacccgaattcgaacaaaaagtcgaaaattcaattttttggaatcacttgttagtctaaaaatggttcaaattaccattttactgaagcagtgatgacttttagttcatttccgtgttcttaaacaaaataccaagaatttttaataagaaaaagctatggtgcatcaaagttgcaaaaaaaagcttatgggcgtgtgaaccgcaatagagtccaattttttgccatttttatacgtccgatttatttacaaaattgagaggtttttcttcataaaatttcatttgatcactgatttgaattatgatcggtcggtcattcttaaataaatcatttcttcttctgttgaccactgtttttgctgggcccaccactcattcattcattgtcagaagacggcccctttgtgatgttttgtgccgcttcttcttccacttcttctggtggcggagacaattgccttaattaagcgcaatttgaattatttaaacaaaattaaatgccttttttaattgctcacccaatgctattattgcaaatgtaaagccaaatgaacacattgtcccaattgttgtcccaattttcctctttcttctgctgttgaaccgccgcggtctccccaataattttgcatcgtttcattatccatcggttgttccatccctttgctttggccaatgtcagcttttcctttgtccattcgtttaccaattcaaacggcaccatttgcattgacggcacacgaacagaaaaatgaatttcgtaactgacggaagaaatggcattggcacggcgaaaatgctaaacaatttggaaacaaaagcactgatttgtcgaaagtatggccacacctccttgaaattgttgatccaatcagtgttcgcttgtgtgttgtaatcatcgcaacgcaatcgcttgggttggccatcttttctcggaatgtgcaaccatttgtacagaatttggccagcagaaatcgttgcatttgttccattaaaatcatcatcaattgcctcgggcaacagaccatatgaatggattgaattcaattggttgagatcagtgagaattgtcggcgaagtgagacgacgcaaatggtccaaatgatcaccaccggtaaagcccaaacagcgaatgtttgtcgaaaaaatgggccaaatttcacgaacaataatgtcccaaatccgctggccatccgtgttgtgtggtgatggaatacacaaaatataattgatgcctcttttgtcgaaaatttggtgatttaagcgaagaaagcgatgacggagtgatcgatgtaccctgaaaaaggaatgaatgcttttattgccataaatctctgattttacttacataatctgaaagcatttaaagcgaattttgctgggcagcggacaattggacaatg

SEQ ID NO: 8731 - DNA, 1136 bp, Heterodera glycines
  misc_feature (1093)..(1093): n is a, c, g, or t
catatttgagaattatattggatttgaaggataattaaaaatttgtcaataaaaatttcaatttaaatcaatttccgctcttacttttcttcgactcatggccccgtacaattccaattgcatacaaactgcccccaatttcgcgtaacaatggtgaaccgctgtctccctcaaacaaaaataaatttaatgaaaaattcaaaagtaatatatacgaaaattaaagaaatgctaaaaaagtcttcgagaatatgtattttgtagaatattttataaaacaaataaatagcttacatgagacgtcttatggatggcactaaactgacagaaaaatccttgtggacacaccggagacaaatggaccaaatcctgtcgtaatatcttcgaatcgatcagctccgcgtgtgccgacatattgtctaagaaaataaaaattttaggcagaaaaaaattttagagcattcttttttaaacaaaatatttagaaaaaaataatccaaatttacttagttttgtctttccccagccgatgattgttgctgtcgttccactccgtggttatttatttggaagacaaattctgttatttgtgggccacattccaaaacatcttttagctaaacaaataaaattcatttaaattcattaatttttaaaaatttaaaactgtacttctaataaagtaatgtcatttgctgatgaagtcagtctgtagaattcgtgtcgttttatccgtgccacctcgtgaacagtcccttttgttatgtctttgctcccaacggtcacttgcatctcggatgctttgactggcaacacaaaatcgtgcatgacttcatgcctaaatgaaggaaaaggtgataattagggttaagttctatgccctaaaaagtgccaaatatgtgcataaaatataaaataaaacccctcaaaatgccctgaaaacccgaacaatacccaaatatgcagtaaaatatgccttaaaactgcaaaaatggctttaaccatcaaaaaaatgcataagcttttttagacaatttcaaaaaacttgatttttcaaatttgtatatgcaatttcgatttttttaaaatgctnaacaaaattaccattttttatatccaacaatttttttttcaaa

SEQ ID NO: 8732 - DNA, 2219 bp, Heterodera glycines
  misc_feature (1144)..(1144): n is a, c, g, or t
caatggccttaaatttgaatttgaagaataattagtaaaataaattttgaaataaaataaaggagcggagaacccgaatttaatattaattttgagccagttggatcccgaacccggattgagcaaaactcaaaattaaatttcgaatctcgcatttttgggagagatttgattcacccccaccgctaaacaattaccaataaatttaattaaataataaaaaaagggtcaatggcaactcgtacgaaaatcaacttatataccagggatgtgccgaatcggaatcgtaatcgtaatcggaatcgcaattaatcggattttgggccataatcggaatcggataatcgtaatcggatttgccttgaaatccgattattacacccctaagaattgcggtgggggtcggtttagtctggccggtttagtctggccggtttagtctggccggtttagtcagagggtcgttttagtcagagggtcgttttagtctggcaagctgtttttgtcctacattgatccaattctgatttgtttctcgaaaattctttaaaattaacaccataacagatttatcaatgtgttaacaacaaaaaaataacaaaacattgaaaaatgaatacgggcatatttcataatttcgagaaataccaacgagaaaattgaagatattatcgggattagcattggcatggtaattttgatcattttggtgagcagggttaatgttgttgatggtattgtaaccctgtaagagtcgaagaattcgtatcaacggcacgatattttcgcgtttttaggagggacttcaccagcgatgcatcgtgcgatgtctgcatcaattgacttttctcatatcgaattgtgttgatgaagcggaaaacagttggataaacaagcaaaagcccgttgaatgaaaaaacgaaaaaaattagggtttactttgcctgaagctataaaaaggcggtgccaaactgaaggtttcgctttgtttttattttctaattgggatattcatttatattgtagctaaacatagatattttaagtttttccttgtttataattgacaaaaaaaacattttaagagttatgggcaaaaacagcttgccagactaaaaccgaccctctgactaaactggccagnactaaaacggcccagactaaaaaccgccagactaaactgacccagtccgtgcaagaccatcacctcatgccatgttcaacctaaatcaaatatatattaatcatttaaagaagataaagccgcaattggtaaattatcaaggtaaatggtcaattaattagttataaattactctaaaagttgggcccagcttaattccgcatggatcattgctaactatgtaaggcgcttttcgtgagtcggttgccgcatctaattattatttataacagactcacattcttcacacctataagcaccaacaaaataagcactgacaaaaagaaattcttcgtgaacattaatgaaacaaaaatctataattattattatttttataaatcatttttttaaatcccatatacaaatttattcaaaaaagatggatattaagacatgcaatttgttaggttaaaaaaatttacgaattgaataattacacttttgattgactcttgaatctgcgatggtatttgctttaattttccttttttgcccttgacctaaaaacaattagtttgatctgacaaattatgaatgactgctaaactaatatcaattccgagatacttccaaataattaattcatatttgaaattattaataaataaattaaaggaatattgtgattgtgcatagcaaatttcatttgcattggccttaaaagatgaaaaaggttaagaaaaaatttgtgtgtatgggaacaaaaatgtcattctgttaaatgttactaccaatatcaagaaaatgtcatccaaacattcattgactcatcatatatatattctcaaaaatatctaatttgtgtaataaagtgattagatattcatattcattcatttattcacgttaataaagatttagcatccgtcaatttataaaataataaaatagaaaatgtttaatttttgatgctttataattgtttaagattttatgaagcatttaaagaaagattttgcaaaattgattattaattgactgactacttaaagatcgggaaagataatttaatacaggaagttccattaaaatt

SEQ ID NO: 8733 - DNA, 972 bp, Heterodera glycines
caacccctcgggcccatttgcaacaatttaagcaaaacaaaattcaaaagttgtttggataaaatgtgattttcgttagatttttggttttccgcttttctcattatataaaaataaagtttccaccgcaattaattcttctgctatttgtgtgacatcattcggaactcgtccaaattgtgctaattgctgccaaaaatgaaccgacggtaatgaattttaaaagtcacaaattcgtcgtttatttgactaaactgtttttccatttcagttggatttgcaacgacgtttggatggacattttccccagttttgaccgtcctcaactcggcctcaaattggcacttctttcgccacgtttcaatgcgttggtggacaaacatttcaatggcaaaagcgaattggcaatttggagacgaatcgaaattcgtcgcaaggacaaaggaccagaaacgaagctgtctgtacaaattggtgacaaattggtggaatttccattgcccgaccgtccgttgcccagcaaaatccgttttaagcaccttcagattgagtaattcggaatcagagatttatggcaataaaagcattcatcccatttttaggtacattgatcactccgtcatcgcttttcttcgttcaaatcatcaaattttcgacaaaagaggcaccaatttatatttgtggattccatcaccacacaacacgaatggccaactaatttgggatgtttttgttcgtgaaatttggccaattttttcgacaaacattcgccacttgggctttaacgatggtgatcatttggacaatttgcttcgtcgcacttcgccgacaattctcactgatctcaaccaattgaattcaatctattcacatcgtctgtcgcccgctgcgattggtgatggttttgatgggccaaattcaacaatttctgctggccaagttctgtcaaaatggtgcactctccgagaacat

SEQ ID NO: 8734 - DNA, 1699 bp, Heterodera glycines
  misc_feature (38)..(39): n is a, c, g, or t
ctgcaaaatgattggcgggtcaatggaaaagtttggcnncgcggggcattggccgttgtggcgccgattctgattcaccacaatagcaagtaaaagcacagaagctcaaaatgaatataggtacaaacatatccatccaggtgtaccccaaccattggcacttttaccctgacaatttcctacccgagaaaatggccaaacggaatgccttcgattacattccgttcagtgggggcccacggaattgcattggtaattattggataatttaaaatgaattatcattagcaaagattaaaggccagaaatttgcaatgctgcagctaaagattgtcttggcacaccttttctgccattttcgtttttctaccgaagtgccattccttcaaaatctgcctgccttagagccaatccttcgtccccaaaatgggcttcctctcaaaataatcaaaagaaggtgcgaaattattacgaacgatgaaaagcgtttggatttattgatggatgaaaagatcgaataataaatcaccagaagcgaaatccaaaataaacaccaaataaataaaaaaatgtattcattttcaattttcgatcatctttttccaatttagtatccaaaaaatctatcgaattgtttgaaatcggtggacgtgcatcagattctgataaccctttcgaccagggacgaacgaagctcggcttacaaattagcactcgaaggcgaagccgaatgagaaagtaccaaatgaaaattcgtacaaagttaatgaattttttaaagcgattgaatgtttaagtgcctttgtcacaccccaaagttttggaaaattaaaaaaaattatttaaggatttaaagtatatatttctgttggctttgtcggttcccataaattatttaatcatgtaattataaaacttaattatttgtttttttttaattaggcttcgtttggatcaaagggcgctaaaaggatttgataattacggggaatcgggtgggggggggagagtaaatgtgtggcaaccccatagatatttataccctcggtattaaaacttatgggttctgggggtggggcttttaaaaaaaatgaattttccaaaaaaatgtatcaaaatatttcctaattggccaatgatttttctttattttgttcaaatgtatttttcaactttgggaattctgaccctaaaaattgggaatcaggttgcaccaaagcttcaaaaactacaaggattattcaaaattaaaatttatttaataataaatttcctagattacataaaatatttttgcatttaattttgaattcatttattttctaaatattaataggtaaagtgcagaagaatgttctgcgatgccagaacttaaggaattatttgcagtggaaaaatgaaaattatttgttatttaattttttatatatttaaataaattgttaataaaaatttggatataaaatcgcgaaatatggccataaaatagggaccaaaaatatggacataaatttttaagaattgagagtggaatttctcaaattttcttcaaattccccaaatgtaacggttaaatatggtattaaaattaatttagaggaaaaaaaaatgtacagcttaaatttactaatttttagcgaaaaaatggaattgttattttttcaaaaataatttctttttaatattcaatacaaattca

SEQ ID NO: 8735 - DNA, 3742 bp, Heterodera glycines
  misc_feature (31)..(31): n is a, c, g, or t
  misc_feature (3733)..(3733): n is a, c, g, or t
acgaactgcgctacttggaccgctgcattcngggaaagtcttagaatgttcctggcagtgccggtggtcgagcggcaactgcaaaatgatttggcggtcaatggaaaagtttggccacgcggggcattggccgttgtggcgccgattctgattcaccacaatgagcaagtaaaagcacagaagctcaaaatgaatataggtacaaacatatccatccaggtgtaccccaaccattggcactttgaccctgacaatttcctacccgagaaaatggccaaacggaatgccttcgattacattccgttcagttggggcccacggaattgcattggtaattattggataatttaaaatgaattatcattagcaaagattaaaggccagaaatttgcaatgctgcagctaaagattgtcttggcacaccttttctgccattttcatcaaaagaaggtgcgaaattattacgaacgatgaaaagcgtttggatttattgatggatgagaagatcgaataataaatcaccagaagcgaaatccaaaataaacaccaaataaataaacaaatgtattcattttcaattttcgatcatctttttccaatttagtatccaaaaaatctatcgaattgtttgaaatcggtggacgtgcatcagattctgattctgataaccctttcgaccagggacgaacgaagctcggcttacaaattagcactcgaaggcgaagccgaatgagaaagtaccaaatgaaattcgtaaaaagttaatgaattttttaaagcgattgaatgtttaagtgcctttgtcacaccccaaagttttggaaaattaaaaaaaattatttaaggatttaaagtttatatttctgttggctttgtcggttcccataaattatttaatcatgtaattataaaacttaattatttgtttttttttaattaggcttcgtttggatcaaagggcgccaaaaggatttgatataattacggggaatcgggtggggggaggagagtaaatgtgtggcaaccccatagatatttataccctcggtattaaaacttatgggttctgggggtggggcttttaaaaaaaatgaattttccaaaaaaatgtatcaaaatatttcctaattggccaatgatttttctttattttgataaataaaattcaaatgtatttttcaactttgggaattctgaccctaaaaattgggaatcaggttgcaccaaagcttcaaaaactacaaggattattcaaaattaaaatttatttaataataaatttcctagattacataaaatatttttgcatttaattttgaattcatttattttctaaatattaataggtaaagtgcagaagaatgttctgcgatgccagaacttaaggaattatttgcagtggaaaaatgaaaatgatttgttatttaattttttatatatttaaataaattgttaataaaaatttggatataaaatcgcgaaatatggccataaaatagggaccaaaaatatggacataaatttttaagaattgagagtggaatttctcaaattttcttcaaattcccaaaatgtaacggttaaatatggtattaaaattaatttagaggaaaaaaatgtacagcttaaatttactaatttttagcgaaaaaatggaattgttatttttcaaaaataatttctttttaatattaaatacaaattcattattctaaattgaaactcgtttaaatgtttaataaatagtgacaaaaatatatgctaaaaattggtaaaatccgctgtattatgcataaaatcccagaaaaatctcattaattaaaaggcatatagcaaattgctctttgctctttattttaataattgttgtaaaattatttcgtaataatttttagttttcaattttatttccaatattcaacagtaaagaccaattgaatttgttgggttttctggtgctaggacgaagtgacaaaaatatcagtgagagactttcagaggggtggcgttatttcagtacggaagaaattaatttaattaattaataatataattattgtaatctattaattatttttctgaccataattataatttcaatatattatttaatatttcccaaacaagttacagttttacgagagaaatacagtgccccaaaaaagtcttgactcaaacctgaaaaactatcttatagttcatttaaatacttgaaataattcatgcttgcacaacttttggtgctgatcaaaaaagtctcttacatcaacttgatcagatcactcctttgtagtgaacgggacacccaaaatacactgaaaatcggggaaattttcaaaatccctagggggttgggaaattttttctagagaaaatgggcaagcccactggcaagagcacaaaatttgctaccgaattgttattggaatagtggttctacgatttgtatatagaaagttatacttggttgaaaattgatcaccataaaaatgatcaatttttgatcaacgccataactttttccagaagcatctaaattaagcatacttggtatcatttgatagcccgaagtgtcctctatttgcctttaaaattctaaaaaatttggttgtggttcaaaaaagttgtggcttgtaaatttcataaattgatttggtaaacctttgtgaccacaacttttttgaaactcaacgaaattttttgaaattttacaggaaaatagagaacacttagggctaccaaaagataccaaaaatgtataattttgatggttttagaaaaagttatgatgcatgaaatttatcaagaaattacttggtcgtgtattttttgtggccgtataaactgaaatagagaacaaatatatttattattattagctattattcaattttaaattatattattaattaattaaattaatttcttccgtactgaaatgacgccacccctctgaaagtctctcactgatatttttgtcacttcggctcaccacggattttaccttatttttttaaattttgactacaaaatggcaaaaagtagtctttttttggctaaaaatggttacaattcctgtttttgctgtccggcgctgaacttttttaaataacactaaataaattttaccaaaaaaaattcttcggattcccccccccccccgtaatttttttctggctattaaaatgttgaaataattatatacatatacataaatccgattataatgatcagactttcaaaaaattttcaaaaatcaacccataaattcaaaaagaatgatttgatcagacacaaaattataaattatttgtaaaatttaaataaaaaatgaagaaactccatcaagaaaatcagttttttgatttttattaatcactatttaaaaatttttttctaaaactctgacaaaaattgatttttaaaaattacggattacggattgcggattacgggaaattacggggtttttggacccccgtaattacggattacggatttccgtaactgagaaaatcgccgtaattacggattacggatttccgtaattgcaaatccagttgcgtgcagccctgccctgaaggaatggtctgatcacctcgttgtcattaactcgtatgttcagcatgaaaagttattgcatgaattttttcatatttttcttaccctatttaaaaagttacttgtcttcgaattttgaacgtattttatgaaacagagcatatccaaattnttgtccacc

SEQ ID NO: 8736 - DNA, 4871 bp, Heterodera glycines
gtagtctccccccacctactggccgccgtagtcgagtgtgcggcggttttttagcgcaataaccaaaatgacctatttgcaccagttcactgcattacatttggtactggtgtccattttcactgggactcagttgtcccaatgctcagatggcgtcggttcgccttgattctttgatttttagacttagctcgtcaagaacgtttgaatgataccaaatttgtacgaatttgaccgttttaaaaggtcaggaaccctccttttcactcaaattttcgagttttaatccggttcaaaaaccggtttaaatgcttttccgcgcccaattttaagcttttctatcgttctcagcacctaagaaaacctataaaagtgttttagtgcgattttgagctgataccgtattcggcaattttactaaaatgaatagttgtcgaacgtggaaaaaccaactttcgaacatttgattttttctggccatttctttgaccctcaatagaattagaaactcaaaacctttatggtgttgaataaaaattattttacatcaaaagcaatataaaatgaaaacgaataagcgagataaagaaggcacagaaatttgaaatggaattcagtactttttctcgggttggcataatttgactgtttacacaatgccatcaaaatcatttgtccattcacaacggaagtgccaatgccgtaccgttcgctttgtccagcacatatttgctgaaggagcgcagaaatttgggatattcacgctaaaatggggggatttgttatttttcatgaatttttctccgaaaaaagctaaacgatggactgacgagtgagtaccttgtagatttgacgaatcccaattttgggcacccaaccgcccgggtgaactgaaaaagcagcaataaacaaaatgaatgatgttgtctccgacaaactatttaaaaattaaaataataaaaaatcacaaaaaaattattaatgttaatccgtagaaattaggggggaaatttcaccataaacatttcgtgctaatcttcgggcttggcccactttccctcccttttttccccagtaatcccccaggaaattcgccatctcaatgctatcacacaatctcggacggatttgttgatgttcgccatccgttccccatcaccccgacgccaattccatcatcacaatgccaatggcccatccccgcctcgccacttcgctgctcgccattccacccgccccaattcgttgctcgctcattggcccttgctctaatcccgcccatcttgcccacccagacgcgcgtataaaaagaaatgaggcctcaacacattatcgctttttctccggccattcgcagccaaattctcgaaatccgacgaaatctcaccattttgtttttcacccatttcatttcttttggcaaatttttccacaaaaaaccaaataaaaccaacaaaaaaatactttgcgttcattcattttccaatttttgtcacatttcacgtttgcttcacatttggccctccccttgggctttccaatttcctgtccggcggctccttcagccgcttgtacccatttcggtccccaaagtcagcacctactgctttggacccattttccttcccttttttgggttttgactgttcggcaccaggaccgagccaaaccccccccccctcggtttttccccgtatttcgcttgcccgatttctgtgtgtcccacagtttggattaagagtctggtgctctcaccgggctgagcttcccaggcacccccctgtttctcctttttttttccttttttcagtttttgggacttctaatttttgatgtcggtgattatacggcaacagcttgcctccctcctccctagcattttgtcggacatttccaatggtcctactctcgaggcattacctaatgagccctcatccctagacgctataagtgtcgccgccgaaaatttctcgcgtaaaatttcccgggccaattccctcctggaaaaatggacatttatccctggcatttctgaccgtggccataaaggaaaagttgcccacggaaatcaaagctcaactctatgataaggaaatggaggaagggggcccttggacgtccaaacaatggcgggaacgtttagcccgggtggtaaaacttaaagaggcggtccatgcaccctgggaaaacattcccattcccaccccacactcgcctcccaaacctcccctacgtctttctgagccagtcagacgagcctttccggtggtgggtgaggtaaaaaggaaaaacaccgacaaagaatgctcactttgtctccgggagggccaccaaccctcgaattgtgtggtttaccggacggtggagcagagaaaagctcgactttctgagcagggccgttgctctctttgcgcccgtaagggtcacacaagggacaattgtctgacaagggcccactgtatccgctgcggtgggaaccatcatattttggtttgcactggcccggcagaaaccccggctaagggtggcaattcggtccctttaggcccccgagcctcgttgggaagacccctccaatgggagagtcaccctcccgcctgttcttcagcatttccccctcagggaaaccaacaaaattcccaaatttcatccgcagtcgccgaaggggactttttccctcctttcaatgagtcccaccccaatggactgaaccgtccaactgcttacctgatgattaaagaaatatttgtgtttaacaataatgggccatccccggtatcagtccctgtcttttttgatcccggctcccaacctgggttcatttccactgatttggtctcactaaccggcccggaattaattactgaggagaaaatgaccgtgggaggatttttgggaaatgcctcacccaatcctatggaatttacctctccccgttttgccgtccgacttcggcgaagagatggtggctgggaaacggtagagctaaaccaaaccgccaaaattatcccgccagtcgaatttttgaaggaaatgcactgggacccatccgagagtcttaaaatgggagcaacagtaaaggaaccacaaattctgctaggaataagagaattttggaaattttttttggggagaaaggaaattctcccgggcctatttcgtgtcgataccgtattttgtcctatttttggaggagaaatggtgcattactgtattccattacccccgacccccaattttttcgcttcacccgtctgtggtgccgttgtgaaagccaaaaggcccgacgaattggtgaagcatttgtggagcttagagtcgataggaattcgggacccattggattctaacgatgatgaattagcttccgacctttttcgagactcagttaaatttaaggagggaagatatgaggttggatggccctggcgcccagggggtaaaattaaactgtccaacaactttttcctggcctactcgcggttgtcaggcctatcccaaaaattgcgttccaattcggagtttcgggaaaagtaccaagcaaccataatggagcaatttaaaaaggggataattgagcctgcagttcgtacgggtggcaacgagcattttattccccaccatgccgtcgttacccccaaaaaattgcgcatcgtttacgatgcctcggcgcatgagaaaggaaaagcatcactaaatgaaatgcttattcccgggcccaacttagtcccggaattggcgggcgttttactccgttttcggtcctccgctttccctgtcctgggggacatccaaaaagcctttttggccgtcggtcttagggatgaagaccgagaggtggccaaattcctctggctaaaggatccttccctgcccttaacccatgaaaatttagttgtttaccggttcaagcgcatagcgttcggtgtcaattcttcacccttcctcctggcttccgttcttcagcatcacttaaccttgaatggggaccccctggggatgaaacggaatttctatgttgacaatctgcttctttgtagtgaaacagctaccgaagcagccaaagccgtccacattgcacgccaagtgatgacaagggcagggatgcacctccacgaatttgtggcagccgacccaacaattttgagtgacctccccgccgaagaagttttggtgggcgatgtacaaagagttttggggctttgttggaatttggcacaggaaaaaatattttttgaatttcctgccaagagcaattttccgaccacccgacggggagtattgagcaccatcgcctctttgtttgatcccctgggattgtgcagcccttgtctcgtcaaggcaaaaatgttttttcagtcactctgggattcagccaaggggtgggattagtcaatcggaccaaaattagagaagaattgggttgccattatttctgagtgggactgccccccagtaacgtttgctcggtataccccgtgtggccaggccagccttcagctccatgtattttctgatgctggtcccaattcatttgcctccgcagtttacctgcgctcagcgcttaacggctccgttcgggtctcgctacttttcgccaagtcgcgactgagacccaaaaagttcaaaaacgatgggttcaccataccccggctggaattactgggacttattacggcaattcgtgccaaaaattttgtcgtttctaatttggatttttcgttcgaaaacatttatttttgggcggattctcagatagtcttatcctggttggccagcacggcctctcagcccattttcatcgccaatcgattggctgaaataagaaaggaaaagggcgccttttttaagttcgtgaggtctacggataa

SEQ ID NO: 8737 - DNA, 1220 bp, Heterodera glycines
  misc_feature (45)..(45): n is a, c, g, or t
tttgaaggtccttaacatccataaaacaatatattgccaaaattntagtgcccaattttttttgcggaaatatttttaaaattttccaacaaaaaaggaattgagaggttcagaaaagaatcgggaattcaacctttcaacattcattcggtaacatgccagttaacacgcgtaacagtggcaagtggcgaataatcattttgaaatgactattttaaaaaaggccaacctgatgttaaaaaatattttttctcaatttcttttattattatcattctgttaaaggccccaggtcaaaatcgtttagctcacaagattactatcataaaataaaaataaaaattttgaaataaatcatatgaaactcgcatatgcaaaatggatataaagagatgattctctttttgcgtctacgcctttttctatgtgacgaccgcacttccgattcagaaatttgaaaaatgcattataggaagatgaaaaaattcccttgattgatgactatgaatgaaaatggaaaaataaaaagccaacaatttcttgtgaattttgaaggtccttaacatccataaacaataattctttttttacacatccgatttacttaaatgtacatatatatatacacaagtgtttgtaattttccctcatagcattcatttgatcactgatctgatgaattatgatcgatcatttctcaattaattaattcatttcttctactgatcacagttgttgttgttcttttgtccgtcactcattgtcagaagacgctcctttttcgctgctttgtcccgcttcttcttcttctgctggtggcggagacaatggtctaaataaagcgcaatttgaattatttaaacaaaaccaaatgcttttttgttgctcacccgatgcaacaattggatggccaaaagtcgatattgttacaatcggcagaattttcgtcttcccattaaaccgccgccgtctccccaattgggcatcgcttcattatccatcggctaatcccttctaattgcttgctttggtcaatatcagcttttcttgcgttcgatcgttcgctaattcaaatggcaccattgacgttggcggcgcatgaacgaaaagtatatttttggcggcaaccactccctgaatagttacagacccggggactgaagtgataaaatggctttggactgaaccgtccgtctatgcctttgatataagcggcctac

SEQ ID NO: 8738 - DNA, 3476 bp, Heterodera glycines
tattttttctcaattttcttttattaattatcattctgttaaaggcccccaggtcaaaatccgtttagctcaacaagatttctaatcataaaaataaaaataaaaaatttgaaaataaatcatatgaaactcgcatatgcaaaaggaatataaagagatgattctctttttgctttaacccttttttctatgtgacgaccgcacttccgattcagaaatttgaaaaatgcattatagaaagatgaaaaaattcccttgatggatgactatgaatggaaaatggaaaaataaaaagccaccaatttcttgtgaattttgaaggtcctaaccatccataaccaatatattgccaaaattttagtgcccaattttttttgcggaaatatttttaaaattttccaccaaaaaaggaattaagaggttcagaaaagaatcgggaatccaacctttcaacattcattcggtaacatgccagttaccactgatataagcggtttagagacaagaatgcctaaatcaattctgtgtgttttgttggagattcatgtgtttttaggcattgaacggttcagtccaaagccatgttgccacttcagtcccagggtctgtaactcttcagggagtgtattcttcactttaaccaaattttgaatttcgactttttgcacgaatttgggtccggaattcgaagttagtcaatatgaatgttggattcggtttctccgacccagaaaacccttataaacatgttttcacgactttttgaacaaaaaaattttcttccaaaaaaggggtcaccccatctatagaataccgaattttcgtgtcaatttggcagtgaatgaatacctactaaattggtacataagcgaaattttaattttgcgaattcaatgcgtaaaaggaactcaaatttttttgtgtgggaacgggtcccagcggattacccgctcaaatcgaacattaaattttacagaattccgtgtgggattaagtgaattttgaaatttttcgaaaaactcaattaatagggcataagttaattatatgaattcattaggtaattgaatttatgtgaaaccaatacatacatatttacaaaacggcatataacattgaaatcaacacacatatataaacgcgcatattacatgcatttaaggggggtacatacaataagtagcacattttcgggaaatcaaaccaccagaaacatcggacaatttcaaggaaacagcaaaaatggcgacagaagaccttaaaaacggaaatttaagcactaaaacaaagtccgaaatggcttacccatcagcgaatgagcgcaatgaagtgatcagtccagccattgctgttgtacaaataacgcaacaccatttgtgcacgactcatagggttgaaaatgccttcaatgcttgtataatcgcgagttgcaattccttgagcctcgtaaagctggcatttcctgtagcgtccatacgaactgacagtacgaccgacaaaaggacctaaaagaaaatggaatataataaaagatggcattttgtgaatgccgtgcctgcgatgatttcatacgttttgtaggtatttgttttacaatgaaagcagaaaaacatcacttgaagcgcagtgtgcttgcgctctaaaaatgaatacataataggttaatttcttcacgatgctttgctacccatttgcataacgcaaattgccaaaagtgcgggaatcgccgaagcaagtaagcgaagaaatggcattgtcaatgtgggaccaagaagcatggaacacaaacgaatgtataacaaaataaaagaaagcggagggcaaatgacatgcctaatgtgtataatgtgtcagatgaaaatgctgcatatttaaatgtaatttaacgtaaaaacataatattgagcaataaccaatgggttgcaattgtccgaaacaatctaatttaattatttgttgaaaagcttatccctctacgaatgtgaaaaaaatcagtttatttcaagtacattcagcagagaatcggttaaaaacccaattttttcgaatttagtgtccaaagtttttgactatgtttgaattagggataggagtccgaaattgatcgggatggatgctgaatctgtgatcagtaataatttttgtgaattgcgcaaatgacgaaaatttacgggctttcagttcgggaaaaaagcgcaaggataaatgaattgtattagtggaaaacattcccttttatgcggcgtttccaaattatagcgttaagaattttttctttttccttcctttttcattatatatatatacctattggctgtttcatcctaattgctgtcagtttcacgaaactcataatcattttacacttcttccctatttctgtttgacttcacttaattgcttctacatttgtttgttttcgctgctttttggtcctacattgacgctttcaattggtttttcagccaacaagtacggcattaatcggttggccagtccatgtttgaaaattcctattccgaagctgcgcaatgttttcctggcatttgcccggctcgcctttttgactttaaggtgacaaaaataagaattattattttttcttttgttttatttcaacgtttatataattttaagattttgccaacaaatccctgcgttttatttggcaaaatgcgtccccattgttcgaatctgaggaattcttacaaattgatcagaatttgcttggtgaaatactcggtcttgatcagttggtgatcaacagtgaatttgcgatttggcaagttgtaattttaaattaacatctattatttaattggtttgtttcttttgcgttaggcactccgttgggccgacgaaaaatgccgtcaaaatgccatcgaatgttccgcggagaatcggcgtgctgcgcttggcccggcacttttcaaaattcgcttccctctgatcccatcagatgcatttgtggagcaaatcggtagataatcagacgtcgtttatcaagcatattttctcttttttgcagttccttctggcgttcagttgatgagtttgtcggtgtttatcaattcaattgccatccgaatttccgtggtgtgcccggattttacactttgaattttcaactcaaattcgaattttcgactggaacgtcgccggggaaaaaattggaaattttgatcatttataagcaggttttcactgaaaattagccaatttatatgtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatccctggtacatatgtgggtggctggacatttcgacaatgaccgtttcgccaatttaaatataataaaatgaatataaaaaataataaattaattaaaagaaatat

SEQ ID NO: 8739 - DNA, 5557 bp, Heterodera glycines
gcagaaattatcgcccgacgagaagaagaaataagacgatggcttcgtaaaaaatgcgttcaaccaatatggtatttaaaaatttgagttttttttgaatttttttaacttgggaatttctttttagcgtctgacatgatctcacttcatcggtcattgcctcaacctgcggacgacgagttcgtttaagccaaaatgaaaaattggactaaaaattttttgtatggtgtttttttgcataattttaccacctctctccgaaattttgaaatttattataatttagaaattttttggaaaaaacgcaacaaaaaatggttccttccctgaaaaaacaaaactaaaaatttttaaaatatcggaattttttggtcaaaatgggaaaattgaatgcttgaatcctaaattcccattttttgccaatttgactgatttttgggtcacaaatctaaataataagtgtccgtcaaccttggaatttttttttgaaaaattgcaaattttcttaaaaatggctcaaattttataaataatacgcattttttcgacagatgcggcaccgaaaaatacgcggacaatttgcccgacacgtcggtgatcatctgcttccacaacgaggcctggtccgtactgttgcgcaccgtgcacagtgtcattgaacggacgccggcccggctgctcaacgaggtcattctggtggacgacttctcggacatggagcacaccaagcagccgttggacgagtacatggcacagttcaaaaatgtttgtatattgggggggggggtgaaaaaatttgcaaaaaaaaaaaaaatcaaccccctctgccggggtggtcctgctggattcaggacgaaactttttttggtcgagtcgaaatttcgggttccggaaaaaaatttccaggccctacagaaaagaaaattcaaaaaaattaaaaaatttcaagtgaaaatcggctaaatttttgtttgtctcattgtcaggttcgcgtgctgcggctcgaaaaacgcgagggactcattcgggcgcggttgcgtggcgccgcggtggccaaaggccaagtgatcacctacctggactcacattgcgagtgcatggaaggtaagcgccatttttggggccatggacatgccagggatttaccaggattagcgcggtcatggttatggtattgagccaggacagcggaccctgtccaacattttcccaaggtttcgatcccttggcaaaatataggaaaattggcctcgtgcctatgttttcaagccatggacttgcttggattttccaaaaaattgcttacctccccctccatctataaaaatcaggaaattccaggttggattgaaccgttgttggaccgaatacacaaaaacgcgtccactgtcgtctgtccagtgatcgatgtgattgacgacaacacatttgagtaccattcgtccaaggcgttcttcaccaatgttggcggtacataaaaaatgtttttttttcaatttttggccctcaaaatttttaatttttcccttaaaaaatttccataaatttttgtttgtttttttcgttatgtcactcactactaatcaactgacaactccggggttcctttcttacagagataacttcagttttcgtcctttttttatctttacgattttttttttttacaattttaataatgagaaaaattatttttcaaccttttttattcctttttttaatgcggctttcttgttgtgttaacatttaatcgcattttttgctgtgtgttttaggctttgactggtcactgcagttcaattggcatccaattcctgaacgggatcgcaagaatcggcgccacattgacccggtgccatcgccgaccatggtctctaaccgagagctataaatttaaaaaaaaactaaaattattaccaattgttgtaaattgtgtgacaatttgccctggcttaactgagaacagtttgcagcttttttgtgttccttaggtattaattttacatgcttacttaacaaatttaattgccagtttcgtctataacactaagcacgtgggcgtaaaattttctaaaaaaaacctgcccaaacgggccaacccgaaaaatttttcacaaaaaaaaactcaaattaatttcgttcacaaagcccaaatcatgggacagtcctgcccttctttaaaaaaaaaattaaaatctcgaggcctaaacagcagatatttttaaatttttaattacaggccggcggtctgttctccattgaccgcgcgtacttcgaaaagttgggcacctacgacccgggcttcgacatttggggcggcgagaacttggagctgtctttcaaggtcatctcacaacacaacaaaccaataaaaatggcttttttcagatttggatgtgcggtggacgccttgaaattgtgccttggtcagcaaatgtcgaaaatttttaggaaaaaattataattttcagcgaatttttggacaattcttgaaaaaaacttactaatttgtcataaaattttgaaaaaatcgctaggaaattttacgaatgataaatctgagaaacaatgaatttttccgcgcctactaaaaattgcctaaagtaggaaaaatccgaaatgctaattaataatttataacaatgttttaatttagttcccatgttggccacattttccgcaagcgaagtccgtacaaatggcggacgggcgtaaatgtgctgaaacgcaactccattcggttggccgaagtgtggctggacgactacaagaagtactactacgagaggatcaacgaccaactggcacgttttttgaggcacaaaaaaatcataaatttttccattttatagggtcggggaagaaattttagaaattaaatataattttgctttttagaccgcttttttgcgatttgtaatcaaatttagtccaaaaatgccaaattttgagaaaatttacgagaaaaagggattttccgggaccagcggagaaaattttgcaaatttgagtgcaatataaatgtgcatcggttttatgccaattttttaataaattttaatttttgaaaattttttcagggcgattttggtgacatcaattcgcgaagggagctcagagaggtaaatgttgtttgcttttcattttataaaattttaaaaattcgatttttcagtcaaaatgaaaattggatgattaaaaaatgaaaatgcatacgaaatttaaattggacgcaaaaatgtttctgaattcatacacttgtgttgtttaaaaaagaggtaaaatcaccgattttaaatatgtaaataggtcccacagtaacgaggggttgaacctgggtaacctttgtgggtaaatccaacacacagaccaccgggacagaaatttaaatttttgaattttcgtttgaaataacccgcgtttttgccaaactgatttttttttaattgtaaatcattaaatttactaaaatttctttttttaagcgactccaatgcaaatccttcaaatggtatttgaacaacattttcccggagctgttcatccctggcgatgctgtagcgaagggcgaggtgagtcgcaatcctaaaaaaatgtgttttaaagcgtccgatttttccgaaatttacgctattttttgggcaagcctataaaaacatcaatttaaacccatccttatagaaatgcaaattccaaaaaaaaactcgaacattttcatctcttcctcttgaaaattcgggtaaattttccacggctttgcttatttttttgttaaaattttcacaaatttgacccaatatcctccaaatttgtttttgtttaaattttattgtaattacggtcttgctttcaggttaatgtactttttaagaaaattggaaaattcggactcttaaaaacaaaatttttataaataatacacgcaaatttgcttatgcttcaaccgctttttggaaatgaaaaactgtctttatctttatataatcgcaaaaaaaaattcgaataattttgatactaaaaaattccatcattaatttgtcaattaatttcaacgttatgtgagatgccaaaactttgttgatcctcctattatttttgttttcctggttctgtcggcttcaaattgcgctttctgtcgcccggtctagacatttttaagtcaaaatttagaaatttcatgtcctttttcttttctttttttctgtgaatgtttttattgctttttctctttcgatgtttccttgccattctgttggatttttaatttcaaaattataaaaagaaaatttggactttttgggtttttttaatttgtttataaaaataatgaaaaaataggtttccaaggcttttcagggtcactgttcacgaatctctgatttttttttgagttccagcggcacgaaaataaaatttaaaaaaaaattcgtcggtctttttccaaattttaattattttcaatccaaaaaatggaaaaaaattttttagggattcctactttcattcattcattcattcgttcgttcatttgtcagattgccaatggtgcgatggtgaagcatcaacggttgtgtctagactgtgcgatcaaaaagcgtgataaattgaagccggttggactgtggccatgccatggacagggtgggaaccaggtgaagttttggcatttccatggcgcccccgccttgcagattcgcaatgggtttgtgccgcgggacggctcgggcaccgcgtcctgtgtggacagcgcggtgggggaggagcaaaacaataagcccgtgattgcatacccgtgccatttacagggcggcaaccaggtgcttgcttactgtgtgtctggtcttccccattactttttggtgcaggcctccaaaaaattgttgttgtggtggtatggcaccccgaaaattgggggggggggcgacgacggcattcaatgacggtcaatcctttcttggcgaaaaaattgtggaagcattttttatgatttcaaaaatggaaaaagaaaggggtaggggcatggtggtagaaaatgtttgagttttatggctgaaggactaaacttaatccttcgtgaaattttgtgcaaaaaaattcgtgtttttaagggtacgaatttggaattaggttgttcccaccagagcagttcgtcctccaaaaaatttaaaaaaatgcgactaatccccgcccataatttcacaatttttttttatcataaaataaaattgctttttcgtatgtttaatttgtctgtccattctctctcatgtaacacttgcttttttgtgctgcttgagggtctgactgataaacaaataacagcaataacaacaacagcacagcaaaatgcacggccacaaaacgctttaataaaaattaaatttatttgtaatttttttttttttttttgccaaaacaaattaccaaattcgctgtgttaggtgcgaaacggtgggggcggttcaaaactgtgcattgactgggccaagcagaacagcagactcggtgttttccactaaaaaattttttttttgtaatttttcaacaaatttttaat

SEQ ID NO: 8740 - DNA, 4641 bp, Heterodera glycines
ctttatttgtatttaagttcgctcacagaaggatcttttgaaattgtgcattgaaaaagacgccgctcccggaacggaagataaggaaaactgaaaaaaacgagataaattgttgacatttgatgctctttttttttactgttgaaataaaccttttcttatttaaatcataatagaaagaataatttaatcatttaatttttcaccagttaatttagatttttaggaaaaatggaaacaaaaaaattcatggagactgatcctgaaaagagaaaattaagaaacaaaaaatattattttaaaaataaaaaagaaataacagaagaaaaaaatttcatcgaaatatcaaacacaattaaacaaaataaaaaatttggcataaatgaaaatacaattcgatttattttaaaagaatccaatccagaggattttaaaaatctattaaaaaatttaattaaaaaaggttgttcaaaaaaagaaaaaggctggcatttggaaaaaatttcatttgatatctatagcgaatcgtttcgagacccgatcatcataccaccacgtggggttaagcaaaatactgtaaatgttgtatttgaagaatttatgcggttgtgtcgcgaatgcgacgaggggaatgatcaaattcgaaagagatcaaattgggcattttccttttgcgttcccccccccccccctttgtttcttatttctctccttttctccttccacattttgttaaccgatcctttgttccccctttttcccttttttattttgtcacttttcactctgcctcatgtttttgtaattggactttaacccccccccccccccccggggggcaagttgtccaaacatccccttttttaacactttttctctttgtctctccccgtccttctcctgcgttttttcgcctctctccttttattcaaatgtgccgtcgcctttctcagcttttttcctcccccttcttctttcttctttgtctccctttggccaatttttgttcacatctgcaaatcgttttttccattttcctatggtacttctgtcgcccgccccctctgtgtctgtttacttaagccttgggctccccccatacacacacacattatataatcactgctcctcttctccccaattttccatcttcaatgccgattgcattaaccccctcggcctttcttctcgtgtcaaataaattgttgttggtcgaagtgttggttggatcagggacggtagagacgggaggaacacacccccctctcgtcactcacaccgcgagaacggcactccgtctgccccccccccccctctcctctcgcctcgccactctctcgccttcagcgtcgccgcccagcgtggcgagtcttgtcgtcctcttcaattgacccaatccctcccccagtttgtcgcccctttctcgacaggttgcagcaaagttataaagagattaatttactaaatgaagaaatagcgttgataatcactacttattcagttccggttggaggtaatcgaatataaattttgttttaaaaatatttttaggtcaatttcaaccgttagatttctttcctccaaaagaaaatggacggcttttagtaaagaataaaacaaataaatattgtctattttatagtgtaatattgagccaattgtatcaattgattaatagtgacggatcggatagaattacatataaacaattcacattaatatatcaaaatgaaaaaagacaacaaaaaatggttgatgaattaatatctagtacaaagattgacacaaacaaaaactcttatggaattgaggatttaatcgtaattcaaaattattttgatactaaattcccgaatagattcttaattgtggctttttctaaggtaaaataaataaattaattttttaatgaatttttttaggaacatgggttaaaaccaatttttaaaggacaaggccatagagaacatttgatatgcgtctttaacgaaaacggacattgggatggtaaaaaaaattatttttaaaataatcaaaaattttaggtttaaaaagcatcaaacaattttttaatgttaaatataagtattgtgtttattgtgaacaaactttccaaagcacaactaaacattcaattaaatgcatcataaaatgcagccgatgtggatcgtggggtaaaatattcaaattaaattcatctatttgaaaatttaggaaatgagtttccgtgtaaaaatagtctaatgaaaccagaagaatgtaataaatgcaaccgtctgttttataataaaaaatgttttcaattacacttggcccgtgcatgcaaattatataataggtgtattaaatgtgacaaagaatatcagaccgatcacacccatgtttgcggtaaagttgcccgaaatttatgtactttaatgttattcaggtgaaaaaatatgcaaagtatgcaaaactaaacatacgaagacggaaagttgttatatcagaaagattaaagtaccaaataaattgccgaaatatagaattatatgctatgatgtagaatgcagcgtaagtaattgacgataaattttaaaaattttatatttagacagataataggattaaagaaggaaaatattttggattttatgagcataaaattaattttatttctgcaagatacacgtgcagcatgtgtgaaggagtaaacattaattgccaaatatgcgggccaaaagggaaccgacataaaaaatggtgtacaaatgaaacccaaaaacctatgattgaatttttaaaatgggtattgtcattcaaacaatttaacacctattgttatgcgcattatgcaggtaaaagcaaaaaaactatgcgttttaatctataattttaagggagatatgatgcccatttcgttttaaaagaactaacaaatttgggatatgcaccacaacttattatttctgatttaaaaatttatcagattaaaattgataaaatttatttcagagatttttggctactttcacaaataaaattagcagatttgcctaaaacttttggcatgaattgtgcacctaaattatattttccttataaatataattctgaaaagaattatggtatgtttgcaacaaaaaaactctaaatttagaaaaatataaagaatttttataggtaaaattctcccaaatttgccaaacatcgctgattattatccagaaaaatttaataatattgagttcgaaaaatttaataagtggtattcagaaaattatacaaccccctttttattaggtatcatgttattaattttttattaattttaaatttagaagaacagttggaaatttattgtggtcaggacactgagattttactccaagctgtcttgcatatgcgaaggatttttttggaaatcacaacagataatgaatcacctaatggttttgatattataaaggtataataattttaaaaaaattaaaaattattatttattaggatgtgactaccatcgctggagctgcgatgcgtatatttagggctaaatttttaaaagaattacatttgccgatagtccctgaaaatgggtttgaaaaacgtgatactcaaagtgtgatagcgactaagtattttgaatggtttatgtataaaaatgccgtcaaaggtcggcatgctggaaatgggggagaaattgaaattagcggtactttgaagcatgctatgaaaataaaaaatatatttagggtttaaagtagattttatatgtgctaaattaaaaacaatcatagagttccaggtaggcaatgaaccctctctattctttttaacaaaaattttagggatgcgcatttcacggtcgttatttcggaaaaattttttttataaaatataaattttaggttgcccaaaatgctttaaatcattccatgtttgtcccaatggaaatacggctgaggaaaattttttgaagacgggaaacagaatgcaaaagttaagaaaagttgcattagaatataaattaaaagtcgaagaagtttgggtaattttttcttctatttttttatagaatttattttaaggaatgtgagattaaaataaaattgaaccctaaaaataaatcttatgataaagaaatgaagaatttttttgacaattgccctgattaaggtattaaaaatatattaaacttttactagaaaaatttagggccaattgacccccgtcaagctttttccggtggccgaacgcaggctttttgtttatattcggaaatagatgaaaaaagtgaaataaatatcgcagatatcatatcactttatcccgcagtatgaaataaatattttaaagaaagaaaacgattttaggttaattattttactccctaccccgttaaaacgccaaaaataatcatcccaaaatcacacgacgttttgtgggcactcccggacgatataccatataacggtaaaaaaaagaagtaattaatagtaaaatgaactttttaaaattatttaggtattctaaaagtaagaattatcccaaaaaaagatttatcacttcctctgcttccttattatacggtcagaaataattaaacaacaataatttcggtgacaaattaaggattcaattttattttttactaattgt

SEQ ID NO: 8741 - DNA, 2897 bp, Heterodera glycines
  misc_feature (83)..(83): n is a, c, g, or t
  misc_feature (91)..(91): n is a, c, g, or t
  misc_feature (93)..(93): n is a, c, g, or t
ttaaagtagattttatatctgctaaattaaaaaccaatcataggagttcaggtaggcaatcaacccttctctattctttaacnaaaaattntnagggatgcgcatttcacggtcgttatttcggaaaaaattttttttataaaatataaattttaggttgcccaaaatgctttaaatcattccatgtttgtcccaatggaaatacggctgaggaaaattttttgaagacgggaaacagaatgcaaaagttaagaaaagttgcattagaatataaattaaaagtcgaagaagtttgggtaattttttcttctatttttttatacaatttattttaaggaatgtgagattaaaataaaattgaaccctaaaaataaatcttatgataaagaaatgaaaaatttttttgacaattgccctgataaaggtattaaaaaatatattaaacttttactagaaaaatttagggccaattgacccccgtcaagctttttccggtggccgaacgcaggctttttgtttatattcggaaatagattaaaaaagtgaaataaatatcgcagatatcatatcactttatcccgcagtatgaaataaattttttaaagaaagaaaacgattttaggttaattattttactccctaccccgttaaaacgccaaaaataatcatcccaaaatcacacgacgttttgtgggcactcccggacgatataccatataacggtaaaaaaaagaagtaattaatagtaaaatgaactttttaaaattatttaggtattctaaaagtaagaattatcccaaaaaaagatttatcacttcctctgcttccttattatacggtcagaaataattaaacaacaataatttttaataacaattaaggattcaattttattttttactaattgtgcaaaatgttgtaaacaagcaaagccaaattttacttttgcaaagaatgtaagaaaatgcaaacatactgatgaagagcgcagtttatatggggtttatacgagcattgaattaaaaaaaggttaaaagaaaggtagttaaaaaaaattatttttattttagcattagaactcggatatgtgatcgataaattttaccggtaaatccctgaagaattattaactattaaaataatcttagagcttatcactttgaagaatttgattccgacctatttaaaggatatgtacgaaaatttctcaagataaaggtaaacagacagacctattttcatattaaaaaataaaatataggtcgaggcatccggttggccttctaatctccataataatgagcaaaaaaaatcattttatacaagaatacaaacgtatttttgatattgaaattaatcctgataatatgtatttgaacccaggattaaggttcatcgcaaaattggtaaataatttgaaattttctttaaaaaaaacgaaataatttagctattgaattctttgtggggtaaattcgggtgagcatcatttaattattattataagatttttttaagaatgagaaataaattgtcaaaaaataaaataatcaataaaccgtcggaattttttgaaatgttttatgatcataaaatagaaatgtcaaagcctataataatgaacaatgacacaataagagtaatatacagagagaaagatggttatattaaagaacatagtgtatcaaatattatcatcgcattatggtaaacaaatcggtattataaagtaataaatttattaaggactacttcgcaagcaagaattcatctttatgggtggttgcaacaagttactaatgataaacaaaataagctactatattctgataccggttaaaaaaaactaagttcaacttaaagtgttatttttttagatagtgtcatttacaaacatcccatgggcaaaactcctatagaatttggcgaattccttgggtaatttcaagcatttttttaaatataattttttagtcaaatgtcacatgaaaatgctggaaatagtgtattagaatttgtatcaggtggcagtaagcaatattcaattaagtataggaatgacaagaatggtcaaatatggtataaaacgaaaattcgcggtaaaatatgttatgttttcttgtttaattgtgctttctttagggataacttttaataagaagaaccaaattgatcatgatgaatttaaaaacatgattataaattatgaaaataataaaaaattaattttcgattatgacaagtttggaccaacaagagaaagttatattttatcaagaaatttacgaaaagaatataaacccattcaaaaaaaaggcattattggaaacaattttgaaattattccatttggtttatggtgaactaagtataacggtacgttattaaaaaataatagtaataaaaattaattttataaaaaaatgtttattattttatttaggtaatgatgtgccaagattatgaattttggaatgatcgcactaatgaactcatttttggaatgattttgctaataatttttttaagtttattaatagttttggtagttgcaataattgcccaatgttttaacaatttttttcgtgctgcaaacatgtaacatggaaagacaaaatttgacgaataaaatataaaatatttgtgatttttttaaaactgtctcaaaaacagtttatcatattttttttgaaatcataatatttttatttgtgtttcagctaataaaaaagaaaatgccgtcgaattttattaagtatcagagttttttgagtggaaataaaaatgaagtattgacaattaaagaattgattgattgccgtttaaaagtttgtgaaaaaaaatattataccattaaggcagatataaaagatttaaaaataaataaatacaaggtt

SEQ ID NO: 8742 - DNA, 4271 bp, Heterodera glycines
aggcggaaaaagatgaccatttcgaagtgaaaataacccttaacgatgggagaagcggcggagaggagacggagagcaccgccagcagaaggtggagggggagggagcccaaggcgacttcttcctccaattgggcccattccgcgtgccgattcgcatttatgccgacactcaggtgcaattagctgggatttcggcacataaaattcacttaaacgacgcgttttattcttcatctattttccttccctgcagctccaatttgtcactccctcactgatcaaattccgcgccgcttttcttgacggagtgccaaactctgagggaatgcttttggaggaacattttttgcgcgtttccatcccaccgaatgtgccattggacatcgctcaggcagagtttcgcctcgtccaaaagagcccatctctggcgctgttcaaccgacgcattgggcagcctatttcgagtggctttagccatggccaactgtcggccggagacattgcgatggtggcgatgggccaaagagcagtggaagaggaggtaaagcacaacaaaacagcaccatggacattgtgaattaccctcaaaaatattttggcatttgaatttgccaatccatggcttaaaagaacgccacttttggattcttccccaaagctcgactttgatttggtttcaattaattggctgttaatttcttaattcaaagattgtaaaaataaaactccgcgtgtgcattgaaccaccttctcacagtgcgaaatgcagcagaaccgccgaccttcgaattcattttggccgagacgaagcacagggtgagtacggtatacttacctgtaaaaatgatattttctgtcctttttttgcagtgccaacaattgtccacaatgttccattgaaggtacaaaagggacaaaaaagtgtgccaatcactgcagatcatctccaagctacggtaacggtcactgtgtcccacttcctacggtaattgtgcttgaaactgttcagcacccttcaaaaatgccgagtgaactccattttatggtatggcaacaacagggcggcgcacttcaaaagggactgaacacgaccatggacactttcacgcaaaaggaattggaccacggctttgtccgctttgaaattgacgaggcgaagggcgtgccggtaagtcaaagaattgctttttgccagggccaaaatcaacatcgacttttataggacacgaaaatgggcttccattttctgttaaacgacggtcgccatcaattggaccccgaatttttcttgttgcaatttgacgaaatattgccaagcaaaaaagaggacggcacaatgccaactcagtcgacattgagcagtacaccgacaattcatttgcctgtgccaagtgtcgcaattgggccaaaaattgaacgaaacgccaaactcggcactgcgccgggtgtccctgcggtgatcggtcctaatttgctgaaggcgaccggcggagggaaaataccggtcgaaaaagtcattttccacctgacaaagcagccaatgcacggccgactggtgaatggctttccgagaactgctcgggactgttgtccgcttctgttcagctgctcaacggctccctggggcggttggagcggttcagtcaggcggacatcgacgcgggtcggctgacgtacgtggcgaggccggacattggcgcgtggagccaacgcgacaatttccaatttaaagtggaggaggaggcggaaaacggcatcggaaggaatgcggggacgagcggagaggggacaacggcacaacgattcagaattgagagcagctactcaaacttggccgaaggggcgccaatcgacgcactgataccccggggaataatcaccgttagcagaggtaatgggatggccaaatgggagagacaatggcaattgtggccaagggaggagggatttggacgaaaggggagaccatgccaagggagagattttgattatgattctgttggtcaaatcgtagtccagaaatggctattgagtttagccaacccccggcacaattcgttgccctccgttccgttttatcactccgcccctatttatttatgtcaattattttttttatttaaatttccaatttttcttttcggtggttccgttgcactgaactcctcccatttgaatctgaccaaactgtccgccgttattgaggacgaaattttcataaagctttttcgcgcgcccgcctttggatggttggagagaattgacgaagcattggcaattgaaagcggcggaggaacgaattttggcggattagcaaacggagagaatgcgggagaagaagaggaggaggaagaggagaagcaaaatggggacaaagtgagaaaagggagttggtggagaggaaaaggaaaaggaaattcaaaatgaaaacggaaaatttaaaaaaatggaaaattaaaatcaaatgggaaaaatttaaaaatggaaaacggaaaattaaaaacggaaagagttcaaattgccctaggccatctttccccagtggcgttcgcccctttcggccgaacaatttgcctctggccactttttggtgttccaccaaaacggaacgacaacaaatgtagcagcagcagcagaaaaagcgggaaatgaagacgcatttacgctggttgtgtacagcggaagggagccaaaccaaagactgaaattggggatgaaagtgcgaataacggacgaaggcactgatcagttgaaggtaaaatagaaaaggcactgatcagttaagaataactgtaaaaagctctgattatttgagggtaaacgataaaaagcactgataagttgaagagtaggcgagcattgatcaggtaatagaggcactgatcactggtcagttaagggttagctagctataaaagggccgatttgtggtgatcaaccgaatattaaaattcaaaattggaaggaaaactcggcctaaattctctgtccatctgtccccagtttatttctaacatttcactctcgataattaattccgtattcattcagatcgactcttttgtgccccacttgcgtttgctgtccggtggttcggtccccttttatcctgccgattttcacgcgttccatccgtcgttgggtccctcccaaattgtctatcgaattgaccaattgcccaacactctccgccttagtctgaacaatttcagtgagtcatatttatccaaaatattcaaatcaaatcaacacatttggacactttcgaaggtttgccgctgttccgacaattcactcaattggacattgaccagggaacggtggcgttggaacacacgccgagcagcgaaatggccaaatgggacttaatcggacttcgaattgggatggaggggcacgaagacggacacggacagcagcagaagggtgggatcagcaacagcaattggggaaacggattttagaaatataaaaatgaggtgtgggggatactgtacaatataggagatgatcaaaacggaggattgggagaaaaatgaaaaaggggagaattattgttgggggggggggtttcccatcaaattgggacaaagctgacatcctctttcttcagcttctcctcagtttgtccactcgcgcgttttggccattcgcatcgacccaatggcacttcacttgcgaaatcatagcgaaattgcaattccccagggcaaaacatacgttctgttgagcaggtgccgaattaagtctaatccggaccgggtcagtttagtacggccggtttagtacggccgttttagtacggccggtttagtacgaggggtcggtttagtacgagggtcagtttagtacggcaagctgtttttgtccaaaatagattctactgattttttccgaaaaaatgtttaaaattaataacataacataccgtatttgctctttttatatgccatggtatattatttttcaacctcctcagaaaggggtagataattggagaccggcagattaatggagactggcacataaaaagagcaaatacggtatttatcaatgtgttaacaacaaaaaaaataacaagcattgaaaaattacgggcgcatttcataattgcgagaaacaccaacgagcaaatgattgatgttatcgggattaacattgacattggcatggtaattgtggtcattttggatagccgggttattgttgatggtattgtattcctgcaaaagtcgaagaattctcgcatcggcggcacgatatttgggc

SEQ ID NO: 8743 - DNA, 919 bp, Heterodera glycines
catcgacacaaaacggtcgacgttttggggtggacaaggcgatcaacgaacttcggatgggatttgctaatgtcgggggcgcaaatttgttggagtcgacggtatacgcgacaattaacagcaacagaagacagcaacagcagcagcagatgatgaacagtgctaatgccaacaataaaatgtaaaggggcaataaagcgcttaattaagaccaattaggaaatgcgcaaacgccagtgcgattgccaacatttgatttaatgaaattaaagcggaaattagccgcataataataccaattaggaggaggataaaatatgtaattcatcccaatttatgaatatgttttttaaatgattaatattttcttttgttcagcatcagcagcagctcttcttcgcctcagaatgtgcagtcgaatgtcatgaacactttgggtgatgttaattatgccttttccgccccggggagtgcccttttggcccgtcgtccgtccattttgcctttgtcgttggcccccacaacaacggcaccctcctccgtcagtgccatcattccgacttttcacgtttcgacggggcggcaaagttcgccgacgcgtcgggtgattccaacgatcgcattgccaccgccgtcgaggcaatcaatgccaaattgaggagcaattaacatatttttaaacactttttgaaggagtaattctcgcgaaaggcaacaaattttggcgtccgccgcggcagcggcgatcgcatcgaaaactgtgctgagcgggacggaaacggtggcgatgaggcggaaaagtttggagccggagagagcgcagcggaggggcagcagcgaagaaaaccgaacggaagcgggggaagcggaaaagagcaacgaattttgggtgtgaagcgacgacagacatttgaccaaa

SEQ ID NO: 8744 - DNA, 6998 bp, Heterodera glycines
  misc_feature (2497)..(2497): n is a, c, g, or t
  misc_feature (6904)..(6904): n is a, c, g, or t
ttaaacaaccgtaagaattgactaaataataagaatgccaggtttccatataaaaactttttaattttcaagaacatagaaatttttgagcacaagggttgttaaatttactaaattttaatgatttatataacattttatatatttatattgttttatttttttgaaatccctccctctggtgcccaaacttcccggtgcccaaatttctggtgcccaaacttcctggtgcccaaacttcccggtgcccaaacttcatgtcgccgttgtcacatattttgccatttgtgggtttttagcacataaaaatccgagatctaattatgattgtgaggtaaattgatttgtgcttctaaaacgatttaaattttttacgaaataacttttgtacacagccgacggaataacaaaaatttggcgatgtgttttatatttgaatttgaacgttctgagaaaacaaaaaaggcaaatgagctcgaagcgggtcagttccgtctggccagttccgtctggccagttccgtcttagtagtaaaagagccggttccgtctcaaatatttttggacccaaatttttttaaatttcagaatgtgaacagaaagttgagatataattaacagtgctgccaaaaatatgcacgaaaagtagccaaaatatgcaaatatgcacaaaaatctcaaaatatgcaaataaaaataccgatttttatacgcaaacacaaaaaaagaacgtgtttttcctattatttatagcatggaaaaggcaggaaaaaatacatttgcatgtttttggcagctctgatatttaatatgcctaatatttttgggtgttaaaactaaaaactgccaaaatatttagggtttcggttctaaaaacctcaaaataggtgttaaagtttcaatttaggggtataaaataacaaaatttttgaggaaatttttcatttctcaggggtgtatttttgaaaattagacgaaatttatgtaaattaatctttatattcgggttcggggtccaaaatgggtgccggatttgctgcaaacaaagtgctggacacattaaggctgctaaatttctcgacacgaggaccaagactgagaatcccgagcagaattactggacatttgcaatgttaaattcatttcaaaaaatttttattttcgaatatacttttaattaaccacaacttttaaaaaaccaggtatatttaggctgcggtaggctgcgaagtaaaagaatttttactttttttctaaattagttattgattttaaaaaatttgagtccaaaaatatttgagacggaaccggccctttgagtactaagacggaactggcgagacggaactggccagacggaactggccagacggaactgacccctactgaatgagctaaaacgaataaaatatttcatctttatttttattttaaattggcacaatgtcaatatttttcataaaaaattcttattcataagctcattttgttattataaaaaaaccaatcattagggggtgtaaaaaagtctcggtctcgagtctcgaaaaccgagacagagacttaaaaacccgagacttttctcgagtcgagaccgagagtctcgagcagcactagcgcttggcacaacaaaatagtaaagaacaaaatatttattcaaagtaaataaaggggaatgaagtgatgaagtctgaggattcacaactcataaactaacagataaattaaaaaaacataaaaagcaatgcatttttctaccgatgtaccaaatatggtgaagagatatgtatagaaaggttatatatagaagaagtccttaccagggatggcattccgaaccccaaaatttttttactatttgtggatttttgggctaaaatttaaaaaaaaatctgattcggtgccgatggttgtttggagaaggaaaaatctgaaatttgtctcaatttcttaacatacataaccaaagtcagaactcgaactaatagtggagctttcaaaaatcataagaaacatttctacacctaaaataccgatagatcatcagccattccatccaaatctattcctttggtgtgaaagtgagttaaataatgccaacttcttcttttaaattacgtcgtcattttttcaatcattttcactttaaatttattttttatttggtcaatttcaattagcggaaattaacaagaaaatgagaacatgtttaagtgttaattgaataaaaaatttaaaaaacggaaacaaaatggaaaaaagtcattagtttatcaaaatggtaacaactgatcattattattcctcaacagaaagagcggaacgttcaaatttgaaattgggcccaaagtttgcctcaatttcgtctgtaaattccttcagagaaacaaatggaaacaaattatcaaaatcagcagaaaagtccgagtccaaagtgtatttgaattcttaaaatatttataaaaattcaattttttatttttctaacccaaaagatngtccatttttcgtgaaaaatatttgacgagtgccaaagtcaatgccaattccaaacaacatcacccacgtgcaaaatgtttggcaaaaatttctgctttttccccgtcgtctatgatagttttgttttcataaagaattaatggggtttcccatctttgaaaatctttttcgatatatttgtaaatatttttgggatttttgtcaagaaattttttttcttcgcgctcctgaaattttctaatctgaatttttatgtgtaggctaattgaattatataaagatttgtatttattcgggttttctttgagctttttccagatttttgctttttcctttatagaagcttggagtgaaataggataattaacattttttggttcctttttgaaggttatttttggtgaaaataaatccattgcatcaatggattctttagtgaacctgttatatttatgctctaagtcaaactcggattgcaatgagtcatttagatggaagcttaagaaggaatttatttgatgaatattttttgggtcaaattttctatagcttattactggtggattagttttctgtaaggaaatagatagatttatgaagagagattcatggtctgaatttattagactgtctttaatttcaacctctgttaccagcctggcatcatttgtcaagcaaagatcaaggatttcatttcctcgggtgggcccggtacaatgcatacttagaaaattttttgtgaagaaatttacaaagtgttgtccaatttttgaaagtggggttggttttccattatcccattttatacatttgctattcaaattaaaatcccctaagattaatgtcggtccattgattttttgatccaaataagaaaaaaagttttttgtgttcgatagattaattgttgggggcctgtaggccccaattattgaaaagtttttcaaatttttaaagcgtaatacaacaatttcacaaccgaatttggaatccgttgttgagtcgaagggtgtcgtcaaggcgtgagcctaaattcatattaataaaaaaaataatgaaaacgaaaattgttttataaccttcagcaagttgaattgttttgaagaaacagcgaacggcattcaatgcgtaaacagtgatcagttggtgacttttgagaggcgattgaattgtgctgatttgttgtgctggcattgttggaggtgcaattccctgaagaaaatagcaaatagaatgatgacattttatttattattttttattaaaattcaatcgtatcaaataataataattttttccgtccgattcacttgtgctgttgtgtacaatgttggcatatttgcggaggtgaacagctgttcagcacccattgccgtcgactgactcgctgaggcagccaaaacggcactggctggcgaaattgtgacggaacgctgttgccggtcggccattatcatgttgtaatatgttgttgccagacgatgccaagcctattaaatgaaaaaataaaggaaaagcacaaatgcaagcagcacaacaccttgtaccagttggggtcaaagttggtcgcgttgatgtaacattgaagaatcagtttctttgctcccgactggtccatcccagtgaaataagttccaattggagagggcgtgaacatagcagtcgggtgttgctgaactgtggcggaccaagcaaaaagctgaaaatttaatggaaacattaatttagagcaacatattcgtatttaatatatttatacgattgtaattttgctttttacagctcacctgcttgtgttgttgttcaatttgagcagtagaaagtgcggcagaaggagcacccgagtgaaggctgatagagccgtgacgacccgcgatcggtggtgtgctagtcgagactgcaattgaaaaacacatgctcgagtcttaggttgtcaacaattctttgttttatgattgggaaattaatgttgatcagaaacaaacccagcggcgattggatggcggtgattgagtcgtgccattcacccaacttaaggtagcatttcgcggtcagtcttgcgtgtggttcaagctgttcgcgggtgagcattgtgcgattgcgctcaatacatcgatgcaaagtctaaaggaatagacgaaatgaaaaaaaaatcgtccgtttttgcctgcgtgagctgttccaattgaactaaagccgttcgacggtggctgtcaacccataattgtttgcaaagtgccagtgccaactgtgttttctctaatggcaatgggattggcactttctccaacggagtgtccggcggcacttccaacaaagaacggatgacattgcgagatacggtcacctgcctcccctcataacgacaaagtgccgcaaattttatccaaagagggcgcaactcagtttgagaaaagacgatcgacctggttaaacccaaatccaagtgagtttaagcattttgtttttcctacctgaccatcaaaatgcgcctccaatgttcaacatttcgtctgcatccttgcaaccgtcggctccacaaaagagcgatacgcatttcgcgctcggggatcattttgtactcgatggcctcctcgagctcggtcagttcttgcagcaaaaccattgctccgtaagcgcgctcataactctctgctgccattgcggtcaattccgagtcaaacatatctctgaccttttgtatttgtgagataaattattatgaacttgaaattaaattggtttttttgaacttgaatttagatcttgatgggtctttaaaaattcgctatttttcataatttgtttaaaaaatcaccttatttatgcaggagtatgccttgtcgaagtcgttgttatgcacagcaaggacagcgcggagaaaggcgccgtcgcggttgttctcattgattttgtcaacataatcttccattttcttgaaatttcctgcaaaattttttttttccaattcctgggggcttcaaaaaagtaccgactgcccaacagccccgggctcctatcgtcgcaattttctgtcgctttgccacttcgcttagcgttgcgttcagaaattcggcggcgactgcgtccaccaacggtgtcggttgcctgagggcgtgtagttgagggagtcgggctccgcttctcctgctcgaccgtttccgtaacaattgtcgctgcggctgctgcttctctgtggcgatgttgaagttggggttgtactggttgctttcctcctcggcgagtgctgtctcacaaatgcggtccaactgactccactgaccgagcgcctccaaacagcgcatttggtgcagcaaaagatcggagcgagaagactaaatagtcaggagaatgcttgaaaaataacataaaatccgtgtgtttgtactccgttttgttgctgcggtgtcgcaattcgattcgtggaagcactggcggaaacggcggcatcatcaccgagtcctgcgtttgcagtgggtttggactggtccaactcctctctgttagtcgggagcaattggggttcactgtgtgacgaaatagatttccatgatagttgttcgtcgggcaaggtggtcatgtcgttctgatacatctccaacgccttttcccattcgcctaatttttcgtaccaacgaccctaaaaacagttgaatcggtgagcaacgaaaaaaggcattaaaactcatgttgagaaaagaaagtcacgacttaccgatatttccatgttgtgacgtttggcatactgaacaatgccggcggcgccttcttccagatttaatttgttgaatagcattatcatcgtttgacagtcatccgcgttcggttctccgttgccgcgggtgctcaaaatttccatttctttgtaacgcagtgcttttgcgtatgcacgtgtcttctccgccgattcgctgagcattcgatgtttaattggaagaggtcccttaaagaataaacaaacaaaaaaaaattttttttttactgcgctttgtttattgccttctcagaatggtccatgaattcggccaaattcagtatggtctgaatgggttcggcatgggggcagtgcctcaacacatcgatcagctgattggtcagttcgttctgttcccgctccggcagttcagtccaaacggacataaaagcggcattgaataattccctgtaaattatttcattaaaaatagaaaagtaaggggaaaaagaacggactttgagagtgattcgcacatttcggccaacacagcgcaggcgcgaagtgcggacgacggactctgacggatgaattggttgcgcaaagtgccaacccactgaagccaatcctcacgcgagagcagtggttggaccgtccaaaagcgacgcaattggtccaaattgatggccaagcgggaaagatcacggcctanaacccctgaccatacgtcccggcattttcctgttcgccttacccgaagacattctgtgcactcgagacatgtccgcactgcttcccgcgggccc

SEQ ID NO: 8745 - DNA, 1984 bp, Heterodera glycines
attagagaccgagatttccaaattctccggaccggaccggactggtatttaaaaaatgaccggatcccggatccggtctctcataatccggtcaatccggtaatccggtcaatccggattttcatattgccggatccggaaccggattccggattggtaaacatttaattttcatgtgttaatttgggaaaaaacccgcaaaattttcatcaattatatgtacaaatactaaatattataagtttaataaaatgaacaaataaatggtttcgataattgtaatttatctgggggagagacttgttcaaaaaaataagttgttctgccgttttgggtgataatttggaacggcgataatcaaaaacatcacgggcgactttgaatgtttgttcacttgggacactggtggcaggtgctgaaagatattttcctgcaaatttggcaaggattataaatcgcggagcaattttcttccattcgtccaacggattcgcttctgggtttgcaatttccagcgcgagaaattccttaatttctttttcaatgtcatcgtcttgcgatgtttatacgccttaaattcattataaatttaatttttatagaccaaaaatcaccctgttcactgtgtttgcgcctgtaatgtgtttcagacgttcaaaaaatgacattcgtcgtttagccggcggattttcgggttggggcgacataacaggacgaacaaattcattttgttgtagtccatcgaggtcattatcaatttcccattccttcaactcatttttgatccagacagtgactcgagcgcgaaaagttgcggaattttcagtcagcactttgtccttgaatcgcacatccaaaaaagtcgctagcgcatattccctatgataaaacattaatttaaatcaaatgaaattttttaattcttgttcgctagctcaaaaaagcgccgttcaaccgcatagtaaagtgtcgttctgattgtctccacagtcctgttgacaattttcattgcgtacaactcatcgtgtagtgctcttgcttgaggaaggacaaacaaaattggctcctccgtgaacctttttgttgcttcttcagcacatttcaaaaccccaactagttcttcaatttgcccccactcatcattcttcaataaaagctcgagttcgttgttgtcgactgcatattgtgtgattgccgccctttgttctatcagcctctcacacattgtaagcgcactgttccaccggacacataccatctgaatgccattaggaataaataaaattaacagtattttagtatttaactttaacctgcaaaagagtatgagaaggggcatcgagtaatttttgaatttttttcaattcgctgaaggcagtgttactgtgtttgaaacggccaacaatatgacgagttttggccaataaactgctgattgattcatctctcttcaacgcctcctgtacagccaaatcaataaatgagcagcgcaaggtccgttcggcattggcaaaatgcgattttcgttttcatccctctcgacgaaagcctgcaaataaaaacaaatggaaagaaaaataaattaatttatcactcttttcatatttgctgcggaatccgatataatcgcatgcacattttctttagcaatgccccatttgagcagtaaatcctcaattttgagagcgatatttttccctgtatgtgattctgaaaattccgtaattgccaaaacacgtgacatagacttccattttgaaattgaatgcgcagttaagctgttattgaaccaatcataattaaaaagaaaaacacaaattgtaccacaaaaggttgcatgtgcttccactccaacaatcagttgtcagtgtaataaatgcggattcttttaattcatctttaattttctgtctgacacgttggtatacaattggcaaggcagattttctgaaaaaattgaaaaattaattttatttaactttta

SEQ ID NO: 8746 - DNA, 4318 bp, Heterodera glycines
  misc_feature (4291)..(4291): n is a, c, g, or t
tgttctcgactgcatattgtgtgattgccgtcctttgttctgtcagcctctcacacattgtaagcgcactgttccaccggacacataccatctgaatgccattaggaataaataaaattaacagtattttagtatttaactttaacctgcaaaagagtatgagaaggggcatcgagtaatttttgaatttttttcaattcgctgaaggcagtgttactgtgtttgaaacggccaacaatatgacgagttttggccaataaactgctgattgattcatctctcttgaacgcctcctgtacagccaaattcaataaatgagcagcgcaaggcccgttcgggattggcaaaatgcgattttcattttcatccctctcgacgaaagcctgcaaataaaaacaaatggaaagaaaaataaataaatttatcacccttttcatatttgctgccgaatctgacatgattatatgaacacattccttaggaatgccccatttgagcagtaaatcctcaattttgagtgcgatgtttttccctgtgtgtgattccgaaaattccgtgattgccaaaacacgtgataacgacttccattttgaaattgagtgcgcggttaagctgtaattaaaccaatcataattaaaaagaaaaacgtaaattgtaccacaaaaggttgcaagtgcttccgctccaacaatcagacgtcagagtaataaatgcgcattcttttaattcatcattaatttttgtctgacacgttggtaaacaatcggcaaggcagtttttcttagagtttaaaaattaagtttcgtttaattgaaaattacctataaaaccattcgctcttcactttttgatggggaaacaaagaatgaaatgtttggtcatccacagcgccgaaggaaatgttttttgtcaccaaaaaatgaagaattttcttatcaaaggagagttgagctgaaataaaaattaaatatttaaagaaaatggttgaattacagtgaaagagtcggtccggtggatgactgaaagtctgagattgtcttttgtttttgtttgtccttttcggctttcgattcaacagcattcagcttttcagcaaattcggagttttcgtgaatggcgtgaagatggacttgcaaacttttaagtgatcctttggcaagcgtgtattcaaatttaggcttttcatttgcttgacactcgagacaaattgctgtagtcttggacgttttttttaaatagaccaatttgccatatagaactcattttaataaacctaaaacaaagaagacataaattatcaattaaaaaattttagattattaaaattacacataaatcccacttgaaatttgtcaaaatgattaaatgttaaagacattatgccagagatatttttcaaagaaaaatgaacaaaagaaggtttttggttgagaccgagtcggaccggatctggtcaaaaattcgccggaccggaccggattggcattttcaaaaatgaccggattccggatccggtctctcataatccggtcaatccggtaatccggtcaatccggatttttcccaaaatcgccggaccggattgccggatccagaaaaatccggtaccggatccggtccggctcggtctctattaattattcttctttttttacactgttctgaacattcgacaaagttaatcaaaaactgaggccaggccattaggctagcaaactaaatagataactactaaacctgtagagccatttaaatttgttggatttgattgaccaagaaaaatgaaaaccccaaagattaatgagcacaaagcattggaaaaaagtggagacagctaaagaagccgaattaaattaaagtgaacataaaaaataattaagtgatgaaaaatgagtaatggaattatttgagtaaaggatttaaaaaatattgtgatgcgtaaagtctgttcatttaatccgtctaatgggaaacgaacttttatttattttattattatttttttgctcattggtaaattcccaattaaaaaaatagagaacttaattcgatgattgaaatttaaagagttttttaaaatattgaagtttctgtctgtttcaagtgaattttcttatgacgtacaacgcatcagcagacttggtaatcggaattccataagaatttatttataaatttgattaagtggttccaatatttcacttccgatgggccccaatggctaattcttttcgctgtgtacggcgcccgctctctgtggacaactttaggactttcgttcaactttggcgttgtgtacattactgccaaatcaaagtgattaattagcatgcgaagtgaacaattaaaatccggtaattatattgaatttgccaattccaaggacacttcgcgggacatgcaacattctgatcgcaatggaaagtgccttcgcactgattctcgacctcggcttttatgccagctttttcgtccttttgtccggcaggacattcgtccgttacgagtactgcttctgggccctgctgttgccggctgtgttcggcgacatggcccaacttacgatggtgttgaccggcgtggaccgactttgttgtgtgatgttcccaatttggtaaaattattaaatttgaaaatggtaatttatttgtccgttttttttattaaggtacaaaaaacggaatgccaagtgctatttggcattcgtttggacacttctctgctgctacgccacctatcagttcataatcgattacatcgactatcagaacagcaaggatttgtaaggatcactcgtttaaatgaatttggcctttttcgattagcatggtctcctgttccaccaacgaaatgggaaacggcggcatgggaagtctaatgagagtcaacggactgacactgagcggcactctgatggctgtgtattcgctgtgttggttcattgtgttcagaatcagtgccgtctcagaaagtgacaaaaattattaatattttaaatatttaacaaattgctcagatgtaaactcggacaatcgcacactgatcaaatccctcgggtttatcatctctctcaatttggcatgcgttttcataaagtgcggcgtcaatttgcttttccaaactgttttccaagtgaatgtgttcaccaaatcggctttttccattgctttttccttcctcaccataactgtgtacagtgcaaatgcgccggttctgttcgttgtcaggtggtcatttaattaattaaatttaatgccaattaattagcaatttgtaccgtgatcactttatccgacacttcccgtggctttcgaaattggttcgaagcaatgaaaaagtttcttcaatttgtacttcgaccacaacaatcattgtccagccgaagaatggcaccccaaacggtgccaatcgcttttacaatgaaaaattggcatctgattgaactcaaaaaagcgactcaaattttttgattgattttgtaaaaatgatttaaatagtttgtttttctgatcaatataaagctgtttatttggtggatctttatttaaatattttacatattattttgtttttattcattttatgtaaatttgggtaaatattttttattttttgagaataaagataaggaattgcgatgacattttgtcacttatcatcaatttataggagaaatgaacatcaatcacagtttttataagagttttctgctcaattgatgatacaaatttagtcatatttttgatttattttaccccaaattcttaaattttttttccaatatttaaaatgtcccaaagaacttcctcaataataaattttcgggacatcgctttatgccaacagcagccacccggcacaataatttgctttcggcactgtcgtctttttcaaaacggcactttcgtcgctgattcgggtgggtgtttttacttgttgtaaattaagctcgttatttctcgcttattattacagtaatacagagatttacattttatgcgtcccatgaaatttatgcgtaacataattattttatgagtctcatgaccaggggatggatttatatgtttttacatatttttttgcgcatatgctatcgtatgagcacaaaaatagcatttttacctgttttaataacaatctgagcgattttttagcacttaaaaaaacaaattttgaactttttgctcataaaaacatattttggtgatttttaaccttcacatattttgagggttttttggctcatataaatccgttccctgttcatgacatagaaggtgtccaactngaattatttttttttttttacataaaa

SEQ ID NO: 8747 - DNA, 4053 bp, Heterodera glycines
tgaaggcgaaagttgatagattggaccaggaaaagcagcagcaattggacaaaaaatacggtagagacaatttaaaaaaataaataatttttattaccgtactcggacagtactgtatgcttcaaaattatttcagtttctgtcgatgtgttcaattcattggtggagcgaatcaaacaattggaaaatcggcagaacaaagaggagggcagaaagggtaaataataaatttgaaataaataattaacggaccgaaattttgcatactttgaaaaggcgaaaaaattttaacggaccataagcttttacaattttgaacagttacaaattttaaatgaacatatttaattagctgaccaatgccaattatttttaattttcattttctattattcaattggatacattttttagcagaggaaaagcagcagaaggaaagtgttggtcaacagaacaaaaacaccgaacagaaattggatggaaaatatgccgtggtggacaaaaacaatgttttgggtgggcacaattggcaaattatttaaaattaaaaattggcgttataaaaaaatgcattttttgagaggggacaaaaccctcgtattatatcgggattttatacatatttggtacatatttcggacttttttcttacatattttcattttttttacatatttgaggattttttacggaaatttttggaaattctcaaaaaaaaatccaaaaatttcggcaaatttttcatttttttacatagctattctgagaatttttgaaaatttttagaaatttcttgtgaaaaaattaaaaaatctttttttaaatgtacccctccaaaaataatttttcaaatgttaaaaggtgattttaaacattttggtcatttttatggcattttgtgcctatttaacactttatgaaaaatgtacatattttttacagccctaattataaatatttaggtgttaaaaaattaatttttctttttaaaatgtatttattgctaatttagttgctttagtgacgtcatcgggcgaccattcgccgtcggcggttgtctcagcgaaagttgcaaaggtgggaaggaaaccttaattatttcacaaatgccatttaatttcaggaagtgcctaattcgcagcaacaaaatgattgggatgccaaagtttgccacaaagacatcgaaatcattggggaaaagcaattgacgatcaattgcaagggcaacagatttggtatttaatataaaaattaaaaaatgtaattaattaattactttcttaattaggatggcgctctgtttttgcgaaatttccaattacgaacttttgtcgtcccggaattttctacttcgaaatgaaagtgttcaaattggaaaggtgttcattttgatgatttcttagcgttttatttataattttgaatttattttaacagttttgctgcgattggattcgccacgaaggaagtgccattggacgggtcaattggtcaaattttgaacagttacgggtaccgaagcgatggctcatttggctgtaatggcatcaatcggccgtgcaaaatgccaatgtcattatttggttcgtcattttcccccgtggcaatgcaatcggcggacgtggaaatggcatacaaatcatcggagttttccactggtgacgtggtcggatgtggcattttcttggatactcgactgatcttcttgacgaagaatggccaacgaatgggtgggccaattaaaatgaaaaaacaaattaattaaaattttatttttaagattattcctcttttttcattcaaactcccgccaattctctcaattctctgtttccgtgcgtttctttgtgggtgggcgacaaaatcgaggcgaactttgggccaaatttcaaattcaatttggcgactctctgaagaaagcaaaaagaatggaagaaggagaaattcatctaattgctgtcatttttactttatttatgtttattttttaaattctttttttcaattttcattttggctttataatactaattactattttatttgctattaatttcgtttattaaaacgtcgattttgtgactcagtttcaagtttcttcgaaaaaattcctatgaatcttaaaaattaatacgagaaacttcacaaaataatttaatttctcttaaataaggatggcatttcttgactcttggttttaaaattctgaattggggcattcttttttaggtcatcattttgccttaatttatgttaattgaccccgataaatatgttaatataagcaactgcagaatcagcagatgttcatttattacttctccaatttgttaataatttttctcatttattacttcttcaatttgtttaataatttatcatttattaaaatttacatcttttattgtgaactttcattttaggaacttaatgaaaagtttgtcaaaatggaattggtattgaaaatcaccaaactggagcttaaaaatgtgagtgttatttaaagtgtcattttttgaaaattaaatgggaattgctaattaattttgaaaaaaaataaattttttaatattaaatgattttagaagggactccaataaaagttgaggcagaaggaaacgaatgtactgctggcgaaatcgaagcggaaaatgggaaaatgaaaacaaaaaaaaaaactaattttgcggatcaatttttgagaaaaatttcaattcttagggttgtatttttctttttattgcatttttgttaaggatttttccgaagatcccgatgcaattagtgccactaaaagcaaaaagaacacattgttacaattgttatcccaattttcatcgttcttctgctgctgaaccgtcacggcctccccaattttgcatcgctgcattatccatcggttgtccaattcctttgctttggccaatgtcagcttttcctttgtccattcgttcaccaattcaaatgtcacaattgatggcgcatgaacagtaaaatgaatttggtaactgacggaagaaatggcattggcacggagaaattgctaaataatttggaaaataaaaatagaagtagtcaaaatcagtaatatgcaaaaaaatatgggaccataccttcttgaaattgttgacccaatcgaagtacacttgtcgttcaaaagtgtgcaacacaatcgcttgggttggccatcttttctcggtgtgtgccaaatcgtcaccaatcgcaattgcctcgggcaacagaccatatgaatcgattgaattcaactgattgagatcagtgagaattgtcggcgaagtgcgaagaagaaaattgtccaactgatcaccatgttaaagcgtaaatggcgaatgtttgtcgaaaaaatgggccaaatttcacgcacaaaaggtcagccgtagggtatggatggggtgtgagcaattaattaattatacaaaatattttgagtggtagaacagttaaaataaagaattagatgatttttatttttgttaaattttccgccaattttgttgtgcggtgaagaacataaaatgccatcataaaaattatgtgcccttgttaacaattaaaaatgtgtaaaggttcaaaatttgattaaaacattaagaatgaattataattttcaatggtaataataactgagatttgtattcgttcgagtgggccgccttgtccttatttcgatggtgtccttattagagaacggaattttgaaaatgccgggcccgggctcgggcttcgacaattggccgggccctggccgcccggtcaaaaaaaccccgcttaaacgggcggcccgggttgggattaagtcaagcccatgtgaagactttttttgttttacaaaatacttttttactgcgcgcttttttcagaaaaaaaatttggagaactagagggtccggctgtgtgataggcgccgccgaggaaaatttacttttttgtatgatttgttaatagattttgtccaaaaatgaacaaattttgcattttgagccaattttttagggccggcagaaaaattttttaagttttgtatccactttg

SEQ ID NO: 8748 - DNA, 3340 bp, Heterodera glycines
tattttcaacatttttaaaattttattttgtgcaaaatctattgattggttaaatggcggttgatcgcttgccgaatcaccaaaaatcattgtcatcttcttcctcatcctcctccccatttcatcgcgcatctcgaccacgatgtcgctgtcaagcggcacctcatcgtagacgggctcttcgccctcctcaattgcaccatccgcgcggcgctgcctcgctgcttttaaatttaaattgtaattttaatgagtgagaaattaaaatatataaagattttaatttaattaaatttgcccacccggtccaccgtcaaattgacgcccgtcgggcgcagagaaacgccggccaacattgccggcaaaataagcggagtcggcgcgctcaccggttggcagttgcgacgggcggcactcattcctgtacaaattgttaattacaatttgctaaaaatgtaattcaaatagtgagaaactcacgctgacgatgtcggctcagcatcccctttttgtaggcgcggtccttcaaaaatttgcgcactttgaatccggcgcgcacaagctaaattgaggaatatggatttggtggataaatgcccaaaattaacgacctgcgcgatgaccaaaagcgccatcagcgctgtgcacaccgcgatccacgcggtcaaatgcgcgggcggaggtgcacattctgccgccgccgccgtttccgcagttgtcggaagtactgatgttgttgttgttgttgcagcttcgtcaagctgaccggtgctcaaaaagtccgtgatgttgcggacgctgggatgcgcacacagcacaagcttcgcgtacttgcgcggatagaaacactgaagtccaattgggcaaagcgtgcagttgaatttgatccactgcatggcgcgaatattcggagaaataaccagcggagtatggcccgatcgctaaaccccccccccttccccatccactttagttctccaaaaatttgtttcttttgtcaatttgtcgtcttttcattgtagaaatggtcatacagatgttatcttcctttgtttggctcggggagtgatcaacaaagattagtgcaaggaatattggacacaaaagaataagtaactttaggcgccccactgacatgatttggtggcggaaaaaatttgaatttaatgtgcgttataaaaactggtgaaattatgattaaacgaggggacggtcaggataatttttatgtattgagtcatcctaaaattagttgtaaaattatagattataggcaaaactgataattggctccaccaaaatattttcataattttgagtgcaaaatgggtcataaacattcgtgactgcgtcatttttagttgacttagataatttgatttgtttattagtgtcggcatcggcactccgatcaaaatgctgccgacatcgcggaggacgacgatggcacaactgagtatgaggtcacatcactggccctgtacgacaaggcgccatgcctcgtctgcggtgctgtgaggtattggtatctaattggataccaatcatgcgatgagacgttcctcaaggatgaggagctgctcgaccacgtaaaaatagctgagaacggaaatttaaaattgaaacgtttttgtagattggattcagtcttgcgagactgatgtctgccgtgtacacccatgcggcggttgttggtgtcatcgacatcgagagggcccgcaaaatgtggggaaattggcgataaatgaataaataatacacaaaaaaattttagcgtcatcgcccgtgtgggcgtgcacgcagaggattttgctttgtttgggctgattggcgaagaaaggatgcccttggtaatgacgcccttgggacggttacagtcaaaatttttgatttaggaccaggttttcccccgggtcccatcaccggaggaggttgtcgtcgacggcgcagccattgttgatgaggaggagcagcagcagcagcagcagcaacaattggcacaatttgtccctttgctggtcgcccaacatgtcgttaacaatcagctggccgcttcaccatttttcgtcaacccaccgtttcctcggcttccgggcgccttggaacttccccctcttcaattcggccatcagcatgcatttgcacctcctcctgcaccggcactccaaattgtcccgctcgatgatgccccggcggctcaccagcaaaatgtgcaatttgttttgatattttccaagaaaatccaaaaaattttcaggcggccccaattttggcattgcgggatgtaggggtagtacaataggggggggggagtatatttaaaattgtaaaatgatgataataaggcgatcgctgaccctcatcagcagccgtgctcctccaactcgttgccgccgaactcgcgcgattgcatcaggaaagcatataaaaagatagctcccgaactgttggagcggacccgtgccgaactgaagcgtccgggaacagccagttcgatcagcagctgtgggtcgtcgtcgtccacggtctcttcaccagcgaggcgatccgatagggagaagcggaagctcgaaatgatccgtcacgttgggcaaaaatgtgaccccaattgccagacgtgtgatcagctcctgaaatgatctctcgtccccattccaattcccacactcatcacaccattcctattatcgacagtctttctatccgatcaaacaccaaccaatgtactcttaattaccccccccttttttttattaacaattaattatgccatttcctttgcttttccaccataaaaaatcatacacatctaattgattttacaaccctcccctacggcacacccttccccacggttcgcgcccctccccactcccaacgctcgcgtcctccctcccacagagtatcaccacgaaaattcaaatttgaatttagcgccaaaaggggcgacaatcgtacaggggtcactactaattgcgccgcaaaaaagcggttttgaaaaacaacaaatagttaaatttatggaccatttacagatttgattcccgatctcttttaccatccatttgaaaaatattagtcgacccatcagccccatttaatgcatcccgctagccctaaaaatttattttcaaaacttcaggtattttttgatttttggaatttttcggattttcaaaaatcccgcaatcccgcgcgggatcccgcaaattttaaatgcgggattttcgagattaatcccgtgggatcccgtcccgcagaaaattttgagttcaatccctcagcgggatccgcaaatttgaaatttccggtctctactacccagggcatataaaagaga

SEQ ID NO: 8749 - DNA, 1108 bp, Heterodera glycines
aaaagattatgatgatgctgacatttttcacgttgctaaacgtccattaggttttcctagagtagaacgggaccgggacctggtactgaaaaaagcggacaactgagtacccaggtctcggttttgaccgtgaccgggactagtcccggttttcccagccaaaaattcccggtttatcaacccgaaaaggtcccggtcccagttttgcctaaaattcccggtcccgatctattctagttttcccatcaaaatttttggctatgttttttcatttgtccacttttcatccgggttatgggttctataaaaatgaagagcacaccgttaccaagaaaaacactttcctcaattaaataatacctatattatatatataacaactggtaattcaataaaagtaaatatttgaatattcccctttctatttgcacaatattcacaaaaaacaatcaattattgaatttaatataaatttgcttgtgccattttgtcagatgtaaatttagctagtaataaccagggattctttttttatgtaagaaaaatcgcaaaatatgtaaataaaatatgtataaaaaatgctaaaatatgtatgaaatatgtacaaaaagaaccaaatatgtgcttaaaatatgtaaataaaaatttttaaatggtgttttttggaaaaaaatcttcgtaaaggggtgaaataagtacaaaatgccctaaaaatgacctaaataggcttagaagcaccctttttactatctcttttctgaaaaaacgatttttaggggtatattttcaaaaaaaattttaaatttttcatatgaaatttctatcacttctcaaaaatcctaaaaatatgtacaaaaaattgtgaaattttgggtttttttggggacatttaatgaaaatttccttaaaaaatcctcaaaaagtccaaaatatgtataaaaatatgtacatgtgtaatatgtagaaaaatcccgaaatatgtaaaaatatgtaaataaaagtcccaacttttgttcgcaaacacaaaaaagaaagtgtttttcctattaattaggctatggagaatccaggaaaaaaacatgtatttacataaaaaaaagaatccctg

SEQ ID NO: 8750 - DNA, 1542 bp, Heterodera glycines
  misc_feature (29)..(29): n is a, c, g, or t
  misc_feature (38)..(38): n is a, c, g, or t
  misc_feature (78)..(78): n is a, c, g, or t
  misc_feature (83)..(83): n is a, c, g, or t
actttgctgcttgtttttgctctttaccntgaatatcncatctgcgtttcacttccctacaaattcgccgtaagcttntctgnatcattcattcataatttccttattttcccatctccgatcacttcctttcctctgatcacttcgctgggtggtcgatggagtcgagagtgagtcgctcgcatgtcgggattccgtttcgggatcactcttgtcgatcattttttgttgtccctccccgcttaattattgttccgcttcttccttcactcccatcgcttctcatccattcattcattcattcattcattcattccattacccatccgccagcagcaagcagctgaacaataaattaaatcaacacaatcgatccctccgtcgtcattttgtggggcttttcctcccatccctcaccctccctattatttatcctcctaattcaacccgctttatccccccccctccctttccatttctcgacgtctttgtgctttatctcccaatgctttacatccctcccctcataattttgcccatataataaaaaagaagcggcgaacaaaagaatgagagtaataatgccctgtgtcggctgttgtgccaatgtcgtgtgcctatcagtgccaacctgcccatttgtgccaccatctcggcagtcctttgccatttttgtcgctggcactaattagtgcgcgagtgtattctctcccttccctccttttgcccataactgtgcctgtcgagagatccttttagaacatccattatgtatccacgctaaaatcataacaacacattcattgttcactcatttgttatttttctcgactattttggatcattcctttttcgttaatccgagagccaaaaaagagtcccatttcagcaaattaggcacccaaataaaattgcttaatttagaaatacactctataatactcattttacacaataatagccatgttttagtcgcatcaatccataaaatgtcaaatcagctcaattttggctgctgttttgaccttgtttttgacttttaattttctccctcatttgagtcaattagtgataaatcattttttatccctctccgccccatttagcagtatcagcaacgcaaccacggcttcgccaagtaccattcccagcagccataagtgcgccgccggttcgtccccgtgcccctcgctgtgcgcctcctcctcctcctgctcggcaaattcagtctccaccgcggtgcgttcgttgtgcgcatggttgtgctgctgttcacggtgctgtggtggggatggagcaacaacagttggagcagaagatgagcatgagcagcagcacaacaacgacggcacatggtgggtacggagacggcggaggtccgctgaccgtgccgactacgaaatggccaactcggcacgggaaaaggagcacagcagcagcggcagcagaaagggtgggaggatgaggagaagtaaggacggagcgggacaagcgcagcagcacagcccccgtcaagttgaagcaggacagcaacataagcag

SEQ ID NO: 8751 - DNA, 2829 bp, Heterodera glycines
  misc_feature (146)..(146): n is a, c, g, or t
  misc_feature (1435)..(1435): n is a, c, g, or t
  misc_feature (1693)..(1693): n is a, c, g, or t
  misc_feature (2754)..(2754): n is a, c, g, or t
  misc_feature (2777)..(2777): n is a, c, g, or t
gtcaatgtatcatcagtcggtgccatcggcggagcagcggctaatcaaggtaagagaaaacaaaggaaaaccagcggcagtgaaaccatcgtcagaaaaatatgcttaaactgattagaaaagattgtaccgatcagactcaattnacggttttcgagaagtcgctttgatatcctaaattattggtttcaatcgatcagttattacaaaatgccgccaacattagtgcaatcggtcaaaggttgtagttgtttcgtctcattttgatcagctccgattaagcccaccctttcggtgattcttttttttggctaattacacccggtcaatttctcatatttgcctaattaccccattattatccctatcattcattcacagttcggtaggcaaacggagtttgggagcgatggaagtgctgcacaaatttgcgcacgactgtctttgttcggcgggaatgtcggcggtgacgcgacgcaaaagtcgcagacatttgttgggcgacggccaacggaagtggcgatcgttggaaagtgcgacagagcgagcggaaaagtgagtggccaattagggattaattaggcactctctgactgttttggcattctgatcaacctatttcttaattggaattcgacttattagcctaaaaatacctatttcggggttataccacctttttctttaatctatttttgcttatcaaccaataaaaatttgttaaaataaataacacaaaagataaaaaatttatgagaaaattcacattaaaaattgtttccacataaaaaacctaaatttattggatttagaagcagaaaatgtttaatgcctatttcgcacccattttggcacttttagcatcttttttgttactgaacacctaaaaacgcgtcggttagagatttaaaaacattttaattccattgtcagagtatgactaattctaattagagaccggcgggaccgggactcccgcgggattttacgggagtcccgctcccgactcccgcttttttcggtgaacgggatttttacgggattcccgttcgggactcccgtcccggtaaatccttaattttcttaaaaaatggctcaaatttgcaaaaattggtcatttttgaataaaaattgaccattcatgtcataatttattaacaaattgaactcacttcggataaaatttcgtttaaattaattaaattttccatgagtaaatcatgaaaacgaatatattttaaaatatttttgcaaaataccgaaaaaaacaaaaattatacgaaaatcttaaatttttttggttaatatctgttaaaaaatagagtttaaatttcaaaattcgccggcggcaccgccgccccccccccccaaaaaaaaacatattataatttttctgtatcggctaaaaggattgtccttcaaatttgtgcattanaaatatttttgtgagtttttaattaaattttcgaattactcccgctcccgcccgggactcccgttaaaaatggacgggattttaacgggatcccgttcgggactctcgtcccgtaaaattttgaactcccgatcccgctcccggaaatttttttaccggtctctaattctaatgaaagcaatttgaatttggcatttttattcttcgtttttttttcttcggcagatctctgccgttgtccggccgtccctcctcccnaattgtccgttcggcaacaacagctgcttctgctgcgcgatatttcgccagaacagccgccttcccgcatttcgccgattcccgaagatgccggcggaccgccgcggtggcagtccgaattcaacgaaatactcagtgagtgggcaatgagtgattggacactctgatcagtggtggctgatcggcgagataataagggaagggggggggagtctcgagactgggatttaagctctatctcgagactgtcaaaaaagcggtggaatttccctaatcgagatccagtcgaatcttggcacaagagactcagtctcgagcactaaagaaataccataggaaataggaccaagttatacagagtatgggatattaccacatatttattttatgggatttatttttccatctatgtcaccacagaataattcaatctttgggcttcaaatgacctctgatcgccacaaaatcacctccctatcatttaaactgttagtgatcaccgttttctttttttctgaattttttttcaataatgtccttgaatttatttccgattttttcaactgcagtaaccggcggtctgagagattgacgcgtcaattcagtttaataaatgatcaagttcattaagcggtttcggttattaacattgattaatcagctcacgtcaaatcacttttcaatacacagtttttggttaatttttagtcggtgaaatgtgattggattaataaatacgaaatttttcaaaaacttcttcacttgcattgatcaagtgccaatacttttcaaaaaactttctgatcactttttgggaatccggtgatcagaaaccaaaaccatttattttaaaattaatattaatgatcaatcatagtgaaatgctgatcaaattctctgatctaattataaatgacacatttttaaaaaacaatttgtggtcatccctgcgttttctgaccaaactctgatcatgagcagagactgttttttcttaacagaattttttgatcacttttcctcgggcttttgttcctcctcgccgctcttctcttaaagcncccattcattctgtcgtcgccgnccgatcgctgaaacggccatccgatgcacccactcttcccatcgttcccctg

SEQ ID NO: 8752 - DNA, 1887 bp, Heterodera glycines
gacaaaaaattaaaaatgtttttaccaaataaatttgtctgggctggccaattttcacgcgaaaacatcccacaaaatgacgtactttccaacaaaaatgtactcgcacagcaaataattatttcgtttcatcgagcggagcggtcgaaaaaaagggaaaaaaagagagagaaggaagaaaaaaaagaggagagaatggaaaagggtaaacaggaagaaaaatgactggaagaagagataaaaaagtaggaaagataaaaagtaagagaaagagaaagaagaaaaaaataagaatatgggaagagagggaggagaaggagagaaggaagaggaagagaaggaagaaggggagaaaaaaagagacggaaggaaggagaaggaaagggaagaaaaaggacaaccaaacggatgaagaggaaaggaagagggagaagaggaagtcgagaagtaatagtgtagtgaataaagagattgggtccccttacttccccccccccaaattatcgacttttcagaaggggctttttggtgggggaggggaaaattggccgaacattgaaaaagggagaaggggagggcggcgggtgaaccttttgatgtgcggcggtggccaaatgatgggacagctgccgccccgccgctgtccctgccgaaattgtcgccgccgcccccctcaaacgcatcgcgggccattgtcaagcaaaagatggcaaaatattttttttattacacacgtgctttattattatgtttacccccaagtgccgtccatcgttccgtttttcccatttttcatatttttcctattccccccgcccattttttgtccccattcttcgcaaccctttcattccatcggagcacttttttcgcaaaaattttttgtccgaagagaaacggggttcatatatacgtacaatattcgtttggttttgtcctatgccctgcgggcataaaaagtgattttttttttcttccaatgccttccgccggcggtgaatgtccattaattagcatctttctcataggaaattgggtcatagggtcagtcattctttcattgtgccgaaattgagaagcattccttctcctcccctcaaccccatccctcggggaattattaatccaattccccgagggttgcttttgggtaaggcattattcgcttcatctcttcctgagagaacggagcgccaattcgtccaattctcccgccggcggggggagcgttcgttcctccaatccttggacgttttcccaattgtgggtcctttttatgttgaaagttctttgatcaaagaatgggaccaactcattcattatcattattatcattggctttttctttcccttctctcactcactctctctttctctctctttctctctctttttctctctttctctctctttctctctctttttctctctttctctctctttctctctctttttctctttagaatttcctttccttttttcttttcaataaattccttccatcttgacttaaatattaatatctttccttgggtgcatttgtcacgaacttagaattttttttttttgtttttttttaaaaggaacatacataaaatatgcaattcaaaaatgaaagaagagagagagagagagagagaaagagagagcgaggggacgaagagaaagagaggagaggagaaaaaacgagtaggaaagagaaagagagcaaattcagagaaacagaaaagcctctcccctctctttatttgtttaactaaaactatgaacttgaaaattaaacaaatccgacggcttttccctccgtctgccgtcctttagcctggcccattcattggaggaataagcaagggcaacgctcatccaacaacaacccccccccccccc

SEQ ID NO: 8753 - DNA, 939 bp, Heterodera glycines
  misc_feature (913)..(913): n is a, c, g, or t
tttggcgtaactattcttttcatccgcttaatgaaaccctattcacaataatttcataattgaaaaaagcttttttaaataattaaatattgaaaataaatacataattttaatgggaattacttttctctcccccctttttttccttctgttcaacatcgtcttcatcattttgctttttttcctgatcacttttctcattctgatcatcgtgttcctcattatttccctcttgatcagtcgtcttctgatggcttccatgattagcaaaatttgatcggttctcgttgtgttcagctggttgttttacaattgatttatccagtttttccaatcgatcgagaatcctctgccgttcagtcagatattttttggagtgacgatttttgtagcctttaattaaatgatttaatgattagttaattacattatgcatccattttactctttccatctttttctccattttgttcttcatccgatgtttgaccattcccattttcgtggctatctttttcctttttgttcttctcccgatcattgtcttcgtcattttcatggtccaaatcacgatcattgaactgctgctctttgttcacttcttgatcagtctcgttcttactgttccgatggtcatgttcatggtcaacttgttcaacagcatccgatttgggtttagatgacaaattcgtgtcggacgggacgaaggcattgagaagaatcatatagccaaacagagcaaattgaagggcagtaaaaggcggaggcgtcatttaaatgctagaataatacaagatcttttttttgaaaaacagtttgaaaatagtcaatttcggacgtgttttggcacgttccttaaaatttgcaaaatgtggttgcgcttttagaaaaatgcatccacccaattccgatnaattcagaaaaattttaaaatatttt

SEQ ID NO: 8754 - DNA, 2070 bp, Heterodera glycines
aaaatgataaataaaattttatataattttttttaatgcgatttttggggcgctgtccaaggcaatatttaaatcattggtaataaaaaataatgaaataatttttttttaatgttggattattctttaattttttttgtacaatctcaaaactcagaaattttaaattaaaaagattactaaacgaattcctctaactttttaaaacaataaacaaaaccttttttaaaatcacttaatttataaatggtcagcaatagatatacacaccgtttcagtttttgcctcccagttccaaaaagatttgaatttttgtctcagtggtatatgtgctagtcaccaaaaggggggttccaggttcgaatccgatgcatgttaacggacgtttttggtgattttaagcaaaaaacgacttataaaatgacaaataaatattctgaaaaataaacaaaaatgataaaacattttgtttcttcactttttttttgaaaatcatcctttaatccaaatttgttaaattacatcaatttggcattcgtcatcaatttcttccgccacttcttcatccgtgtcatcctcgcccttcctttcttcataattctaaagatgagaattcagaaaagggaaaccttttgaaaaaacaaacccgcttcaattcgtcaatccttccggtgtccagcagccaattgttgacgaaatggtgctccaattgttgcaaaatttgttccgcgtcaggcatacatttccaccattgttcgagtcttcgccacaccgaatgaagcgcttcatcaccttgaaaatattaaaaatttgtgctaattaagcaatttgtttttcaccctgctcatccaaaaggccaatgaattgatgttgtcgtgcaaatggcacaaagtggaagagtagaagatgggccttgggtttctttgagagaaaggcactcatccggtcctgctctgccaaaaacactttgaaatcgtcaattgatcgctcaagtccgtccaggtcatttggggacaaaatttgtgcctaaaatttatgattttatctcaataaaatcggacaaaacacttttgaaaaattttgaattgaacgaagcagaggcggctttgtgatgcccattgatgccgatcgaacagcagcagtcgccttatcgccattttgcaacgtcgtcctccattgttccgcaagctcaattgtctgatcaatagacctgagttggcagctttgctcctgaagcatctgatcagtccggcacgtgcaaattggggacggaaaagttgtaacggctgaaccgcagtgaccaatcaatgaccaaataaagctgatgtcgctgtcgcgactacgcgaattcggaaaattaatttaaaaaaataaaaaacattaaacccaaaaaatatttaaattaatttttaattttaaattagacagataaatattaatttattaaatgtgaacgaaataaaggaatgtgagaagaaaaaaaacattagtcatattagtcacaattttttctttccgaaaaattgtcaaatgttaaaatttaattatgaataatcggaacgttaaaagaaataacagattttaaacaaatgttaaaatgggacaaattgtgaatgatattaaagaaattgtaaaatgttagaaaattgggaaaggctaaagtggcacaaactggaaaatgagaaaaggttagtaaaattgccaaatgttagggacagaaatttggacatgccaggttggcaaacacattttcaagcagaagttgccggtataaaaggagggcactaaccccccaccaatcagtacaccaacggtttcctgagaggcattgcctcgtcctcctttccctcccttccctttccccccgtgccgacaactgctccgcctgcccgttcgtgccgccgactgttgtgcctaaccgtgcgccgcccgttcagtgccatgccgatccgtgcgccgcccgttcagtgccatgcccgatccgtgcgccgcccgttcagtgccaagccgacccgttcgccgaccgttctgtgccatgccattccgtgccgccgccccgcaccactgatg

SEQ ID NO: 8755 - DNA, 1392 bp, Heterodera glycines
agtagagctgggcatttttaaaaagcctgaacctggatttcgtggacaaacgttcaggaaaatccaagtccatgaaaaacacaggcttgtttaaaaatgattaatcttgaaaatgcaatttttcaacaaaattcttttattttttcaattatatacttcttatcttatgataaaaattcaaataaaattttacttttaaattattcttccgctctaaatatcaataaaaattattattttttatagattataaatttaatttgatgataaatcaatatttttcgccaagaaaatagtaaatttctcaataagtttttcaatttttgttttcttagagaaatttggtttgacaaaaacacatttatttttgcatattaataatttaattgtaataaagtattactttgatggttttctataggcttgaagctcgaaccccgagttttcctaatcccgacattcgggtcttacaatcgattctgtttttatatcagcctttttcaagtatttacataattactaacaataaggacaggaggaggcctgagacatttttctcttagcgaacattgttttagtaaatatcaacaatgacgttgatatttatttaaatcgaaatacattatgccatcaatgtaatatcaacactatttttaaaattgggataattttttaaaatttaaagcaaattttttaaaatgacttttggcggaaaataaaatggggagaaagataacgcaaaaatgagagggtataaaaatcagccccagtcaaacaaaagcatttttagtgaagaagaataaagaaaaattaattaaaaagagagtgttatgggaagagatttaagaccgagagagaacagagaatatagtgagagttctgcgtctattaccaaaagaatcagcgaagaagagaagtgaattatcttcccatagcactctctattggaaatattttctctaccctccttcatcaaaaatgtcttgtatgactgggactgagatccagcactctctcatttttgcgttatctctcgcactaaaattattacccgttgtaacaaattttaaaaaattatcgtaatttttaaaaaatacgttgatatttgcgttgatggcataatgttagttgatttaaataaatatcaacatttaaattgatactccgcaaaaagcaataaaaaggttgatttgtcattctctaggcctgagccaaacttccagcttcatgcatcgaaaacattttttcaatcaattaaattttctaatttcaataaaatatatttggtggaattagcaagtatttttagattgcgtttaataatttgtaatgcagtgtttgagctttttctaatctccattatttttttctctatttaaaattttcttattt

SEQ ID NO: 8756 - DNA, 2790 bp, Heterodera glycines
  misc_feature (27)..(27): n is a, c, g, or t
  misc_feature (58)..(58): n is a, c, g, or t
cagcggaagagcacttttgtccacacngagcgacctttgaattgcgccgtttgttggnacgtcgaattggagtcatttttattaggctctgctgcacttttaacaaatccaccaaatgaccatcctcagttttttggaataactcattcttactttaaaaaagcttaaatttatggtactcttttcttgtatttttaaattcccgagactttaaaatatttacagcccattccttaaataaaagtcgacatttggtggtaccttttattctaatttttgactataaaatccgttttttagtttattattttgtttttgatatttgtgctatttagcaattccgtgtcggactgtcgaaatgcgcactcccaaaactgcggacataaaattcgggaagagaaagcctattgtttgaccaggcaaacgcaaaacggaaaaggttattaattattgctaaagttacaaatgaattgataaatctttaaatgggtgaattggtaataaaaattaattttaaaaaatattatttagttaattaattaactctaatttctgttaagatgcatttattgtggaaaaaagttgtgtgacaacgcgccaattttaccagcaattccctgaagaattggagaagcatagtgccgacgaagtgccaattggctgtgatgccacttatgacggtgaaaattcaaagatattacaaaaataataatttaaaatgttttaaggctttgtgaattattgcttatgtgacgagcaaatgtgcaacagaaattcgttaagcgaacaagcggaaagaaatgggaaaaggcgagaaatttaaatgaaaatgaaattgaaagaaataaataattgaagaaacaattaaattaaattaaattaaacgacaattaattatttaagcagtggcaaaatgagaaacaaaacgagaacagataaagaagaaaagcacggaaaaagcagtgaagaaaaaaagcgaccattatttgtaccatcagcagcaggtgagaaaacaaaaatgatttaaataataaattaatttgacagatttaacgccaataattaacatgagaccaataaaatcatcagcagaattggctaatcagaaagaaacggggtacttttatcatcaaattaatttaaacgccatttacaatattttttaaagtgttagatcctttggcgacgatccttcgccgcccaattggctctcaaattggccatcttcggatgcccccaattggccgacttccgccgcttctcccattttggtgccggccaccactccgccgtcgaatttaaccgaacaaaatgaccgactcaaaaaatggaagcaaaacagcgaaagggccaaaaggccattcgaaagtgacggaggcgaagagtcatcagacggaaagcggacgattttatccatgggaattggaattgttcacgcaatactcacactttttgcctccctttatctaatgctatgaaagaattttattcgcttaaatatttattttaaataatttatcacataaacaatttattcacttttcaataattttaaataactcaattaaagattgaaattgtttctgactttttttagttttagttttattcgccaaaagtcaataataaaatggtcaaacgattatcagaatgatcaatttcattttgtccacttcattttcacctttccttttcttttatcatttccatttttcacaaatttccttttcacttttgccactgttccttcaactttttaaagtgcatttccgtcatttcattgcttttattgtctcttttttgctgtcgcttttcccaccgcttttgcccgtcaattctttggaccattttctgacttttgccactgtcagtgatgcgattattggagaagcagcgatttggaagaaattttgccaaaattttcaatgcatttttcctcaaaattggatgacgtctaaaaattaattaattaaaatgcatttaaataatgagttttattctattatcacttttaatgacctcattaaagtcaattcaatcaaagcgttgctgagagaaaggacggagtaataagtgaacacaattaaattcagcaaaattgggtcggtgatcagacagatgaaaagacgacaaatggggtgaagacggacccgcaaatgttaatgaaatggaacagaaaagtcggcgcgagttggcgccccgttcgaatattttcggccaactaaatttaatttaaataaaatcaaattataaaaatgaaattggaggaatttaaacgaatgacgaataatgaatgaatgaatgggatttacctgatagcgttcgctgagattgtgcaaattcgccggtatttggagcccgcgcatgaaaagtttcaaattgtgagtgatcagaatagagaaagccttaatgtgaatccgataaattcaaaatgataattaatcgctcacaatgatctcaaagaaactgataagcatcgaagcgcaaacagtcactaaaacccccgcggtgaaagtgagcggcgcttttgcctcagttgcgattgcttcttgggctgcggtggccacacaaaatgaggtctaaatggttagccgacttttgcgccgcagacatttgcgccgcgccatttgcgccgcgacacttgcgccgctcagcaaaaaagactcttgcgccgcgcacatatgcgccgtgccatttgcgccgcgacacttgcgacaactaataaacaactgcatttgagccgcgacatttacgtcgtagacttaaaatatacatttgcgaactgattaa

SEQ ID NO: 8757 - DNA, 4144 bp, Heterodera glycines
  misc_feature (1411)..(1411): n is a, c, g, or t
  misc_feature (1440)..(1440): n is a, c, g, or t
  misc_feature (1450)..(1450): n is a, c, g, or t
  misc_feature (1471)..(1471): n is a, c, g, or t
  misc_feature (1515)..(1515): n is a, c, g, or t
ctaaataaagtaaaatgagacaaatagttattaaatggcacgagtaatttgaaaatgccttacaattaatgcgaaccacgtgatgttaaacgcgtaacttttggcatgttcgtacattttggcaaatattgtcgcgataaagcgctcgatcagcaacacatggccaatgtaatttatgtaaagcagaggaaactcgagaaaaaacttaaatcatatttaaattaaaattaaacaaaaacaaaaaaccaccaaaataattttgtaatcaagccaatgctcctttcccaaaatgaaaatgaccaaaattaggctaatttgtgccagcgaataaatgcaaaacaaaacgctttgggtgaaaagcacaaattttaaatttcgatgcaaaagcgaagttcggcacagaacggaaatgttgagcagggaaaggggcaattgagcagtgcaaaggacaaatgcagaagcaaaagtgccgaactgcaaacattgacgaacgaagtttcgaaaagtgtcgcattggccatttttaaaaaggatgggttttttcaaacttttcgctattcttttgaatttacagaaagcttatagaattaatgatgaatggtttccgagtgaaatctgaacaacttcttcctcttctttttttgcctgccactataattatttaatgattctggtcatcatttcttttttaaataactttgtatctgataattattaattattattttttgagtcaaattattttaaaaatatgtacttttgacgttaagtttacatcataaaataaaaaatttaattaacaataagaaattcataataaatagctaataaagtccttattaataaaatgacaatttttgtgccggagttttttcctcccaatttaaaacaaaaaagcaaaaacaatttaaaacctaattgccagtccattctacaatccacatgactttaattgtctctcttaaattgttcgttggcattggcattagctttctgtcgaatgttttttatatttgcacccgtcacaagaaagttgcaaatgaccgggcaattcccaagaccaataccgaataacggacatgggtaaaattaaagaccaaaaaattgtaatgcaaatttatttaagttaacgtaatttgctaattccatccgccggaactgctaagaaatggaaaatcatttctctgctccattaagcgcacaaataacatttggccgcaaattaaaagtatgggaaaataaataaattaggaaaatttaagcgaaaaggtcttttcccgagttcgaaaaaggagccaaaacgcccggggtttttgccgaatttctccgtcagggcacggaaattcacttggcaaatatttggcgtatctttcaaattattaccattctgtgcgactccatattccatganatccaccgtaatgagcggaaaagtatttnaaatgctttnaaatgtataaaaacgaattanagcatctgcttgagtgacagaataaaatattggccaaccattgnccattgacgctaattttgcaaattaccgagtcaattaatttttgtaaattatgttttagcgataaaatacttttgatttttttaatatgcaaaatttcgacttcatttcacgtgctttttcaccaaaaaggtccattcggtccactttccgctagcaaaaagttaaaattaatttttgctggatgttttttgtttattaaaagttattaattatttaatttcaatgaattttggtttgtcccttcctctcatcaacaatcactttattctgcattaataattatccgatctttcacattttcttcctgtatcctttcgccgcttctgcttcgccttggccaccggcggcgtttgacgccacttcggccggtgcaggcgctacgccgacgctttctgccggttgttccggcacaggtgcctgttcagcgggcaagggcgcgtgttcgactttggcaccgcctccgcctcccccggaaacgccataaccgccgcccgaccggggcgggcaggcgcagtacgaggcatctttgccgggtgctccagcagcgccaggatgaccaggctgtcccggtgctccgggttggcctggctgtcctgggtgccccggggctccgggttgtccttggtctccaggcttcccaggtcgtccaggtgcgccaggctgtcccggtgctccaggttggcccgggttgtcccttcggtccaggaacggtcttactgcaaagggttaaatggttcatgcggtgccaaaagtgaaaacaaaatgccacttactacacaacgccattttggtccgggttgtcctggttgtcccgatcccccaggtcgtcctgggcttccggcttgtccttgcgggccaggaggtccgggtgggcccactcctccgctctgtccaggctggcctggcctgccaggttgaccggcttggccggcaggtccttgatctccgggctttccaggcggcccagctgggcaatgctggcagacgtgaggaacatccgggcatggcgctcctttgatgatcagataatcttttttcttcgttgcaaaatattctcttttttctactgtatgtaatggcgatggttatttagaaattagacaactttttttggtagctaagtgatttttggtaccgaaattaagagaagaagaaaatgttttagaggaaaaagtaaaaaaaaacataaaaacttaatatatattatccaaccgggctgtccaggcactcccggctgtcctggctctccggcttgtccagggtatccgggctgtccgggtgcccccgcgggtcccggtgggccaggcggacattggggctgttggacgccggcacattgacaatgtccaggcagctgccgcttggagcggaagatggagacgaaaggattctcgcggggttttgccggaggagtgaccgtaatttgtacttccatcagttcgttccatgccgagtcggtgttcacgcggaatgcctttagagacaaagtgccgtggaatgaatgaccaaaaaataataatgccatgcccatcctttcattacctgcactccgtcgtgcaccttcagactgatttcgttgatctgcgagtacaatgacggcacaacgaccaacgtggccacaatggccaaaagggagcacacggaggccactcccacaacaatttgtgtctcttgcattgcctgaagggatttgaaattgaaatgattcggctgatgggcgctgttaattgacgcagtgtttttctctggcgatcatttgcgattggaattcatttaaatacggcgcgggggagacgggggccgatcatttgccatgtcataggaggcgcaaaaatggccttcacttttttggtggaacggtcggtccgctgacttttgcctcttcggcggtcaatttgacgatttccccagcgtcggcggttgtttgttctttcgtcatcgtcggccaaacaagttttgatctcgaaggggccaaaaaagcccaaaaacttaaaaaaatgattatgcttgggacaaaagtgtacaaataggcgaaaatgatgaaacagattaataggaatggcatggaagaagaagaaaaatgaacaaacagacgaaaaaaaagtggaggaaagtcggaaaatgacgacgaaacattgacgaaaacaaatgattaattgtgctaaatgacataattaggttaattacgttgttcaaattggtcaaatgcataatcattctcttcacagaagactttcattcatttcaatgcatcttttccatttttctgtttgttaattttactcttttcatcattttataattatcaccttttcattctcatctcttcgctagttcttgttgttaatcatccccctaatgattattaattaaacgtgcgcatattccaaaggtagtgaacatttcgctgtttcgttgcgttgcgcccactcaaattttatattttccaattgtaaaaaataatgcatttattttacttttttttttgcttttttcaaaactgaaaaaatggactaatcggcagcggtaaagagtaaaaaccaacgcaacggaaagggaagggacagtgtttttctttcccaattttcgttattcgacagtcaattaatttgtatttcgggaaagtaa

SEQ ID NO: 8758 - DNA, 1061 bp, Heterodera glycines
atcccaaattgtggcacttccggcgtcacatccaacgcgtctttgccgctttgcccgggaacgccttcgatgccttccttcccaggctttccaggcactccggggggtccgggaggaccggcgggacaacggttagccgacccagtctggcaatcttcaaaacagtaattagcgggtcccgtattgatagtactcactgcatccagctcccccagctgttccggtttggatgcttggcgggacgctgggcggattaacgctccctgggggaactccgggggaagcaccgccattagcatgagatgatgcgcctgaaaataataagttaaataaaattgacttctgttttccattacgattgcccgacggtgccgatacgcttggcccgccgctgaccgacgcacttccgccttcgtaccccgcggcagcgcgacgagttcgcgccttttggcccaacttcatcatgtcgcgccacaagtcatccgtctcggagcggaacagaaagatttgctggtccaactcctgccaaatttgttgcacgtcgttgtaaatgttggcgatcagcagcagacagccgagcagagaaattcccgaaatggaggaggccaagaaagtggccgtgtgcaccttcattgttggcttttcctgctaaatattaaaaaatataaaatttaacagtgcttttttggtaataatattaaattaattgagcgattggaaagctgaaatgctttggctttagctgttagtttcacctataaaaatgtgcgatcaaatgactaaacaatgctcgttttatactcccccccccattttcagcaggttttactaagaccacaatagtggggaattcttcgcattgagacgattaagcggagaacaatggcaaagcgtaaaaggggtaaatcatttgcgattggaaaagccacgggggacggaagtttttaatgcccccgggcagtgagcatcggatcggattgtcttgtgaactgattggacagagcgaagcatccatcccttaacgcaccaagcaaaatttgcgattaaacggcaccatatta

SEQ ID NO: 8759 - DNA, 4219 bp, Heterodera glycines
tttttttaaaataatttttcaggggtaatttttgaattctaacaattaatttagatccggattcccgagcccctggaccttaaatttcgaacaaaaaagtcgaagtttttatcaatttttagaacaaaaaatgaaaaattttaaaaaatttgaattttaaacctccagcgaaggcgttttacacggctttttgaaaactttattttttcgaaaaatcggggggggggggggggtcaaagcacattattaccgacgaaatactgtagttgactagtcaaaaaatttcacgtaacacacgtaaaaacataacagctaaaaataaacgtcatatatgtgttcagcacataaaattaccctagaaaatataattttaaaaaaatttcaggggggggtgaaaaaaggataagaacaagggatgggccaaattgaaaaataaaaagcggggaccaggtcgttttggcgccgacgttttggcgccgacgatttggcgccgacgttttggcgccgacgttttggcgccagggtcgttttggcgccgacgttttggcgccaagccaaaaatgaaaaaaaaggcaggaagaaattgtaaaaattataaaaaatgaaatttttcgttaaatataataattaacaaaatgaagaaatggaaacaatttatttggtagaacattggaggtgccaatgaaaatgtgccgtctccgaaacattctttcattcgatcagcccaccggccgaagctggccttcatgcgttattttaggcttttgttttttcgtatcaatttgacgattcattacctaaatacaaaattaagagaacataagccaaagcgaaaaagagtaaatgaagaattaaatccggctctttgatagacttcgtcagaaaaattataacgatttcatcatttctacccccctacatggcgtcaaaacgtcggcgccaaaacgttttggttgttttaatctattttagaaacaaaaagagaattttgaaattttttattttcgattttttgttcgaatttcggctccgggttccgaattggtcgaaatggatgcctggttcgtgagcagcgaccctgaaaaccattggaagcatgttttcatgacttttgaaaacaaaaaaattttcttcaaaaaagggggcaaccaaccatcggcagtattaccttcgcgaaaaatacgttttttttgttgttttacaaaatttttaaatttgggtgtttttcttttttttattatagcttggcgccaaaacgtcggcgccaaaacgaccctggcgccaaaacgtcggcgccaaaacgtcggcgccaaaacgatacggacccaaaaagcgaaatgcgaaaagccaaaaatatgcgaaacacgaaatttttttcaaaaattttaccaatagtaaaatcatagattttgtggttatgattcaaaaaaaatctctgaattttccggttcaatctttttctcagatcacaaaaaaagacaaattctacccattttgaggttaaaatttcaaaaatcaaggtaacatgaaggtccggcggtgccgtcaggcgccgccaggaatttttttgaaaattgtaataaaatatgataggaaaagttgcaaaaatttcaaaaaatttactattttttcaaaaatactgaaaaaggcatgaaaagtcacaaaggtcaaaaaaggcacgcaagttagcaaaaaaggtaattattaatcctgcagctcaaaataataataaactgaagcattcgttttaaaaatttaaaaatatattcattcttaggagtggaaatttcgcatttcgcgccaaaaagcgaaatgcgaaacgacaaaaaatgcgaataatgcgaaaagcgaaacctaggcccatccccgacatacatgatcaaggggtgcgccggcgcacccccccccccccccctcgttcgtcgtaaggggggcggctgtaaaagaggaagggggtggggtggggggggggtcggcgaagggaaaagaaggaaaatattaaaccttaaaccttttgtttaattttcgtagcaaacttaaaatacaacatttattccgcagcggctagaaaagtgaaaaaaagaactcaaagaaatatactataaatagccttcctttccgggtctttaaaatatgcatcttttctatttgtttcaataaatccgtcaatatcaatttgttcaacctttctccatatatcaacaaaggttcgtcattttcatcaaagccactttttgttgtaaaaccatgcgtacgcattttactatcactagcaaaatgtcattcttccaataaccaacgttctttaaatgaatgcattgaaatttgttcaacaggtgggccattgaggcgcactctcaacttagcatctagattaagcgccgtaatccttgcagatctaattttggaaaattataacatccaaaaaagtaaaacaacctttttcctcgtacatgaaataagacagaaaaggctctctcagcatcagctgaacccaaaccaaaaataagcatatggtgtacaaaatttttcaattcttctccaaaagtatcccctagtttttctataactaatttccaaaatctttgaggagttagtgagttcttcaaactacaaagccggttgtcattcaaaataagagaaagaacgtttgaaaattcctgataaattaaatgcccaacatagttgtaataattcgccaatttctttagcttgtttgcatattgatttatatcagctgaacgattgggtaaattactaggatctaagagatcaatctcatccataagcgttccgaaaggaaaatactgtttgatttccgcaacaatattattaatcaatttttcccgaagggctttattgaattcaggaataggaggggaaattccaacaactagattctcttcggcagtcgatcgtgtatgtgcttgttgtcttaacatatattgagcatgttcatatcttttaccatcagttgcacacagaaaatcagcctcatagtctgagttttaattgccagtcataaacattcttaagacgtgactgaaaaacgatgagcaaagcaatggattcccgtgagttttttatcatgatttatgaacttttctaaatgagcaaataaaccacctcgtgttccacgcattacagaagctccatcactgataaacccatataatttatgtttgattatttccgttaaaccgtcttcatcaaattctttttcgagctgttcaaacatatatactgccttttcagaacgaatatttattagtttgtattttaatataattttaatttttatttgatccaatttcgtgccgctcgagaatcatggttaatttagtgattaattttataaaaagaaaattcaattttaaaaccgcacttaatttggcattattatatgagaaaaccgattaaattcactccttaagattttggcaattcgttaagaaatgaaaaaactagagtagagcgggaccgggaccgggaccgggccgggaattcccggtcatacgaggtcccggttcccggtttttcttgcggtcccggtcccggtcccgaaaaaaaatcgaggtcccggtcccggcttctcaggtcccggcaagtcccggtcccggttttggcaaaaattcccggtcccgtggcactctagtaaattggccatggaaaagggacgaaaaaaaagtaaaatgcctcttttaatgttaaatggcctaaaatgtgcaatgaatgaataaaaagtttttttttgcagaaaaaatggattgggacgtaagtttttagtattatcttttaacttttcagatgaacaaaaattaatatgatttttgttatattttttttcgtaagcctatttttaattattttgtgtgttactaaagcaatcagaattttaaattttagttttataggtttttaaaaattaattaatgataatgaaactttgcttttatttttttaaataataaaattattttgtaaatacccgtaatgataccaaatttgttcaaatttttttaacattcaatttactagtataagttttttttctcaacctgatttttctcgtttcattatgtgattgatgcatgggattatttataaagctggatttgcaatcattaatttattatttgaattttctcatttattactattttgtaattactcattaaaggtaatagcataattatttatattttttgtctctttaaaa

SEQ ID NO: 8760 - DNA, 634 bp, Heterodera glycines
aaattcaaaattgcatatgtaaattttgaaattcaaaatttttacaattgtctataaaagctccttagtcattattttggagtttttatagtcaattctgaatttttacataattttttgggatttttttatggttaaagccatttttggcagtttttaatgcatagtttagtgcatatttggggcatttttcgtgtttttagggcatattttatgcgcatatttagcatttttagtgcatataatttatagccctactcattgtagattaaaaaagtctctataagtccaatagcgtggtgagccgaagcgaaaaaagtattagtgcgggcgaagcgaaaaaagtatgagtgcgggttgatcggaagggtcgggtcatttcagtacggaagagttattctaatgattaattaattatttaaatataattgaatatcaatttaataataaaattatatttggctctatttaagtttacacgaccacaaaaaaagacacaaccatagaataatttgacaaatttaaggcaccatacctttttcaagaagcatcctaattaaacatccttgatatcatttgatagcactaaatgtcctatattttcctttaaaatttggttgagtttcaaaaaaaa

SEQ ID NO: 8761 - DNA, 2670 bp, Heterodera glycines
  misc_feature (2574)..(2574): n is a, c, g, or t
  misc_feature (2580)..(2580): n is a, c, g, or t
  misc_feature (2631)..(2631): n is a, c, g, or t
tttcattttccaccccaagtaaccgtctcgaatggttccaattgcatcaaatgcactaaaaaatacacccttttagaaatgtttgcgtgaaatgcctattttggatgataaattggaggtaccattaaaatttaatgcaaatgatggctaaaaattccatggaaattgttggttttcatccttttccgtttttgtgcattttccctttctcatctaccacctaaatattctgctcatttcattcagttgaatccgtttcattttcccacaaatatcattggcattcatttccaataagaaattagagagttccctcaagtccattactaatttaattttatcatcaccgcgtcgccctcatattgggctttaggggcaacaaacaactttctttccatttaaataaatcaaataaaataatattgcaaaggatatgttctgctgctgttttgcttcgacagtgttcctgctgatcaaattaacctttactatttgttttattctgctataatcagttattctcattccctccccatttacgctttttttggccttcaacaatttattttgtcatttcaatttgtaatgcatcactgcttccgtgggccaataataaaacttttggttgaccgctttaattaagaagctccttcaatgcctaagaccaagaattaaaagagaaatgcggacctacctaatccgtattccgttaaatgagtgtcgaacgggggggggggggggaaaggggcgaaatgggcttcatctatcgctgcgcgatgacaaatattgtctctagatttccaatttcaaattaactgatgtacttagtgaatatgatttcttcgaactaatccatccgatgtctctccttccgtctccgcatttttatccaagtccatcgcaattatcattaggcgcgcaatgtccgtccgttttctatttcagtacaaatggaaggaaaaaatcgctctttcccctctcactgtccacacattatggaaagtgccaatttctttttcaaattaattattcaattgttgtggccactttcagtcccctcctccacattcattttccgcatacgcgcaattgtcaaaccgaatagaaatgttgtttcgttacaaaggcgtacacatcagcaaatgtgagagctttttcaacaatttgcatttcgaatgaacaaaatgtgtgtcccccgccttcgctaattgcctttggttccgtttaatcctttacaaaagcaccaatttgcataatttcacccatttggacgttaaaggactaacgcatccaaccaaataaaaataattgctcacagcttggttaatttcttgtctgaaagagtttcattttgcagtcgaaaacttttagcgccctctcaaatccattccgactttttttcctgcgcaataagcaaatgccctccctccttctcctcccaacattttgcttcttcgcctttgccgtcgtagtggcccattcccagatgactttctccgatggttggggaaaacgttcagcggttgcgccattcgcattgcttgcggacagacatatggcgggaaacaaacggcacgaaaagccgagggcggcggccaatctgttcatcagtcgtaagtacatttttggaaatgaaagattggacggatggttcagcgacggatgaggacgcactggcgatgagcccggcaatggaagcgtgtcaagtgggatacgcgcaaagactgatgcaactgcacgagcaaatgctggtgagaccgatggaccaatcactgacagtcggaagcaaaatgttccgtccgtcgcttttagactttgttcagcacgtaccaacaatgtcagacaaaagcgacgatgatggagacgaagaaagcgtagagaacgacgagagaaagaaagggacgaaaagcaaaacgaagccaaaagcgaaaagacaccaaaggaaaagccagtgtcactcaaaagtaattcattgtgtttaaagctaaattagtcattcgttgaagcaaaatgccgaggggaaaagaaaaactcaccggaaaatgcccaggaaaaggttcagtccgtcctgcttctcaaagtcgccgaaagtgttgctgtaatagcgcgaaattgtttggaacacatctcgacttctttcctttaataacaaatttggagaataattaaaaccattcgcttgcctttccgtacctgaaaaacggctgtccttttgtacgtttttatggaatggaccaattgagaaccggcatattgccatgccaaagtgttgccgtgctcatcgaacatttcctcaaaaacacggcacacctcactgtgaagctgcaacgaccatggcaaagccaaaaagcccatggagtaaagttgccagccaagtgccaccttcccttacaaggaaaagcctaatgtagtcacgtgtatgaaatttaagtggtattaacagataaaaggctcgacgcaacacacccaaatggaaaggaaatccaaccgattccgaattggacgacatttgtccggtccaacagtccacgcaattcgaacgaacgacgccatgctgcaaaagcattcgcgcgntccggncgaaagtttgggcagtgaaatgagaaatgttttcttcgattttttggaggntgcgcggaggacatttggtcagcaaaatgtgagggagtc

SEQ ID NO: 8762 - DNA, 3537 bp, Heterodera glycines
  misc_feature (3441)..(3441): n is a, c, g, or t
agactgatgcaactgcacgagcaaatgctggtgagaccgatggaccaatcactgacaatcggaggcaaaacgttccgtccgtcgcttttagactttgttcagcacgtaccaacaatgtcagacaaaagcgacgatgatggagacgaagaaagcgtagagagaacgacgagagaaagaaagggacgaaaagcaaaacgaagccaaaagcgaaaagacaccaaaggaaaagccagtgtcactcaaaagtaattcattgtgtttaaagctaaaattagtcattcgttgaagcaaaatgccgaggggaaaagaaaaactcaccggaaaatgcccaggaaaaggttcagtccgtcctgcttctcaaagtcgccgaaagtgttgctgtaatagcgcgaaattgtttggaacacatctcgacttctttcctttaataacaaatttggagaataattaaaaccattcgcttgcctttccatacctgaaaaacggctgtccttttgtacgtttttatggaatggaccaattgagaaccggcatattgccatgccaaagtgttgccgtgctcatcgaacatttcctcaaaaacacggcacacctcactgtgaagctgcaacgaccatggcaaagccaaaaagcccatggagtaaagttgccagccaagtgccaccttcccttacaaggaaaagcctaatgtagtcacgtgtatgaaatttaagtggtattaacagataaaaggctcgacgcaacacacccaaatggaaaggaaatccaaccgattccgaattggacgacatttgtccggtccaaacagtccacgcaattcgaacgaacgacgccatgctgcaaaagcattcgcgcgtccggcgaagtttgggcagtgaaatgagaaatgttttcttcgatttttggaggtgccgcggaggacatttggtcaagcaaaatgtgagggagtcgagaatgaagaagagggaaattctgaaggggggtgtattttgaaaacgaagcaaaccaacttggaaccatccgccggacattgccacccgttgcccaatttcctccaaacgctgcaaaacgcggccacttttgttgcaacgactgacatcgaaactgatgtaatcaatgcattcgccaactctgcggaaatcgtttaaatagcgaacagtctgaaaaaccaaacgaaatgaacaatggaagaaccaaacaaatgcactttcagaaatattttgtggagtaggttctcgttatgtctgtgctcctctctcttcaccaaattcagcaccaccaacggatgtccgtattttctgcccaattctctgaagtgtttggccgtggtcagtgcgtgcggctccacccgatcgatcaaaatgggcggctttccgacgaccattggggagccgcggtgggtggggtcctgcgaccaaaaaagcggcacggagccgcggcgttggacgaaggaggagaatttgccggaacgaaaggacagaggactgctcgtgtcccaaacgacctgctcagtctcaacgtcgttggccacagctcctgaaaagcattttgagcatcgcaaaattgaagaaattaaagatttgataattgcaccctcgcaattgacgcctctcttgagaaaacgggtcccagcaaaggcggacgatcggcgagcaatcagaataagatccaatttggcacaaggcaattccaaaagttggtgggcttaagcaaatgaattgaattgatggtttctccatgaaaagcgcaaagaaaaagcactaaaagtgtgtcaatcacggagaatgggcggttcctaaattttacttttttgtttgtgctaaaaattaaagctctccattctccatgattgatgaaaatctcaccgacaaacccacgcattaattccagtgtccatttgcgattgacctgtaaaagttggacagttcttcagaaaatgccacttgtcggattacccccgccctatacaatggttccatcaaatattcgttccacacaaattttttctcgggtcctatcgtttttccgtaattatttcattcccatttgtgggcaaatccggcgagacaattctcttgcagagttctgctcaattggtatgtgtaagaaaagtaaaaatcagcggtgaaatcgacagactgaacagtagccaaaaatgaggaaaaatcagtcgtttgtgctttaccaggaaaagtttgctgtacttcgtttcgtcgggatgggtggcggcgccggtcgccggaatataaatcattgaaacgtcctcaattttgtaaatggaatggacgccgatggaaacgaccattttggcacgagagacaatctgaaaaacgcaactcaaagcgtgtgtttggaaggaataacatgaaatttgcttgttttaccaatagataaaatccctccatgaagcgaaccgcgccaatgattccccacgccttttccacggtgcgcaacaatccgccgccaccagcgcagctgcgccgtttgttccatttttcagtgggagtcacaactacaaaagaatattgggcgtcttcaacagtcatttcaaaatcaaaaaaatcacttgaagacgacgaaacggtggcgagcaattcgccaatgtcagctaaacaaattcgatttaatgaccgaaagctgagttacgcattaattaattaaccttgtgtgtagtcttggtcgggttcagcagctatgaattctttgtcagtcacccgatcaattttcaatgttcgaaatcgttttccctttggatcggaaccgattatgtaaaaatgagccgctgtctcataaacactcaaagaacacatccgatccgacattactatgctatgtacatattcattcgaatgagaataatggtaaatccacgaattctggctacgtggccttattggcaagctgaagcagttattgccatacaaaattagagcctggaattttggaaaaatctggattgggattggcatcaggacgggataggaatactgggaatcaatcccaatactagattaaaatgcaaattgcttgttattaatgtcgtcaataccctttctcgaatacaaaagggatgattttgtctcttctgcggtttttgtcacaacggaaaatcattcaaatcaggaaacaaatgataaagttaacaaacacaattaatgaaaaataaaaaaggcatttttcagataaaacataagcttctgtttgcgtggaaatgtgcacaagaaaagggcgttttgaattataaattgagtgacagcaaatccaaacaaattgacggcaattatgctttttcactgatggttttgttttttcgtgttccatttggaacccctttctttcttcaggtcaacaaagaaaggagcagaaaacggagaagcgcggaacaattcgacaatctttgccaacctttcgacgaggaaaaatggaatttcactcggctanaggaggaagaggtccgtgccatcaaaggataaagtgataaaccatagtgatatcaaacggaggaagaatgacaatcgctaatcccttcagtgcctc

SEQ ID NO: 8763 - DNA, 1269 bp, Heterodera glycines
ggggatcccgacatttaggggacccgacttttggggacctgacttttggggatcccgacatttggggatcccgacatttggggacccgacttttggggaacccgacatttggggactaacttaggagacccgacacttaaggaacccgacttttggggactaactttggagacccgacacttaaggaacccgacatttggggactaactttggagacccgacacttaaggaacccgacatttggggactaactttggagcccgacacttaaggaacccgacatttggggacccgacttttggggactaactttggagcccgacacttaaggaacccgacatttggggacccgacatttggggacacgacttttggggacccgacttttggggacccgacttttgggatcccgacatttggggacccgacttttggggacctgacttttggggatcccgacatttggggatcccgacatttggggacccgacatttggggacccgtcatttggggacacgacttttggggatcccaacatttgggaacccgacttttggggatcccgacatttggggacccgacttttggggatcccgacatttggggacccgacttttggggatcccgacatttggggacccgacttttggggatcccgacatttggggacccgacttttggggatcccgacatttggggacccgacatttggggactaactttggagacccgacacttaaggaacccgacttttggggactaactttggagacccgacacttaaggaacccgacatttggggactaactttggagacccgacacttaaggaacccgacatttggggactaactttggagcccgacacttaaggaacccgacatttggggacccgacttttggggactaactttggagacccgacacttaaggaacccgacatttggggactaactttggagcccgacacttaaggaacccgacatttggggacccgacatttggggacacgacttttggggacccgacttttggggacccgacttttgggatcccgacatttggggacccgacttttggggacctgacttttggggatcacgacatttggggatcccgacatttggggacccgacatttggggatcccgacatttggggacccgacttttgggggatcccgacatttggggacccgacatttggggatcccgacatttggggacccgacatttggggattcgtcatttggggacacgactttttggga

SEQ ID NO: 8764 - DNA, 2216 bp, Heterodera glycines
ggggatcccaacatttgggggacccgtcttttggggatcccgacatttggggacccgacatttggggacccgacttttggggatcccgacatttggggacccgacttttggggatcccgacatttggggacccgacatttggggacccgacttttgggtcatcccgacatttggggacccgacatttggggacccgacttttggggatcccgacatttggggacccgacatttggggacccgacatttggggacccgacatttggggacccgacttttggggatcccgacatttggaggcccgacacttagggaacccgacattccctaagtgtcgggtccccaaaagtagtcccaaatgttgggtccccaagttgcaaatccccaaatttcgcaccacgggcggctcccggacttttcgacagaaggacttttcctaaaaacaactaattcttattaaaatgaattatattgcttgtcagttttactaaatttattttaaattaacatgctaatatttattgctaaatcattattactagggatacggttttttggttttttacctagaaaaacttaagaaaaatgcacccttaagaatcggcccctaaaattttcaaaaatactcccctaagaagattgaaaaattttctcaaaactcattcaaaacttatttatttattttcttggtaagaatttttgatttttaaaattatttatctcaatactgatctggcttaattttgttgctttttcgataaaattttacgattttatacccctaatttagaaacttaattactctttactgtccaaaaatcccctcctcaacatttaaatatttctgtcgaaaagtccggcgcccccacgggcaccgccgtgtaccccactgtttttcatcaaccaaaattgagtatttatatgcttagaggcatttatagcaattaacaaatgaataaataatagttatttaactgtccgcttatatttttattatttttttttctgtaatattttttggtattaattgacagttggctcagacgaagttggcccgttccgaaaaaattataatatacaaacttgaaaaaaacagattttagggtcgaaaatcagaaaaatttttcaaattatttggactatatattcaatagatttttcaatcaaaaattattatttttaccaaaaaactcaattcttaccagtgcatttttactcccgttttttgggtaaaatttccgggagcgggatcgggagttcaaaatttaccggagcgtgaattccgtaaaatcccgcgggagtcccgatcccctccggtctctagttaaaagtatcatgtaaactgcacaagtaccgaaattcatacattcgatatatagaaaacccatttttatacatccgatttatttaccgaaattgagagggttttcttcataaaatgcatttgatcaatgatataattatggtcgatcggtaatttctaattaattcatttcttctgccggtggaggagacaatggccttaattaagcgcaattcgaattatttaaacaaaattaaatgtcttttctaattgctcacccaatgctattagtgccaccaacatgccaaatgatcacattgttaaaattgttgatccacttttcatctttcttctgctgctgaacgaatacggcctccccaattttgcatcgcttcattatccaatcgatgccccatttatttttcattactttggccaatgccagcttttcttgcgttcgtacgttcaccaattcaaatggcatcatttgcattaatggcacatgaacagaaaaatgagtaatattttagatggtagcacaccttttttgacaaaaattttttaagttttaaaatttgaaaaacatgtcttatcgggttttcggggtcactgatcacgaatataacaaagattctgttcgacctatttcgaatcccgaaccctaaggctaataaatgatcgaatgtgaattttcaggataatgtttcttcttctagagaatatctactttatagaaatgataattaaagatattttctgttttatcctagagaatgtgtctttggcctatttataaaaacgtaaaagactacagcaattagtcttgaacgacaagaacatgacaagctataatatgaataccagattgccacaggaccggatataacttcgcatactcatcgtcatgccattca

SEQ ID NO: 8765 - DNA, 1091 bp, Heterodera glycines
ctaccatctaaacaattaccgtaaaatgaatttcgtaactgacggaagaaatggtggcacggagaaaatgctaaacaatttggaaacaaaagcactgatttgtcgaaagtatggccacacctccttgaagttgtggatccaatctaagtccgcttgtgcgttcaaatttctgcgaaaacgcaatcgcttgggttggccatcttttctcggaatgtgcaaccatttggacaatgcttggccagcagaaattgttgaatttggcccatcaaaaccatcaccaaacgcagcgggcgataaatcaccggaatagattgaattcaattggttgagatcggtgagaattgtcggcgaaatgagacgacgcaaattgtccaaatgatcatcatcgttaaagcccaagtggcgaatgtttgccgaaaaaattggccaaatttcacgaccaaaaatgtccaaaatctgctgcttttccatggtgtatgatgatggaatccacaaatataaattggtgcctcttttgtcgaaaatttgatgatttgaacgaagaaaagcgatgacggagtgaccgatgtacctaaaatgggatgaatgcttttattgccataaatctctgattccgaattactcaatccgaagccatttaaaacggattttgctgggcaacggacggtccggcaatggaaatggcacaaatttgtcatccatccgcacagacagcttcggttctggtcctttgtccggctcaagtacagtttatgcgtccaatcgacttttatgcgtccaatcgacttttatgcgtccaatcaatttttatgcgtcccatcaatttttatgcgtccaatcaaatttttatgcgtccaatcaatttttatgcgtccaatcaaatttataattctaattgcattatattgacaatattgcgtcatttctagtctattttacaattccccaattttgaattatacggggtaatttagtctcatctcctccaaaatatgctgaaaaattttgtcgtttgcgtggtatcttctgaacatgtactgatacaaatatgtcggcagcatttcctcattgaaccacgtaagtgtcggaga

SEQ ID NO: 8766 - DNA, 2008 bp, Heterodera glycines
  misc_feature (62)..(63): n is a, c, g, or t
cgtctcgaaaataaattcaaaagtcaaattacggatcaaatttgcggaccaaaaatccgtannccgcaatccgtaatccgcaactccaaaaaaccccgcaatttccgtaatccgcaatccgcaattgcgcctagccctggagtgaacacttttttcgactcaattactctagggccaaaagaaaaacaataaattttttaaagtagcacccggaatgctattaaaaaatttatatgaatctattaaattatttctttgtttaaaatagaaaaaaattaaattaatattttaattgcgaaaaaaacaaccaaaatgactgaataataatttaattgctttaaataaatcaaatcgatggatcacaaaaaataataagaaaatcttgaattatcgtatcttcttcttccatacttttcacttcacattcttccggcttagtgaacaaggagatcatcaaagaacttaaaattattgaaatattaattacctatgttttatttaaataaattagattttcgcgaaattatcagatgaatgcttagaattttttaaatttattattttttaaaaatgtttgaccatacgaaatgaaaaaatttgatacaaaaaataaaaaattgtagggaaagaaaaggggctggcgcccatttggttggcgcccatttggctggcgcccatttgattggcgcccattcggcgtcgcccatttggcagcgcccatttggcggcgcacattcgacccggtccgaactattttgagaattttcgtcactaaaaatcataattttattgatcaattacgcaaaaattatgtgtcgtcgatgaaccctcagtttttaaaaaaacttctctagtgcagaatggctgatttttcaaacatgccgtaaaatttcaattcgacattttggcaaaacctgttaacaaatacaccatttgattcaattttacagattatgtaataacaacaatacatttaatatataaaaaatattttaaacaatttaaaatcggaaaatgtttcacaattttcattggagaattgggttctttttcctaagattttcccaaatcaaaagctattttagtgaagataattctttagggcgtttttcattcccaacctcatccttaaatttgcaaatttttattcccatttaaattttgctataattttctctttaattaattgtcttcataatttaaacgaccatcagtttacgatttaatctatccattcgatttccattcctacaattagctgaattggtaattaattttttgcccatttctgatcaactttgggcagtggaactgggcaaaacaatgattcattcacacattatattttagctctggaaaacagaaaagcgaacaaaaatgggcatttggggatggaaaatgagaaattaatcatcagaaaacagaattattagccaatttgagtggcttccattcttttacgcccattactccacccattcacaaatcgtgttgaagccaattatgtgcataaatagacggattaggccataaaaaatcagtttttgggttgcgacgggatggcttcaacaaatttcattcaattggattttgtagtctttttttttgttaggaattgaattcttttcatagtattatcaggatgacaataaacaaaagattttgttttttggtaggctaaataaaaaaataaatgcaaaataattttactggagtaacagtcaaaaaaaaaaattttgttttttttgaaactttgttttttttatcactgagaaaatcagtagtttttttgtttattgatttttaagttttatatttgaaaaagaccagaggcttaataatgagtgcaatttggcatcactgatgagatcggtgtggtctgagcttcgcgccaagcactgatggcttcaacaattgatagaaaaacgttagtgattaaatcaaataataaaaattaattattttttgaacttaatgggatataatatttattttaagggcccatttt

SEQ ID NO: 8767 - DNA, 2962 bp, Heterodera glycines
tatgaatgtgaagctggcggcaccgccttttgtatatggagcccattgttcggacacttttctactgatcgttgacagaattgtaagtaatctgtcggataaatgggtcacttggccatcatttcccttctccaataaatattttgtactttttttcgcttttctaataatttccccatagacgaatgaataaccccactaatttttcttggctgctcgtcaacaattgcgtttgtcctgtgaaggacaacttatgttaccattttccgggctataaaaagccggtgatttgtgcccataaaatggtgcacaacattacctcattcctttccactcccccgcacattcctaatggtattttttctgtttgcttataatttaattttgttaaacaataacttattttccagaatcggcacccgcgtctctttcctcgggctccgtgctgcagctgcttatcgtgctccaaattttcatcattttgcttacggtgagtaaaaattatttatcataaaagcgaaaaataatttatttatgaaaaatatttaatttctttaaggtggctttatgctgctgtttgctcgtttgtgccgcgcgaggtcgaacttacacggtgaatggtcgccgttccactcggcgccgcgctgccgctgcaactttgagcgcctttcaggcgcgcacttcgggtgggcgtttttatattaatttgttataataaaaatttattattatgtttggggtgagggaagggctggatttcggtttttgaaaatcatttttccaatttcagcacttggtcttggcaccgttggtccgttggcggttccaaaccgtccggcggattccacttctcatcgtgtgccgggtagcgtgacttttccaatttatttttttattttaattttcatttattttttaggctgaattgtgccagatggtcaacgaatgaatgatgtgtgaagaaaatggggataaaatttttaaaaagaagaatgattggataatatttaatcttttttttgccttttatttttttaaaatttaataaaattttgggatattaattaatttaattttgaattttaagttaatcaggttagggtgtaaaaaataatataattatagtgtatactcagcaatatgttttgtttagacactcccttcccttaaccactcccttgacaagcaattgaatatttattaattgaaaaataaacattacaaattattattgtgtaatttcggatttttactgctgtccggtttttactcggtgcgtttctttgccttgggcggcgcgatcaaatcagtggcccgagcgttcacccaagtgcactcctcgcacagttcaaaattgacagcgaagcggccatcatccttgcgcaacaccctctgcttgttgttgtacaatttgttccaatcatctgagatttataagtatttaacaataaaaaataaatagttattcaccaacgcagaggtagaaacccagcatgtattttcctttggcgagtttccacaggtctcggtcctcgacttttcgctttttcattgacggctgctgctcctcaccaccattcattcccacattttttgacgactgcttacgggtgggcgctttcaaggaaggaaccacaaattcagcttttccaacattgttctcctttttgacgggggagctttttgtcggagagaatttgcttggggaggacatttcgatagaattttttgaaaattttgcaaatgaatcctgattttgggtaggtgaaggttgggaagcgaaaaatgggcggagcttcgaactgtcgaaaagtgggcggagcctagtcgaatgaaaacatataaaatcggcacgcttttgaacttccacacgatttcgcaaatcattcttaattttaccaacaaaaatggccatcaacatgagcgacaagcggggcttgctccgacagattctcggcgaagcggaaatcaccgtaactacgtctggcctgacaattagcggcccccgtctgtccacacctcgattcctgccatttgacgagtgcggtcgctgccgctcatgtaaggcaaccgaagtggaggttgacacaatggtgacgaaagagggggtcacgatttggtgcacgcgcatcgacaaagtgcagttcgtgccatttgacatggtctacgaattgccagggcactgcttcttccgactgaaaaacaagtcgcgcgtgttcaaccttccatatggcgacctgccctctgagtcgtgtgaaattccgctaattcaacacgctgatgatgaacgggacctcaagcgaaaggcaaaagctgcgctcgaattggtggaggccggactgattgcggacagcactgtgcaggacggggcccgattgaaaaaagccaaaactgcgatgaaagtgatcagtgacattctgctctctgaaccggagggagatgatcacaagaagacggttgaagtggcagatgtcgacaagcaggcacaagagcagcaaccagcccctgtacaacagaagaccgcctcggtacccgctgtggaacagagcactgttgaagagaatacggaagaagataccaaagatgatcttgactgacattgatcgaacactctatgaaatttttgcgacgcgtcaagccgcacccacctaaatgattacgaatactaatatacatcctacatatatattagtgcacgatatcacttgttcacagtaatctctgataaatacacatcgcgcattcaattcaatatatttggatattttgccctaatgagaaacatatataaaagatatcttcgtatgaaaaatgacaatatctactatataatatggacagatacttccaaattgactcttgcacactgttattgaataaaaagttgcaagatggttgcagaacgcattagttataatactgagccaaaccatgagattataatacaaaaagaaaattttaa

SEQ ID NO: 8768 - DNA, 4774 bp, Heterodera glycines
  misc_feature (210)..(210): n is a, c, g, or t
  misc_feature (4699)..(4699): n is a, c, g, or t
gtatgctgacgagcattctcttaccaatgttatgaaacaatttactgccaaaaactaatggataaatagataaaaaataaatatataaaagcgaaacagctaagagagcactcgtttaattaaacattagagagagcgcaaaaaatgcgtcacgcaatgcgaatgtttctcgttccggttgacgtctttcagtcggtatttgttcaaccncaagcagcaacagcagcagcagacggtgccgacggtacaccaattgggcttttgcgctcacgcatccaacaaattgagcgtagcagggagctgaacgaagagcagaaggccgcgcaataccatcaagaattcaaacggctcaacaaactggtgcgcgagcaggaggagcagccgatcaatgttcgacttcagcacgaaaaggagagagaaaaaaatgcagcaacgccgccgccgccgccgccgccgcaaacgataaatcattcaacgccaaaaagattggagaaaaacattgtaccatcagcgtttgggttgaggaggcaaagacaccactacacacaaaaggcgggggcattatcaaatcgcagacctgcccaaaaacaacaaagaaaagcagcagcagcagcagaaacaccaaacagcagtggaaatggagaaacgggaaaagaagagggtgatgtagatgatggggaacagtgggacgacgcacaatcatcatcatccacggcgtcaacaggtggtgccgcagcaaaaagagtgctcagagcaagagatggggaagcaggaaaaggaggaggaggagaaacggctgatcgccttcaaacaaaacacaactaccagatgaccaaaaatgcactgatcacacacattcaaaaaaaggggcacagtctgggagtcagtgatcagggaaaggttttgcgcacagatgggtccgagtttaaaacgagcaacgtggaggcaattgtcagccatttgttgaacagggacaagcgaagcgaattcaaagggccgcctgtgggctataaggaatttgctgaaaaggctagagaggatccgttgctaaaaaagtatttgtttccggaacagcctctacaatttggcaaaggcctgactgactttaagcatggaaaaggacataaaaagaagtgcgaagggggaggagggaaaagtgtcttcaggttcaaaccgacactatggtagtcgaccggaagaaagaacagctgttggaccagctgtacaaagatgttaactcatcggtcagctttaccagcgttgagccgcttttacgcgaggcgaaaaaggtgaacaatcaaatgagtagaaaggatgtagtggactatttggccacccaacgcacatacaccattcatagacaagcgaagaggcgctacaaacaactaccaacactcgcttctggactgcacaccgaatggcaagcagacctgtctgtctttgacaaattgtcgcaagagaatcacggctacaagtaccttcttgtctgcatcgacacactgagcagacagctctttgttgagccggtgaaaagcaaaaagagctccgacatggttgctgcttttgaacgcttgtttaaacgctccaaatacataccatggacattgttgaccgaccaagggctcgaatttaaggcaaaagaggttcaggaatatttcaaaaataagaacgtgaaaaacttttttatgtacacctcgccgcgaattcacgcagggatggcagagcgggccaaccgaaccatcaaagaacgcctttatcgctatttcacggaacggggtacccaaaaatgggttgatgtgatacagcaaattgtgcatggaataaaccactcgtacaactcaagcataaaaatgcgcccagttgatgtgaattttgagaatgccgaaaagctcaggaaaaaactcaagcagaacgctattggtgggacagcggaattaaaacggaaacaaccacaaccacgtttccaggtgggtgaccgtgtgcgcattgagaagtacaaacacgtgttccaaaagggctacaccggacgcttcaccaacgaagtgttcactgttgccgaagtgcacactgaccgctttcccgtcacgtaccgaatacgtgatgacgacggttccctgatcaagggccgtttctatgccaacgatctctgtcgtgtgctagtgcgcaaaaatgatgatgatgatgatgatgataccctatatgacattgaaaaggtcgtccgaaagaggaaaaagcaaggtgttgaatacgttttggtgaaatggaaaggctacagtcaacggcacaacagctggattcctgcaagctcgatgacatggaaaaatatataaaggggctcttttttttttaaatttcaaatgagaatgccttcatcaaactcattctatgtgatcgttccttccaacacaaatgttgaaggaaatcgcacaaactcttttcgagttcgactaccaagaaaacttcaatttaattcggaatgggatgtgggcttaggtgtgataatatacccccattcgtggccctcactcggcacatcagaggaccaatttgttcaaattgaatggaaaattggagagaatgttcaaataccaattccatcctctaacgtgacaaaccccgttgagctttggaaaagtctttacaaactgcttgaagaaggcaacaaaccgttcgcagttaaagtggaaggcgtacagaaaaaatttactgaagcggccaatacagcacgtcaattgggcagagccgagtacatcaataaacaacaacaacaacaacaaagagacaaaagaaatgttaatgatgatgatgatgatgatgatgacgaaaacgaagaacaattattaaacgcccttttagcgggggttgacacgttgcttgacctttacggagcaaccagtggtggtctacttgagagagaaaaacgtgcagcaacaagcaaggtccccctgcggaattgggatgacactgaagaggaatatcaggaaaagcttgataaatattttttgcgtctacgtggccgtaatttagaacacttagagggactgataacagaaaagttgaatgcggaaattgcactgatggatgacgaagaaaggaagattctcgatcaaaccaaagaattaggcatgacagcatggataaaagttttccaatcagcgtactctgcatgtttcctgcattttgacagtgcaacgaacagattttcgttgaaactggacgatcgttatgtgcaaaaaataaaaatttcagaccaattggcctacattttgggttttaactcaaccgatttcactgaaaaagaaacgattgcaaaatttatgccagacatgagtggaggagttgcttcttttcatgtttatgcacctgatctaattgaaccaatgatgattggtgacgtgattgccccagttttgcgtatcgttacgattcggggaaaacctgacgaaattatagaggagcagtttctctccgtccaataccatcgcgtactagtcaaagaaataagtgaaattttcatcgaaatcagaacatccggtggtaacctaatgccatttcaatacggtacatgtacattaaccttacactttagaaaaagttcctacttttaaaaatgaacagtgttcaaataaataaaattcttgctcgaaacccagtcacgcgttcgacctttttagggtgttttccatcagatcaaattccagcagtagcagccacaccagctccttattcaatggtgattaacgttgatccgagcggttcacctggttcacattgggttgccgtgtattgcgagcagcaaaatcgggtggaatactacgattccacaggaatttggccaccactaagccctttcatccaaaaatttttaaagagttttgctcaaattcagtttcatcaactctcgctccaagcaccatactcacactcatgtgggaagcatgtgattttctttatatttggacggtgtatggggatgcactttgaagcaattttgcaactgctaaaacgcgcaaaaatatcaccagatttttttgtaaacaaatttatgcaaaaaaatgtgtttaaacaaatataaataactagaaaactcaatttaaaaagcgcaaaaaaaaagaaagaaaaatgcacgttgattttgatccttttaaagttgaatggtcagaattaactcaaatttctccagaagtagtcgtccaatacggtggttataatgtgttcagagaagttccataccagcgcggtagtggtatcgggtctgtttttaggagtctattgcgttacctaataccaatcgggaaagaaatcgggacagccatcgggcgccaaggacttgaatctggaaatcgagttctatccaatgtattagagggtagggacctcaaagagtcacttgttagtgagggaaaaacggggctcaaaaatttgctagagaaagcagccaacaacataaatgcccaaaaaagtcaagggttcgacttcaaacgatacacaaagagaaatgatacaagagaaggtggtgcaattggtaaagcgaaaaaaggtataaataaactacaatcaaggttgggaccacacgatttcctaccagcaaacaccccagcaggtcggaagaaaaaacacactaaacagaaatcggtcaaacgccttcgtaccgatatacttggaacctattaataaaacaaccacccagaagcataantcatgagttgttcacaaaaaattagcgaaagtagtccccttgccacaaatagtgctttgaacattttttcagtac

SEQ ID NO: 8769 - DNA, 1357 bp, Heterodera glycines
  misc_feature (1244)..(1244): n is a, c, g, or t
  misc_feature (1290)..(1291): n is a, c, g, or t
  misc_feature (1333)..(1333): n is a, c, g, or t
tgttgaatgtatgaggcacttggcatggctaattcagagcgttctttcgacatcacaaaagagcaattcaaatctggttggaccttttttgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaattaactgtataaataagatgcataatgcgaaaaaatgccaccataaaaatggccttcttaaacactacagtcaacgccagtttaaagccagagatacaagtactaacatttgaaaacaaaagcgttcatcctaacctcctcgtgcaacttctattgcttgcccactatctcattgcttttcccgttttcattttatgctggtattctttgataaattttcttaagagaagaggacatatttctcagcgtgatgccaatgagatgatggatgatttgcgaaattaccaattaccaaaaaattcatcaattatttttccaagtttatcaataaagaaatgattaacgcacaaatattcaaatttttttcacatgatcccctttcagccttgatgaagatcaaaactaaatttaggagtgcttttccttcttttgaaaaattagggttacgtgacaaacgcatatgggccaagcttttccaacaacgttaattggattgttatgaggagagttgacgatccaccactcggatagagccaactgcaaatctctctgtgctcattacgaaaaattgtcaacgtgcaatcctgtctcatggtgaattcacgaagaaaaaacaaaattgcaatcacatcaagaccattttggagtttgtgtctcaacatcttcaacaataaaatgcatttttaatggatttttaaaaaagtaaaggacacattaaatcctttttttttgaagctcacaacaaaatgaatccgttatttctctctctctctctctctctctctctctctcaatttttctttgtttttttggtagcaatctcatcaacgtcaccatcatcatcatctttttcttttggcacatcactgtcattttttccagggcacttcttgaacaaattgacaatccaatcaaatccagtgtaagtctgactgttcgcctatgttgtggtttgtcanatatgtaataaattgcaaaaaaaaaaaacaaccttaaatgtgactnntcgcattatcttcacagcaatcaaatcgtccaaatgtttcgncaggctctccggctccttctcctt

SEQ ID NO: 8770 - DNA, 1100 bp, Heterodera glycines
cacaaaaacttaaaaaaatgttttccgattatgtcaaccttattaaaaattttgaaattttgcaggctaatagagaacccttagggcttcgacctctgctcagtgcctcaaccttatctaatggatagccatttttataaataaacggcatttccaaatcgcttgcttattaatgacatttgtcttttcttttttttcttcatttttttttgctcttagcatttctttttaacaaaaaaaaaagaatcaaattttaatgacgtcactactggaatttgttcttctctaaattgctgcttcttcaaatattttgggggagattctccgccatataatcaatcaaaaaggcagtaagcgatcggaattcacgatgctcaagacactcattgatcattatttgatcacaaaaaaagcattattttgaaatcagtatgaacagcaggcagagaacaagaagaatgtatgtgtagcctaggagaagagatgagagccaatatgagagggaaaaaaatttgttaaaaaaaataaattgcaaataatttttctttaaatatttcacatttctaaacttttcaatatacttatctttcatcaggatggattttagattaatttttttttttattattaaattggctagagcttgtcgggaccgggaattttgacaaaaaccgggaccgggacttaccgggacccgaaaagccgggatcgggaccaagtttttcgaccgggaccgggaccgagagaaaagccgggaccaaccggtaattttcccaagagaaaattttttgaaaaaaatttggaaatttgagtgaactttgttacgaaaattgcctatattcaaaaatgtacccataaaattttatattttcgttttgggggacgaattcgaggaaaatttttaaaaatttcttcagggggggggggggaatcttggaattttctgagtcccaaaattctgattttttaaataaattaataatctcttaaattgtttgcttttaaatcgctctttttgtggcgctgttttcccaaaaaactttttgggaacattgggggagggggggggggtccggcggtgccgataggcgccgccggaa

SEQ ID NO: 8771 - DNA, 1877 bp, Heterodera glycines
  misc_feature (79)..(79): n is a, c, g, or t
aagcagtttgttccaaatcggataagcttgtctttaaatgtgtttctaagaatttttatgttttaaaaaaatttcttanacctttttctcggtttttatgaaaacttactcgctgacgagggtgatgcttcccgacatttttaaaattcttcagccatccacgacaaattttgtcggggaattgaattttctccctgatccccaaattttatttccccaagggtcagagaggaaccattgttttaagtgccattcttacaaataaaaattgaaaatgggtatcaaatgtttttgatttctttagtgctctgctcccttctcttccattctccgatgccattaacaactcttttttcaatttggcaatatcaattaattaatcgtccggccattttgctgtgctttgtgtccctttttgctggcttattacttttgctcgccttggccactgacaaacacttcctaatcattccattccttttcagctgtgtgagtaaaaatttttggttttaaaaatcaacagagaaatttttttgggtttttacgaaaaaataattgcaaaaatagaatgaaatgatcttgctaactttataatgagaaaattgttgattttcggcagttaagttgtcactgtgaaaatttaattaaaaaggaaataaatttccctgcctatcactgtgcactatgataattagagatagctagctcgacctggacctagacccaggcctgtgtttttcctaggtataggtttaggccatttttcggcaacctggtttttttggcaaggattttgtacggaaaaaataggtccagggtccaacatggaatccaggcccagacttttgtcaaaatgtcaagctctaatattattttatgccttttttctaatcattgtaagattctcaatatgatgggttccatggcgtttgggttagtgttgttaatgaatccgctgcacgtctatttgccatttatccgtcattttggctcacttgctgaactgatgccggcttttatggcactttgtacgtccgtcatggtaatgatcaatttttggtttctcatgctcggtgcgttcacttatgtgctcattcgtgacaagcgtagcttattcgtgtataaagagtaagtgatgcttaatcgggtccaaattatatttaatttttaaatatttggttttaattgttgaagtcggtaattaaatttttagaattttgaaaatttgttcaagtcagagactcggtattggatggtttcgtattcctgatcactgatctgtgacccgaaaacctgctgaaacaaacgtgttcccgacttgacttcaacctaaattttttttttgtaaccaaaagccctccccctggttttcaataacgaaaaaatactccgatttatattaattgatcaaaattgataaatttttctgtaaaatgagtaaaaatatgaaaaacatttgaacttttaagagaatatttcaataatggttatacggatgaagaaaaaatgaatgtcaaattggcgatgattcgtcgttcatcatccgctccaattagccgaatgtacagtggctgatgaatatcattgattttgcaattttttaacctctttttgaatttgtattaaatttggaataaatggaagggataaaacatttattcaacaaacttattatatgaatgacaccattttaaacaaataacaaagcattcattaaaaatttttttttgtccattttttgatttggtaaaaagctttgccataaaataattcaaaaatatatttgatgtgaaaatctagcctaaacacattgaattggcctcagggcagatttgatcatattctctatcagaaaatttgtataccatatttactga

SEQ ID NO: 8772 - DNA, 2739 bp, Heterodera glycines
tcgaattgaagcatccgctgtttctattacagtaaatacggtaaaacaattatcgactgtatttgactgaattagagcctcctatataatagagccgcccgcttcaaaagggcttgaaaaattgagcctacgctagggggttgtattacagtaagtatagtaagacatgttgcgcttatcgttgtttactgaattagagactagcactgtaatcagggatggacgaaatttcgtttcgttttcgtttcgtcctacattttcggcacttttttcgtttcgtacgaaaatggctattttttcgttttcgggtttcgttttcgtccgtcaaaattttttcgtttcgtgtttggttttcggttttcaaaatttcttttttcgtttcgtgtttcgttttcgtgtcgaatgccctttttcgtttcgttttcgtatacaaaaatttttttttgtgattttcgcacatccctgactgtaatagaaacacttctccacgcttaaagcgtctgaaaaacagagcctacggtagggtgctgcattacagtaaatacggtaaaaacaaaaattgggcatgtgggcagtttgggttagatcagtttctcaattttgcgctgattgttgtccggctcatacatcaaaccgttccacagtttgtagaaacagtcatggcagtatggacgacgctcatgctcgcggaatgttccatgcaaattcaatgcctgtttcatgttaaaattattttttttaaatcgtataatattacataaccgtatattctctaattatcccccaatctccattaatcccccagtctccaactatcccacagtctacgaggcgtttgaaaaataattccccatgggggataaaaagagcatatacggtataataaaaaattttactttttgacaataacagcacataaagtggtatggatgaaacttttgtgcctttgtggcattcggtgccagcgctgtcagaactgacaaattaaaaaaattttaatttgggcaaaagaagtatttgaattctctttttttttagtgacctggcccatcaatttcctcttgacaataggcacacaccgggattggacccattggcccggcaggctgaacaaacggatttaaaattagaaagttcactactaaattcttaattagcaattttaaaattcataataaatcaattagaattgccaaatttcaaatacctctatattcagtgttcggcgcggggtcgctgaacgtgcgcgacgtttcaagctacttctggaagaattgtcatgttttattttaaaaaagtattgtccaattatttcaccgattttttaacaaattcattttttaattcataaattttttatttttaacgtatgaaaaccccatctacctaccttttaacattttttctgaatgaagcaaaataatttaaaaattgtttaatttctatctaaaaaaatatttcttttatgttaaaaattcagacccacggatttgtttgaaaaatgccataatcacgacttttaaaaaacacagtgattcattcctcaactcaatcaacaaatgtaaatttgcaatctaattaattgttgggtagtttaaatattttattattacatttgtgactcatccatgaggtcgacgtcgtaatcctttttcacatgctccacagtgaactcatcctcgggctctaaatcggttctaatggatattaaaccacaattttaggtttttgggtacttccgtgttttgctaccccccgcccccccccccccgaaaaatttaaaaattcatattttgtggtgttcaaggtcactctgatcacgaatatggtgtttgttttgacatatgatgacatctgttcatagatttaacaaaatatccatgattgtttgaaaatgtaaaatatgaatttttaaaatttctcaaaggggggggggagcaaaacacggaagtacccaattttgacgttttgtcctttctctctgacaaatgagccaaaaatgattgattaatgcgccaattttgtgcgactgcctttgttggcgcgcgctttgattcattttaactaatcgtaattgattacataaaaaatatttaataccaccatcagcagaaagaaagttcttaagtgtctgcctgccccgcccaatcaatcaattctgctcccctaattattgtaacaattctatcttttcttcatatataaaaatgtaggcaaaaaaaaaaatatttaaaaatatttttgtatcaagaatattcagatgaatgaataaattaaattaaaaaaaggaataaattgcatagccattgcaaccgaattaaaattattaaaaattaaatttaaatagctaccaagtggtggcatttcgtcctgttggtacaaatcggcttcgtcgggtgcaggtgttaggcgcagacgatattcgatctcctgtttaagtttggataaaaatgtttaagcaatttggcaagactaacaataaaaaatgaacctacaaatattaaaaggtgttaaaaaattaattgtaagtagttatgataactactattgtttaaattaatttgatctaaatgggtatactgtacatccaagtttaaattactttcaaattactgtacatgtctatctgtgcacgaatatcgcgctgacaaaaaccgcacctcgtgacttttgggctttttgcgcttcatgaaccgcggcgagccacttccgctggtgcattcacgtcgtacaccaatg

SEQ ID NO: 8773 - DNA, 1171 bp, Heterodera glycines
taatttaaagcagtcagatttatgggaatattttgaatcggcgggattggccgggaattctattttgctcggagatagtggctatcccttaaaaaaatggctaatggtcccgtttcgtgatccaaaaactgttgccgagaagcgtttcaacactgctttatgcaaaggccgttcagttattgagcatgcttttggaatttttaaacggcgattttcaattgcaaagttataaagattttttttaaaattaaaaacgctatttcagaacatcatgccgtttgaagcttaggcggatcgcaactgccattctagcagccgctgttctacataatattgcaattgaaatgcgtttgcctgaaccaccagcgacggaagatttaaatgaaaatgatgatttaaacgaaatcaacaatgagaatgaaaatcggaatgccattttaaatgatcgtcaatcgcgccaagctggaattgagaaaagacaagaattggtggcccgttttacctaattttttgttattttcatatatattttgtctctcaaatactctttttattagattttgactaattttggttaaaagggattttttaaataatttcacatgtctctattttagggaaattaattacagttcataaaaaaattttttttttttaattttgagttggccctaaaaaatcaaaatgatcattgagaaaaattattttataactgtttttaactggttttttgttagtttagcctaaattatttatcatacaaaaattttttggttggattttgactacttttgctaaaatggattttttatatacttatcattaggttaaaaaaatttttttggtatcaaaagaaagagaacacttcaatctataagaaacttatttttgttaatttttatcacaaatttccgtgtcaaatggctcatggtaaatattgcaaccatgggtatgatggtggtagcttttctaaccaccaactcccgtcaaatgaccacgaactaccttcttattctacgggtaaaaaagagggtcatggtcatggttaaatgaccaccaacttcgtggtcatttgaccaaagttcgtggtagctcttattctggcaggttttaccaccaacttcgtggtcatttaaccatgaccacgttcttattctacgggcccaggtca

SEQ ID NO: 8774 - DNA, 4218 bp, Heterodera glycines
tgaaatgcagaattgagtcccagtgattgaattgctggtgggttgactcccggcgattggagaaaaagccaagaaaaggatgcgaggccgcgaagcggccgagccagtcgattttatcattcataatcctataatacaatcgtactacctagcgggggatgcgccgaaggcgctgaccccgctagtacatatatgtagttcattttgcacaatatttgaacatcgatttttggtaaatttaattaagtgactttttgcttttgttttttatctacataataatgaatttttaaacaaaatttttctttaattataaatagaaatgccttctttacttggggcgtcgaatcattatgtagttttgcaaaataagtttggcagtaccggtaattaggcaccgtcgagaaagttttaaaaaatttttaatttttatattcaccgaaacaaagtccccaaaaaatagttaaataattaagaaaccatacctaattatcataaaattatattaacgccaaatttcaacatcgaatatccaccatttccaacaggtgctaatttgtaaatgtcaattcataatcaataacatcacaacttcatctctaacaatggcacattaggcgggtttcttctcagtgagttgagcaccggcacactgctccatcagcacctttttgatacgttctgtgtccagctcggactgctcgcataaattggccaaaacataagcatattccagggcataaagattctatgattaaaatatttaataaaattttatatatatttaatcataatattacatcgctaaagttgaagcaggaattgccaaaagtgtgcaccacctgaaaatcagaaccatgttttggagtttgtcaaaatcatcaaatagaaaaaataattgggtttctcaattcctaattgtccagtttttcagctttgtgctgctaaagcctggcgattctaaaaagcaaaaaatgctaaaaaaaaattaattaaactggattgggaaagcacaatttttattaggccgtttcgttctatattcttccaacttatattaagattcccaattcataagatgaacaaacggaaattttcttacacaaatcgcattattttcacccttattaatgttttccaatttcataaaacaataatactttttaaataatttttgtattttttgttgcacgtacgaataggaaattggaatctcgtgaataagtttcgaattattgtgtttgctgattgttttttacctcgtcatggcagtccaaattgccaattcgtttcggatgtttcgtcaaaattcgttggctgtcgttggcattttgcacaagtttgttcacaatttgcttgatctgttgctccacaacatttctctcctacaaaaatgcataaatatacataattttacggcatctttccatttccaacccgcgacttaatctcggaacagcgggaaaacgggaccgaacccggtcatatatttgtttccttgtctctgatctaaacatttgagcaagtttttttgagaaaaagcatacgaatgcctttcctaattctgtccctgaattttttaaatttttggcttcatctccacctcatgttgaaggttgtgccgatcttgttgggactcgttctgacgcttcatcaacagagaagcagcacgtgatggaatcgtcagaaatttgtgctgcgaagatgcctcaaaattcttaatcatttaattgaaaattcttcaaacattactgctggatgatgacgttcgttccgtttttgtgcctgttttttgcccataaattcggcaacattttcgctttgaattgtcaaatctccgtatttcatcacatggctttcgttcgtttttttgcgcacaatttcaaattggaccctcaaagtttccttgcccaaatttgccttcaattttatcatttatcaattggtaaatgattgcaaaattaatgccttggccgagtctttcatccaattcgctgaaaacaaatcacccaaacattcgccgttcaaaaaatcagggtcacaaaaagtggcataactgaattcgtagggattggacgcagtgacagcataaacttaaataaaaataaaataatatttttaaaataataatataaatttaaatgttacttttccactcctttttcaaagtttcaaaaaacattgagcccgctttgcatgcttcgatatacaaagtcatttcggcatacatcttcttctcatgcattgtcttcagagttcgtgtcaattgtttcactgtcagctgaaaacacaaaacattttaagcaaaggtttccagaatttttcttaaattccatgttgaaaaatatcaatttttgatattttcagttgcgctgaattttccttaatagtctgcttaattaccaaaaatttttatttctaaaaaaattaactacgtaaaattaattttatgaatttggtattattcaattcagcaaataccgtttgatagcataattttaattattttagaatacttctgagtgtgggaagatgagaaagccaaagtccccgtggccagaagtgtacacaaacactttgtcctttccagtgcttaatttgggaaaagcttcatttatctcaaattgttgtccttgtttttttctgcacctttttagcaccggctttcctttcgttcgcttctcatcgcccaataaaatggccatgaaattttgggggttaacctcatggccacggtagtcaattttgactccttaataagaaatgacaaattctatttaagttgaaaaattttttagaagaaaagtactttgtgcaatcaaatttacaaaatttgattggcatttgcatttttattaaagggttcttccaaaaaggaacaaagactaattagttagttagttttaatgcattttcaaaaataaattaaatgtttgctacttttgtaaacgtcctctccgtctggcacattgaaaatttttcctggctgtggatttctgtcaaagaatgaattttcttgtaatgatttcattaataattaattagaattctcttttgtttaataattaatttttatggctctgttctctctctaactctgtgttgttggcaatgtcgtcgaccatcattgtgataattcgcttcttttccactccatggtttatcagtgtatgataagcatggctaacatcggcctaatcatagaatatttttttgcgcattggactcagaaaaaaagcacaaaaaaatattgaaaattatgtttgaaattattaaaggaatatttcggtatgaaaaaagaaaatttgttaatttttttcctcaaaaaatcgtactcaaaaagagatgttttttatttgatgctaaattgagaattgtcattgtctttcatgatttttcctcattgtttctctggaactctcaatatatattttttgaattattcaaaaaatcccatcaaataatttaaaatggaaccgccccataaaatatccgaattgtaaaattcaaattttccaccattaattaaacactgatcagcccacttggtgtctgtaattttcccatccgttcgaagtggccacaagcacagcccaaatgttcccgtcctcggtgctgttcctgttgtcattgtcttcatccgtgggaagcggttgactagaaaatcttcaaaattcaaaacattctcaaccacttacccattaattaatggcaaaaaaatagcacccaaaattgaaaataataacataaataattgcataattagggaagaaatgttgtcagagacaactaacttaattagcacgattaattgcaggaaaaaaagatgaaaataaattcctctaccttcttttatactgccttttcagttgtattgaatcaatttattcttcttttttttattgcattaatttattcatcgccatatttttggactcagattccattaacaaaaattctatttttctcagttttcttaattaccatttagcttctcatttcgttgagaaagacttttgacagaattaattacataaattgtttttctctttttaatgtcaatgtctttcttttgaaattaacactcgccgtcacggaattttgaaatttttaatgaataagtttggaatatataatattaattttgtattaaatttttgaagatttgtctacagtccggagtattctgtcggagtatgctgctgtgatcttggattg

SEQ ID NO: 8775 - DNA, 2482 bp, Heterodera glycines
tttctcatccgaccacgcgtcacgtcattcagtcactgtcgctgtttgaggcgcttctggtcgcattcccatgggtcgtattgttgttggcattcgtcgtcgtagtcgccgccgccccatccgtggtcgtagtcgttttcgccgtagtcgcagctccagttgcgtcagtgttagtcgccgcgttcgtcgtcgtagtcgccgctccggttgcatcggttttagtcgccactgcccccgcccactgtgcacgccgtccggcacgccgttcgattctgcccggcagggtcactgaaataaaagaaacaaacattaacatgaacagaaaaatagtggcaaatcttactgagcgaatggagcatccaattgatgccacagaactgaaagggggatagggtttccgtgtccgaaattaaaaagcgattcccccgaccctcagaacccaccactccaccgacgaacgcaagcactgccacgcacatccaacccacaatgcccttgaaattcatcgaagctgttgacgaattggaattgtggaagaagaagctgttgacgaattggaattgtgttgtgatagcgcaacagagagcagagagagggaaatgtgtaagcgctaaaatttaattgcaaataattcaattagggagggataaagtaaagccgacttgaacagagagtgaagaatgaaattcgaaccaaacaaaaaatggaaaagaactcaaaatcatcggagaacaatttagaatgcactattttttggtctacgcccttaaaaatcctttgaaaacattaagggggctctttaatgtttctatcgaaaactcgaacctaaattgtccaaaaaatggtacaattaaaaaggacaaaaggtcgaaaatggacagaacagaagagtgaatttgaatgaattcgaaccaaccaaaaaaaaatggaaaagactcaaaattttggctatttatacacactttttgaaaacaacgactgacaaatttatgcaattttctgcgtatttaagcggtgcattccctaccaaacgcatccattcattcattgcactcacttccattgtttctccatcggtcgaatcttcatcctgctgtacaattaaaattgttcccgtcagttttttattttttgtataatttttttaaatgactaaatgttgtgcccttttcaggatggtcagagcaacaacggccaggacaagggcatcagcagcgcgagcacggagcatcaaaatcaatcgtcgaaatgccaagaaggcgcgtgccgcaattggacgagccggacatgtgagtgaagcggagggcaattaatacactaattaattcaattcggcaccttttttaaatgtgccaatttttcagacacgcaatgcgatggcacgagagaagtgcatgatgtgtctgggcaaagtgagctccatgacgcgtgtgaccatgggctgtgtgcacgaatttcatcgcaggtggaggcggggctaattccgatcaatttcgaacccatgggaccccgagttcgaacaagtctaaaagtcgagttttcctggccaaaatgccggaagttttgcttttgctgatcaccgaattcgaaatccgttccgatcaatttttaacccatgaccgtcgagttcgaacaagtcaaaagtcgttttcttcgcctaaattccgtttatgtgtctatgattttctagaaattccttggtggaaaatttttggattttttggggcatagaatcccaattttgacatggtgatttcggattaatgcaacgcttatcattatctcccctcaaggtgcctgtaccgctggctcaaatacaacaccaactgtcccgtgtgccgcttcaatttcatgcgcgcaattccccctgaagaaccggcggaggaacagcaacaacgagaagaaatgactatctgatcagatccatcattgaaatctgtactatcataatgttgtgtattatgtatatgtctgtgtgttgtgtgtgtactcagtataaagatgatgatactcggaaaacccgaattttttttgtcggtttttgctgtagatattatttagaggtcattagtggagtccggcttttcagattgttgtcaaaattaggttagctttgatcagttcctctctcagtctctctctctctctctctagctaatctggacaggaaaagcggatctatgcaatttttttttgaaaataatgagatttaggtgtatatgtatatcttttttaaattgctgatcatgaagtgcccatttcaaaattttcgaatctggccaatttattcctctttttctctctctatatcttgcaaaattttcacgccttttttcatttttggtcacttttacaaaagtttgattagtttaaacgcatatcaccaatacatacaattccagtgatcggacattgattgaattcaagtaatcggatattgattgacacatgatgataggcaacataaggaatcaacgaaacc

SEQ ID NO: 8776 - DNA, 3132 bp, Heterodera glycines
catgatgatagtcaacataggtatcaacgaaaccaaatgtccaattcaaaatgatcaatcggataaatgtcaatttcttatccttcttctgttgttgtgccatgatgctaatccaaagccacatccgcggttgtcgctggagtagtcgcagcgggcgcctcagtgttggtcgccgcattcgtcgtcggagtagtcgccgctccggttggatcagtgttagtcgccaccgcgccatccgcaatcgccgtcgttgtcgtcgcagcggtcgcctcagtattggtcgtcgcagccatcgtcgtcgtagtcgcaccgggttcgttggcgttggtcaccgtcgctccgtccgcgttcgtcgttgtcgctggagtagtcgcagcgggcgcctcagtgttggtcgccgtagtcgcaccgggttcgttggcgttggtcaccgtcgctccgtccgcggtcgtcgttgtcggtggagtagtcgcagtggtcgccgcgtccgttgtcacagtcgcagctccggttgcgtcagtgttggtggctgcatccgcagtcgtcgtcgtctgctgctgggcagcgttcttcccccgtcgggcacggccttttttcacggtcctcggacgtccacggccacgcttttgtccagcagtgcgcggcgccgccctcgatttacgcgatcccttcggtcgtccaaggagcggtttgagcttgagcggacgacgcattgccgagccgcgcttcttcctcgtcctggtcccgtcgccgtcgttgttgttcccctgccgacgtgacgcgcggcgcaccgctgcactcacacgcgctcgggcgctgcttcgaccacgcactggcgctgtccgtctgttgttggttgaggcgccctgctgtcgtcgacgagctctctgaacaacggcggggagggcgtaaaatgagacacggaaatagttgcagcaaaaaagagggactgaagcgggggccaactgagcttgagaaaactttcagaagccatctttttcggcacttttgctgtttaagagggtcccgaaaaagaacgacagagaatttcattttcacacactatttgcacaattctctttctctgtttccactgtccccttgttatgagaggtagagaacgcatagttttaaaaaaaatgttgcttttgctttacttataaaagtatgcgtctcttctaccgctcataacaagggacagtggaagcagagaaagagaaacacgaaaatagcgcgtgtaagactttttgtcttttcgggattcaccaaacagcaaaagtgccgaaaaatgtgatggcttcttaaagttgtctcattagacgcagttgaccgaccactagcgccagggacggctcaccgaacgcgctgctgttgacgcgcgacggcgtgaagcagtcctcctcgtccttgtcctggtcgctgtttgggtggtgcccggcgtgacgatgtccacagtcatttcggccaaattgtagacggattggtatacagaagacagaagcagggatacggagctaaaatgtaatggagaattgatatatggtaaatgcaaagacattaattgtgaaaaagtcgggaagttatacaaaaaattttcggcatttttacatggggtgaaaaaaagtaagttagggaaactccagaaaatgtcattagaaagtttttcacaaaactggcattccatttaggccaatctcgaaccccgggcccgaactcgaacaaacagtcgaaaactcaaatatttagaatcgcgtgtttttggtctcaaaaatggtctaacaattttttttttcattgatgacttttgtttgtttctttgtttttaagccgttgttttgaaaacaaaaatgcgaaactcgaaaaatttgaagttttcaaactttttgttcgaattcacgcccgggggttcgagtttagtcgaaatggatgtgccctattcgtgatcagcgcgaaaccgaaaatacattgggagaaacatttttccatgagttttgaaaacaaaaaaaaattgtttttttcgctgtttttgttaattggtggggaaaatgttttttaagagtttaggttcaaaacccagaagggagtaagcaaattaagttgaaatttgaaatacttactaattcaaaaaacggagtggcgacaaaaaataacgaaggaaggcaaaggtgttgggcatcagccgacggaaggcggaaatataaaaatgaattgtgtgtgtggaattggccgtaaatttcgttccttttatactgccaaatttcgttggaaacgcggagagagtcgggggtcactttgacgcgggacattttggcgccgccaattttgaagttttctaatttttttttattttgcaaccaaataaattattttgatatcaaacgataagcctaagtgttttttataagcctgcaaaatttgaaaaaattatattagattaaaaaagggacgaaacccaactcgtactgtttttcgagaaaaaaaattgtcataacttttgcggtcagggacgttttcgtaccgccattttcgtaccgccgttttcgtaccgccgttttcgtacgggggacgttttcgtaccgccattttcgtaccgccgttttcgtaccgccgttttcgtaccgccgttttcgtaccgccgttttcgtacgggggacgttttcgtaccgccgttttcgtacgggggacgttttcgtaccgccgttttcgtacgggggacgttttcgtaccgccgttttcgtacgggggacgttttcgtaccgccgttttcgtacggcggacgttttcgtaccgccgttttcgtacgagtggatatgcaaaaaaaattacattcaaataatttgttaatcttttttttaattacttttaatgttttgacagttaagcatttattaactacaaaatgaaccagcagcaagtaattaaaacgaaactaaataatgataaattggtgcatgaaaggtgcacagaaaaagaagtatcgcgatgccgacgcacggattcttcgtctcgtccaacgctataacgatatcaataacaatattgtccctaaaatgatcacaattatgccaatgccaatgtcaatcccgataaaccttaacaattttctcgctggtattttccgaaactatgaga

SEQ ID NO: 8777 - DNA, 1022 bp, Heterodera glycines
gtctaacccatatttaaatattgcaaaaattcgattatcggcgcccatttgcccgccattttcgccaacgaattgcgaaatcggctccagcggggccaatgcgcggacgacgtgctcattgtgttgaccatcaacgacagttcggtaaacggtgctccaattgaattaattgttcaatcggttgcgtaattttccgtcattttttccgattcgcacgagtacgggcggatgggcagcgacgaaattggacgcccaattcattttgaacgtgtcgcagacagcgcgtaaagcataataaaaaaatttcaatttccacttattaaatcaaattaaaatcatggataacactaattaattacaccgattaaattattgcaaaatttttgcacttttaatttgtcagaagcgcaatttttctctcgaagcgattacaccggaggcttactgtacatgctggacgagtacggtagacgacttggtgccccaccctttcgagtggaacagatcaaagaaagagaagccggcggttggtgggacaccaacttttggccattgttcccggaagtgggtgcctttggaatttgaatattttccaactttggcacttttaggcattacgccaatccgaaattcgttggttttggttgcttttccttctccttttgctgttggctctgattttgctcgtccttttctgtgccattcgaatgcaaaacaaaaaacggcgccattctttgggctatcagttgggacaacggacgaaagaaaatggcaaaaaatgagggaaaatcggaaaaaagcgaaaggaaaatgaacaaaaaacaaacgatcagacagaagagagaaaggaatttcattatcaaattgctcattcatttggtcaattggttttaatttgtgcttttcagttttatgactcaccaaaaaacaaacaaaaaataatttatttattttttgttttcatttcaaagtattaatatttaagtggacgtgcttttgctaatcattgcttaatttatcac

SEQ ID NO: 8778 - DNA, 905 bp, Heterodera glycines
ttgcttcgtcgtcttttgcttttcgtctgtcgcagcgtcctcaacagtcgtatttgaacacgtgcggcagtgcgcgcacttgcggcaattcgcaaacgcgcgggtccgggcggcactccgcgcacggctcacagcacgcaattttccacagcgtgtgcctctcgcgcgtaatggtggtgccgcagccgggcaacggcgtgcattcggaataaattaaatacatcattaattaattaattgtctcattggtgataatgccgttttaattgccgttaataattaccttacttagattagctataattaagtaatatatggaggtgttccattttttaaattcctttaataacttaactgcacttacttaaatcagttaattgaataattcgctaattaattattatttagttgttgtcccatttcttttttctttttaattcccaatagtaattgcataattgctaatcaattaattgcttcctcaccatcctcctgctcctcttcttcctcctcctcctcgtcctcttttccgtactgttccgtttctttggccaagttgaatttgtgtcccatacacttggcacagctgtaaatggcgcaaattttgatccaatcgcctcgcgaggctttctccgccgttccgatcactttctgaaaaacattaaaaaaaaatttttttttcattttttttaaatttattccaacagtaaaaaaaaatttttttttcattttttttaaatttattccaacagttctttaaataaaattattttctgcctgaaatttccgttttcgcgtttcaattgaaattgctttggcggggcgtgcgaatgcattttcaccgtattgcatcagactacggtagacataccgtagtccgtatgtggtggccctgtcctttgcta

SEQ ID NO: 8779 - DNA, 3008 bp, Heterodera glycines
tttaaaaacttaattggtttaatgccataaaataaattaaacacaattcgtaatgaatgcgtcgttaagtgatggaaaatgagtgtgtccgataattagaccgtcagtaaattttgaaataataaatgaaaaaatcaattattcaaataatgggaataatgttcctaataacagcagaagactgatgagttttcttaactttaatgcattttaggccagcttctgtgattgaaaaacttaagtttgaatccaattttgggcttatgcgcaaatggcatgtaaccgcgagatagttaattcatcctaatgaatttgctagactccttgaaaccgttaatttttaatttggatttgggaaggccccatttaaactattgctttaaatgccataattaaacaattcctaatgattaatgaattgctttttacccttcgccgtattcgttttgaatgtccacaaagtctttgtcccctcctccgctgctcctttttgtcctgaattttatgcacgtattccgctcaatttcttccattgctccgaaaatcactgccaattccttttgtgctaaaattaatttattgaatttaattggggtaattaaattttcctttttaattcgcttcgattaattatttatttcatttgagtgctttttagacccactgaaattgcccgttattcggtagggtatcacaaattttccgtccgtttcgtccttttccgttgtccaccgattctgtgcattgtttcttagcgcatttcgcatttttgggtttctaaaattgaaatttgccaaaatttggtcccaaattcggtggtgctcaaccgctgattctcctcccacagctgaaccacgtcgccatttccatgccgatttcgcgtgccgtgttgtgccgccaaatcaatcgcaattggctgacaatgagttttattattcgatcaaatgctatacattaaaaaagaaattcaatgttaatgttcgaaaattttaattttagttttgaatttgtagttttgataaataaaattaaattttcaatttcattttttaaaattcttataataataaaaatccaaaacatacttcacactttaaaagttgacaaattatggggagaaaaaaggagaaatattttccaaatttattgacaaaattacagcgaagcatttaattaattgaatttattaattggaattagttcagcaaaattcccattcatttggaaagaaattattatttgttcagtgggatgacgcaaaaaaaagaatcggaaaaatttaaataatggaaaaactttcaaaataaaaaaataattagggaagatcatcaatcaattttttttcttggtccaaaaattgcacaacacaaaaatggatacaaaaagatggattattgtgcttaatttcctttccaaaattgttttttaatgacaaaagccattgccaattgcacaaaaaagttacaaattggtcggattaattacactaaaaattgactacaatggattgggctgattatctgatcgcattttcctctgataacttttccgtcctccgtccgtccccatttctgatcggttctatcatttgccacatgatggcttttccttgcaaatgatcgctcgctgttccgcgggcaaagtgccagcgtacgctttgaatgcttctttcttttcttccaccgatttgtgcttcgtttctaggcacaatttcttgatttgggcttgcacctaacaatttacacgaaattcgatttaaatttattggaattttgctatttcatggcacggacttcctccggaagttgtgccaaatgcggcggcatcggcagcttttccatcacttcgtccggcaccgttttcatcagttcgtcgatcttttccaatttctgagcacagtccagcgacttgttggccagcaatgcattaatatccgctacgactttggaaggcaaaagggcggctaaatcggccggcaattccttaagcattaatttcgtaacttttggcataaaagtgccgaagtccctttggtccatggcacttaaccgatggatgggctatcccaccactatcaacggagttcttatcggttcaaagtcagtttttttctcatttgtcccttaatcactgcatttatcaaatggaattggcatagcatttgattagagttggttttttgtgcgatggcattagtccaaaatgatcggaaagtgccaaaaaagtaaaaaggaaacttacgtctttcttaagaagcgagcagaagaacattttggcgattccttttcaaaaatgggaggaaagagtgaacaattgaaagaatggaaatgaatgaattgcctcaaaaggcgcggctaattaaataacattttttctcttcgtattgtgcttaacgacaattagttgaatttgacagaaaatggcgaaatgtgtgccatgacaaccaaaaattaacaattaatgtgtgaaaagaatgccggccaatttttgacgggaatttgtgacagcgattagtgtgctaattaagcccataaaataccatattaaaacggagagaagggaaagaaagtgaaaaagtgaatggactttgaggcgattattcgttatgagtcataattcgctgcatcataaactcaaccaaacaattttgataacactcgaaaaaattttgaatgggagaattttgtttaacaaatgtgcaaatgtttctattcaaattttcaaaattctcccggcgatttcttccggcaccaatcggacgttccctccccccccccaccatttgcaacaagattttttgaaatactgcggcaaaaaattggacgtatatgccaagggcgcagccagaccttggctttgggggggggggggggggttgaagtcaaaaaatcgatttttaggggtgtatttttcattttttgaaatctcgaattcggggggttcatttttacaaaatttttcgccaaaaaattattattttttccattttggcctccatttttcaaaaa

SEQ ID NO: 8780 - DNA, 1116 bp, Heterodera glycines
atcgctcatttccacgaattaaatggcaatgcgacgaattgcgcgagaaattaggccaattagagggatcatttgccctgcgggtatagtgtgatgggcacggggtatggtaaagtgatgtcaattgggctcaaagaggcgaatttcttcaattaattggatggaccgaatgaccaaaacggcaaattgagggccaaacgaaatggcttttcagctgtgaagcggacaaattcctccaaaaagaagaaaaaaggcccaaaaaatattttaggataatattccgtttttataaaataaaatatttttattcagcagatgaatccatcccttcggcattctttcagcatcgaaaacattttaacaaaaagcgtaaattttgagaccttttctgagtaagtccgaaatgaaattgtttacaaaattttgtctgaattattaggccagaatttgccaacaaatctctccaacaattttcgccatcttttctattctcgtgagaaattgtttaaattattatgaaaattgaccaaaatattaaggccattgcttccgcaccatttcctcggccgctgttttgacaaagtgccaacatttgtcttagaaccgccgccaaaagcatttccaactgaatttagcagcgcattttttgagcggaataatggagaacgagaaggtgttagaagttagaaaacgcaaaatacagtaacataaatgcaaaaatcccacgataaacccataaatacggtaaagcacagtaatcgtaaggaagaagctgactgctgggcgcttaaaatgctgaaagcgataagatccataaaaagaaagagcggatgtgcctcgatagctcaatggtagaattgtccacggaatggggtggacgagtgggttcgattcccatgcgatgcctaacattttgcccatttcttatttaatgtatacatatcacaccgaaagaaatagaaaatataaatagaaaaatgaattcaaattttaaccgatgcttcactctttttgattcgtattttagtcgaatttgaaatatttaaataaataatttttactcttttagacatttaatgtgccattcatccattttcgtctttttaaactttttta

SEQ ID NO: 8781 - DNA, 2500 bp, Heterodera glycines
  misc_feature (2496)..(2496): n is a, c, g, or t
tgccaatttgggtgggcaaagtcggacaaaagcgcttcactctcctcattgacggaagaagcactgaaaaggagggcaccatcaattacgaagaagaggaacccaaagccaattagggcatcccttctccgatcggtcactcacttcgctcttccgtccgtccccccgacccttttgcaacggtcaaacaaagtgccgagcacgcggatgttattgcacagcgtaatggccacaattacgtaggaggaagtgagcataaagacggggaacagtgccaaaaagtaatcggtcagtctcagaagaccgcccgtttgttcgtcgtgctgaaaggaagcgaaaatacaggaaaaatgggagagaaaacggatggaaacggacgagaaaattgatggtgtaaatgtcttggacatgcgcaaaagtgaaggcaccgctcaaagaaagggcgcagtaaaaaaggaaaacgagagagtaaacggaagtcaatttggcactcaaatgatgcttattcctgaacagggcaaaatgtgagcaaattgggcgaaggcactcgcctaattggggtgatcagagcagggagtgaatggtggcacataaaggcgtaaacggcgacgccgaacaaagatccgaagccgtgaaaattaacaggtgccggcgaaccctttgggccgttgtgggccaattgggcgatggccaagacaatcatcagcaaaaaggctaaaccaacgcaaatgtaggataaatttaaaaccaaatagttggtaataaaattgtaaattgtgggaacaaatttgcttttcgcttacggcaaatgcccagcggctgaaagcaccttttgcccctttccaattgtttggcaacaaacggcgtgagattgggcccatggtttgtgttaaggacccaattctcggctttgttgcagggaaatcccatactttgacgactcggacggagtgccgtcctcggcgtgtgacgttttctttttcctcgtcaaaaattttcgaaaaacggcgttgccgtgaaataatttttttttattttgtaaaatttataaatggatttgcgatccgaaatgagcaaatttaactttttggaggaaaaaatcaaaaaaggacgaaatattttaaaagattttacattaaaattgtcaatttttaagtgattgatacaatttcaccaattaataatccccccccccccgttttctcgcctgtccatctcgaaagagtcgtggccaattgaagccatttcgtccgagtgattcccatcaaaatctgaacaaaagaattagcaattttattggaataaaagggaaaaaccattggcagacagaagaggagaaaagcgaagatgcaaatgcgataaacggcgaagcgactgagcgaatggaaaagatcatttggatgagaatggcacggggagaagggactgatggaaacggcagaaacattcagcgaagagcaaatcacattcataagggacttggggacagtggaggaatacacctgagaaaaggggcaatatcagcagagaaggcaaaaagaggttctttcccattatgagaccacaagcaaaaattttaaaaaatctacaaagggcgcgcaaattccacattcccaccgcataaattagcaatttatgtttatgcctccaaagtaatgcaaccgcgcacctttgttgattttttaaaattttggcttgtggtctcataatgggaaagtacccaaaaagaatggggacgaacataaagcaaaagcattggaaaaaggcaaatttaggactgaaaagcaagtgattttgagaaaaaagcgtgaattggggcaaagaaaatgtttctccgacccgacaatttgaaatttgacactcattttctccataaaaaacatcttttcccaaagtatacttttctgttacattaactgagagagaaccaaatcctaatatttattatggcagttagttgaactatgtatgattcaggcttttgaaattaaaaatgcaaattctcaccgcgaggtcgccgaacagataaatggtgagcaaaagataggagagaatggtgcccgactgtcccagaaacaaatgggccatttcactctgacaagcaaatgtaatatttttaagccaaaatcgcattgcgttacaatttcgattctcctttcgatttcgaaatcggattcggtcggcgtttgcccgcggcgttcgttttgcgactgaatgtacgccgatgcgcccgcggggtttgccgggaaatagaagcgttgttcggaggagccgtccgcgtccaccacgacacttcctacgcgaacctcgctcatttccccgtccgcactcgacggcacatcgtcctccaccacaaaggcaccctcctgcaattgctcacgaggcggtgcccttcgcaaaacgcaattgccatcgattcaaaaatgaaagtggcgcaaacataactgaaaagggtaaaatgtgaattgggataacattttgtttagttagaaaaanggaa

SEQ ID NO: 8782 - DNA, 1615 bp, Heterodera glycines
  misc_feature (1582)..(1582): n is a, c, g, or t
attagtagtaaaagttttaagtataataaaaatataaaatgaccctcaaagattcatcgaaagtagacttttctctgtgcagagatgcgtattttcaccaaaagattaatccgtttttttcgctttttctccatcgtttgaattgaccctcgtaatgcgggaaataaggagcagaaggggcccgagcagataaccgcccgttttggaaggcccgcggcaaggcgagggcgccggtgccgacgatcaaattgaacacgtagagcaacccgacctgaatattaaatgaaagttgggcatttttttaaatttgatttttgggaggaaatttagaaaattagcaaatacaacgggtgtactttagtcaaggccccatgataaccatatgaactgaccgtggcactgaatgtttgtccgctgggcacagattcttctgccatcggccgcaatctgtccgaccgatggcctaaaaatgcaaagcaaatgacggaaaggcagaaagaaacaaatgaaaatggaaagtgtaaaggaaagagaaggggcgaaccgaaagggaaaaagagaaggaggaagaaaagataaggaaagtgatggaagggaagggaagggaaaacactcgcagagagcggaaattttaaattagaaaataattacctaattacacacctaatttagtgtgctaaattaaaaggtggaaaaaatgttcattttaaatttctctcgtttctcctttgtcggtgtgttgcgacatttcgcttcgtttctcaaattttgtccgtctgtcaattcctatcccttaaccttctgtttccctcctctccctcttcccttcccttctctttccctcttccctttttctcgtttctgtccctgccctttctttgttcctttctctgtcctctggcctttcttttcggttcctcgtcctcacagggatttcttgcgcattcgctttgttcatctcccttttccctttctccccactctctcaccgccctctttctctcgccgccactttttctgcttttttctcttccaaccatcccatccttaaataatccatcgtccgcttctcttctcttccctttcctttgcaaatcggcagacgaattcgtttgggtttaatttgtaagagaccaaccaacaaacgctcaaagacgaataaattcgtaacattcgttcatccccaaaaccaaacagatctcatccaccgatccctccatccaattaatcccaatacgcccaatcgcattcaatcgattcgatttgtgaaggatcggggggggggggggggaagggaagagtgtcggggtgggaatggtgagagtcgtcgtccattcgttcattcatcccccccccttttttgcccgcaataattgcacgtccctgccccatatgtttgtatcccctcaaaaggagattgtctgttgtttgatgtccattaaataatgtgtgatttcttgggaatttttccaacacccaaaaggcgcttgagcgatttgtttggctgcggctgtctctctcattctttggcctcggggcatccctcccgctccctaattaccgtcaattattttagagacgngatttgctgactcaatcatttatccattcctgg

SEQ ID NO: 8783 - DNA, 839 bp, Heterodera glycines
cccctccctcccccttctcccttccttccttccttcctatcctattccaccacaattcccctttttccctttcctttcgtctcttcttcctcccctcccctctttgtgtgtacattcaattacttctgctgaatgaaaagcgcggcttctcctcctgccgatgggaccaaagtgacgaaaggttcgccgccgttagccattagccttccattagcagcaattgcattcattcgtcacattcatttgcccgtggctttgactttattccccaccctaaaatttcaacaacgaactctgaaagagacaaaggaattgctttttttgccgtttattttggtcacttttccactcaaattattctccaaaaattcccgctgggcaaacagtcgagaaatttgtgttgtgttggggcaactttacgatcacaacaaatgatttggtgattttctcgcctttcgccgccgcctcaccaatcggtcgatcaatcattgataaatacagaaaaactttggagcaatcgaccgacagcagcagttcatttgctccgttaccctttcttttttcggtttttggtgaattgtcccactaatttttacataattaccccatcacaaaattaggcaaatgtaaattcaatgcttacaaaaattaatttaattcttacaaaaattacgtctattttgtacaagagtttccatctttaaacaaacggaaaagagcaggcaattaataactgttacacagaagggactacattcgtttgtccatctgttcggcgtttcccccccccccccctcgctatttctcattttccatgtccagacctcaggcagcaagct

SEQ ID NO: 8784 - DNA, 3684 bp, Heterodera glycines
  misc_feature (6)..(7): n is a, c, g, or t
  misc_feature (3528)..(3528): n is a, c, g, or t
  misc_feature (3531)..(3531): n is a, c, g, or t
  misc_feature (3603)..(3603): n is a, c, g, or t
  misc_feature (3615)..(3615): n is a, c, g, or t
  misc_feature (3638)..(3638): n is a, c, g, or t
  misc_feature (3645)..(3645): n is a, c, g, or t
ctgcannggtctgatattttgagagaaaaacgtaagattttgaaaaacgaataattttttttaggaggtgttaaaaaccaaaaaaaaactgccgcgaaatttgtgccaccaccttgagcgcttccagcgtgattttgtagaattgctgcagcagtgccgtgttcttcgagagggacacgtagtcgagaatggagttgatggacttttccgcgtaatttttggtgaccgatgaacgaatgtaagtgagcaaattgcgataatggcgcagcatctcttcaaaattgcccttaaaattaaaaatattaaagtccgccaaattttccaaaatttgaaaaaatgggatgaaatatggcctggcattgccaaattactccaaattttccccaatttggacaaaatgccaaccatggcatagttcagcttcatcatctgcttgagcgccttgaagccccagtcgcccttctccgtctccaactccaacacgcggcgaaaggcgtccaacgcgccgcgctggtcgccgtccgatttcagcgtttttgctgcataatattggttctccagcgccacgtccggctcactgcccgagtcgtccgaatattgctgaaaaaacaggcagcaaaaatgccgaaaaatacgtgatgaaattttttgcgagaaaatttgcgaaatttcaatcgcgctattcgatggcattaaaaactcctcactaaccaagccataatcttctccatcgtccatttcaaagtccgacattgtgtttgggtgaacggagaagaagaatattaagttatgttttagttaaatggcctaaaaatgaaaatttaactaaaaaatgaatgctaaaataagaataaataaataaatgtttagattaccatgtgtacttatcaaagaatgtacttggaaaaaggaaaacagaaaccaaaaacagaaaccaaacaatgtaagtgtccttatcgcgttggacaaaaacaaacaaaaacaagaacaataaaaaaatttttggcatttatggcattttatgccttttcaaattttgccacatttttgaaaaaaaatggtaacatgtgatttcgtcagtgagtgatttcgtcagtacggggttcgtagtaataataatattttttttacgaaaaaattttaataattcataaattaaattcgttcaaaatatattaaaaaatatgtaaattcaaaaataaagattatttgttcgattatcaacctattttcggccggtcacttacatataagcaaaataatttgtatttgagcctcgtctttgctacttttatctcctatatgttcattctagatggtcgtcagccattatcattctgcattaacctcgaaatttcgctttcaattttcttaacagtgttggagcgcgaccgcgagttttctgtccgcgttccacctctttcttaataagcatttcgagtttgttgatagtctttgtcagttttctgtctataaatagagattgtgctgcgtcagccagtcactatggaggctacgtttaaaaatgggttcggcaggacaacaatttgaaaatacttgtaacggattttgcaaatcgcaacccgctagggtatttacgagcctgctttatctttcggctttttgaattttttgtaatttttggctaggtgttcgtttttttctgaattaattttcactgacgaaatcaccgggaacctaaaaaatgactatgtatcgaaaaaatagagcacggaattgaaaaagtttggatcggaatacgaattttcttgtttttgaacatttcccaatatttcttgagctttcgtgtcgttttctgcgtctcccggaaaatttctgctaaaatcataattctctggccaattctcagttcggaaccaatcaatatttccaactgaattggcataatctttcgtctcaaattcgtcacaggttttgaattcgatcccccaaatatttctctcgtcagtctcggcattatttccgtcccaaatttggcacacaaacattcgtcttaatttaattttacctcaattctttgcaattttcattttcttccttacacattgcaattaatttccatagtaataatttcttccgcccaccaattacccttcttcttgctgctgaccttaacctgcgttcggatgggtacacaaatctgtcgagatcggaatttgctttatgacacagagactgcccaattaatgcgggaaatgtttgggttcgcccggttcaaatcgaacattccatcaagccggcccctccggcgctttctgttgccgcgcatagcccccctcctccctccgccgtcctctaacattcattccgtcattggcattccgacgccccgcgtgccggacagagtttccgtggcattcattccagtgcctccgcgtgtccgtcctccgtttcaggctgaatatgtgtgtgttatgtgcccccttccttctactgatcagagcagagcagctggatgatcagcatcatcgctctcaccgatcactcatcctccaaaatgacaactttctttcccatccccttgggcgggtgccgcccgccggcggagggcgagaaattgcgcccgcggggaagtgattaataatcatttgtatttacccgccccgactttccccgatgatgatgagtttagtttgatcatcactttgctgatcggtgaaagagagaggatgaggattaccggctagcggaggatgagattttgggtccggatctttgctgattgctgaactgactcactcatcttcttatatccccccccccaattttgggctgctgattggggcgaggatttgtggggtatcatcgggtatcatcaccattatcagatagttatgactagatcacacacacacacacacactcaccaatttgatggattcgatctcgcttttctaatgaatttttttaattttacaaatttagtgggttcgccaaattcgagaataaagtcgacaaccgccgggatttcacgggatctcctcggtccaacgtttgaaaccccccgcctgagttcggcttcctgaaaatctggtggctaaatttgatccattgttgcattccgtgagccttatttgactccagcttattagctaatcaactctttgaaggcccgctaattgacagattgcattttctctaatcattaagcccgactttagagctgtatcccataaaaaatattttcaggaactttggtaatagagaaaaaattaaaatgtataaattttttagccaaaatatcgaattaattccaatgacaacaacagtaatcgcagcatgtcttctgtttctgtttatacatgcaggtaaagagcagaaaatgcaaaaaaaaaaataattcccggaaaattgaaattcaaatgcctaaaaatatttccgaaaaaacgcccggctccccaaaatatgaccaattttcggtaaaactcagcaaaattatgtccgcaatgatcattgcaagggatttctctccccggaaaattacgatcatcccttagacaatttggncgncaaaaatgtcgtaccgatttaaagaaaattctgtccgtcctctgctgagcattgaaccaactgatcgattangatgatcaattncaaagttgtctcaacaattcccngaataantttaattttttttcaaattttatttatttacgcgttttt

SEQ ID NO: 8785 - DNA, 2020 bp, Heterodera glycines
gcgcattcgcctcgtcgttgagcaaaccgcgccaagcaatccatcgacctcagcccgtccatttgctggtggacattggcgaaatgtcgtcaaccaacagcaacaacaacgggagagcagttcaacaacaacagcaaaacaatggccgggaaagtgccggcggtgccatcaaacaaagggacggagcagcgaaagagccgacggcacagcttcagcaacaacaacagaaaattatcagtgagtttattatatatgtgtcgtttggtgcatggatgggagtatcaatgccaaaaagtaatcgaaaagcggcacttgccgtactccaatggcatagccggggttggggctgagggggctaagccccgccctcccccaaaaatataaattgaattcagccccccccccccgtattataaaaaagttttaggaattttgtgatcggcttgtttaccggccgagttttcggcagatttgtgaggttttatactgcttgagattgcccctcttggcaacattcccgataaaggaaagggtgccatcaagcatttcaacttttattggcatttctaagggaatcagtcccaacttaccaacgagttgctgttttgttttagggtcaaacatttttgtggcattaaatatggccattctcaaactcgagagtcccgacccgggcagcgcccaattaactaattaattaattatcacttaattaattgcccagcaaaaagtcaatggttggattggacacggtggagtcgttgtgagaacggtgaacgaattcgggtgcgcaaatgtttgagcatcaacggtggtccatgtgaggtcagttgtggtgcagggcgtggtgagcttaaaaaccccaccaacgaagaaaaaattgtattttagcatttcccaatcaaaaattgtccaattttaaaaacagaaagaaaattaatcgagaacgaagaccgagaagaaaatagccctgggaaaaagtaggaaaagtgaataaaaattacaacaaaaaaaagcggtagtcaaaaaggcattcataagcttcatgaaaaattttcacgaaggcattactaattcacagctgtaaaattgttttaggaaatggaattgccaaaatatttataatttaaaataaaacaattattttttataaaatatataaaatattttgcaaatgttttaatgaacttactataaaaatggttttaaatcttctaaaccgaatttactgtttaaaaaccgtttgggcaaaataaaaattttagaattaatcggggaacaaaaaatagggaatctggggactctgcttttgaaaagataaagcctgaggctgaaaatcccccgaggttttctttgctctgaatccctttaaattttttaaattgagtttttgccattttcaggggccaagcattgagaagcaaagctgcttttcgtccatcagttccggcattaaatttgccaaggacccaattatcattgagcgcgaaatccgtggcgacattttgacctcacagcgacgatttgcaacagcaaagaattgaaaaagctattggagaactgagggcccaaagtcaaaaataaaacggatttaattttggttttttaaattttcattcaacccatttcctgaaataagcccgccccccggattggaaagccccccagggcttgatttcaggaaaacggtatttatcttcactatttatcattttcaaattgtgaaccgtttaaagcaaagcttataaaatcttggataaaatcaaaatgctttgtaaatatgagtaggattggaacttttatatttaagtctcaagaagccgagatcggaaaaccaagtttttctcgaattgagactctcgagcaccgctaatactcaaatccctcttgctggttgcgcaattttaagttaaaaatttgttcctcaataaatatataattgactttagctcatgttatgtaaataagcgacaattttgagggaaggatttggggggggggggggggaagagatcattca

SEQ ID NO: 8786 - DNA, 1508 bp, Heterodera glycines
  misc_feature (1434)..(1434): n is a, c, g, or t
gcgcgctcttcacatttcaaaattggaaggaaatttgatgtcaaaaatggtcgcggcgggcccctgttggccgaactcgcgcactttgcacttctgaaatttggataatcaaagcggggaaggaaaatgccatttccggtggcattaattcaccgatgcacataaaaggtcgatgcaaaaaatgaaaaatttaagaacaaaaaaaggaaatgattgctacattcccaaaaaaccgaataattccaagaaattttttaaataaattaggctgggtaaagaatttttgaaagatttttttatttgcatcatttgtaaatgccaacttcttcgtgccgttgggtgagccggtggaccgcttgtgccaatgtttccacaacgacggcctctgtggccactgtcggcgatgtttttgttgtggcgatggcagcacaattgggctggtgatgatggtgttggttgaccgttactgcaccagtgccattctcaccgttggtcaattcattggcacaattgcaattgatggcagcaccaccttaaaaaatagtttttttggattttttaaattcttgcagaggaagtggatttcctttattttcagttttttttttcaattttgcttggattttattttaattcaattttatgaatattttttaataatttttgttataaaaaaatgcagagacactaaaatagccaattagaggattttagaaataaaaatagaaaaatttttataaaaaaaaattaaagatttttttttcaaaaaatcttctagcgattcttacaaattttatagtcaattacttagtttttcaaaaaaattttcaataacgctgaaatatgtttcaaaattattgaagttttttataaaaaacattctaaaatttttttcaaaattaatttgaagggggggggggagaacacagtgcaccccaatgtgaccaaccattaccattctgttgctgctgttgaaacaacaacgcctccaactgtttgaccgttttgccacggtaaagctccagcaccttgcgacttttctcctaaataaagaatgttgctgctagctattcgtttttttaatcgtaaaacagaaaatgtcaatttaatgggccaaattctttcggtctccgaacaaattgtggggggggggggggaggccacctggtcaagccgttcttcctccgccacgtcaattggagaattggcaaagatgcgcaactgttccacggtgatgggcaaagtgagtgcttctgaagaggaaaaaccaattcaaaataattcaaatttctagcaaaaaaaagtaaaacaaacccgagcttggaatattccgaaagatttagtaaaacaaagaatacacatttggaaaaaggcaatgagaagcggagcaaattaaaaaaaactccctatccttattatgcaaatttttagaanaaagtgactaaatttgtcggaaaaactccgagcatgtaaaaacattttttcagaaaatctgcagcagcgctcaa

SEQ ID NO: 8787 - DNA, 2837 bp, Heterodera glycines
  misc_feature (2810)..(2810): n is a, c, g, or t
aaaaatcggcgaaataggcattaagcacaaaaaatccaaaataggcaaagttaggcattataaaagtcatcgtagacacgccaaatcaagcggaaaatgcgttgttcgtgcttatctgtacgtattaagtgcgcaaaaattttaggcatttgcctaaaaatcgcatccctattgatggatgattaatgcaacaaatgttaatttatacatttttcattttctccatagtccgtacaatcgaaaaaaaattattaataaacagcagaccagcaagcaatgagcaattttatccatttctattgaccatcgacagcaaccaaagaaaataataatatataataatttgttatccactaaattcttgtattttaaaaaatgagaatatctgttaggtttctatagaacgtacgttattattaaaaagcctaggttttgcatttttttaaaatttaatttattaatctttcggaaatatatatttttatctgaaatttatttttttcaaatttttttttgaatagttctgataaattcaaaaaattatattagacaatgggtattaaatactatttttggtattgtaaatatttattttgataatattaacataatggtaattaattaagattttctattttttgtctactttctgactatcttttctttttctttttgtttccgttcttaaactaacataaaaaaatagtattagttgatttttattttaaaactaaaaataaataaaataacaactaaataattgaaaaaagttcataatttttatttttctttgcccaattctatttttttggaccattaaagaaatatgcatcaataatacaaaatctttcattaatgggaacacagaagtgagttttgtcctttttgatttgtgtcgagattttcgtaatatataaatttttttaaatgtcatataatataaatatttaaaattgcttaatcaattaatattcaataactcgctgcccaatttggtgatttctagctccacatgacgagcaatatgttagctggatttttgcagaggctagcgcatatttgcgcagctcaattcattttctatttttctaattcataactaatatacaactactttaaattgtttcaatattaattatttttttaaaaaatagaaaataaaaaaattttttgtccataaaaagaattatttgaaaattttaaattaattttaatttattaaaatactatagaatcaatgaatccttcttaaattcgtcatcataaaaaactaattttgcataagataaacaaaattaaaaaatagttttttttttggcataaaatttttttaaagcacaagaaatttcaattctattatattaaaaagcataaatctttttaggaagatgaaatatttgatgctcatattttcactacaattttttaccttggaatgctttgccaaaaaggaggtagtaaaattaataaataaaaatgtttataatagaaacttttaaggaagttgaaaaattgcttaattttatgtgccgaggactgagtgacgaatttgattatagaaaaagtgaaaattggcgaaaaattggccaacttgattataatgttgtgccgagagaaaaatttgccgattttatggactggcaaatttgctacgcatccattgaacattatttagagtattgcaaatacagtcatggtcataagtgttgtcccatcatgcttttaaaaaaaataattgccgtataaaattgtcattttccaatttcaacagataagtagcataccattggatagcattttttatgggctttccaatgatgccatatttgcttttgtgacataaacatttatttgatttattttaccatattcacaatttgatcaaaatataggtggtcaaaagtgttgtcccatttcatttttaaaatattgcttctctggatcagcattaaaaaaatctaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggccgattttatagagcacaaaattctctacaatattcaaaaaaccgcatgtctctatgacttataccggctgaggtatgggcaagcgccaattcgaatcttaatggagtattaattattgctgttaattagtactaattaacaattaatttgcacctcctttttccgaagcggtgcaccaaaggtaaatggagtgaaggtgctgatgtccagcccagaatatgaggaagggaacgagtgagaccgaggattggatttggggggaaaaaggaataagccaaaatccgggccctggataaatgacctccccaaattggtaataccttggccgctctctagctcgcattcgcgtacggcgatgggcgagaaggagtaaactataagatatatattggccaatctcatgggatgataattgccccgcgctcctctcttgtctctcgtttttcgactatctcttctctccactgctacggtatagagtgcactctttccgtataaaatactcgaatttagtgccgttgtaagtcaaatagatggtaacaataataaaaattgaggtacggcggtaccgataggcaccgccgggaaaaatttttggaactttgagtgctattttttacgaaaattttttaaattttcgtttggggggggggaattcaaaaggaattttcanttatttgctggagaattttttaaaatt

SEQ ID NO: 8788 - DNA, 1309 bp, Heterodera glycines
aagattataataaatttgagttacggaaaattaaaaaaagattttaaaccatttttttttttgcaattttaatgaattactgaaaaaaatcttataaaaaactatgcgataaaaagtaaggtagttggaaaattgtcaattcttgtaaaaaagttaatatatttcatatggctgtgggcggaacagtacaactcgccgataagatgacttgccgataaattgggcaaaaaaaatttttaaaaatgaaaaaattttttaaaagttaaatgtaattttgccgtagataaaaattttttttgcacaatttatactaatcgcgagtcgacgtcggcgagtcagccaacggaaagtcggcgagtttgtgtgtactcctgtcgtaggctgtcgtccaattttcgatttttgtatataatttctaaaaattttaagaaattctctatgaaaataatgaacaaatcagcttgcaacaaattgcgctgcagccaaggtttttctacgcaaaaaatagcattttgccaatcattgaagtaatgaaagaaattgtgcgcacacaaaaacaattttttgtcacaacagtcaaaaaaaatttgaaatattgtgacaattgcaacaaaatcacacaaatgtacaacctccattttgagaacaaagaaaactgtgtgaaggtttttaaattttttttttttgaatttttatcgtcttaaaggataaaattagaaataaatgattaattatttcaaaaagtttaccggcggcgcctgtcgacaacatcagattcattaaaataaaaaaaaacgttgcccaaaatggaaaaatcttttttttgggcgccaatttaaccaaactcaattaaattttaaagaaatttcagagacggccctctaaaatttgtattggttttttaaagaatttcccgcctcggcggatgacttgtccaatatttgggacagggccatggaggtcctgataacaggcgtttttcaattaaagcttgaagtcataaaattttttatgggattaaattctgtgctaaactcaatgaacaaaaaattattcatgaaatattcgaaaaaagcagaattcgaactttctcattgagttttcttgccatcagtattatggcatatgctcaattgatctaccctgtgtaaaattttaatcaatgttaaaaaatgatcaatttacaccaatttaaaggcattggcttgggctaaattgttaaaaaacagtgcggaccaaagtgcgttatctgtgttaagaaagataaaaacgaatatattatcaaatgccgatggaaaaaagataaagt

SEQ ID NO: 8789 - DNA, 1510 bp, Heterodera glycines
  misc_feature (1451)..(1451): n is a, c, g, or t
aaaggaaatgtttctggcattggtactgtgagtgtttttgacatatgcgatgccaattgtcgggaagaacagcgtaatgataatgaggcggcgagttcaaaggttccggagaccgttactatcactaatgatgattagtgaaatttcgtgatagcgtgattaaatcaaaatcacatacaagagctgattcattcctaggaatatgactgaaaagggcataaattccaaaaaattgaaaaaaaatacaaaacaagcacaggttggaaactaaaaacaagaaaatttatcggggtctaaacccttggtctaggttaaaattttcatttttacctaaattaaagaatttttaattgccaaaaattgccggtccgtgcaattgtaatttttgaagttttttaaaaaatggaataaaataaatcgcaaaaccaaaaactcagatcattttttctcctcatcaatatgcctttttaagctattgagttcactaaaactggataccattatttgttgattattttttaatcctttttcttttctacattatctatttttcggaataattttgattccatatacaattgattatttctttgttgttgtattttacaaattatatattgcatatttgctacggaatattttatttattgtatatgtatttatttaatatgattttgcagagacttttagcatttaaagaagccgacatgaattatcttcttgccactattttgattcaacaatttatcattttagtatgtggtgcgaatgaaaaggtaaacttagattgattaattactttaattaatttttaaattattaaaatatttaaaaaaattaaggaaattattacattatacaaatttatgtgcaaagagttgactgaaaatgatgaagcaaatttatacagaaacactaaagattggcaacatatcaaaacaattatccacaatgagcaaattatggacaaatttgagactttaattgagtggcaaattcgctattcatctattgaacgttggttcaactattgtgaaaagctcaaaacatatatcaattctaaaaatggtatatttaaatttaaaataataaaataggaaaaaaatggattttttttaaatcagttaatggcgaagcattactaatgtcaatttcactgaagccaaagtttacattgccaaacggaaatggcattttgccaattgccaaggcaatggctaacattgttgaagcatacaaaaatattttcatgggaaactgtgaaaaaattttccgaaattgttacaaaaaaataattaagcaagaagaaaattcttcagaaatgaattttgaaaacaaagaagattcaatcaaggtttgataatccaaatttcgtttatatattgcatgttttgccctcttcttgtgttttcatgttttaataattaggcctttgaggctttttgaaattntttgagttttataaacaaaaatgggtaggctttgagattttttgcaagggatttaaaaa

SEQ ID NO: 8790 - DNA, 1484 bp, Heterodera glycines
gtatacaaaacaaaaaattgaaaataatataatttatgtagagggattgaaccaggggaaagaagaagggaaagtcaaggagactagccattaggccatttgcacacttggggcgaagtgaacccgaggaacatcaatcagaacaaaatggcccgtctcaaccaacaaatggccaaaatcatggacccgcgcgtgctgcaacaaatgggcggacttggcggtctccaaaacatgtaagtgccgaaaccaaaatgggagaagtgtttcccacagtcctgtttcaggtttcagttccccttgtatagccccccccccgaaaaaagatttcacattttaattacatgatttgctcccctatataggatgaagcaaatgcaatggcgcctcgggctttggtggcggtgccggcggcggtggtggcggaagacataaatgaatatgagaaggacagacaccaaatgatgaaaaatttttgtatttgtgttacatgtgtttgtggacaccccaaaatatcgccgcccgaaatctcatccagccaaaatagcgcctgaggaattcaaaaagaaaattttataaacttagaaaattttcaagaaaataaattattgaaaaaatttttttggagaatttccttaaaatatcagtttaaaattttttggcaatattttgtctcggcgatatggtgtgtgctgattcttctctctctttcagtttgtttgctgacaaaattgaattttgtgactgggccagaaaaaatataggtcgggattcaggacgagaaaaaaagggtttctagattcggatggaagtcagtttttctgtgggacatttttgtatgggtaaattcaattttattcgaatttatctgcgagacagcgacggtcttaagattttcgtactttaggggggggggggataccggctggaaaattttttttcttaaaatgggattggatataactgcaatttatacgaagctgggtttttattgtttacctcacataaaaaatatatgatcaaaaaataaaaaattgcgaggagagagagtgaccgatggatgacgcagggagggagagaaagagagatgaagtgaaaaataattgggcacaaatatatgatcaaaaaataaaaaattgcgaggagagagagtgaccgatggatgacgcagggagggagagaaagagagaggaagtgaaaaataattgggcacaaatatatgatcaaaaaataaaaaattgcgaggagagagagtgaccgatggatgacgcagggagggagagaaaggaagtgaaaaataattgggcacaaatatatgatcaaaaaataaaaaattgcgaggagagagagtgaccgatggatgacgcagggagggagagaaaggaagtgaaaaataattgggcacaaatatatgatcaaaaaataaaaaattgcgaggagagagagtgaccgatggatgacgcagggagggagagaaggaagtgaaa

SEQ ID NO: 8791 - DNA, 1593 bp, Heterodera glycines
taaaacattcagaagaagtctgtaagtctttccatttccatcatcaaaaggatggattttgagctgtaaaaggagtttttaattaattattttaaaacatagttaaaaatttatttaatcaagacattttttcaaaatattttttaatttaattatacaaaatctcgcaaattcggcttccattcacctatgtaagtgatatgattaaaattggtattaatggtcaaaaaattaataaattgaattttcgggattgattattttaaaataaggtgataccaacatttttaatttatgggaaatgtaaacgaaaaaagggaagggattcccgggtttcccaagggatgggactcccgttcccacccaactctaattttgagaatatatattattatttttttattttaaaatatatgttcgtctctttactcgtctttgctctcctcatgattatggataaaccacgtaagaaaatcaatgccgctgttggtgccgggtgaggattttcatcagatttaattgtggctttgttaatggtatcttcataatccttccatttgttttttggaaggacaaatgacaagttctaaaatttttgttcattttaaatattggaggatagatgtaagtcaccaatcttttcagaagaagcagatttaataaaagccgcgatgttcgcccattggcgtctatgtaaggatgcacatttagctaaaagaaaagaattttttttacaattctgctagctaatctatattaattgtttgatttgtgaaaagagccacatttttgagcgatttcaaacctaagaaaatgcttgaaaattttttgaaattggccaataaaacaactcgtttgatgaacaacgatttgggatgatgtaaattcatgttggattttttaaatctaccattttagataatgttaaaaatcagttttgctcaaaagcagccaaaactattatttttatggtttaactcacaaactccacgtgatattttatcgcgtttttcatgaaagtgtcatcgtcatcattcgccaccgcagctctgatgcgtgttaccaatccatccattagtcccccaactttctcccactctgggcaaagtttgtcaccaatgcgcacgtcgcttgttcgaaaatggccggagtgttgcgtccccgaccaagcaattttatgcaactgatgaatcgtctcaaaatggaaaaatatattaaaaaaatttgttttggcataaataacaagaaacaagacattttttcaaaatattttttaatttaattatacaaaatttatcctaatattttttaataagcgaaacttaaacccaccattataggaaatgcgattgatgtgcttttgatggacttcacagtccaaagaatggacagacaagctaataatgcagcaatctgcgcccgcgggtggcaaaagcagcggactttgaccccgcgggacggggaacaaggcaacagcatccatcgactgtggcccaccccaaacactttccccttcgttagcatttagcaataaatttgggcaagggggagaggggcaaacgacggcggcggtggacgacaatcgtatctttt

SEQ ID NO: 8792 - DNA, 1316 bp, Heterodera glycines
taaaaatttggtacctctttattttaaatatcaatcccgaaaaaattgatttattaatatttacgatcaataaaagcaatttaatcatttatttacataggtgaagtcgttccagctgtggtcactgttttatgaggcggcggaaaggggcaaaaatgttcggcggacccaccgacccatcatcaaacacactaattgatcggtcaattaacatttttcccattttttatgcatccatccattttcttcttccgttgtctcttcccggccaattaatttcacttcctttctctccctccctgtgtcatccatcggtcactctctcctcgcaattttttattttttgatcatatatttgtgcccaattatttttcacttcctttctctccctccctgcgtcatccatcggtcactctctctcctcgcaattttttattttttgatcatatatttgtgcccaattatttttcacttcctttctctccctccctgcgtcatccatcggtcactctctctcctcgcaattttttattttttgatcatatatttgtgcccaattatttttcacttcctttctctccctccctgcgtcatccatcggtcactctctctcctcgcaacggtccaaagcaatggcataggtgaattttgacaaaagtacttacaacggcatttaaaacttgaagcatctcctcgaacagtgccacttcctgcttgtgccgtccggacgtgtcgacgacaatcatttcgaagccgtcatttttgaatttgtccaccccattcgctgcgatgatcaccgggtccacctcagtgtaactagaataatgcccggaaattcatgaaaaaatattattatttttttagtagtggtgccattatctgattgcaaatagacaaatgaataatgaacaaaggcacagagtcgcaaattgtaaggaaaaggtttttgtgacctctttttatttttcattaattttttgttaaaaatttggagcgtggtaaaaaatttttcaaaccgtttaagcgtttgtataaaaaaatggtcaagaggaattcgttatgtagaacataaaaggtaactcgcccagtcaaaaatattcccaaaattacaaaattcgcccgaggggttaaatccaaaatataaaatgaaatctgtcaatggttttgggcccccaaacctttgtgcaggtggtcgtttttccggcaccctgcagaccgacaaacatcaccacatttggccgccctttgaccggttggaacggtgtgacgccaggatcaactgaaacatggacggatgaacgaaaagatattgtaaa

SEQ ID NO: 8793 - DNA, 839 bp, Heterodera glycines
ttttgaaaagcatacgctgaaagtgcgcctccgcccttggcatgaccgtccagcttggtgatgatcactgagccgacatccactgaatctttgaacgcgcgggcttgcgcctcgcaggcctaatttaaaaaaaaaaattttttttttgccaataaatatacacctgtccaatggaggcgtccatgacgaagacaacgttgtctggtttctgaaattatttaatagttataaaaattattatttttaaatcataaagggacaaaaaccgaccaagaaaaaaggtgtcactttttttttaaacccaatacccaggaaatttcgcgtaaaaacggcaggaaaccagagacggttccaggaaaagcagatcatggaagggctacgaacaagaaaaaccgaaaatttcagcctaaaatactatttttccctcaaaaatttcgagtggagagggggggggggttacaaattggtaaaaaagtgaacttttaatgacaaagtcttaaaaaactaaaattactccaaaaagggtggtggagagcgatgaaagtcaagtttttaggaacgaactccaatttaggcccgattttttacgagccaaccccatggcatgggttatttttgaaaagtacgtacaacggcatttgaaacttggagcatctcctcgaacagtgccacttcctgcttgtgtcgtccggacgtgtcgacaacaatcatttcgaagccgtcatttttgaatttgtccaccccattcgctgcgatgatcaccgggtccacctcagtgtaactgaaaaaatcccaaataattcataaaaaaaatttttttttttagtagtggtaccatt

SEQ ID NO: 8794 - DNA, 3154 bp, Heterodera glycines
  misc_feature (3054)..(3054): n is a, c, g, or t
  misc_feature (3093)..(3093): n is a, c, g, or t
  misc_feature (3132)..(3132): n is a, c, g, or t
tcccctctctctctctctaaatatctctctctctctaaatctctctctctctctaaatctctatctctctctaaatctctatctaaatctctcctctctctctaaatctctctctctctctctctaaatctctctcactctctaaatctctctctctctctctctctcccctctctctctctaaatctctctctctctctctcccctctctctctctaaatctctctctctctctaaatctctatctctctctaaatctctatctaaatctctgctctctctctaaatctctctctctctctctaaatctctctctctctctctagatctctctctctctctctctcccctctctctctctaaatctctctctctctctctcgcccctctctctctctaaatcgctctctctctctcgcgatgtgtccgcccatccaaatgtgcacattggtgtgagttatctccaacactgccgaggcgttgctctccgtgaacagttggcgagtgcggtcctcattctaaacagttcattttcgactcctagaagaacaagtcggtggatgggaaagtcactccgtcgggtgtgaaggcgaatatgtgggcgaagttttggtgtgtgtagtgtggtatcgactctgaaatcatttaattctttttggtgagttaaaatgatattaattaaactgactggtgaacggtcagcaacgagccttggtctccatttctgggcgcaagacgtcgttgcacgggtttatcatccggcttaatcagatcgatgatttaactgactttgagtgattgtgcatttattggatggtcatttttgtttgaaaaatgtttcagcagcaggaattatacaacaatttagttaattttctaaaagctattttgtttgtacttttcagggtattttttaattgctataattaaaagtgaaacgatttgggcaagaaattccaaggaaacgttttgaggctgagaccccgaggagaaaatgttaagtaccgtaccactctcaaaaagtggaagaaagggcgggttttaatttaaaaaatgttataaaaccaaattatctgatcctattagtgttttttgtaaataccaataaataattacagtaatccaattagtcaaaaagccgtcaatgacataaccactgtcatttttggatcccatgaatttgtcggtccaaatgatggaatcggcctgtcaaatattttcttggtaaacaaaaagtaagccgggaaagcacagggttaggaagtccttggtccaacgacgagtcccaatagggaagggccaccgaagggtcaatggaacgaaggccgaattccaaactgaaggtgaatttggaaaataaatgctgttccccatttataccgtttcaaatactcgcggtgccacaaaggaaaggtcggaccgccgtgggcggacggcattttgtcaatgccgctgtggagaaaggcgaggcgatcgtactcggagcagccgttgtacagatgcttcagtttcaagagagcggaatgctttaagggtggtaagaggttttgaaatttcacaattaaatttaattgcttacgaatcggtcccgttgctcatcactgagcattcggtattccatgcgcaatgccttcccataacttttcccattgattgagcactgagcaggcgaagaggaaattcctgaaattggaattgaattagaatttaaccattaattagcttagttaaacaattgtatttgtttattattaccatcaacatatgagcagaagcaggtgaggttaagacaagcgagcttttcggcctgtaatttggcgggggtttctcatccaaaagttcggcagctcgtgaagagggcacagaagtgggcaaacctttaaaaaaacaaattttaacctaaatttggcaaataattcaaaaaggaaccaattttgatggatggtgggagcagatcatcttccttcgcaacccttccctccctttcggcctaaaaagcgtcattattgtaaataattggattagttaattaactaattaattggaattgcacaataattttattataaattcattctgttcttcaatatgtttttccaatatgaaaatgtagtaaaatgccctttcgacgcacattgcgcgtctcaaacaaattgtgcaccattattctgcacgctctctgcttgttggccccaaatctggcacaaatggagtagttcggcttttcctttccgtttggcactgaatgtggcaccgatttggtggcattttcagctgattggccgctaacggtgaaaatacagaggaaaatgatcagagttagagaagacaaaacaatacgcatttttatgacaaatgctatctgataatattcatgtgtcattaatgcatttttattatttgaaatgaatttttattcatagaattgtgattttttaaaatattcattagaatgggaatgaccacggcgagtggcgctgactaatgaatgttgggcgccgcgggtcatgatcattcattagcagacaagggtcatttatttaatattcatggtcatgttaatgcctaatatttgtctggacgaatgctaacacagttaatataacataataagagattttcttaatacaatcataaatttaatttttttgtcacaaaaatgggcaaacctataaaatttatgctaatgttaatttggtaaaaaatgaattaaaatcgagaaatgactctcatttaaaaaaatttttaaattttttgaaatggcgcaaatgaatcaaatttctggccttttaaaaggatttttgctttgtctgaagtgtccgcatcatattttcgctgatcatatggtgcaaatgggcgaccactttcattgtcataagaagcaaaagcaacacgactaaccaaagaaaaatggaatggccaaatcggcgtcagcagatcacacacttttggcgacgatgctttttgtcgactgctcaatgactaataaatttaatttgagtttttgcttcactaaatttcaaaagtaggcaaattttgaaaatgattttttanaatttatttatttcttcgctcgcaagaaagcttaattanagagtggccgatcgtttcgtcactgtttagttcgtcacntgagaaataattttttaaaaat

SEQ ID NO: 8795 - DNA, 2565 bp, Heterodera glycines
tcatatattaaaatgattttttccttcttggcaaaaaattttatgggtttacgaaatttttttcaaaaattcaaagcaattttcagaatttttatccatattttcgtattttttgtcgatgtttcagggtttttgtccatatttcttccatattttggattttttagtccatataaatccgggccctaatcattatcaataaattattttccggcttgttccactaaatatacgttacctttaaaaaataagtcatgtaaaattcagggcagacctattttagattaattcaattattaaagaagcgattcaaattctaaaagttcttaaattcccactaaattccttaggcgaacagaactaaatacatgttcaacttgagaatgcaatagtttatcgggctgaaaaagaaatgaaattcaaataggaaagttacccaaatacttgttacaattacgtcatcccgaatagcaagtggaataataagtctaaaaaagataatccatcctcatttctcatcctctagcattcttttcctcccgtttcccttccatgcttttttttgtcttttcttcatcatttcttcgctcctctttctcttcattcatcaacctcagatacttcccctcgaatgaccatcactatgttccttgtaagtttccttccgcttctcatcactactctccgcctgattgttatcactgtagtgtccatcgctatcattgtcgtgcgaatcttcactaccactatcaccgctctcttcattttgcatattctcttccacgtcgtcttcttcatcagcttcacaagcatcacaactgctttcgccgttctcattatcatcactttgataattttctctaatcttttcagcatttttgttctcatttgacagcacaggtaccgtgcttctgacaattacactcggctctgaacaagcaatgctgctgctgctggcgctgcttggcacaccgtctctttgcatgctggcatttgtaatgctttttctcgatgaactgattttgcttctactgctgctgctgctatttcccaatcggtgttgactgcattaataagcagaagtgccaaccgagtcgtcatttctctctttcttctcgctacttctctcacttttcgctgttaacttatttgatgccgcactttcattcggatcattgttccaactactcgttctgcttacaccagcacactctccgtcctcatcacaacactctccgtccccgccaccacactctccgtcctcatcacaacactctccgctttccatcttcttgccacttctctcacttctcgctgttgatttgtttgatgccgacctttcaatctgctgattgttcccactcctcgccaatgccatcgtggcgataggagcagccggtcggctttgatgagaagcctcaccagcggtgcgactgttcttgttgttgttccgattggtcggcgggtagtagtcaagtttaaactcaaattctggggtagataattgctgctttaataaaccaggcgtcgcttgttgggcatttccatgacgatccctttctgtgtaactacccctatgaaatgcttgtagtccatgtgtttgtggaacatttctgtgcggctcatcatcactgttgagcaatggctctcgctctgtgtgacgatctgtcgtcccataaatccgatttgcaacattagcaattactttggcaatttgattgggccgattatttgcttgttgagaattaagtgtaagaaagacaattgcaacaatcgcccatgggttaaggtcactgctgaaggctagtacagtgatacaaagaatagcaagagcgattaataaagcgtgaattgtcgaagagtcaattggcgttatggcacgtcgtcgacggcggaatttatcattgccaagagaaaccgctttcttttctgtcacttttttttgtctatctgacgaagccgtgtgcttttggttttttggaattgcttgatttttagctgccttcgttggagcctttgttttttgtgccatcggtgtgttaagtttcgtccgtagcttaggtgaagattgcttttcctgagttgattttaggaaaaatgcaagtttttcgctcatttttgaatatcgaaaggaattagtggttctgggatgccgataaggccggaggaaaaattttgaaacaaattttcctcccatttttttatttgcttaaatttcgtcaaaaagtttcttcattattgttgttgagcccatttttagtatgtttcatgcccgtccacggtaggaatgaggtgcggggatccccgtttcctgggataggaaaaacggggaacggggatgaaaatccttcccccccccccgtccccacacatcctcactcattagaattacctctggattagtttgagtagctttgtcttggtctgatttgcgaactctttgcaaaaaatgtgtccaaagccccatcattaagcccactaattgacttggcattacagtactaccgttgtttgccaccgtactcttgccggttacttttcccaattgcttctttttccgtactt

SEQ ID NO: 8796 - DNA, 4364 bp, Heterodera glycines
  misc_feature (4306)..(4306): n is a, c, g, or t
  misc_feature (4324)..(4324): n is a, c, g, or t
  misc_feature (4356)..(4356): n is a, c, g, or t
caaatcaaaatcggatttcaatcgccctcctttaaaccatcaaaaccaaaattttgaatttgctggtccacggaacactaatttcagacaaaccggagacttacaaaatcaaatgattagaaaccagcccaccccggcaacaaatgcgaatactgttccattgaatgctccaaatcgaactcaaaatcaaaattttcgtccctacggttctaatgcaattgttgtaaccgaaaaaaatgaggatgattcgccagtaatttctgtcgcccattttgaacaaaaagagactagggactatgaaaaattttttaatgctctttcaactcattccacggagttcccaacgaacaatcccgcacttgtcaaaacatcaaaatgtttagacatcacattaagcgttgtggaaaaagaggctaaaggcttaatggattcgggagctgaggccaacattgcaaaccctgaattcttataccaaatttcagtggaaaagggaattaatctcacagattggggattttgtccaaattctggtcccaccaaattgccattttcagttgcttcattcaatggcggaaatatttcagtaatcggtgtaattaatgtgccaattcgtaaaggaaatatcgaaagtgttatttcatgcctaatttcactaaaaccttttagttacgattttgttttggggccaaacgcattagacgcattgggttattatatcgggaacacaattacaaatgaaatcctgaattttacatcgaaatttcccactaaaaatgcacttctaaatactgtttacgtttcttcttttaaatctattcctccgttttcatcctgttttgtcgaatcattcgtcaaaacccaaaataactgtcaaaaaaggtcccaatttcttatagaaaacagtatgagcgaacaagaccttcttgactatgaatcggaaacggagcgtgatgaaaatgtgatggaattatgcggcgaggaggaagagaaaatgctcaaaaagttcgggattttggacgaaaagccaaaaattgtccgctcaaaatcagctccggaaacagacgatgtaaaagttcctattaataatttgatggtcgttgagcgggcaattgtcggatcgaaacgtggtaagttcaaaattctaattcacaacaaaagtaatgaacggatttttttggaaccgggtatgaaggtggcacaagctgaagtaattgagagagtttttgatcctttttccgaactaatgcccaaaagttttgatcaattgcttcttccacaaattttcataagaaacctttccaaaattgattcaaaaaacagaatcaatgatcttttttctattctcgatccgaaaacaggcccactttccgagtcggaaaaagaacaaatgcacgaagtctggtgtgaatttaacgaaattttggcgttagacgaatcagaattgacccaaaccggtcttataaagcaccatataaacacggaaaattcgaacccaatcaaaagtcctccaaggcctatcccatttggggtgagagcaaaagttactgaaatgatcaacgattatctgaatcgaggcgtaatacaaccatcttcttccccatgggcctccccaatagttttggttacaaaaaaggatggaactgttcgattttgtgtggattacagaaaattgaatgcggtaacagtaaaagattcatatccactcccaaacattgagcaaattcttatgtatttggggaaccgaaaatttttctctgttttagacttaatctcaggctattggcaagtcaaagttaatccggaggatgttcccaaaacagcatttactatgcccgagggactatacgaatttttagttcttccatttggtctttgtaatgccccggccaccttccaacgtttcatgaataatattttgggcgaatttgtgaatgattttgtctatcttgacgatattctaatcgcctcaaaaacgtttgatgaacatatcattcatctcaaaaaagtttttcaaaaactcaaagattttgaagtcaaagttaaggcgaaaaaatgtggtttcgcacaatccaatttaccgtacctggggcatattcttacaagacaaggccttgccaaggatcccgaaaaatataaaccgattttggattttccgcaacctaaaacaattaaacagcttcaaagatttttgggcatgactggttggcacagaaaattcataaaagactacgcaaaaattgcggcacctcttaccaaaatttttaagaaaaacccaaccaacaaatcttgggagtgggacgaaggggctgaaaaggcatttacaaatctgaaagaaagcattgttaaagaagttgttttaaaatatcctgattttgaacttgcccaaaaagacccaaaatacaaattccatattttctgtgacgcgtcaaaagaaggcctaggagcggttctttgtcaaagggataaatccgggaaattgaggccgatttgttatgcttcaagaaaatgtaataaggcagagtcaaattacggtcccacagttttggaatgtttaggaattaaattttccgttcaaaaatttaaacagtttattgcttggctcccaacaattgtcgttaccgatcataaagcacttccggggatgtttcggagcaaaaattcagttgggaatccgaaagttgaccgttggatcatggaattaggtgccccttttcaattggaagttgtttacagtccgggaaaagaaaattatgtcgctgacgcactttcaagagcattcccgaatgatgccctatttcaatttggtgataatgaggaaaatgagaacgtgacaatttcagtgatggtcattcaaaaaaataattccttgcccaaaaatagttcaaaagaagaatggttaaaagaagtcaaaaattcggaattaggctttatctttgaatttttggaccataaaatcttgccatccgatcaaaaacttcgccaaaaagttattggattcccttggaagatttactgttgatgacggaattctttttcgtttaaatgaacacatggaaactgaacttttcattccaacaaaattccgagaatccctcatcgcagaacatcactcaggaccatgtgcaggccaccagagcgggaaaaagatgtttaagcgactaaaagctttaaattttttttggcctaatatgtactccgactgccaacgtttttcaaggtcatgcagaatttgtgctcataatcgtgttccaaaaaaaaatcatccgggtttaaatccaattgttacaattagaccacttcaattagtctgtatggacattttaaaactcggtccaacacgtaatgggaataaatattgtctggtaatgattgaccatttctcgaggttcgccgaaattgtgccagtcccaaacaaaacagcggaaactgttgcccaggaatttgtggaaaagtggattttaaaatttgggaccccggaaacaattcattctgatttaggaggtgaatttgtcaatgccattttaaaggaaatttctgaaaaactccttgtttcccgttccacaacctcagggtacgaccctaacgctaatggtctcgcagaaaggctaaatcgaacagtcattgaaatgaccaggaaaacctgtacaagtccatgggaatgggatttacgtgtcccatacgtcacattttcatacaatattacaccaaatgaaagtacgggatttccaccatcaaccttatttttcggcagacaactccgttttccatcaaaaatagatgcccccaaaagaccgaatcccttgtatactgtagatttagacgaatatttacagttctttagagaaaattacgaaatgattttaaatgaggcatccaaaaacattaacagcgcacaaaaggtccaaaaaagtaaatttgattcgaaaccgaacgttaaattgggaaagtacaaagccggtgatcgggcacgtgttcatgcattttggtgcaggacatttttccgaacttgccaactcaagacccactccgccgtattcaattgtcttctttgggcgaattgatcccagtcgttttggccaaagaaaaagggattctgcttggccacatccgcaattgggcaaattcgaatgatgagccaacttctcttttcaaacatattccaaattttgcaccaaattcccaggattttgtctctcctatcttaatttgggttgatcactgtgccattgcttttcaatccctcaaaaaatcggggatgaaaaacaccaaatttcacgtggcaaagacaaacggtctctaccggttncgagagctgataaatgangcgatggaagaagtgaaagccaaaatatttgngcttttca

SEQ ID NO: 8797 - DNA, 1967 bp, Heterodera glycines
ttttctttttttgaaacattttatttatgtctaggcatttttccgttttttggttaaatacaattatttccagaaatagaagacccctggggcgtttttgttggttttttatttcaaaaagtttttttttgcaattatattatataatagttagactttggtattttgcgcaacttcggtttcacctcatctgcgccttcacgcgtgggtcccattacttttgcgccctgtgtcataggcgtcaaaatttttttaaaattaatttcgtgatttatttgttaacttcgaacaaaagaatttaaaagaaaattttaaaaaattatttcgaatatttttttggttgattaaattgtgagaatgattcaaaaattttaaaattttcaataaaaatgaatatgcattgtataaaatttgtaaatgatcaaatcagcagaaaatgagtgattttatgggcttatccaccggccaatttcctctttgttgtccctttttcttcctccacaaagatgtcaatggccagcgtcactttgtcctcatttttgtcgtaaaatccgttgctcgggtccatcaattcctaatttttattatttattaagccaataaatggtgttttggctacaaactcaccgaaaaaataataaaatttgggaatccccagtttttttcttctttcttaaaaacatggtcatattttcccgtcaaatccttcgttccgttcttttgtgaaacaattcgaagggttgccgaacatttgcaactccaatttccatctttggcaatcaaaattaggtaatgtaatcaaaaaatcttaattttgacttcaccttttcccgaagcggtgcacgaaaggaaaaatcccaggcatttctcatcagtgcttttttccttcgtctttatttctgccaatattttccatccaaatccatttattcgtatttcataatcactaaatcgtctgctccccacttcctctcgcgcaaattccgaaaatttctcaatttccaaagccaatgtccccctgttgcctttggctgtgttccaatcggaaattcgtccatgccatgggaatttcaatgttttaaggccgggcacaccacggagattggggtgagaatggaattgataaatggaaacaatttcatcgtttgtcaaaacgccagaaggaactgcaaaaaaataacaaaataatttctatcatttaaaaaaaatgttaccgatgtttttggtaaattcctccggtgagatgagaggaaaacgaattttgaatagtgccgggccaagcaaagcacgacgctttttggcggaacacacattacccttttgacggcacttttcgtcagcccaacgaagtgcctaaattaaaaatgaacaatataatttaaatacaacaaaatatatgttaaaattacagcttgccaaagttcatattcatcgttgatcagtaattgatcacgttcgaataattcacacagcaaattctgatcaatttgcaagaattcgtcagattcgaacaattcgaacgcattttgacaaatgtaacgaaaacagtgatgggcaaaatcctaaaaaataaaataattatttttagaaaatatgctttaaaatggacccttaaaattaaaaattaaattttcccggcggcaatatcggcactgccggacccccattttaacttattttttgaaatttatgttgacccaaaaatggcaggaaatagccccttttttagcgaaaagcggatacaaatctctgtatttgctttcggcgctgatttgaaagaaaccctggaaaaaatatttcatacctgaacaaggggtcgccagggcgaggcccatacgacggacgatttgcgcgggggggggggtgcgccagggccaatttttcgtacgaaagcccccaattttcaccggcgacgaccttttttttttttgttattcagaagacttttttctgacgacctttttttt

SEQ ID NO: 8798 - DNA, 2938 bp, Heterodera glycines
  misc_feature (1809)..(1809): n is a, c, g, or t
aatttcgaccggcgtaaagcacagccattgcgttttctccgtccaattcgctcaaatcatccgcataaataaagctgagcatcactttgaacgctgctgcttcaacatcgggcactttcacgaggcttgactgatcagcggaagggcctaaaaattatgaaaaatctaaaaaaagaagttgaaaaatgctttttccacctccgctttttgcattttgggcgtcaaaacgaaacattgcttcaaatacatccgaactcaacgtcaaaatgtgcttgtgggctcgaaaaagctaaaattaaaatataaatgaaaaaatgaattttctttttgaatttttcttgcctttttttcctctcccaccaaaaattgaatgtccgccccattggccgtgctcagcaacactttcatccgatccgacaaattcgctgattccgatgacggcagagacatttatttggtaataattaggtaaaaaaacaaaatttcttcgctaaaattttgattaaaatttttttcatgatcttagagacacaaaaatagtacaccaaaacgagagaaaaagaaagacaaatttcatcagctcataactttttaggaaccccttaatttgcccaaaaaacatttcactgttcagattttttgttggtatatttgtggaagattgcagcgaaaagtaaatgagtaaatgttgtttttttctatttaaaaatgaagagatagtacgcctaactgagagaaaatagaaaagaaaaagagagcgaagaaatagtgtacttactatgttttcttgtggaattgacccctaatgagaattattattgtttgtgcgccagaaaatcgtcaataatatgtaggaaatatgttgttcatctatatagaggtatgcatcagggatgggccaaattgaaaaataaaaagcgaaatgcgaaatttgcgaaactgaaaaatgcgaaatgaaaaaaaaaagcgaaatgcgaaaagcgaaattttttctacaactttttaatagttaaaatcataaagcaaaaatttttttaaaattttataaaaatttaaaaatcaataaaacgcttttttgaggcgcgctttttccaaaaaaactttttgggaagagggggcaggcggcgccgggaaaatttttgaaaatttgattaaaattgttgacagattttcaccaacaaatcatcaaattttgtgatttttgtatcatttttctaatgagaaataagagttttggcgcgccgctgagaacagtttttcatcaaattaccaaattttgcgattttgggcaattttctacgggaaaaaaattggaaattttgatcatttataaacagtttttcactgaaaattagccaatttataggtaaaattttgaaaaatttcatgggaatttaatccaattcttaggggtgtaaaagtcgcatttcgcgccaaaaagcgaaatgcgaaacgccaaaaaatgcgaataatgcgaaaggcgaaacctcggcccatccctgctactcactgagcccataaaattttcatagctttgcgtcaccgccggcaaattggcacgcggtgtccaaatgggcgcgtcgccttctttgacctctttctgcaatttaaaaaattttaacttccgaaaatagagagtgccaaaagacgcgcactttggatgccactttgtaatagggcacaatatccacgccctctttgaccaacattttgcggcattggtccacgacaaagtcaccgccgaccggcgatttgacaacagctgaacaattgttgaaaattaattaataccttttaattttacgctanaataaaatctaaattagatatcttccggccaagacatgaccataaaataatttaactaattagtgaatcataactttttctataagcatccaaattaaaaattcttggtataatttgttaaacccccatgagtcctctattaatctacaaaggtgaaaaaaaaaccccccaagatcaaaaaccttttgaaattttgcaggctaatagaggagttcttggaactttcaaatgatacccaagatgtttaatttagatgttcctaaaaaagctataatgcattaaacttgccaaattattttatggtcgggtaaactgcaatagagccaatgttatcatatactaatcctctctatccattatatattaatgtgccataaaaatgctttgttaatttacaatttgtgatgcaatatccgtcgtacaccggcacagcggaggtgtgggaggagccgctgtcgatgaccaacccggctgtacgaccgcttgcaaatctgacacaaaatggggggaaaatgccattgaaaaatcacccaatttgtgccacaaaatgaaagaaactcacgcggccagcacggcatttttggccaaataataggccggcacgccgtacttctcgaacaccaactcggtcaaccgttgccgcttttcctttgggttccacttgaaaaaatgaataattaaaagataaaaaaccaaattaaaggaataactggtggctctgtgaacagtacgccatgctcacgactttctgtacaaatgcaaaatttaatcaaataaacaaaaaatgaggtagaaaattttgcctgctccaagacacggcccgtagatgtagtcgagcatcttctcaaaaagttcccagtcctccactaaacagaggtaaaataggcgaataaataaatgtaaatgtccattaaaattactcaagttaactgaagaattttttcaacgaaaaatcgtggtaaatttttgaaaattctattcaattttggcgcctatcggcaccaacggatccccctttttttgttgcaaatttgactccaaaatggtaaaaattagtcatcttgcagcgaaaaacggctaaaaactaatagtttttctccccggcgctggaattttcgaactataatac

SEQ ID NO: 8799 - DNA, 669 bp, Heterodera glycines
  misc_feature (504)..(504): n is a, c, g, or t
  misc_feature (554)..(554): n is a, c, g, or t
  misc_feature (559)..(559): n is a, c, g, or t
  misc_feature (565)..(565): n is a, c, g, or t
  misc_feature (571)..(573): n is a, c, g, or t
  misc_feature (630)..(630): n is a, c, g, or t
  misc_feature (636)..(637): n is a, c, g, or t
tgatcatgggtttgaacagataagtctacgatttaaagaaaaaaccgattttaaaatatttttaaaatccttcatttgttggtaccaaaatgaacaaataaatatatgtcaaattttttaaatggtataatgatggttagaatctagcatataataaatagtagaaataagtatacaaatgcaaaatttgaaaataaaatgaaaaataagataaataaataactaattatgaaatttcaatctattataaataaagcaaaatttaaatttgaaaaaaaaatcaaatctatctttaattttatttcattttattttataaattatgtacttgttcagaaaaatgtaaataaattattatataacatgaaatgtaaatgaaatacaaatagcatttacagtgcataatgacttttaatatgcataaaaattaaaggaagaactattgttttcgtttaatccaatgataaaaatataaaagtgaattcaattgaaaattcattttanaatattttaattaatttttaaaacaagttaattgcctttgcttacattanaatantataanatatannnatgaaatgaatatccgagacaggattagaagtagaagaaattattgctggacgagangtgtanngggtggatgagaaaatctttcatatatgcatt

SEQ ID NO: 8800 - DNA, 3169 bp, Heterodera glycines
ttttttagttataaattttcgttgtttacttttaacgcccgatcccgattgttcattaaatttttgttttaatattccactagtcctcgggtcgtttctcagtcgttgctctaaagcttttgtacctatgggtgatggagcattctcgggtgaccgtctcaatattcgctctaatgcttgattaacattactttttaaatatgccgtaccatcagctctcagtatatgtcctctagagccaaccccaaatttctcagggtcattatttataacttttttcttgactacaaaagacttttgcttttgacgaaatttagttgttcctacacgcattggtcttatcagtggtctcgtctttggtgttgatgttgttggctcagcatcactctcttcagcagtagtgtaagggtcttcaagtgttggaatagagcctgtttcatccaatccttcgtcattaacaatttgtgtaggaattattttgctatctctttcacgctgttttggtttaaacaccatcaaagatccatcagtgagttcaacctttacgggtttgtcttcaatttccttccttagtttcaagaaacgcctcaattcctgattataaattaaattttttgaagtagcgtctaattttctctgcttcaaaagtgatgacaatttatttttagcattttcaacgttaatctcgccagactcaggtttaataaatttttgtacaagtcggaaggaacaagaataaatatattctccatattttaacgcagcaataagtactggtaataataaaggagacaaattaacgaaaaaaccaccaccgttttgttgaaaaactttctttgcacccttctcagtctaacttttgctaattttcttacaaaatttgcgtatggtaaaagtctatatttttgtctcttcgtgagcgggaagtacccctttaatatataataactaatttcaattaataatccaatttgttcagtagacgcttctttaaatatttcttgcatctttttaaaagattttgtttttgccaatttctttaaaaaatccaagttttgaagaacatttttaggtaaattaatcattttgaatatacaatgcttttttttcatctctttaaatatttttgtccgtattctcagcaatggatttgatgccggttgtaaatccaaaaataaatatccatacggtgataaagtggcatctttataagcacttaggaaaaatgcaagattttttggaaacagttgaacgcctaaattacgaatttgtagcgcggcattcggagcagacattaagacaatgtactgtgaattaattcgggctaccttcacctttttttcaaataaattctgtgttatgaaaatcacacccatattaagatggtgagcttttttgatgaatgattcagacaggtttttctcatcaattattattaaaaggtcatctagaattaataagagcggcttctttagcacctgctttattttttaccagtcttggcggcacccattccacattgtctcagtttttcaaccaaattctccataccatgttttgcatgtgcttgaattgactctcggagcgctttgccctgagaaatgtcttcaagcactcgatttccggccttaagtccttcacgagaaactgtctttagcaaatttgacgcaaccggcatcaggaaacgggccaaattcttcagaagaccggcacctcgttgtttttcaatgttgattcaaaaaaatttacgccggaaatgtagcgtgatgatgcaagtaccccagttaaactttatgtgtcgtccaaatgcgttctgaatttcaatttgtatttcagaaactcgtttgttttgaagagaatggaaaatttcattagtatatataacctcgggcacgtccgtccctccaggtgttgtagatacattaacaaccctcagcaatggagccattttgtcgccaattatggattcatcaatcagcttaggagcgtacacatacaattgtttaacgccgccggaaaggtcggatgtattgtgcttgttcaccatcatagagacgagtactgttaaatcctagaacatatgccaggtgtttgctgacatcaatttgtaccacgcctgatcctgttttcaacacaaatcgttgagcaagcccattgaaaagtagttccgcgccagtttttccctttctctgctcttcaacaagccttttgaagctcgcttcagcttctccggtatattttgatgctctaagatcagcttaaaaatgtctcctcgttttggctgcagaataatattgatgctgttgctcatcctttttcttttcaattaactccttcagtgcttcacctcttgtaagttgccgatccgagtcggatgaaccatgaggcggcggcctcaacttgtcctcctttacaatattttcgatcagctctttgagaatctggcctcttgtgtgaccttctccactgttcggcgtcacatcatgaacaggctctttatctgctatcgataacattttctttaactgttctccatgtgtcagctcaactgtaattgttgagccagcgggactttcaacaccaccatcccttctcttttctatcatactcaccaatttttgacctcgcgatagtaaagctactactgtatcgctgtgatcatcatcccttttagtagatagctggtgctgcctttattttgttctatcttctcctttagaagcttggcatgggtttttagtctgttgccgctttgccaccgtcatttgcaattctgttggagttgccgtggttatctcctgttgttgttgttgctgtattttttctttgagaacctcagcgtgggtttttggtttttccatcgaattattattatcctgatccgacttttctgtctccttcacttgagcggcacctattcgctcctttaacgcctctccagcggtcaatgcagctgagattggtgaagagaacggggaggactgttgctgctgttcatcacgtttctttgcctcaaattccaatgcggcaaatctcttacgtctgtattccagcagttgttttgctcggtcgatttgctgctggaacgatgagtgctcgtcgtcctttagctgcttctgtgtccttttttgttggagttcttctatcttgtcgaactattcacggagac

SEQ ID NO: 8801 - DNA, 3726 bp, Heterodera glycines
tcttaagctattaaaaatcacttaaaatgacataaaagtatttccgaattaaaataggtcaaaaaattttaaaacttaagcaatttggccacgattttcgggtttcgacccaaaaaacgagttgaagtaataaaaacgagttggaacaataaaaacgagttgagtcaaaaacgagtcgatacaaaaacgagttgaagttttaccttttgcgaccccccccctcataaaaatgtcatggttccgaggaagaaaagcacttttatagggtagttttagtcgctgatcaagaatctgaagtcaacactgaaaaaatctatggttatatcaatgcttttcatattgatttttctatttttttgaaaaaagaaataacgagttttttcgtgtatcaatcgattccgttaatcgagagaattgaatggtacttgtttcagggttctccgatgtctatatcaaaagttatagcccagtttaaggcttttttcgaaaaatcattgacaaaatcacatgatgaaaatcatagatttttgcagttttgacgtcagattcatgatcagctcctaaaactacattagaaaagtactttcctttgtcaggaccatcacatttttatggggggggggtagcaaaacctacaagtacattattattattattatacaataggtaaaatagatctaatgaaacacgtagaaaaggcaactcgtacaatggcttaggctaggcttaactttaggcttaaactgatcccacattttataccaaaaagatcaatcactcttttttaattaattttttagaaatgctaaactaattttctatttttattcttaattagaggggcctcggtccctcggacagtccctgggggaggggggggggcgagctgctcgttctccatttttgcatgttactcaacttgcggttctgttatagccgaacattatgcatttaatttgtcaactgaaatgtttgttatgtacatatgacacactgacgaaaatgtgtcggtggaaataatgaaaggtcaagaaatgcaacaaaacggggcagagggggggggggagacgagatagaatgtcatcgccagggggggcaaagagcaaagagataatgcaatagagattgaagaaatggagaggaagagtgtagcagaaatgactcacaaatcaggggaagagagagagagcggaagggagagagagtagggtatagagagagaactgatcgctgcaatggttttcaagttttaaaaaaaaagtttagaaattttttctatcggtttaatccccgttctgttaaacatgggttgtgccgtcattgaccctggcgaggcaaacacctcggcccccaaaacgcaccggcgccgctccgcgtcccagccctcgggcgccaacaccgccgcactcgcttccaccacgcgcagcgacccttaaaacgagcattccgacaatgaaatgtctaattgcaccatccctggtacttttgtgttcagtctacatgcaaccgcccctgtgacttagaatcatctaatatggaagaaaagcggcatttttcgattgacttattcaattatgacttactttttctaaaatttaaagattatccgatgattcatatgattattacaaacgaagataccaacttctgtgatattcagcgacattttctgccaacctaccctttcttccgataaatgaccacgaccgccattatcaattaccacattccatctttgctgttgttgtcaaacttgaaggtgatgcagctttctttgcttaaatgtttcattttgttagtgtgaaagtattagggacccaacaattcgggttgtcggaccctaacaaaaacagatcacgaagattttggaaaaacgctaaggacggtaccgagacagaaagcaccgaatttagatcccaggataacgagaattagtcgcgtggccgtcacggtccatagtaatacacatattcaccttatcaaattaattccgttggtaatcgcctttttgtattgctctgtatttcacacttaaatttaattataagaacatacatatgaaaaactccaacatttttcactgaattttatcgaaatcggtaattttgtccatttccgtgctccccgaatatttgggctggcctgccgtttttgacgaattgtcccaaagcactcttcacatgcttaaaacatttcctcagaacgtagtttaattcacaactgtccacgcattaccttctttgcgttcgtcataaatttcttgtgcatccatttttgtgaacaaagtgtcgcctgcctttaatggatcaccaaaggggatttgcacatgctcctataaaaattaatatataagacaaatataatttaaatgaatttataaattggattttgtcttttaaattttttcgcggatttttttatccaaacaatttttgacttaaaggacttataaaaacataaaagcatatcacaggcaatttaggaatttttagcacaaattttggcattttgagaaaaacggtaagaaaaatggctcgggggttttcgcgccagcggagtttttggactgtaacttttttcactgtaacccaaatccaactaaatttattgccagaaatgtttagaaaaacagctttttgaagttttctggccataacttttctgaacctaaaccaaatttttcgcaattttgcaggttaatagagaacatatagggctatcgaatgataccaagaaacttggatttgagttttagtcgctgatcaagaatctgaagtcaaaactgaaaaaatctatggttatatcaatgcttttcatattgatttttctatttttttgaaaaaagaaataacgagttttttcgtgtatcaatagattccgttaatcgagagaattgaatggtacttgtttcagggttctccgatgtctctatcaaaagttatagcccagtttaatgcttttttcgaaaaatcattgacaaaatcacatgatgaaaatcatagatttttgcagttttgacgtcagattcatgatcagctcctaaaactacattagaaaagtactttcctttgtcaggaccatcacatttttatgggggggggggggggtagcaaaacctacaagtacattattattattattatacaataggtaaaatagatctaatgaaacacgtagaaaaggcaactcgtacaatggcttaggctaggcttaactttaggcttaaactgatcccacattttataccaaaaagatcaatcactcttttttaattaattttttagaaatgctaaactaattttctatttttattcttaattagaggggcctcggtccctcggacagtccctgggggaggggggggggcgagctgctcgttctccatttttgcatgttactcaacttgcggttctgttatagccgaacattatgcatttaatttgtcaactgaaatgtttgttatgtacatatgacacactgacgaaaatgtgtcggtggaaataatgaaaggtcaagaaatgcaacaaaacggggcagaggggggggggagacgagatagaatgtcatcgccagggggggcaaagagcaaagagataatgcaatagagattgaagaaatggagaggaagagtgtagcagaaatgactcacaacaggggaagagagagagagcggaagggagagagagtagggtatagagagagaactgatcgctgcaatggttttca

SEQ ID NO: 8802 - DNA, 1868 bp, Heterodera glycines
ccactgtgcagagaaaagcctagtactatctcgtcgtttctctttttctttataatttctctcactttggcgtactatctcttcattttaattatgtaaaaaacaacatttacttctctccatataactttttttctatgcatacaattttcaccaaattttgcatatcgatagagaaaaggaaaataaacaaaatttcagtgatttgattaaaaatttcggcctagaacattactaaaaatgggatgaaaaaaatttgcatttcctttcctctccttttggcgtactattttcatgtctctaacacattaaaaatcatgaaattcgtaaatgctaacaattttggttataaggatacaaaatcactttggacatttagaatcaatagagaaattaatagttttagcatttttgctgaaaacagcagtttaggacttgagttataacgtgataaaaatttgaaagtatcacaacttttttctgagatgtcaaattgcttagcattcgcttagaaaaagattccccttttcaaaatctttttttagataccaaatttgttcagtttagttgggaataaagcgagttatggcagatcaataaaaaatacaaaaaaggcatttttcagtgtaaattttgaaatagcgggcaaaaatttacgccaaatgcgctatttggcgttatgagcaattttgtctgacactggcgcgtacccatagtgtttctgcttttgaaagtcaggtttctgcggtcagacactaactgcaggaacctgttaaaaatgacaggttttgcgcaccttagtttccgtgtcgaaaggttcaatgacgaaaagtttagtgacgaaaagtttagtgacgaaaggttcggccaccattttcccttataaaagtgcaacagcaagacgaattaaaagcatttctttataaacaaatcattatctgataggggaggtaaaatattgggctatacaaaatttaaaatcctcattttgacgcactatttccatgtctctaacatataaaataataaaaatcaaaggttggcattaaatcgtcatattacactactaaaaggctcatcattttgcttttaatttacgcgtataaaatgaccttgcgcaatgatactccgatgcctccggacgaagaattgagagtgcctcatgagatttcgctgtcttcgccttggctaagggctgtggcggtttatatgggaatcgcctgcgagaaggaggccaaagtttgactttgccactttttttgtgtgggaatgaattgagtcaatggcattcgattagtttattgtttttcaaattaatttcctttttttctatttaatgatttgttcaggagtttatgcttttgcgttccgaacgcgacaacgacccgcgcaaagcgttgccggaggggcgcgcagtgactgcgtgcgctatcaattttttgcgtaaaatgcgccgcgagtgcggtgacgaaatccgcgactacgccaattgttttcacagagagtccggcaaaatgcatttgcatcagtgagtgggcagttttgttgttggttagcataaacaatgcccaattttttaaatgggtgggcaaaacagaaattgtcctgacattttgggatttacgttttttgttaggtgtcgccgtgcacaatttcctatggatatttgcgctgacgaaaagctgggcgttcgtcgtccgatggtcggttacttcagcaaattgcatgtgcacgaaagcgctgtcccaccgccggaccctttgggtgagcgaaacgatgggaatggaatgctattccgattggcggcgacgccatgtattaacgggggatcaatgtcgacataccgtcgtttggcggggggggggggg

SEQ ID NO: 8803 - DNA, 1353 bp, Heterodera glycines
gtttacgggggttttcagggtcgctgatcatgattctggcattcattttgaccaatttcgaatcccgcacccgaattcgaacaaaatcgaaattttcaaaattcacatttatcttcgtttctgtacagaatgaccatattttgatgctgaaataatttttgactaaatttaacttgttttggtcaatttatgaacaaaagtaagaatttcgactttttgttcgaattcggatgcgggattagtattacccaaatttaaattttcccccttcgttacgacccccctccacgacgaccccctccctcttttacagccgccccccttacgacgaacgaagggggggggggtgtccgaggcctcttacgacgagaggggggtgtgtcgagacaccccttgcacatgtatgaataatttgtaaaacaattttaaaatttgtgtttcagtaataaaagtttgaaatttccactacataaaatatgggtattttagcaaaataataaaatccatcgacttaaaatttttttttaaatcctttaaataaatcattaattttttttcaaaattttatgacaaaaaaaattatttccgcccatcaagtttagtcctgctgaaactccatggacagttgggggccctcttttgttaatagcattcaaaagttgattaaggaaccgtggaaaaccgcacaaactgatttatattttaaaattaataaggcccattttataggatttgccgacaatccgaaaacccacaaataaatattttaattaattttcaatcaaaattgtataaatccctctgatcaatggtttatttaccctttgcttcttctgatatttagcattgcttttgctttgttttcaatttttctcctcattttcctttcctttttaaattcgcaccacttaattaccaattattatgaataaaagcgtctatccctccttccccccccccttttcacaaacattgccttttgcccactgaaagaaaagtcacgcgaaaattaggccataacaattcgacgatggccaaattgggactttcagcggggaaagcgttcgccgagtgcactttttggatgggaacaaatcgatgcttttcttttggatttataggcactttaaaaaatttagaatttttcattttattacaattaactagagtagagcgggaccgggaccaaaacacggacaactgagtacaactgagtaccgaggtcccggttttgaccgggaccgggaccagtcccgggttttttcccggttttcccagccaaaaatttccgggttttcaacccgaaaaggtcccggttaagcccaaaattcccggtcccgctctactctaatt

SEQ ID NO: 8804 - DNA, 1778 bp, Heterodera glycines
  misc_feature (20)..(20): n is a, c, g, or t
aattgcgacatttaataatntggctattaattcctttgcgttcatttgtacactttgagcaatttatataattgtgacagccgtttcggttgaaaaacccttacaaattaatggttcgatgattatttctgttctttattaatttccccgctaatgggtaataattaccgcccccccctttgccccccccccaatgctcaaagtacgggagcacaataatccgcgttttgtgttctgcttgggtcgccattattgagccgagccccgggggagggaaatgataaaaacggtgggcaaaaatatggcacgggagaaaaagaataagccatggcaaaaaaggaaagttaaagggcaaaaacaagtcgaaacgacgaaagtgtcctttaaaagacggccttaagtgatttctgccgcacattttcacagattttacccatcgcattgactttcccattgatcacaaattgtctgatcagtcgctgaccgatcgatcaattggcccttctcttccccatggccacttctcacgccgggcaccatccccaccaccacaaaggctgtgctgccaatcaccaccaccacaacaaccaccagctcaaccagcagcaacaagcgcaacaggtggccaaatgccacaaatttcggcgcaaaaaaacattttggcattccgacaaatgcttgactgttagccaaaatgagcctctctctgttgatggggccaacaaaaagaaagagtggtctgactctccccccctccccctccccctgcagcgtgtcaatgccgcacccccttccgccgctcattctgtgcctttgtccattctgtgcccggccatggccccccaatccgtcgtctctcccccgctgccctctcgtccgtctcccccatggttgggcccgtcaccggcggaagaagtgaccgaggagctgaacatcgtaacaacgcccaaagtgatctcgaataattcgggcagttatacgggcggtcggccgaacttcggcacaccgccgatgccattgcatcacatttctctgccgtcgccccaggagatggcaccggtgacccgacagattccgccggagatggaacgcgagacgaatcggtggggcgggggaaatcgtacgaaacgaattcaaaaccaacgaaaaaatggaaactttggaaaaggaacggcagaaaatctaacgctttctaaaatgcacttttatgttcagatggcgtcagtacgctgctgctgtgctggtccatggccgcaagggaatgccaccgaaaagtttggacgaatacgaaaatgaggaggacgacgaggagttcagaggacgacggatgaccgtcacttaccgggtgagagagtcgcgcacaaagttaagaggaagcaaaaaaaagggcggagtgccttttaccataattaattactaatggcattttcttgttttggattgttattttttcaacaatctccttaacgaattcgaagtgaaaatggcattttaatgcgtatttgttaggccgattcctccgaaaaacgaacgatccctttttatttcctttctttctcttcaaaatggcataatttcttactaattcttctctcccctcttttattttctcctttccctcctttttctctcttttcctttcattcctcccactctttggactttttgttgctaaatgcgggaacatcatcactttttttgatgcttttttctccgctttttctttcctccaccgccggtgtcaaagaaaatgatgggaaaagggaagaaacaaactg

SEQ ID NO: 8805 - DNA, 208 bp, Heterodera glycines
ttttttagtagaattatcaatttttattatcaagatgtgaggggaggggaggggaggggaggggaggtatgtgatttacggatgttacggatggcctattacaaaaacaaacattgatttgattttgattagtcatcacagttttgtttaaatttgccctctctttgctccttttttgtctattttctcatttccgttgcatcattag

SEQ ID NO: 8806 - DNA, 2817 bp, Heterodera glycines
taagggtaagggttacgggcttgacaccaatacgggttacgggcttacgggctaaaaacccgtaaagcccgtagcccgtaaaaacccgtatccaggaaaaatacgggcccgtatacgggtaagggttttttaaatttttgaaaaaaatcggtttaataaatacaaggcttgaatgttaaagctagaacattttttataacaaatttattaacaattataagcaacaaaattcaagataacaaaaaattggcaacaaatggaagtgagggtaaatattttagtatttgtaattaatttccggaagtgccttgtttaaaaaaattaacatttcggctgtttctggtttcaactgagaccgtctgtaatcgtaaacatcccgggcaactttaaaagttgcttcgcttggcaagcttgtcgcaggagcagaaaggtattttcgcgcaatttttgacaaaagtggaaatttcggtgccatttttcgccatgcttcaaccggatcatcacgtgagtctccacaaccggatgccagatatttgtcaaattcatcttcgatgtcattggctaccacttaatttatttttatatgcaaaaacattgataaattaatgccttcattctctttattgcttgatgacgcaatttcattgagttcgtcaaacagagaagccctttgtttttttataggcggcggtggacagtcaagctcatcaatttccgtaattggcgggctaatgaacacggcattttcttcttttatccatgtcaaaatttttgccagaaagatgtttctacgttccagcaaaaatttgtccttgaaccgaacgtcaaaaaatgttgataggcaatgaacactaaaacacagaaaattggaatgaactaaataaatatgtgtttatgaaccgtttttcgcgtaggccaaagaaatatttttcgatctcattgaccaacgagcatcgaacactgtcgatttctttgttcatcaatttggcattaaataacttgctgtggagtgtcacagcaattggaatttgggctaaaaatattcgatttaacttagaattaaaaaattttgttaacccgacaaaggtgatttcatgagcatttttgaagcttcttaaattggctgaagcaaagaaattaattcttcaataagtttccattcttcttcggctaatgtcaaatcaaaactccgattctcgaacgcatattgataaatagcatctttttgctctaacaaacgtgaaatcattgccaacgccgaattccaacgcacagggatttcctaaatacaaatattagacgcaaaaagtttttagtaaaaacttgtaaaagtgaatgctccggtaactcaagaattgactgaatgttctgcagcatgcccaacgctttgtttgaatgtttaaaatgtgagacaacttttcgacactgtttgagcaaattggcaattttctcaagcctgatactcttttgaacgacgagattgagtaaatgtgcaccacagctcacatttgcaaatggtaaaagtgggttcattaggcctcgttcctcagcccttgtctcagaaaatgcctaaaataaaatagcaaataattgaaaacaaaacaatatcaaccgctttcatgttcgccgcagaatcgctcacaaaacaatgtattttctcatcaccaatttgccattcaccgatgattttgtccagcaattttgcgatttcttgtccagtatgtgagcccggaaattcgcacacagccaaaacgcggtttttctgaacccaatttgaagcgattccatgcgcatttaagcttgaaaacacaatttatacacacatattcaccgccttttttaccatagaaaattgttggttggtccgctccacgcatcagttgtgaatgaaagccattcacattcttctaattcgtttttgattttcttccgcacttgcttatacacatcaggaagaatttgctttctgtaatagctctctccctaaacataaaaatttacaaagctttaaaccatcaaaaactttaatttgttgaggcgcgagcaatgaatggaaagtgggatggtcaatcgctttgaacgaagtgttcgtggcagttacaaaattaatcacctttttgtccatgtaaatcacattctgttacagtttcaagtagagaaataaattgtttggcgaattgactacacaaaatttaaaaatttactcaatttaaccttaaaaacgtaaaaaattaacccgtaaaacccgtgtcgtaattgtacgggtaagggtaagggttacgggtttgacatcgatacgggttacgggcttacgggctaaaaacccgtaaaacccttaacccgtaaaaacccgtatcgaccgaaaaaaatacgggttacgggttacgggcccgtaaaaacccgtatacgggcccggcccgtagccgatctctactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatca

SEQ ID NO: 8807 - DNA, 2066 bp, Heterodera glycines
ttacgggttacgggcccgtaaaaacccgtatacgggcccggcccgtagccgatctctactctacatattgttgtgttttatatttattattttaattttttggatcgtaacaatttctaatgaaaccgcctgtcgaaaaaaagaaaaaactcgctgaaaatcagcaacagtcgtcgggttcacttgtgacaccacctggaggacggcgaagtgttcagaggaaaatgtgagccaaattaggcattttttcatggcattaagcagataactatttttagcacggtgtgcaacgaattttggatgcacattctgcccttctttgatcgtgttcaactcggcctaacattggcaatggtttcgcctcgttttgatgagctggttgacacacatttcaatgacaaaacagaattggcactttcgaaccaaatgataattcgaaaaaacactgatgatggtgctgaaaagcccatctttgtgtgtggtgaagacgaagctgcgcaatttccgttgccggaccgcccgctgcctcaaaaaatccgttttgggaggcttatgattgagtaatttggactttctcgaaaccataattaattctggaaacatcccattttcaggtacatcgatcattacgtcgtcggatttctccgttccaatcaacaaattttcaacaaaggcacccatttggatttgtatgttcgttcgtcaaatgccacggatgagccgatttgggatgcgtttgtccacgaaatttggccaagttttgcgaaaaacatccgccatttgcaattttttgacgccagtcttgtggacaaattgcgttttcacatttcgccgaccattctctccgacgtcaatcccaactcaatccattcttctgagctggtgcctgatgtgattggtgttgatggaccaaatgcgactggtggccaagcactgtgcaaatggttgcacagcccgacaaacaacggacagccgaagcgattgttttgctgcttctctggccatgatgcagcaaatgaatggctcaacaatttcaagcaggtcgccatttttatccgtatttcgtcgtatcacccaaaaattttgttgcaaaaaatgaaacaaaatttgctgattttcagaaaatgtttttgaaattattgcttttttgaggcatatttcccctagacaaatgcatttatattttttgttattttcaattagacatttctccatgccaccaattcttctgccggttacattattgattttacattggattcaccgacgccgcacatggagccatttgaattgacgaacgaaacgacccaagaaatgttgacattgaagaaagaacgcaattcaaatgtgaattgtttgaagcgacaatcaattgggaagtcgggcggcgacatggatttgaacgctttgaacattgtcagctttgaattgcgcggtccgaagtgcattgggtgagcagcagcttttgctttgatcaaataattataggcaattttgctgttgatggcccccgaaaaaattcttagtgaattccctttttaggtctttttcacggttttagggaggataatcacgaatctgatatctttttagtgtaattcaaatccctacaaaagggtcctccctttccgggagggtggtcaatttcgtataatttccggcgaacactaacatgggaacattccgaactgtatccacccaaatcactttaaaaccacttttatcgtgtagagcatagtcgatttactattgcaaattttcggcttttttggctacggagccaaaaatgatcagaaaaaattgatcaaatgaaaaccccagccaaaaattgttaatttcattcattttttactcttacattttaatgaccatttgtcgtgggttcggatccgctcgacagatgatgaattattttgattttttttaaactattcttctacctaacgtatttttattccagatattttaatttttttgtgatgctctttgatagataattgttttctgatcatttaataaaaaaagtttatggctcttattatttgtttaaattttttatgaatttt

SEQ ID NO: 8808 - DNA, 2896 bp, Heterodera glycines
gattcggtttgcactttaaattttgtatgtgtaacaataaagatcctttaaaaataccaaaagatttgcttgttgactccatttctgacaaggaatcaagtaatgtacggcgttgtttgggaggaggaggaactataaaaagcgacgcattttcaatgtcttcagttgtaacaagcgcagagtcattgccattttgttgttcgtccgagagccagaatttcacccttaattaatcacattttagataacttaaaaccctaagatatgcactttaatttgaaatggtcattgtcatttgcaaataaatgtttgtaacgagggtccaagaatgttgaaagagcatgtaatctaaaaaagaaatttaaaagaaatttaaaaatatgtacacacttctcattctccaaatgaccgaatctttcctcaagtccagccaaaagctttgaacgcatttcttcaatttcagtaattccctgtaaatatccattttcacatatcacccgaaggtccaaattctttaattgtgaaattaacgcttttgcaaaaggaatttgagttgaaagcggtgatttgcaaaaataaagtgatgcttcttccaaaggtgccaagagcatctccaatgcattaagcagtcgccactcgccatcttgcaaagtcaattcaaatttcctctgttcaaatgcgattcggtcaatagcagccctttgctcagaaagccgccttatcatgatcagagaagaattccatcgaactgccatttcctaaatttacagtaaactggtgcttttcctccgaaatttcagcttacctgaagcagcttgtgctgcggaagtccctcctcaatttgtgcttcgttcaattctgtaaatgctttaatcgagtgtttaacccatccaacaatccgacgacaatttgcttaattattaagaaaaattttaaagaaatttagatttcatacaaaaaagtcccgatatttcaccctctcaattgccaaaactgtttttgacagcacggtccaataaatgcgccgcacagtttgatcgataaaaaggcaaaattcgcccgttttcgttctcttccacaaatgcctgcaaaaaacaaacgaatatttacactcattagctcataaccaacttttttcatgtttgttcctccatccgttgcaaaggcgtgaattttgtctcgacattcccactgatcaataatttcggacaaaatttcagcaacgcgacgtccagtgtgagtgccgggaaagggtttaattgcgagaatgtgtctcacacgctcccattggttcgtaactccttcgattattagacttaacatttgatcagaaatggtaaaatttcaaaaatggtatgatttcgctaccttataaatccttcatttggtccactccaaatgtcagatgtacaagaaaatgcttcacattttcgtaactcctctttgatctttcccttgactagttcacttgcaacgggcaaaattttgcggtagtgtgattcatctttcagttgctcattccatggcttacataatgctcgaaattgtggactgttgatcaaattaaacgacaaattgttgcaacatattaggttgatgaccactttgtctagccgagacataaggcccaaagaaaaaataaatatccctatagattaattttattcgtttaccactactacgcagaataaaattgtcaatcttttcggctttcacttcagtccttttgtctgttttcgttagagtcttcatcttttcatcaaatttggttttgtactccgaatctttatgcttttcacttttcagatgacaaattaatgatgatatgctcccatcggaaagcttgaattggtattttggctgttttttggctttgcattcaacgcattctgccagtttgtcgttttccttgctcttctcaaacaacccaattttccaaattgggtgaaatggcgccattaattatgaattattaaaatcttaactaaattggaagaaagaatatcaaaaatattattcctcatgagaaagttgacaagtaaatattaatctgactatttaattttggcaaaatgttttgccaaaaattcaaaaaattccaattcttaccagtgcatttttactcccgttttttttggtaaaatttccgggagcgggagcgggatcgggagttcaaaattttccgggacgggagtcccgaacgggaatcccgtaaaaatcccgatcccgtaaaaaatcccgttcaccgaaaaaagcgggagtcgggagcgggaatcccgtaaaatcccgcgggagtcccgatcccgccgggctctagtttatgtatatgattgacaaacaaaagaaatttataaaaagtaattaatttgtgggtgaaaacagctaaccagactaaaccgaccctctgactaaaacggccagactaaaccagggctcggatcgaaaaattttcaaaatcagaacatcgggtccaaaaaatcagattttggggtcgaaaatcagaacattttgcaaaattgcttcaaaaacatagttttgcgtagagttgagcgggaccgggaaatttccaaaaaacccggggaccgggacttaccgggaccagaaaagtcgggaccgggaccaagtttttcgaccgggaccgggaccaaccgggacttttcccaagtgaaaattttttttgaaaaaattgaaaatttaagtgcactttgttacgaaaattgccaatattcaaaaatgtaccaataaaattttgtatttacggtttgggggacgagttcgggaaaatttttaaaaatttgtttttcaggggggttcttggattttctgagtcccaaattctgtattttttttaaataatttacaatctttttaattttttgcttttaaatcgctgttt

SEQ ID NO: 8809 - DNA, 1482 bp, Heterodera glycines
aaaaaaaatagatcatacctctattttgtcatttgcacaatcatctccactaaaacgcaatcataaatcttgaaaaatgtgtgtccagagtttgataaaaacgccttttaaaatttaaatgggtttgatataattctctggcgcggctttttaaagttttaattgttttgttatattaacaccctaattcagttcatttctataagtaaaacactgaacagagaggagtttgacccacctttaaaaccatgggatatagttagggtattacgacaacaattattcctagctaaaagacaattctaaacccttttcaagaaaatttcatttatctttatatacgacagaccaaacatccgtttgataattgcaaaacaccctgctgcatattggctgtggacttagatgtaaattgtgaaaataggctaaaaccgaaaagtcggagctaaaatcttttgctaaaatggtgaaaaaaggtgaaagatcgaaactacaaggtgaaaaatataggtgaaaagtcatatagtgccatgttttcgagcgggatatgtgatgaatgtctaggtgaaaacaggttaaaataggtgaaatggtaaaagaacaaaggtgaaaaagaaaactgaaaataggacctaaaaatccctaaatttataagtaaaaatttactaaaatttttattgtctatataatttattgtattttttatattaatttaaccaaaaaatggaaaatttttgactttcaaaaaaaaggtaatttgacaaaatttcgtttgcttgagtggttcaacgagatagtcgaatatgtattatgagttaacgtcgtaaattatgttaaatacgtattatgagttaacatcgtaaattatgaagttttggacactaatagtgtttatacgcgcttggttaaacctgttgttcattaaaaaaagcaacatataattcatgcctcaggcgaatataaaatctactgttccctctcgatctgaagtaagacagaatctggctgatgattatgtcttcgcgtgctaataaattcgccattgctctcataaccccaacccttacatccataatggttaagctcaaacttccaccatattttattcttggtctttttgtgtttatagtaacgatatccatcgcaaaacataccttttgcgcagctgacagcgaccaattttgtcattatttttattatgctcttaaatgcactcaacctatatatattttcaccttttccaccatttctcgaacatttcagctttgttcttttaccatttcacctattttaacctgttttcacctggacattcatcacatatcccgctcgaaaacatggcactatatgacttttcacctatatttttcaccttgtagtttcgatctttcaccttttttcaccattttagcaaaagattttagccccgacttttcggttttagcctattttcacaatttacatctaagtccacagccaata

SEQ ID NO: 8810 - DNA, 2055 bp, Heterodera glycines
ttaatcaaaaagtcttcattttgacattaagcatttaatgccaatattttaaataatttctaataattgattggacacataaatttttgattggacgcgtaaacttttgattggacgcgtaaactgtgattggacgcgtaaacttttgattggacgcgcaaactgtgattggacgcgtaaaagtcgattggacgcgtaaactgcagtagagcctaattttttgtctgttgcctttaattttttgctttgcattgccaatttccatatcgacgaccaacaataattcggatttttgtttctccgccacaccgttgacatgtccgacgcgcgtgtagaggctccatgttttcaaacccataattttttaaaccaaaagccaacctcgggaatagcggaattctaacacaagaaaccgctgacattttgtttatttaatttaaaagaacgtgtatcggactacaaaatactttacagatacatcaaatgaattgatgagggaaatagagtaacacatagggtcatattcatccgtaaaacttaacagcatcaatccacctcaacgatctcttctgtcactactgactcggaaaacggtgccatcgcataattcttgaaactgtgaaacgcttggatgacgtcttcagatgacaatttgatttggttgtcgagttgagcccccacagcaagcagtgaagctggccttaaagcaaaggaaaaatgggtatttagttattaagctatagaatcggtttgaactcacgcattgagccgactcagtgcgacatggtggtaacgcaaaaggaatgcgaaacggatgacttccttcagctcggagctggtcagctttttcgtcacctcaacaacctcggcgtagtcgaagccaacatccacattttcttgtgccaaaagcatacgaaggagtttctcgcgagattcctcgtcgggcaaagggacatgaactttgagtgaaaagcgacagaacaccgtttcatctacaaaacaatgaaattgtacaaaagagcgaaggatgtggtgaaggcattctcacccaaatcgagcacacgattggtggcaccgatgacgatcacgttgcagtcggaatagcagcgcacaaactcatcccattgcgcgaggaattgcgtcttcagcagctgaaagtcattccgactgcgatggaacagcaaatctgtgagacaagaacaaaagcgaattgcaaaaacatgaaaaacacaccaatttcatcgatgaaaatgacacacggctgaattttctctgcctggaaaaggaaggattggcagaaagttcaaaaaaagactgaccaaagtgaacagagacttcatagtaacggatgatccgttgacaaaatctgaaaaataaaattattgcaattaaattgttgtttttaatccacaaccgaccgacgagcgaagttccaaaattgatgaagcacgcatccacctctttggcaatggcacgcgcaatcagagtttttccacaaccatttggtccataaagaagaattccttaaaagcattcattatgcactcatttttactggtccaatttcataagacaaaggcgacctttcggcgcactgtacagcaacgacggaagagtggtcttgttggccgccagttgaagagggacaacaactttctgcctcagaagttccaaaatggaagaacagccgcccactttctcgaacgaagcgacatcctcggaaaatgctaaacgaagattttcaaaaggaccgacggcaaagcccaaaaaatactgacacatgagtgaagcaatggccaactgaaaaagaatttccattatttgactaatcggtttgtttgtgtcgcttcaaaacccgcctcgtgtgagttgagcggagtgttcgggtccaacttcagtaagtccataagctgtgcctcgaatttttttttcatcaaagtcatttcgtctagaagttctttctgggagtttttttgctgcaacaatttgtacgcaatacagccgagcgcaacggaagaaaggcacacgccgattatccacggcacattcttttcg

SEQ ID NO: 8811 - DNA, 2192 bp, Heterodera glycines
ccattcaaaaaataataggtggcttttttaaggggcagggcaacagccgagcggtttttaccgtacgtacgagccaaaagaggtgagtgtgtgcaaatcgtaacgaatccgatttgattacaacacggaatcggccatcgtcaggtgatcggccggggactcgcttcggttgtgaggcgttgtgtggagaaaggtgatttagggagaaccgctcgaaagcacatcttaacaatcgccattttcattttgaagagtcgaggaaggaatacgcagtcaaaatcgtcgatctgagcaccgaaagacagtccgaaagggaagcgaagcgcctaagcgaagagactttttcggaggttcgcctcctcaaattgttgtcgggccatccgtccataagtacgttcttacgccttcgtaaatttcctctgatttttctgcgtttttcagtttgtttgcatgagttctttataacgccaacatttgtatttgccattttcgagttggcacgctgcgaattgttcgaagcgttgaacaaatcggtgacattcagcgaaaaacggacgcgactcgtcatgcgacaactgtttgttctgattactttacataaagttgaaaattgtcattacgtttcaggtttgacggtgtccattatttgcactcggttagtcatttacaaagtgacgagaaaaaataaacgcgatattattttaatgatccaatgatgataaataactaatgatttctaaattttcagaaaagtattgtccatcgagatttgaaggttttatttttaaaagtcatttaaatttaaaaataatataaacgtcgttaaaacagctcgaaaacattttgtgtgttgatgacaaacgcgttgtgatcagtgactttggttttgccaaacaattggagccgggccaaaaactcaaaggtggacactgcatcaatttgcataactaatcagtgttttcattaacaaaacttttaagatctcttcggcacccccgggtatttggcgcccgaaactttgcgctgtcaaatgtatgaaaacgcggagggctacgggttggaggtggacgagtgggcacttggcgtaatcatgtacacactgctggcggggtacgcccctttctaccacagacaacagttgcgaatgatgcgactggtgcaggagggacgttacgaatttgacaaggaacactgggaaaacatttcggaggaggcgaaggatttggtcggttttgggaagtactcctctcaccaacaataattctcacaatccactcactaattgtgagaatatcttgtttttggaatctcaaaatttacgaaagtgcctgtatttccagacagtgaaagtcccctaatcatggctgatgattcacccacctgctttacaattagcattgatttaatttcaactaattgagtggtctttcgtcagattcggcgtctgctcatggtgaatccgtcagtcagaatttcgagttgcgactgtttgtcccatgtttggatggccgcttgggtcggcgttcccccttcccccgctcgaatggtggaacccacaccattcaaacgctcccctgaacaaatccgtcgccttttccgtgttgcacaattttctgtctgttttatggtgcggcttcggaacttcaagcagttcaaactcaaattcgatagaggttatcataaaatccggccaattgaaattgcagaacattcatttcttccattttcagctgcgcttagaacgcggccctaccggtccagggaaatacggcacgaagccgaaagtaaataatgcttttcataatttttaaaaggatttatctattgttacaggcgcttccttcgccatctacggacattgggtcaaccgcggctttttttattccagggatatgctttttgcaaacaaacctcgacctagatatgttaaaatgaacaacggaagtcgtgatagtaaaagccctcaaaaaagtgtgaattcgacggagaaccctttgaatcgtaattagctgttccctattatgaattcggtaatagtaccgatggtagcccccctttttccaaaaacaaaattttgaaatattttcgagagattatattaggggttttaagggtcggagaatccgaatctgacagaaatctcgacctatgtctaacccccaacccggattcaagccgaatgtataaaattc

SEQ ID NO: 8812 - DNA, 550 bp, Heterodera glycines
aaaattcatattttagaatttcgcatatttggtctaaaaaggtttaagtgattttgttagaggatttgttgacttttagttttgtttccctatatgtaatccattttaaaaccaaaaataaaaaatataatcttttctctcgaaaaaatttcaaaaattttgtttttcgaaaaaggggggctaccatcggcactattaccatgatttctatctcattgaaaactaccttaattgatttagctctacaccttttttcatgtcgtgtaaatatctgaataaaatatcttaatgcttttaaaaagacgtttgttttctgcctttagactgggatttatttaacaacttataaaatagtgactaatatttacaaaaaatgatcattaatgattaagatttgatatgagtaggaaggtagagaccaatcacattaaaataacattgaaattaagctcacggggaagaagcaaagaaaactgggactttcgataaacgcttagaaatgaaaagttgagagcttacagaaataagtaaaattcggaatgaatttcag

SEQ ID NO: 8813 - DNA, 2270 bp, Heterodera glycines
agaacatctctaaataattatttatttggtcggcaattgttttgcctttattttcccatttgcctgtattggctgagcagcgccagcccaaaaaacagttcgaaatgacgagaacagctcatttccgcagcccaaatcacttcccaaagttggaacacttctttataaaccaattctgaaaggaaattagccattgttttgggaataattcattttttctgatgcctcttttgaagtcgagcaaaagccaccgatagaaaacgacgaaggaatagtcgatgttgcgcattagctgacagtacagctcggggtccatcacttcgaccagagaacgctgaaaggataaaaattaaaacaaaatgaaaaatatgaacggcgaaaatactcacaaaattattcaaattttcctccattccgccattgttttgggagctctgtgggaagttccgtcgcagtcgcagcatcaatcgctcaaaacaagccaacgtcagagcctcgtgccgaaataccaccaaaaggggggccaccaaatcgcacattccctgcacgtaaccgtcctccaagtccaacttcagtcgacggaaaatgtacgtgcaaatgatgcgatgcaaaatgtccaaattgtcgtggcatgagtaaaatttggtggttcgatcgcaacggtcgacgtcctttttgattctgagcaaattgttggcgaattccttagaaaatgcctaaaggaggaaaagtgccaattggttatatttagataaatgcaccatcacctttctcttcttggaaaagtcggtggtccttttctcttccaaataaacgtcgctctcttcaaacacttcgctattcattgagccaatagccccaatgggagggaaatgccgggaaatgtcttcctcactttggtgggttgacaatgagtcggagagtgctgttgatgggatgatgtaaaaaagtaatttcggatgacaaaccttcttcctcctcatccactccatttctctgctcattatcagctattaatttcgcatccatttctgtccactctttcaaatcgtttctgtacgtctcgtcgatggcgtccaattcgcgacgtccaaaatcctcgtgccattcgatcaatcgcagcaaatacggccacactttggccctcaaagttggctcaatgccacaaaagtaaactctggtgaggaactgcttgaaaaggacaatctgcaaagcgtgagcaaatgactgattgtgttatttaattgtctcactgttttttcagaacgacaaatccgccaaaatgcttcgttcaccggcatttccattccgtccgaatttgggataaatctctcgatggtcacaatggaggccaagtttagtcggattttgcgcaagtgttgtgagtaggtgagccatccgaggaatgccctggccaaaatttgactttgcatcgctttggtcgcattgctcagcgattcactgaagttaaatggataacacataatcaaaacttattaaagacaaaagaaaatccaattaaatgttcggccaaccgtaaagaaatcttcggttgttgtccttcgcattttgccgattcttgcgtggaagagcgcgaaaatggacgactaaaacttttttaaatggtcgaattttatgaactttcccattggcacttgcttttctaacggcattttctggtcaaaactcggagaagcgaaggaaataatgcgaaataccaattcagaaccgggcttttcaacgagaggtcctttttggtgagaacaatcagtcgctttatacaaagttgtcgaatcaacggcaaatggttctaaaaaaacaaatggaaaagtaaaaccgaattccaattagtagacgacctgtggcaccgcattcgattttaatggaatttaatggtgggtcgattttgaaaagtggggaaagtgcgccttccaacgtcttcagaaaggagaaacaatgctgctcaagagagaacgaaaagcaaaactgttgaacaccatcagaatcgataaggacgattgaagatgagagagtgccctctgaaagggagggaccgattaattgacgagacgtttttggcacggacacggaccgtttttgatgcgaagtgcgaatgtgaaacggtctcgaatttaatcgacaccggcacacgaatgcgatgagtgacttggacttttgaccggccatttgttgttgaacccccgggtctaaaaggaaagcgaaaatgggttaaagtgaatccattaaccaacaaatcgcttaaatgaata

SEQ ID NO: 8814 - DNA, 1346 bp, Heterodera glycines
ggaataagacaagggtttttgccaatggtatatctctatcagtcattcacggtcctcatgttcgtgttgagccccttttgcacgcaggccacccacatatccttgcatctgcagactcagcagtgaaaggatgttcatgacgtcttcgtcggcgttgtactccgcctcgtccaatgcatctccgatcaattgctccttcaaaatgtatttgatgcggcgtttgtacgggaacactcgggcagatcttgcgatgtccacctgcttgtcaacatcatccagaatagctgctagaaagtctgacaaagatgggtgatggactagaccacgcttaagttttaaaaaccaaattaaactcgcactaaaaatcgcacaaccgaaaattggaggtgtgatgcctccatagcattgttcgttttctccactgctgacttcgcacggtcgtggacattccagaagtgcacagggtacagtggtggacgcacaattggcagctcccagcgcggcacgacggaaacaattgttgacgattgggttgttggcgttgatggaacaggtgaagggatgccgaattggatgaaattgttaccataaacatggtccaaattcactaaaagcacacataatgcgagccgccggttgacaaaagcgccgatcacgaaacactgcgtccatgcggctggtgacactttgaatgttccatcaactgaaattttcctcgcccgcttcaaaacgtccaacagctgaaaacaaaagcgaaaaattgaacatgaaatgaatgaacttaacttcgggtgtgcaaagaccaagaccacatccgattctccttggcgatgcgctcggctgtcatacaacaatgtgctttcgccatccttaataagcagggcatcgggtaagacaacactcaaagggttgacacggtccatgttgccgtaaatcttccttttctgcctaaaaattttgaaataagagtgaaagaggaatacacgtatcaaaagagaagaaccttctcattactgccaccagtgcgaggtcagtgcccatggaaacaaaggtttcgtccttggtgtttgcacggatttctgccaatacttttgatggcttttggcgcgggttttccatcgttgtcgtcttaattccgttgcgttttacctccgcgtggaagcacgctgggtccggcagatggttgtgctcttttcttccgagcacaccattagttccgccttctttactcaatgctgcagttgcctcacagtcccggttggagcagcggaaccaccttccctttctgcgagtgaatcggaaccctaaaatgacagtgattttcctaaaaaaacaaccgcagacct

SEQ ID NO: 8815 - DNA, 1726 bp, Heterodera glycines
tttaaaaaccttaaattttaaaaaccaaattccaaatttaaccaatcattgcttctattaataccattggcgcagataggcgagcacaaagtcgcggttgaactgcgcccccagcgaagcgaggccgacttgggtaaacgggaagcggttgcagaacagcaaatggggcagtgccaagtgctgggcaggcacactgcaaaaaaacgccaattggaaatgccatcggacggagtaagccgaggacggaggaacggacggcacggcactgacccttcccgttgtgattcaccatgaagggtcatttttgagactctagtcaagcgactatgccgggattccacacttttttgggtcccgctttttggaggagtagccaagcaaaagatggactggcattatggctggcattttggcctaagacaggcccttccttatgcaagacaaaacgccgtacaattcggtacgggccggattgacttgtccggacgagcattggccagatcagtctccggttggatcaaaccattgttgtgaaaatcaacaaagtcgagtgttataagctatgatcaatgtttgatcagccgatttaaaaagtgaattgcgcacctccgccgcttcacaatgtcagccccttccatgtaaaggaacagcgcgggaagactttgcatcagccaaccgacagcacaaacggtgaacagacaactcttggccaaggaagacacggtgggaaaagcggggaaaagcatcggcgaagggagaaaaagctcaagcaaacagatcagtgaatgattggaaaaaaagtgatcagatcagtcaatgattggccaaaagcaaacaaaaaagggggcgggcaaaaaagagtctgacaatgagcaatacgcaaaatattcagtttgagatttactggtgatgacttaattggttaatgtgcctaaatgactgctgatgttggctgaccaatcggaatatggggatcactcattgaccaatagcaaggtgatccgatcagagtggagtcataatcagggttagtcccgggcatttgggcggaggaatgtcgggaatgtatgatgaaaacccgcagtcaaattacgacatatacttcctatttggagttgtaacccaaagcatctggcaaagcaaaacaacgtcgaggatcagggaccagtgttcaaccaacagactaagcacaaagtttgtgaaatggcgctcattgaaaatggggaaaagtgaatggccgccccctcccctcgggggacaacggcggtaacagccggcggaaggaagccaaaacctgaagaacaagatggacaattggggaggggggagaaggtggccaatgccgcaaaggcaaccaaaccaattggcacagcgtcgcccgggcaactccacgacaaaatgcccaaaattatattttgtgtgtgcgttgtgccagccacccggcaccaccaccaccagcagcagcagcagtgggtggtggccaagcagttgacagtcagtcccctcatctcagagcaaagaatggcaaattggcaccggcaccggtcgaaaagtgccgtagggggcgccggggttggtgaccggtgccgccgttttgtcgtcccattcgacgagggcaccaaagggtttctctcattattcacatgccatactcaacttatgccgagatgagtgactaaactgagcgggggagagggggaatggtcatcggcggaggggggggggg

SEQ ID NO: 8816 - DNA, 1469 bp, Heterodera glycines
atccctaatcatttgccggatgttttactatggcttcgccttcaccgccccgctctcctccaattgcttttctgtgctggccaaacactgcatcagcccaatggaagaacagcatcagcagagccccaatttgttgtaatgctgaagaaagtgccgggcaaacagaacgccaacaaatcggcacaaaaagcggacaaagtgaacaatttgaaattgaagggacgaaaagcatttataaatgatgacaatgttaaaaaaggtgctgaaagtgatcactgctgagcaacagatcgaatatcagcccaaaattagttcgagttgggaaccaaatttgatggcctaattagtgagagatgggaacaacataatgccagtggcgggtggagtaacccaaatgttgaaaactctccatcataatcatggcactttgggatatttagcttaaggcagaattccattaatcgtacgcctcaaaaaactcggaacagtgcacacagcaggcgttgaacagcttctacaacgaagaacagcagcagcagaacgttgcttacggcgatgaacaacagacggaaagacattctacggccaattcaatcagttgaaaataaccaatgaaatggccaggcacggaaataaaagtgccgaagaaagtactaatagagcgacgaattccgaagaaaatgccaatagaaacagtgccaaagcagcagcagaggaagacggagaagaagcagaaacaagatctccgtcttcggcatgggagggagaaagaaagagagaggggagagggagtgtggagagagaggagaggcagagaaagtgggaatggggagagagtgacagagagagaaaggcggagagaaagttaagaagagaggaagggatagacactgattatcgaattggtagcggagaactgggattgatcagttatgggtagtggtatcaatcaattaagtacgagtaggagagaagtgataaaaacactgaacaccaaagtgtacgagcagaaccacgcgctgtgcttctccaccgagccggtcaagcagtgcccgcgcggcaacacaacaaacggaggggaagaagccgaacaacagcggggaaaagccgaagcatgtccgctttgtgtgcatggaccgcgcggagtcggaggcgcgccattttatgcgccaactgcgccgcgggcagcgatcagtcaaagtcagcggcgcccacggcgattccttcacagaagaggtggacgagccgcagcagtgctggcggcgccggaactgaacgcggacgaatgggacgcggagagtgcgcggagaagagaagagtagaaattgatcattagtcagtaacacacgtaacactctccgatcacttcccccccccacccgcctgatcagtgatcaatgtgattaatcaccgtaataaaagtgccaattttattttgtttaaatgtatcagtaaaataatgtagtaaa

SEQ ID NO: 8817 - DNA, 3940 bp, Heterodera glycines
  misc_feature (3739)..(3739): n is a, c, g, or t
  misc_feature (3857)..(3857): n is a, c, g, or t
  misc_feature (3877)..(3877): n is a, c, g, or t
actccggggaaacttttgagtgtgatttgttatcagatttttcaccaaaaaataaacagattttgtgattttagataatatgtttacagaatttatatcaaaatattcaaattttcgagaaatatatggttaaattcttctaaatttcggttcttttctgttttgtgaccccccccctgaaattttcaaataaaagtcatttctagggtaatttggggcgctgatcacgaatatgacatttatttttcaaaattccgaatcccgaattcgaacaaaaactcgaaattgattaatcacaaggaaaacatttttctaggggttttcaaggactgacctctaccgtaccacggcattcaatttaaaattgaatcattaggaattattagaattcttttttggcgcaaattttggcatattgtaagagcaaattacgcacaaaattttttaaatttgattctttcaattcttttctatgcctcttgtcatagataagtagcgatgtgaagcattaagcagtagtgatgaagtggtcatttaaatttttgaggggacacgtaaaactgaaataaagcagatttcccgctgcccctacgaatcaagcccgtacccaaaaaaaagtcaggatttttatgtgtaatttttcaaaaattttcagcaccggagccaaaaagcaggcatttatagcggttttatacaaaaaatgacaactttttggcattttggcgtcaaatctatccccctccccccctggggatacgaatataaacaacgattaaaacccgagaccgtaattaccaatatataattttataatgtgttttagaaagatgtcttttgtccaaagtccagaagctaacgttccggtatgccatttttgagagtctaatggaagtgaaggtttttgggtgtgcagaagttcgttaactcatgcaaaaatatgcataaatttcattaactttgagtttagaattttaaaatgtttcaaaaagggacattctgcattcttaaaaacttttactttacaatttgtgtaaaattccaaacgtttttgtttggattcacaagggaaatcaatgggtggggctgtgggaatggacggattcgtgggttttccgcggtgggcgttgcgtctgtgtcccttccataggacgggcagtaaattcattcttcgtccattcacttaccattacaacaaaactttgattatggattctaaaaaatttctcccccttgaacttatttacgaattggttaatgcactgccaattaaccaccattgggcagctcaaagggtttcctccgagttcgacaatttggtttttgagagacaggctgacttgataaaaattattttgcaaaaggtatgggaaaatggtgacccttgaaaaatcagaaaaataaacaactaaacaaaatgaattcaaaataacattttcgtgtaattcaggcaaacgtgtccaccgcgcagtcgtacatcacaactatggtccaattggcaaatgcggatgaacgaatagtatttttgacggagtatgcaattttgaggaccattttgggtggtaatctctttttccattgtcattctgtcagattcacgccctcccaacatgaattctgtagcgaggcggtgacacttggcaatcgattattcaattgcgctgaaacaaaacaaagcattgttgaccattccgttgtgatgactttctgtggccgtatgccccacgtttggtaactgcagatgatgcactgttgaactttttacttttttttgtaatttttagccttgatgtctcttcattctcccaaatgtctccccaacaattcgccttggccgatggcgcctcagcaaatgtccaatttgtcggctgttactctggaggacaactgcttatcaatgatttggcactttttggtggtttgcaaaacagcgttgtcctttgtccgtccgacgcgttctccgctgagcgtgcgactcagttggccatgacgcacaacggaatcacttacattcgaatttccccatatcccactccggcgatttacggcagcagtgaccacgacaaattcgaaattggcttgttcattgtgaggcttttcaattatagaacggtgaatgattaattaacagtggaaaactaattttttggtgaatgttaaccgtctcaaattagcggtataattaggtatttaagtgagtccacgaaattcgcctttctgattaatcattaagaaaatttgtccagtttttgattttgatgggtatttatttgccataactctttttgattaaactaaattaagaatcgacatcaatcgcacaaagacaaagttgttctcgtcggaattggagctgcggtcaatttgtgcgagcaagcatatcgtcaactgttgaatgaaaagattccggtgacggtcctcgacatgttttcgctcaaggtacgtaatcgcaatcagttttttgagtgtttttttaattcttcagctgacgcgtgagtttgctgttttatcgttggttagcattctaaacgtcggtcgagtcgttactgtggaagaaggcgttactcccttttgtcttccactcgcttcatcaattctcagttttatatctgaaaaaaaactccaagtgagagtaattcataaaaaagtcaatcttccatgcaatttgaactattcaggtttctgtgcgaagtctttgcacttgcggtatgtgtgtgttgtctaagtgaaattgtttaatttgggagaatggggcttaattagacattcaatatttcagagtaatccttttcaaaatctctgaggatgaaaattagcgaattaatttgagttttcaattcttccatttttttaagaagatggcttttctgcggattccattgtcgctgctgcgaaagcattctcaaagcgttaaacgaagaacgacgggcaatgctttgccgttttgttgacaaattctccttttgttacgataatttgttgaaacgttaaatgttaagttgagcagatctcttacgtcttttgttttaaataaaattgattttatatattttttcaattaatcctgtgacagaacccgaaattcttaattatcgaacccactgtttacataacatatgtacacgtttaatactttttaagctaatttaattacgagaggctttgttgggggatatgaactcgattgaataatttttaaaagcaaccattaaacggattggaatcattttaatgctttctgtcgaaattcgccattattttaactcattgttatacaattgccgaacaatactggcgaataaatcttatacaaaggctgtgaattgcgatttttcctattattttgtttttaagcgaaaattgactagaaaaagagcaatacaaaaagttgataaaaattaatgttattttttaaacgatattttatataaaatgataataaaaattcatggaaattggtgatcaaaagataaaaatgattaagggcaaaaaactttttaagtaaaatgcgtgacattttaataaaagtcaaaaaagaaagcttaactgattgtgaacttaaaagaacagatattgtaaatgaatgaaaaaatgtattgatggaatcactcaaagaaaaacaaaattaagtgccatggaaaaaaagatcccagaatttgttgcaattgaaaattgaatttacaacaatttcactgctttgtcctcaattgtttcatccgacgtactcaaacggatcaggcancaaagatgcagcggatcagatttatgaaggcagcgaccaaaatcagcacgatcagaagagcgatgacgccgacagcccaatcctaaaggaaaaggcatttggccaccaaaaagcatancaattattagagcccggaanttcaaagtatcgggacttggaaaatgaatcggaacgcagattccttgaccggggtccctgttt

SEQ ID NO: 8818 - DNA, 678 bp, Heterodera glycines
agctcgagtagagatcaccgcacattttgaagtagtaaagcggactcgactcggggcatcgctcgccgacgagcaatggacacgccgaaacgccgctcctataacaaagggcgaaaattgtgccaaaaaaggctttgagatggaccaactttagctggaaaatgtccaaatcgcgcagctcgtccaacaggtttttgtcgccatttgcagtgccggagagtaaacaaatgacgacaacaatcgcagtcaaaagcaatgggaaatgtggcggccgaagcataatgtgcgcgaattatgttatcaaatggcactgataaaagataaaaccttggagaaacggaaaagctaaatgactttgaaaaattgataaaaagccgatgagagaaaacaaattggaaaaaccgttaacccaaaaagaaagaaaaggaaatgaaagaaagttgcaatttgaaattggaataaatggaacgaatggttaatggcaagtggaaggttttgcttgcctctgctggccaatgtcattgctcatcagtgtttggacgccatttgatggaatatgtatcaatgtgagatggaaaaaaggggagaaggaaggaagacacaaacaaaaagaaaagaaaagaaaggggcagggcaataaagaagagtgaataatgcacaatcgatccaatttgaacg

SEQ ID NO: 8819 - DNA, 2686 bp, Heterodera glycines
ttggcccttctccttccgatcattttgctggccacaactttgaacccgctttaccagcacatccatccctacctcaaatagtcagtctcgaaattttaatagtgaataagtattttaaattaaaaaagcaaaaatttaaatcgaaaatttgctgctgccttttgttgtcagctattgtatccacgccaactaacgttaattgtttcaaaatatgtttttaaatttaaatttgttcattcagtccgctgctgcacaccggtaactcgtcgcccagtcacgacgcgttcgccaccgacatttacgcgatggtcggctcgcagcagcagcaacagtaccatttgctgccaacgcaacagctcaaccacaacaggaacaagcagtacacgacgcaacaacagcagcagcaacagttcacctcgccgtacgccacctcaaactacggttaccacgagctgacccatccaccggcctacagtatgagcatggtcggcggcggaggcacggggcaacgacgatagacaatgggagatgaaccaacaaagaatggaagccagaatgaacaaccatgatcacacagttattttcatgtagatatgaggagttggagcctatctcttgccggaaaattggaaattcattgtctggggtatacaatttcccatagccaggaactttgaaaacgcccgggttagggcacggatttccgagatgaaccggaacagaattccggattgaagtactgttttaacatgatctcctccggtccaaagcattttctaaaacatacagaactctgagccagcacctaaaatactgtaaatctttcggttatttcctgacagagtatttttccgattagagccgaaaaccgaatgaattgaatttttgactaaccgacccaaagaaaattcaacataatgctttcaagaacaccatttattcagaatccattctccgcctttttgtatcgggcagtttctggagatttaaacaatgtccgtcccaacgtcccattcctcttaaacgaaatgccatttaaatttctttatgttttttatcattgcttattttttcattttgaatgattatgtaaaaaaaaaaaataatgaatccaagcgctgatatgtatgtaaattcttataaaatcgtgaaataagcataaatgctgtaaataaagatcctagaccacctaattttgaaatagggaggatgtagaaaactatctttgtcagatagtccattcgttgcttttttgaatttctcatttttatttcattctccgcccactccccaagcctttctttctccccccccccctccataaatgtgtaagtacagcgattcttcttcagtcctttcactttttccatcgataattttttaccaatagactaaattgacctttcaaacacccatccattggcaattgataaagttgagcacggctattgtgaactgtagggagtttttctttatggacgggtcaagacggatgtgatattattataaattgaaatctttccatgagacgtacccatttacatactgtacgtgtgtatgtaaggagttgatcagaagcgattaaaccggtttttgaacgtccgaaaactcgaagagaatagacacagtaccaaatacataagacggggcaagtaatggtacttgttaattatccctactcagattttcaaaaatcaattttttgaaaataaacttgtgttaggggttttcggggtcggggaactcgatatttactctctaacaaaatttttggttctagtcggttttacgcgtcccatgacattttacgcgtcccatcacattttacgagtcccaacaacactttacgcgtcccatgacattttgtgtccatggcggggatggcattccgaggccccaaaaattttcggaaatcggaattccgtgccatccctggtctcatggtataatagttgtcctaataactaagagaaaaactttattttttttgtcaggtattcagtaaagtttttaactaaagatttcgttgttaaacctaaggttatcatgacaacttatacacaggcaactcgaacaatggcttatggttagactaggcctaagcttaggcttttgtaaacttttttcttatattagttgaatttctgttgacatcattaagtgtgcttagagttgcttttgcacatttcgatgatcaaagtatacaaacaagaacaattagactattcggaaggtataaagtttccgattgacggttcgaaaaacattttttgacgcgtaaaatatgatgggacgcgtaaagtgtgatgggacgcgtaaagtgttgttgggacgcgtaaaatgtgatgggacgcgtaaagtgttgttgggacgcgtaaaatgtgatgggacgcgtaaaatgtgatgggacgcgtaaatttcatgggactttgaatttaggcattaaataggcaaaaaaaatgaaggttcatgcatagtcagaacttagattcgtgatcagagtattttttaacccaaattcattgctaaacttttaaaacaataactttataattcgaaaaaaatcaagtagttgacaaaagatcttaaataagaatcaatgattttccaaatctgagctcagattcgtgatcagcgcatttttttaggctaaaaaaaaaacccgacaaattttttaaaatttttt

SEQ ID NO: 8820 - DNA, 1496 bp, Heterodera glycines
  misc_feature (1344)..(1344): n is a, c, g, or t
  misc_feature (1361)..(1361): n is a, c, g, or t
  misc_feature (1371)..(1371): n is a, c, g, or t
  misc_feature (1481)..(1481): n is a, c, g, or t
aaggttatcatgacaacttatacacaggcaactcgaacaatggcttatggttagactagtcataagcttaggcttttgtaaatttttttcttatattagttgaatttctgttgacatcattaagtgtgcttagagttgcttttgcacatttcgatgatcaaagtatacaaacaagaacaattagactattcggaaggtataaaattttccgattaacggttcgaaaaacattttttgacgcgtaaaatatgatgggacgcgtaaagtgtgatgggacgcgtaaaatgtgatgggacgcgtaaaatgtcatgggacggcgtaaaaagcgacttagaaaccccaaattttgcttttttaagtgacaaattatcattttaattttaccaaatttaacaatcgaaaagcaatgactacttcactggcggacttggatgtggaatgggagacgtacaaaacggaattcgagaaggcagaggtgggcacacaataataaacaaatgacagtcatcaatctttggaaaagtatcgaaaattatccaggccgaacacggtgcatacaatgcgcgtcagcgcgcaaatgtgaacaaattgtaagtgtttttgttttctttgccaattgaattaaaaataatcttcccctttgcaacaaggaagcaaaatttggctctgttttctgggaagatcgaccggtaatataggaaatccgaattttgagggggagtgggttctttccatgatgagaattgttaccttactgtaccacaaaaaacgcattaataaataaataaatagccaacaggctttactaaggatgactctaatgcagttcgtgcgtttaattagctgctcaaactgtgacaaaatcagtttaatttcgaacgaatacgatttgaataaaaaaactgaaagttcacattttcgtataaaatcggcttaaatacacggaaaaaacggagacaacaaaaaagcgaaatttgaacttttcttcattttcttcgaattcgggtccgggttttatgattggtcgaaatgactctcattatcaagatcagtgaaaccttatgatagtgtttttatgacttaaaatgattaataatatttaatgttttcgttggttttcagcttggaaaggggcgaactcagcgacgatgacaaacgcggattggaagcgctgaagacacaggcggagcaaatgcacatcaacctgtccgatttgtggcgtgaggaggtgttttaattctataaacaatttttaatggccgaaggtgtaggataagttaaaaaagtgccagaacccgggacaatcagaatgcttattcagttttaggctttggtttaaaatgngtgttataatgagaggngagaattatntgtgtgtggtacgacgaaagggacagagaacaacactttctcgtcgccatctctggcccattccgtccactatttcgtcattttgtcatctctctttcttgccttttcgntgtttttaatcaatt

SEQ ID NO: 8821 - DNA, 3898 bp, Heterodera glycines
  misc_feature (3866)..(3866): n is a, c, g, or t
actcatgcaaacccaactcatccatacccaactcatccaaacccaactcatccatacccaactcatccatcatccatagacccaactcatccaaacccagctcatccatacccaactcatccatagacccaactcatccatacccaactcatccataacgctgcgagtcatcgtcgtggcatggcattttctgcttatgtggtcgtggcatgacattttctgcttatgtggtcttgaccgtggacatttttgattatgccggtcttaaccgtggcattttttggttgtacggtcttagtcttagtattttttggttgtacggtcttagtcgtggcattaaatgccacggcgacgactcgtatcgtgctatggatgagttgggtatggatgagttgggcatggatgagttgggtatggatgagttgggtttggatgagttgggtttacccccgtaattgcagtggatttcaagtttaatgggttttttttagactttatggatattaaatggcattttgttggatgcttttttaaaaacatttcttactacccaaagcagtgtactgtttctctctttttcaattttcatattttacattttcacttgataaatgagtatattaaatgatttattttggtaaagaaaagttgtttcttgcttttgggaaatgttcttcaattagaaggcgaattagtgaaaatggcacttccatttttggaaatgccattgtcagaaattgacttttcccctaatcagaaaaggcacttttacatttattacttatgacaaaaggacagctaatggagttcaattgggagaacactcagtgcaaagcatttaaaacgcaaattgtgccgttcttttcagttgaaaacgaaaattcttcttcggaagtatgccgacaaagaaaggaatggcagaaaaaaaatgccaaaagtaacaaaaacatttgccggggcaatggcatttgggccgacttttacttttccattttcttcagattgactaccttttcagatttattcattttaatccaacaaaagagagaatggctctgtttttggccaaatactttaaacttttttctcttttccttctctgttttctgttcactttctctttggccgatgattctcttctcgctgacaatggccaaatggcacaaattgacgaagtctgtttttttgttgggttttgcgtttcttttgccatttccattaattgtgccattgtccaccaacagcaacagcaggacattgtccctttggcggagaagagagtgccgcatccgttgtaagtcgagcaatacggagacagaagaagcccaggaccttccttctgaatttgccctttttagcgggtggcgtcagccgggcacgggccgagtccgaaggtgggccaagaggcggtggagaggaactgctcgaaggcgggaggggtggatgaccatcaatccccgattcagcagcttccacccaatgtccatggcgccggccgaattcggcgggcgccgctttaaccgtttttacgactacgcggcccccggacgtccgctgtttatccgttacatgcgaaattttgtagctgacaaagcgactgaatgagcaatgaatgggcacagcaaagctgaggaaggggccggggtgtgatcgaagactgatcagattgaacgccgatcacttttaatcacttttttttgttgctgtaataatacatcccttttttggttagtttactagtaataataaaagtaataataatatgttttctgttccgatcagggctggccgtgattaaatttccaatcacggaaatccgtgagccgtgatcacggggcttccaaaaaaatccgtgaaccgtgatcacggcaccccaaaaaccccgtgatccgtgatcacggccagccctagttccgatgtgccaattctcccccttccccggcgaaggtttttctttcttcctctctttctcttcctcttctcctcctttcttcctctttcttctttctctctctctcctcctttttttcttcttcctctctttctcttcctcctattccgctgactatgttctgctgctctcctcctcctcctccttctcctcctcttttcctttgcttctattgtttgctatttctcttccgtttgtccccctttccatttccaatgcttcttctctctctctcacattatttactttctctttttcctttgctactgctgctgatcgttgctaaaatttcgacactttaaaaatatgcttaattccgcaaattttacattgctttgcgatgccgaactcgtgttcagaatgtccatgtaattatccttaattcattgcctttattaactttctcccccccttttccccggccacttttatgtcgtcatcctccgatcggtttctcgtctctttcctccgttgcatttcttcaatttttctgtccaacagacgagagaacatcgcataaagcaattccgcgttatcccgattagacatatacttaataagtaattaccataattaatgaattaattgctttccttcgcccacttgtcccaattccatttctctgcttcgtattgtcattgtttcgttctgctcctcctcccttcgatgtgcttcggctgtctttggcattgtgttcggttgcttttctttcactctgtcaattttggcacttttccctcttccatttttcctttttcctaattgctcttaattcgtcttaattgatcccccgtccacttgacccatttactttctcatttttcgcccaatgtgcgcaattttcagcgcttcctgtagcgttattttgttgtacgcccgcacaatgtctgttgcgtcgaatgttttccgtgtcatattgcgcattagcaatggcttcaaaattttggcgttgaaccgttcgaaacttaaatttccaaaatgaaatgtgccgtcgtccattggccaattgactgacgcgtctctgaagaagtgtttgccccgctgaccaacaatgtcctcaataccggccattgtgtagtcaaagtatttgttgtacaccttgacaaaagcgtacagtaaccccgatagaatacggtattattggggtggaaaggcaccttctccaccatcatctcctcgtattccatgtcctgcttctccaccttaagcaaagacagcaaagggcgaattgtgatgccctaaaacaacggcggaggataataaaaacagcaaaacaaagaaaaggacacctggaggaaaacggtgaagtaaatgacggcgatgcaagtggtgacgaacctaaaaagaccgacaattcgtccgttggctttcaaatggccaaacattcgtttcgcttcaataatcgccgggagggaaacgaccaaaccgaaggcaatggcaccgcgcagccccccgtaggagaggacgaactgatcggtggcgctgaactttattttgcggaaacggttcagaaaggcacactgcacgagaacgccttggggtggggaagattacggtaccatttggacactacggtaagaatgggcaatggtcggtaccgatgacacggtaaacgaaacagatgagcacagtgcaggcgacgaacagagtgtcccagtggtgtttgctggcgatggaagacaagccgaggaacatgaaaatgactgaatgccaaaacattgcgccattttgaacatcgcaattcaaagccccaaatgacctgtctcactgctctgtgccaacattttgacaaaatatttgaccgaactgttcgcgtcgtggctcatgttgcccttgacgtactgtttcatggcaatgccacaggcgacgatgctaatgaaaagcgaaggaagggcaattaggagaagcaattaangtaattggggatgataatacgcgagaatggcg

SEQ ID NO: 8822 - DNA, 1799 bp, Heterodera glycines
  misc_feature (7)..(7): n is a, c, g, or t
acacctntttggggagaagggataagagacgaaaacaaatgagaaggggatggccaagtgtaattaataattaattaatgattgttgttaattacccccccccccccgtttccccgggactatcacttctagcaaaaaaaaaaatcgcttaccggcgcaagaatcttcacacgtcctgtgaatctaagcgttttgagaataaattcacagtgattttctgtgacccaatcacctggtcaaaatggagacaaaaaaggcgaaaaacaatccggtgagagcaccgccgaacgaaatgaccacaaaagagccgacgccggccaaataatccgcgagagacaactgatcaacgccgatcagagtgaacttgcggaacatttggtagagcaccggaaaatgttgccccttttcactttcaattcaaaaacgcaacaattcactgaccacgctgactccgtcgttgaacagcgccttaaaaaaggggggaaacgattgggggggggaccaaaatgatggattgaatggaatgaatgatcaacagtgaataatgatcagcaaaaagggaattgattggactgatcaatcagtgacaaactgattaaccaaagaccaacagcagttcacctctccgaaaacattgatgaaaaggaactcgttgacgtgaatctcttcaaagacagcaatgactgccacgggatcgacggcactgatcaaagaggcaaagaggagaatttcgaagggggagaagggcacggagaaaaggttgaagtggccgaggacatgcaaggtgaaccttcaaattcaactaattggccatcgtttagtcggttttacccaaccgaacccaatggacaaagtgttccaaattgtgccgacaatagcgaagagcataacggagtcccaattctcgaacaattgcctcgagggcatgaaatagcctgacaaagaatgactaattggcgacgattaagccaaacaaaagcatttaccggcatcgaaaataatcggaggcaaaaggtaaaggaaaaatatggtggatttaaggttgtacaggtcgatgctgacgtgcaactggtgaagtccatagcccaacacgaggccaacgacgatgagaagtgcgctgtcgggaattgcttctccgaactttttgttcacgtgaaagactaacggacagatagggcaattaggggataattatgcttaatgatgatggccatcgtacgaattttagcgatgctggcgaggagaatccaaacagagacggtgtacggcgtttccacatgatgccaattcagcgagacaatctgagcaaacgaaggataaggcaaatatgccaatttggaagatgggaatggcattctaattggcccatttataatttcgacaatttgcaattaagcatatgtgtcaaaagtgactgtgccgtgccgacttggaaatgtgtcatctgtctctcctcctcctcctccccatttgcatttatgtcaaaagtgtgtgccgtctgctgctgctgaacatccgtccgatctctgccttttcggcgttcgttgatcacttccccgtccaccggcgtggtggtttccgcttctccgtcaacttcgatcagttctgataggtcaagcgcattgcttcggttttgaagttgcaatttgttcagtaaatgctccaaatttggagcagaaaaaatagaagagaagaaaaaagtgagggaaaggagaaaaaatgaggaaggcattttgggcttacaattaaaaaattatgaataatgaattcatcgattgaattaaacgcaaaaaaggaaa

SEQ ID NO: 8823 - DNA, 167 bp, Heterodera glycines
ggggagtgagggtgtggggcgggtgcggtaaagggtcacgcgggaagcgatcgctaatcgccaagcaatgcaccaaaagggaccaactcgcgccgcattcagctgctgttgctgatcagcagcacaaaaggtcgatcaacaaaatctctccgtttcgctctcgtcag

SEQ ID NO: 8824 - DNA, 1363 bp, Heterodera glycines
agaaaatttatgacggatttttttttcggaaaatgcgtaaatttggcagtttttgcgagacgaccgacccagcacggtgttatttttattttaaatcaacctactttttatcaatgattgaacatcaaaaattaacaaattaatatttctaatataaaaattggtgaataaaatgcaaatttgcctctttttttttcattgataggtatttaaaattttttagagtggtcaccggaaatgattaaaattaaatttaaatttctaactcctagttaatgcaaaaaagaaaaatatatatatatatttaaaaaggcggcgataaaggaaaaaatatgcaaaattttaaaacaactcttaaaaatttagtttttattactgataaaaaacgaaaattaataataaaaataaggaggactgaaaaataaaatactgaatgtcgtaaagtctccatatcgttgttcttgcattactcatttattccttctccaattatctgcttccatcgataaacgttaaagtgattaattttcataattttcgcaatttctttgtcattcattttcggatattctttttttgtttgccaataaactttcattttttccattttttctttctccgttatttttttgcagcaaatgccaaattgtttcttccattttctaattgtgtcataaccaactccaattttcttacaaatttctttatgattttgttgccattcttttcttgaatattttcttttttgtttaaattcatttttcattgcaataaacttttgcacaatttcaattttttgttcatcagtttttgatttgtagcttttttgcatgcgttgattaagtcctaattctttaatccatttttgaatatatgtttgatttgtccccaattttttcgctatttttgagttaattttattccattcttttcgtgaatattttcttcctttttgctttattttttcttttattttataatatttttgaattatttctctttttttgagttcatttcgtttttcttcttctttttcttgccatttttctccaaatatttcgccaaatgacttctgctgcaattttttcttttctgatccaattttgacaattaaaaataatataattaataatagtagcggaaataatttcatttttgtcgtctcgaaatgatttattttatttttcttcaattaaatggcaattcattttttgaggcatttaaatgattttttttctgataaaaaactgaataaatcattattttacttaataaaataaggaaatcctgttttattttcaaagaaataataataataattttatcttaatgacaaaataattgccaattggtaaattaatga

SEQ ID NO: 8825 - DNA, 2715 bp, Heterodera glycines
aaaatgagtatttagggggttttcagggctctgatcacgaatcctaacccgtatttgcccaattccgaaccccggacccgaattcgaacaaaaaagttgaaatttttttccaatggtactttttctgggtaaaaagctttgaattcatttaacaactatttattttgatgcaaaatatgcttcaactattaattgcatcaaaaatatgcaatttacgccaaaattagatcgattttaaagcgttttttgaaaaaaattcaatttttttgttcgagttcgggtccggggttcggaattaggtaaatccaagtccaggttcgtaatcagtagggatgggatttttagtgataaaaaatcccaaaataattaactaaatagtgaacaaaaaatgccaaaatagtggcaaaaatattgtcgaaaaagttccaaacctagaggtgtaattttttaaatagctgtttttaatttgaaaataatttaaaattaaggaaaaagattttattcactgattgcagttacaaaatattttcttagcaaatattgaacaagaaaaaaaaaatttgggtgaagaatttttgtgaaatttttccaattcttgggggtgtatttttcaaaatttttatatcgattcttaggggtgtatttatcgtttttattgcaattttgggaagttttccaaaaatgccaaaatagtggcataaataatgacgaaacgccaaaatagtggcaaaaaattattttagttgccaacttccgaaatagtttttttttagtggcgaagctcaaaaatagtgattcctgaatagtggcactaaaaatgaaaaattttcgaaaaaagaatgtgtttttcgtgcatttctcgtcgagttaaagccgcagaaaaaatagttaaaaaactaagaatcccatccctagtaatcatcagcaccatcgaaaacctccggaaactgtttttaagcctaaaataaaaaagttaaattagaaacccccattctttaggattgcccagaaaaatatctttttcgcaaggaaattttccaatttacctgcattttccatcaaaatttttatgaaaaattataaaatgtcatttttagttcttgagcacatcattaggggatgtatttttcacattgaaaaatcagtcattatgagtgttggtttttccgaaacttcgtgtaaattaaccgaagccgaaatccggagcccaaaaactctaagttttcgaagccaaagtttcgccaagccctgatcgaaagataatcaaacgttgcaaaaatgctttctcgactaaaatagagaacagtcctttggatggagaaggtttaagcaagacaatagacaattagcaaatggaattaatttctgttttttatccaaaacaaataaaattaaaacctctttttataaattaaatgaaatgatatattctgtttaaatttccctcttaataatccatttttattcctaatttattaaatgaatacacataattaagagaatgaatagagtaaacaaagaacacaaattgatagggtcaaaatcataaaataaggggagacaacaaaacgccacaaaagctacaataatttagaattttctaaaaagaaactcttgtgtcgccctttatttataattaggagtcgaaatttctcgtacaccaactaagaattttggaaaaaaatatattaaattttccatttaaaatagtaaattttaaaattcgatttctctcttgattatccgttttcaatcctcatttatttattctctaatctttttcttccatatcgaaatgctcgaatgattaattttgaacaatttcgcaatttattttcttttttgcttatatccatttgtcatttgaatgaatttttgaatagtttctaacttttgatcattattttttgatttgtaactttttgattaagaccaaattctttaatacattcataaatttggtttcgatttgttcccaattttagggaattgttgatcaaattaaatatttataattggaggtaatattaagtattgtcaaattgaagtaattctgtatcaacatcgttctgaattccgaaccccggacccaaattagaacaaaaactcgaaagtccaaattttcgaaattgggttgttgattcaaaatcggtttaaacgcacggaaacaaactgaaagccaaatccttcaataaggatcatttacgccttttgtgaaccaaaaattctaaattcggaaattaggactttcgactttgttcgagttagggtccggaattgaccgaaatggaaacaaaattcataatcagtgagaccttagaaaccccaggaattgtttttatcacattaaaattttggaacgagtggttaagcaactaacattcaagtcattggcggcaatgccccgaacaaaattattgttcgatattttgattgatataatttatattcattcctattattaacccaatattttttataattaatgagataatcaacatcatttagaattttatatttgaatgaaaaattttatctaaatttgcaccataattgatttttgtttcattttttgttattgcaaaaaatgagttttgcttataaaaaagaagaaattaaaaatattaccgattaaaccatgactaattacgaagatattgattaaaagcgaaaaaaaaagttaaaaatatgaaatatttaattaaaaaaataaaa

SEQ ID NO: 8826 - DNA, 3520 bp, Heterodera glycines
acgattccatttccatgccatggcattgatgagaggtgccatttgtgatgaatcactaaagaaatgcaatattaattaatttgttctcacaataatgagaatttccgttattaattttatttttgaatcttttaaattaaaaaatcaacgaatttctgaaatttattcaattttcatttaaaaatgaattactcaattcccatgtgtttaggctcctcctcaatgtcatcttgcaaatcatcaattgaattttctataaataaaagttatatggctcatattttctacatatttcaaatttttgtttatgttttttcattgttttttttacttgttttgaaatttttgtgaatttatagaaattttcttatgaaaaattcaaaaaaattttttttgaaaaaatttactaataaagcaaaaatcaattctttcaaaagataaaaactttattttaatctaattatatctttttaatacttctttaaagtatcgtataaattttcttttgtaagagttattgtataccatcggcgtccaacgtcagcgattttttccattttttaaatgttcctaaactgattggcaataatttttttacaattttttcctgccccagctcgggatgtcgttgcttatattgataaactgttctcaacatttcttttttctcttcagctgaataaattttcttccctatgaaaaaaaaaaattaaatttaattggcacattaaaatgtaataattaaatttatttatttttattttatttggtttttcgtcagaggcattgaattgagatggacacaggaaactgagaaaatttaaaagatttttcagtagttggccgatggacaaaaaggcaaatttggcgatggacaaaaagtgcaaaattgctaaatttcaaaaaaatttattaagtttttcaaaagttatgacaaattttccagtttttggcttgaacttttgaaaaacttaataaaattttttgaaatttggcaagctaataatgcaattcaagggctatcgtatgataccaagattgtttgcaatttggttgtgtctgagaagagttttgagttgatttattcaaaaatttagcaaattttgcactttttgtccttcgacatagcaccgatttttcacaagggttaggatcgactcaaattagtcatgtagctcggcgtcagtccggcgcttttttacagtaagaaaaacggtttttacagccttatatatttaatgagaccgtttgattgagaaattcttaaaatgcttgaattattttgatttaacttacagaaaatgctgtcagttttgctaattttctccgatttccattccttcaatgtgctttggcccatcttcagtttcttagctattttagaatcgctaatttttggattgtcacttttaatttcggaatattttttcatcaacatttccttgtctttttccgaatacgttttgttgactaaaacaaaaaagaagtattaatgtaggaaatttcataatgaaaaaataaaaataaaataattgtaaattaaagagaattttcgtgcaaataatattattttgtggtattttatacacaatatttatataaagttctaaatagcgaaaaatataggttaatttactaataataaatcattaacatatttatattattaataatttaacgattttatgcatttttaaagcaaaaaaaaaaattattttaattagaaaaattttaaaaaattaatttaaaaaataaaaaattattcatacatgttaagccaaattctcttttccatctatatattatgccaatttgcactggcatttggtcagtgatcatttgattgatttcacgccatgattttgatggatattttttgtgtaattcatccttcatttgaataaattgcgcaacaattttgcgctttttttctcttggaaaattcatcgctatttcggcttaaatattcaataaaaaaattttcaatgaaaagtcgaataaatttctcaaaaaatatctatcattctagcattaattagcttgccaaatttggttaatattcaatccttttaaaaaacataaataaaaaaaggctgtttaagactttctgagttcggaagaaaagcccaatgccattaattaatggcaaaattacattcctaattagcccatttaaaatgagcagaaaaattcatttgaatacatttattaaaagaaaccattttttaatgatttcaaataaaaaaaaattaatactcactaacaaatggtgataaatggcactaagtaaaggtaaaagtgcataattagtccaccaaaagtgattataaattttttaaataacatttttttacaaaaaacccactattctgtacacccaattctcttttccaggtgcgtattctcttccggcggatgccaatttgctgcgcaacttttgtttcaagctcaacattgctcattttttggcatttatttcttttcattaattgcagataattgcttttaattttaaaaaatatttttacaatctttttctttttatcattggtcaaatcattcaaattttctgaatggaatatgttattattttaaaaattacaaaaaaaaaattatgtacttaattggaataatttaataaatgccctatttaatgccaagattttttattgaattataaaatttttattcatttttacccatttcgtctgaatcctgatcatccgtagatatagactgatcagaactgtgactttcaaaactttcactatcatccatttctgattcttcattttcattttgttcaatttttattttatcattaccaattcttaattgttcatctatgccgttaatgggttcgtttttaatggtaattgtttcttgcttaatgctaattggtccattatctatgttaatgagttcttgtttgacaaaattatcttcatctaagtgttcttctttaattgaggaaatcttcttttcaaattgtttttcatcctcatactgagtttggtaatttgtgccatttacctcattttgaaaaaataatataattaaaataaaaacaataattatggtttttagcattgcgtaaatagtttcaagcaaaaaataaataaatttgttttttaaattgatgtttttatttaattaatatatcatatatatatatatatttaaatattaatattacactattgccaacacataaaaacatccgtttgataaacctttaaagaatttcatgtggatatcataaagctcattaaattattatagttgattatggattcacgagttttcctgcggaaatcacgtcatcgccaggctttacatagttattccaaagctatttcagggcttttttcattaattatattatgatgcacttaataaatcctgtattttaaattaatttttaattacatacagcaaaataataatttttattttaaaattgaaaatgtcttttaaatatttattttaataaatgcattttctaaattggaaaatgcat

SEQ ID NO: 8827 - DNA, 969 bp, Heterodera glycines
atgggaccagtaaaagtcagtattaccgcccccgcacaggttgtttcaatactttcactgagatcaaatttgtctgtgtgaacggcgttggagtcaagtttatcaaacaaaaaaacgacgcctaaatttgccaagtatcgaaaaattatataaaaaacgaaaactttgcaataaatggcaaaaacattgattaaaatgtgatttctgatagataatttttagtcatcagcaatcaaatttcactgtaataattgacgcatttcacggtcattgctagggttcgttctccggtgcccccaacaaattgtcaacattttttatcagtagagaatcatcatgtataatttaaaaagtttggcaatatttggtaaaagatttttcccagaaattttgtgcaatgccaacatgccaattcggtttttgatttagagcaacataaaaatataaaaacctttattttggggttttggcacataaaaacatatcgcacatatttcaaggtttggtcatattttagcatttttgagaaaaatctgtaagcaaaatataagaaaattgaaaaatacacctttgaaaatcaactttcttgtcatttcttacagaaatttgaaaaaatttctttatttattccgtgtgccaaaatctaatcttcattagctcgtcacttgctttcaaagtttcttgctggcacttactcaattgatgtgaaaattatctttaaaaaaatttttcagaaaaaaaacgaccaatagactttattttcccaattttaccacatattttcgcacatattttagcattttttagctatatccaactctcttccgcctacaagtttacaattacattaataaaaattttcaatactttttataaattaatagatagatagaagatacacgtatatgtttattgaaataaaatgtctctggaaagcctaaaacattcattattttgcttttaacaact

SEQ ID NO: 8828 - DNA, 3152 bp, Heterodera glycines
  misc_feature (105)..(105): n is a, c, g, or t
ggatatgtatacttttggggacccgacatttggggatataaaaatgatatgtataatttggagacccgatgccaagcctagttttgcttgcaaaaaagccttatntaaagattttctgcgcatgatcaccttcgcttcaaatccagttacgtgcatcctttaagtggattcatataaataatattttggcttcccaatttatgaaaagtctcccaaaaaagtttataatttaagcataaatttaatatttgtcaatacttctttattcatttaatgttacataaaataataaatttaaaaaacatataaatccttttacactttggttgaatgattttttgttatgaaataatcaaattgatataatgtattatcaaactcagtcccgatagtttttttgtaaaagaaaaataagaaatgaattttaataatttcctttgtgtaaattaaaataatataataaaaaccttataaaaagagtaaaaggttattatacaattaaaaaatttatgagattgggttcgtgtcctgagggcttgcagcgaattagcttccattttgctgtggcgaaacttgaattacatttaaattttgtttaaatattattggaaattggtctcgaaaggctttccgatattccgtgctaaaataaaaatatcaattaattatttaatttaaaagaaccttgtaaaatataaaatgggtccattcgatgcggcgccaatgttcaacagaattgcagtgattacttgcagaaaccaagcagtgatcggagaggcaattaattgattgatcagagtaataaaacatacacagattaaatagcctcaaacattcactgtgatgatacaacaaagagctcgaaaaacacgatgattaatcgatttggccgagggcaaacctaaattaggagtaattatttttaatgatgtaattaagcttaagcaacccgtcatttaaattttatcaccattccaacaagcaaataaataattaaagtcattatgatgatcagcaaaataataattaaacgggagattgacacacaaactaaataattttttattattttttatgtcatttaatttaccctgaaaaaatcaacaaagcaaccggtgaccatctggtcaccgtgaaactacatttcaccaaaaattaatacaatcagtcggtcaaacccagtgaaaagcattgaagtgtaaattgcacctgccaaataatttattcaattataaaattaatatattaaagtaattaccaaaaccaaatgctgcggtaaatataatctttgtggccaagcgatactcaattaaagtttgtccagaaaaagcgacgtaaacgaacaaaaaatggccagattgttgaagaatttcaaaaaaggagcaaacgaagaaaatttttcggtttatttcgatttttcggtttttttgaatttgttattttttttcaaaaaagcaataaactattctattaatagaaaaagcaaaaattcctctgagtaaaattgtagagctattgaaactctattgaatggtgtactaaaggtttgtaaaatgatagaaaaggcagccaaaaaacatgtgtttgctccttgattctaaaaaaaccacaaagattagttttagcgatttggtgccttttttggcgttttttcccgaaaaattccattaaaaattcaaaaaaatcggaaaaatacacccctaagaaatgatctaaaaaaattcagagaatatacctttatgaattgaacgccaaaattcatatattttttttttgataaaaaattttaggtttaaaaatttccttattgaaaaacattataaaattgaattatcaataaatcagcaaaatttagttttttggttagtttttacgtgttttgctccctaaaaatcattaataaaaaaatttaaatgccttttttcatgtctttttcggatttttgtgcctttttcagtgctattttgcgctttttggtgccttaattgtgagctctaaccataactttagggccggcggtgctgataagcgccgccgggaaaatttttttgtaattttaatgctatttgttagcagattttgtctaaaaataccaaattttgagattttgggctaattttttaagaaaagctagctttttggggggtcgcggtgccgataggcgccgccggaggaaaattttaagaatttttaatgaattttgttaaaaaaatggccaactgatttgtcaaaaaagtcggtcgattgtttcggttttttaattatttcggtcgaacggttttggttaaaaaaccgaaaaaaaccgaaaccgaaaaaaaccgaaaaactcaaaaatttctcgatcttttttgagatgttgcgaacaattgagcccatggcacaattagatattttggtacaaccattgcaccaagtcggaacaaaaaacaacccatgtatttgatatcgtagtcaaatacagtcgggtttttgaattttcgacaattaaaaaatgattttttagaatgagaatttatatcctttttaatgtatatttaatgtttcttttcccttttggaaccaatttaattatgatacaaaaaatgaagtgattaaatacgggtgttttttcatacattttattatcatctcaataatatttggaaggtacttacgagaaaaaatatatttaaaaatgggatttttcatgcagttcacaaacaaatcacagtgaaaaaattgtttgagcaatgaaattctggcgctagaataattggccataattattattacttgaatttaatgcccaaatgatggatggtaagtttcaacaattcacctgccaattaattaccgaaattacacatttttctccaataatgaaatgtcattttttctgttttatgaatgttaatcatatgcacccaaaatgaacaaatgaactctagaaagaatttgtatgacaataattgtttaaaaattaaataattcttaaaaatttttgcattttttatatatacatgttgttggactcggctatcggtgctattacattagtcaaaaatcattaaatgagaatattttttcatgtaacttgctatgacattagtcaaaaaccattaaatgagaatattttttcatgtaactctgctcaaaagcactaaattttaatt

SEQ ID NO: 8829 - DNA, 1242 bp, Heterodera glycines
  misc_feature (110)..(110): n is a, c, g, or t
  misc_feature (142)..(142): n is a, c, g, or t
tttaattaaagtttgtaatcccaatttttgcccgtgctttcattgggctgtcatcatgacaattgcacctatgagatttgatgaagacgattggtaatgcatttattacnccaataaaattttaaaattaaaattaattctntaggaatgtgttcatgggcaagaactcatcgttgggtcacgcatgcttttcaacgcaaagggactactgcaaacaaatgcaaaaaacattgtgtcctgctgtttcaaattgtgtccgttgaatttgttaaacagcggtgcctgcggtgccattctccgctcgtccaccttttgcgtcaccaaattgaacgacatgtgcccggcataattagcaattgcctaaagaacggaagaactaattgtgagaaaaacccctattgggatgttgttaactactaattaatattaattaatctatgattaaatccatgtgtttgatgagtcatatttcaaataaatgctatggaataacattcatacatagccatttggattttataatcattttacggtaatattttgtcaaaaaattatggttaatgaaagagggcggagtcattattttaaacgatcaatatgatattgatgaaaaattatttacaactaagctcaaaagcaaccaaatttttaattcttgatattattcgataactctaaatattctctatcagtttaaaaatttcaaaaaatttcgttaagtttcaaaagagttagggccaaagatgctcgaaaaaacaaggtttttgagttcctctagccataacttttttgaaacttaactaaattttttgaaattttgagaaaattcttagggctatcgaataatatcaagagttaataatttggttgcttttgagctaagtttacataatttttcatcaattcttttttcagggtaaaattggattttttcaacaaacaacaattttaaatcgcgaataagttgaatcgtttttttaatgaaaattttcaacaaaaaactacccataactttggcacaaaactaactaaaattttaatttttgatatcattcgattgctgtaagaattctctataagcctgcatgaattcaaaaaatttaattccgtgaaatgagacgttctcgtccattttcttcttcttatctgcgtcagctgctgctcggatgaaggttgcagatttggtcacttccagtgcctgctttttcctctctcttctttttcgcttctctgctgctgctg

SEQ ID NO: 8830 - DNA, 2333 bp, Heterodera glycines
attctggcatcatttgaaagctctatgtgtgctctatatttacatgccaaaatagaaattaatgattcaacaataaaaaagttatggcacgcggcgccgaaaaagccaagaaaaagtcaatttttgaggttttttggccataacttttttgtaaacggatgaaattttttgaaattttgcaggctaatagagaatctcaagagctatcgaatgataataaaaatatttaatttggttgataatgaaaaaagttatttgaatcggcgccgaaatggcccgcgccgaagtggccggttcccatttaattcatcataattcatcatttggcccatctattgattctaatccaaaatcggaacttggccaggcgagagaagcacacgtggggtgtcagacagcgcgacacgcgcagtcgccagtgctcctcattgatggcactcatgcacttgtcaaaatcttaaaacacttcttccacctttattatattccgaaatccaatcgaatgccgcggcttccctcccccccccccctttttcccgccgatggctttgcctcttttggccgttgcttttgcttttaccttcaaagctttccaccgacgagcgtgccaacattttcgattgcatttctgaagaaaaattggactcggcacggaaatgccaccgttcgttgagcatttggcggagttttgacatgtcaatgggccactcgttgatggcaatgtttttgtaggagtggcgcaggtgataaaagtgcgcttgtcggcacggcacacggacctaaaagcgaagaaacggggagatgggaatgagattagaaagagaattggacgaccggactgaaaggaggggggactgacctggacgaagccaaaccgatggatgcccgattcgtgcatgttcaccttcgaatgggcaaacaagcatgagaaacggcatcctaattatggtcgttaattggttgcccactgtgtccacgcgactcgcattgaccgccacgcgcgttttcatccgccacactttgcaactcgtcttccatttggagtgggcgaggaattcgaaattgaaactgcgcaaagtgttttgagtggatgggtcggggagaacgaactttaaagtgggggctaatgaagcaaatagcggaataattaaaagcaattagcaatgataattaaggaatagcaggtaaacaaaggaagcgaaaaacgcacttggacatcgcgatgttcgaagagcaaagagccggcatttggatgctgatggaacagatcctaacaaagggaacaaacggaagcattaaaaagcattcacagggagtaaaagcattgcccttttgaccttgagtatgtccacgtttattcccggccgaactttcattgggtccaatggcatcaacctgaaaaagcaaaaagggaccgactgatcggaaggaaaagaaaaaacgatcaatgcgatcgatggcagacggacatgtcgtcgatgtccgttatgaccaccatttcggcgaacggcttgacaaagtgcagacagttgacgtgagactcttcaatgcctcgggaaaggaccaatccgttgggattcgcatcggaaagcaccggccatttgggccacacgcgcaaatggacaatgcctgacattagtttaattggtttttaaatgaagatttagcacaaaatttgaccaatgcgctgatactccgtcagaatttgaattgtgtctgccgaagcggattgaattgggaaaaccttaagggggggggggggggaaattgaggacaataggcacagtttcagaagaaaaccattttggaggcgcccaatgccagccaaacttcgatgcccgtcaccataatttgccattcggtgtactgtacaaaaaggcatcttggtcgggcactctcctaccgtgtccgtgttcctaccgtatacattggtgccacgcaaacgaccaaagggaactttttgggcccaaagtgcaaaggcttttccaatggcacctcaatggaatggtcactcaatgcggaagtggcaagggacagaatgtgccgatttggagtcagcctgaaaggggttgttggactgacactctgagactcattttggcatttttaccgaatgctctccgccgttccgtccgccaattggcactccgccaaatgtccgccccacgcgcaaatgtcgttggccgccctctttccctggtgaatgcgttcgatgtgcgcctcactaagcacctttttgctgtcttttccttcgctaacacagaacaacgcgtgcgtttgacgaacgtcgccgagaattgaaacacccaaaacggacgaaatgatcagaaaag

SEQ ID NO: 8831 - DNA, 2035 bp, Heterodera glycines
gggggtttaattagcatttgaaaggaggaaattcgagtgagtgatcagagaggaggagagacggggctttcccctgactgatcagtgaacgacgagttaaggccggggaattgcttttagcggaaccgatccgatcggcgtaaaagagccaacgacgaactccggtcaaagatgagaaaagggtgctcaaaaacgattaattatgaaaaagcattggctttttcgggtaagaaatgttttattcgggagagaaacgcgcgaaaatgaaaagctaatcagcggatcggatcagccgacgaacaaaaagcggagatggcaacccattttcgactgctcacttgaaaatgggcagaagcagaagaaaacttcctcgttcaatccaattccatttggtaaatttactaacaaataagctggtcaatgtttttaaatggctaaggaaggacagaaagtccgtcaaaaaaaagctgaactacccatttttttcttacggtgatttgaatgtccaaggaaacgctttatttatcaattatcactatatgttaattattaagtgcaccaaacggaagtgacaacaatgaaatatgaaacgaaattatcattatgttcattgtcagattattctgccaattcctccagctaaaatatatgatgagtgattctcggattcgcgcctatccatcgcatattccacacttctgttcaataagcgtgctttgccacaaaaagtgattcagcggcagacgcggctgcctcctcgccggtgtatttcccctgctgagcgtcgccgttggcctaaaggaaagtcagaaatgaaatgttaccgaggacagcataaaagaaccaattgctgggcatcatcagtcgccccccccctaccttggcacggtgcagcaacactttctgcgcatcgcccaaattctcgtctttgccgttccattttttgatcactgacgactgcagcgctcttccgtaggaaaaggacagcgtccacggcttcggcccgggcacactgttaatggcgttaagattgtgtgtagcctcgatctcggattggccgccggagaggaaaacaatgccttgaaaaaggaaatgcaaaatgcgaaggaaaggcactcattacgcaccggggacggcaatcggaacagaacggcggagggcagtcacggtggcgagaccaatttggtcgggcgtggccttgggcgagtgggattggccgggggtgaccatgttcggcttgagcagagtgccctccaggtaaatgtggtggtcggccaatgctttgtaggtgtaggccaaagtcaactcagtcacctaaacaaagaccgatacaacaattaaaaatgaaattgaaaatgtgtgcaacaaaacacccgatgatcttcagtttttaaatgctcatccgcgtttcaacattttctctctatgattaaattgctctcgaagactcaaccaataaattttgggcacattggtcggactgggctaattgtaaaagcaaccgatggccaacaatccaaatcaaaccttctggcatcgttccaagctgtgttcgccgtcacaaagcacctccggctccacgatgggcacaagtccgttctgctgacaaatgctcgcgtatcgggcgagcacattggcattctccatcaatgccaaatgggacggtttgtgggcaccgatgttcagcacacaacgccacttggcaaagtcacagccgccctttttgtactcggcacagcggtccgacaatttatcgaggcctaaaaatgttgtgtcattgctttccgaatttttgggttttgctccaaaacagaccctgggtcgtcccctcatcgagagtgccggccaatggcacaactcccgtgtccactttgatgccagcaacggctcccgcctttttgatgacgtcaacaaatcggactccgttgtcggttgactaaaaaacattaaaattggacccaattatgcgatgtctgcccacctgaaggaatgtctcatcaaaaagaatgacgccgctaagattctggactctaga

SEQ ID NO: 8832 - DNA, 2238 bp, Heterodera glycines
aatggcacaacgacctgtgctctcgtcagcagcgagaatccctttgcccggctgaagaattttctgagcaattgcgcggagttcgttttgtttctcttcgcttagcggcggtctgtacgagtttccgacttctgccatttggacttcgtttgcgcaattgatttatgtggattaaacgatactgaaatgtaatcagtaataaacacaaaataaatcgaagacaaaaagaatgaaatcgaagacaaaaagaatggtaatggggtgggcgaaagaagatgatatgaataagtgaatgaatggaggacgaaatgagtggggaagaagagcagtggggaggcgtggaaagaaaggtcagggacacaaccaattgataaacaaatgttgtaaaaataataacaacccaataatgcacatgcccaaactgaacattggaggagaaagggaataaataacaaaagtctttatgaggtttcgctgatcatgaatggattatttatgcggtatttttctaaatccaatgtatgggggggcgggccgacggtgccgataaactctgccggaaataatggttaacaaatttgttaacagaatttttccaaaaatggccaagtttagatgttttgagctgattttaaaaaaataaggatgctgttgtggcctaatggtgccgacaggcgccgctcggaaaatttttaaaaataaaattaaaacagaaaatttaaagggaaatttaaaagatttccgtaaaaaacaatcaatagaatgcactttcgcaaagtgtggaggaagaaaaatgaacgaatgctaaaataaaggaagtgaagggagcgaaaaatgatgaaagaacgcacagaaagattatatggaaaagaaaagaatgaaaacagaaagaacgttgacttataaaaaatgagtcattgtactaaatatttgcgtgtttggctaggaagcaaatttatttaattacaagtaaaatggataaaattgcaatgtcaaagtcggaagaacaatcctaacaaaataaattaattaattataatcaaagtcgaaaattaagtccatgggtagttttggcatcacgatttgcgggattccttcgtctcattccaccgtcaccgatttggccaagttgcgcgggcgatcaaccttgaaattccttttaaaaaagaccaaaaattaaaacaggcacattaaatccattgagttcggccacgtggtatgccaacagttggagtgggatgacagtcagaatgttctgcagacagtcgacagtccgtggcactcgcagcacatgctcaacatcggcaagttcagacgacggcaccgactcatccgcaatcacaatgggacatccgtcacgggctttcacctgctgcagtgcgttcagcgagcgctaaaaaacgtgaaaataataaattaaatcaacggggcaattagtacggtggtccgtcccaccttgtacacattgtcgttgcagatgaccatcacaatgcatttgtctttgtccaccatcgccagcggcccgtgcttcagttcaccgctcagaatgccttaacaattgcaaattaaaaggcgggttcagcagcagcgcgaccttcgcaatgcatgtaggagagctctttgatcttcagcgacccttccagacaagtggcgaagttgtaaccgcggcccatcaccagcagagacttctccttgtagatttggtttgcaatttgcaacacctgctggtcaaggatgagcacctgcttgatttggtctgaaaaacaataaatgggggactaggcaatatgacatttatctgtttaattcataatacgaccttttaaaaggtgccatgaaaggggggggggggtttattttcttttattaaaaaatctaggactttctaactattgttgaattgaatgaaattttaaatacggagccttaaatactatattttgggagggagcatttcatccgaaatcctaaaaaagcaaaactttatttcttttaattttccaaaccaaatttgtcatttttccgatcaaaactttgagaaaaatttttaattttttcaggtataacatagtccgaaataacaaaattaaatttttaaattttcatttttttccaaaaatttttaattttcaatcaaaccctttttcattccatttaattccaatcgttgttggtcgatcaaaaaaatattttactaaaaatgatcacacaattttcttctggtgggtttgttgcttt

SEQ ID NO: 8833 - DNA, 2298 bp, Heterodera glycines
tgccattttatgagaaagtaaaaataaaaatttctcacttctataaatattattaaaatttgccaaataatcttattttcttttaaacaaaactaaatttaacaaaattattatccaatagaatcaaaaacaatctattcaactgcatcatcatcacttgcaaccgtcatgatcaagtgaattagaaaatcctagcaagtttattggtagaaatgaaaaattatttaatgcaaaatttagaaataacaaaataattgtaatgaataaaactaattctttaattttaaatataaacaacaaataaaagatacagcaatgatttttaaaagatggaaaaacttttgcttttttatttaatagataaaaaagttattttaaaaatttacaaataagatatgaaattatttataaaatatattatacattgaagctataaacataaatgcaaaagaaagtggggggtctgagtgaaaaattagtgatgaaaattggagttaaagggaaaaaattaagaaataatcataaatatattctttcaaagaaacaataccaatgtgcaaatggcctagtggctagtctccttgacttttcccttcttctttcccctggttcaatccctctacacaaattaaaatattttaaattttctttttgtataatcatgtgatttatgtttaatgtaattttttgattttaatggaaaaatatttaaaaagctcatttggcaaaaatggctaaaattttacaatagaaccttggggtgatctacacccacacaccaagcttcatttggaaattccacggtcacttgccgacccttcctttgtcagaattgaacttttaaaaaaatttcaaagattacatttattttaatatcttttttttatcaatatcttcttataattaattttaattaatataatttttgttttaaaaagctcattttatttttaaaaaggagagaatcgaattttgtactttgaattcaaaaaatttatgaaatgagaaggataatttcttggtcaagtttcaaatgcgaattccgtcgccaaaaagtgacgggtaatgttggaatttggtccgagtagggggccgttttggtactgaaaatgtagtgacattaaatttacattttaaaatcaaattagctggtttacttttaaattttctttttgtataatcatgtctttcctatcgacaaaatatgattcttaatttttttaattgtattttatcattttttaaagaagctccgtacaaattgagcctagtaatcccaaaaaccagccttttttttgttgaaaatctgttaacaaattacacccaaatttcgtaaaaacttttttagaaatagttttaattttaaaaataaaattaatgtgttgcgtttgatagcccgtgaaaaaactttatatttggtgagttgaaattttttattatttttaaatttgaaataatattagacatcgatgaattaatttaccccaagaatatttttattcttgtgcgctacttcctgacaggatggttcagttgactctatacatttcttgatttttttaaagatcaatttattaagttagttaaaagaacggattttaattaaaaattatatttgctattataaaattttttcaaattatctaaaaaattatatatgaatataactgatgaaaaataattataataaataaaattattttttcagctagctaattatttttgtaaaataaaatcatattatgattttttctgttgacgggtcaccgaagataattattatttaggttaaatatattttcacaattattaatgctttcatattaataagtataggtaatatatttttttcaattattatacatataaataaaaataccagaatgcagcttttcgtaaacaaatgaaagagttataatatttaatttttttttcattaaaaataaatactaaatattcgatttttaattcttttaattattttttattatgctatgtacaggatataataaattataatttattcaaaattattcaaagaaatgtatatttgcaagcatcattttaatagggtattttgaaaattcaatattcattttgataaattttgtgacttttttttaattgatttttcattaaaattagtaagaattttttattaatctaaaagtatctcttaaataacaaaatctattttgaaactgtgatttcttcatttttaaattgttaaataaaaagataaaaatagttcataaagttattgcgaagatcgattatttaataatttgttttacaaaa

SEQ ID NO: 8834 - DNA, 2161 bp, Heterodera glycines
aaaaaattccgcttaaagattttgtgcaatttaataaccataacttttctacaattttgtaaaaaaatttctaaattaatattcttgtagagaacaccatgtgctatcgaatgatacatgaaatatttatttggttgcaaatgaaccaagttatgaatttatgtcttacattttttgttttcctatcacttggcggtttttaggaaaccacccagcacgtaaattttgatgttatattattataatatttaaaatatcacatggcgagttgtgtatagtctgtgtaaatgtcaacagcttcgtatgatatagatattgagtcttatcaattaaaaaatatatatatacaaaaagcgaaagacgaagcctctaatttgttgaacaacttgatttaatgtaaaattgaaaagaaatgtttacatttcaattaacaaaatttatatgaaattctaattatattgtccttgttttctgcaattttcaataaaaatatttataaaaaaataatttaaattcgacaggagattcccgagcggctccggagaaggaaaacttctacgtccttttcacttccccccccccccttttcgattcccggataaaattcatctttggttctctttcccactcccctccccgggccgtccctcaggattctcctcttttcggccattttcactaaaggaacacttagaactcggaccatttccattttcaccaatttctcatttacgtaatcttatttttcaccgattttcatattaaaatcacaaccattctcacatttaatcacaaccattttccattattttaaaataaataaagcgatcaagttaaatggataatggagaagtaaaaagaaaggatatggaaattataaaaagcggagaattattttaagggatttagacaattaaatatggaaaattggggaaaatcacaattatcccggggaacccaaactcgggaaaagttgtactttcggcctggcacgttccctttctaaattaattaattaagaaattttaaataattttcatcttgcaaaaaattaaaagttaattattttaataaatacaagatatttaattttctactaaataatttgaaaacaataatacaaatattttgtgataaaccttaaatatatatagaaaaaaatacatgcatttttatataaatatatttatcttttaatgcttatatagaacgagttaatatcaaataaataatgcatttatataatattcaaaaataggacaattaaatcataaatttaacatcatttaatagtcacaaaaacattcaaaaaagtttgattttttgagtcatttttcaaacacagttcgaacagttctaaaccgatcgaaaccgcactatttttcccttatagccagtccaaaaccttatcgaatgataccactcccgacccataaaacgcgctaaaaagtcttaaattagtttttaagcttgaaactggggtatattattcttatatagggaactgtaaaaaaacattttatactaaattattctgtatatttttttttattatttaattgttttcggtttttgcattttcgttaagtaatttggggaccgccatgctgggcaccgccacggctgccgcctcgtcctccttggtcaccgatgccgccattgttctgtcgcagaccgacactttgtccaccgcgggcttcgctgcccttcctcgccccattctcgtaaatgcaaagcgcccagagcaccatcagaaatatctagtagtatgagagtctataaataagcactcagaccgacccataaatcatgtgtacccaatttaaaaaagcatttttgagccccaatgtcacttttgaagcatttgttgaatgaccatcttcatattcgagacggagtcgtcgactaaataatcgttttatgatatttttaaaaagaaaatttgttcttaccacgaggaaagtgaggccagcagttcagactgtctctgctgttcccgtttgttggtaatgtcaatttgttctttcggtccataaccaataattggattttctagaacatttgaaatataaattattgtttattttaactcccactaatcttttccaaaccttgtcctccaacgatgcgaaatcggtttgcgcagcagacaacatgccga

SEQ ID NO: 8835 - DNA, 1996 bp, Heterodera glycines
  misc_feature (1967)..(1967): n is a, c, g, or t
  misc_feature (1972)..(1972): n is a, c, g, or t
atcaattttaggaagttggagatcagaaattaggcctctttatcatccgcaaatagcttaatttcaaccttttccgtgtgacaaaaatccgtaatatcatgaatatatatattaaaaatagtaagggccccaggatcgaaccttgcggtacaccactcaaacaattatactcatcagaaaaagatgagccaacttttacataaaaggtacgattggacaagtaatcactaatccatttaagtaatgaatcatttatcccaatgtttttgagcttagagattaatcggttgtgtggaactgtatcaaaagcttttgccaaatcaaaataaattgaatcaattgctttcttttcttctaaagcttggctaaaatcatcaactacttctaagagttgagtgataactgatcgatttttacggaacccatgctgacattaaggtaaaatcttattggtttcaacaaaatctcttatatttcgagctatattttcttctaaaatttttgacattgtacagagcaaagaaattggacgaaaatcaatgggattagcaggattcggaatttttgggattggacaaacaatcgattttttccatattgtaggaattttgccacacattaatgaaaaacagaaaaggtgaaataatggagctattaaagtttctttgcagtttttcaaaagaatgcttggtataccgtcaatagaagtattgtttttatccttaagtttacataatgaaaaataaatttcagcatgtgttatagtaaaaaaatccatacttttttccagagattttttggaaccagtgggttcgggttcaatgttttgactagtgaaaactgagaagaattgtttagccaaggcgtcagatttatccttattggtaaaagcaacctttgaatttttatcgtttttaaaaacaggtatgctattgctttttgttttgacaaatgaattaatatagccaaaacgtttctttgcagaggtcgaatttagtaatttgttctccttgttcttataaaacttcgaggtttcaaatgtaattttcttagaaatttcaacatatttttcccttattctttcttttttaatgtctttccaaagtaatttccgataattaattaatttctgaatgtgttcaggcaatttgggctcaaaattgctttggactaatgggacatattctctaattaaaaacaacaaaaattgattaattttatgaaacattgagtcaatctcagtgcaatctgaaaagaaaaaattccagttaatcgaataaagaacagagttaatcgctaaataattagctctacgaaaatcgaaacctttttttagaattttcttagaagtttttagcttaatttcacatgaaatactgttatgatcacaatgttaaagggagggccaacaagcacatttgatattaattgtttattatttgtaaatagaagatcaagaaaaatttttccctcttgtcggtgagataactaattgctgaaggctaaaaccatgaaggaatgataaaaaaagtttttctaaagatttttcggtcagatttttgtagatatcaaaatgccattttagactaggaaagttaaaatcgccaaaaagaagacaattgtttgattgttcaattaaaagtgataatacttctaaaagttctaaaaagtcttcatatttttcttgtgttactggcctataaaccaaaattaagcgaaatttttggtcggaaaacggagaaagaatatctatgcaaattatttcagaatttttgtgttttggtattttgataatttcaaaaggtatctgattagaaatgataaaggctacgcctccaccttttttggttttttctatcattacgtacaattgtgtaaggaaaattttggactataaacgaattatctaacttattgctcatccatgtcctccgagatggcataattttttatattttgttttctanaagtnagtttttttaaatcatctaactta

SEQ ID NO: 8836 - DNA, 1550 bp, Heterodera glycines
gaacgaccccacttccctggggtctattagcctttccgccgaaaagctctcgcataaaaaaaaagcaaagcctaagccctcctaaaaggctggacggttatcccttcctccccgagtaagaaatcagggagcaggaatgctgacaaagttagaaaaaaattgacgggatccgggccatgacaccaagagccccaccctgcaaatctccgggcaattcttttttgatttttccgtatggtttgccccgccagcggatgagaagcaaaaacattgtcattacataacaaataatcactcgccactcattcataataaatgaaaagcaacgggctgaaaaaagccaatgttagcatattattcaggcattatcgatttgtttattacgtcaataaaatgagaaaaaattgagcaatattaatataaaaaaacaatattatagaatatttcaaacaaatatttccattttatgtaaaaatgaatttgttgtatttaatatttattataattttctttatttttgtaattgactccgacaaaattcgaccaaattttgatgaaatatttggcaacggatgggacaaaaaagaaagtgagcaaacagtgaaaattgaacaaaatgaacgaaatgagaactcacaatcagcagcagttgatcaaatgggtgaagaaatgggaaatgaccgaaatgatcaaatgaaaaatgatcacaaaaagagagaaataattttgaaatttgaagcaattaaagaaaaattgagagaaaaaggaaaatacaaatggaaagatcaaggcaaaattgagacaaaaattggaaatttattaggaattggtcgtcataaaatatacaaatggaaaaatgaattaaatctaaataaaaataaaataaaaaaggaattttatgagatgaaaaagagtgaattcattaaacgatttgatgaatttaaagatttatatggccaaggcaaacagaaagaatttgcgaaggaattgggcatttccaatgacacattttggaaatggaaaaaaagaattggtgccgaattaccataaaagtcaaagtagaatataattttagtaaagttaaatctaattttaatttaagagcaatttaccaatgaggacaaactgaaaaagatgaagcaatattttaaaataaaagaagcaaatccaaaaattattgacgaaataattgccaagaaattgggaattggaagtgcaactctgaaaaaatggaaaaaaagaatgctctcatccatttgatcagtgattttttatttgattctaaactataaaaatattttgtagggcatctaaaactcgccagtttttttagcattagaaaaataaagcgaaaaatttactaattttctttttttgtcaatgcttatgaacaaaagtaaaaagttagtaaacatttttattttccaacattatttaactttatcaaaagccaatgtaattaaaaatgccaaaatttctaccggcggccccctaccggtaccgccggacgtcccacctagggatgtgcgagagtctccgttctcgattct

SEQ ID NO: 8837 - DNA, 1512 bp, Heterodera glycines
  misc_feature (1373)..(1373): n is a, c, g, or t
  misc_feature (1447)..(1449): n is a, c, g, or t
ttctgacaatggcacgcaattttcgagctcagaattcgccaaatttgttgcggccaacggtatcactcattttttctccgccccaaataatccaatgtcaaatggacaagtggaaagatttttcgacacatttaagagagcattcagaaaattaaaaggggaggggaagccaaacaaggaaatcatcgacacttttctgatcacctatcggacgactccaaacgacacacttcctgatttgaagtgtcccgctgaattgctgctccgtcgaaggccaaggacaacgattgatctccttcggccaccgccacaccaaccatttgaaagtgatttggagatggaaaggcatttcaaccgtagatttggcaccaaaaatcgaaaatttgttttgaatgacaaggtttttgcacgccatcgctcctcgcaaaactggaaattggagtgatcagtggcacatttggagtgatttttgacgtcaaatttcccgacggatcattcggccgttttggcgccaatcaattgtgcgacaggaaaacagccgacaattttgatcagtccttggccatattaaatgaggcatttgatttgccattgcctccggccccgaataatgcgccacccgaagaagaaaatgccaatttagggctcaatcaactggaagatgaggctgcgattcccattcaggacaatttggctgctccaattgaggacgtcccaattcaacgacgcttctgttctctccgtgttagagacagacacacacatgcatattgattgacctttgcccttcccaattattcctccccattgagatataattcattctgttgttttccccaatttactgctccgctcccccgtttttgcatttatttgtaatttattatttgcgtaataaatttatttgttgtttggacttgtggtcctaacactatgcccatggcaaacagaaagaatttgcgaaggaattgggcatttccaatgacacattttggaagtggaaaaaacaaattctgccaaatgatcataaaagtaagggtttttctttttaatcatataataattttctattcagataagtgtttttcctactaattagagcatggagaatccagaaaaaaatatgcatttgcataaaattgacatccctacgcataacaaatccatggtttcgtgcaaaaattgactcaaatgaatcttattgttcataaaatgattcaggaatcggacgttgtacgtagcgaatacggcgcattttctggtcaatgtacagcaaatgtgttcatttgttcattggacgaaagcccgcatcccacgacctggaaaggctcaacaacatgccaacataatgtgtccacgtgccagttctcggncaaattgtcccatcgcatccaaccgactgtggcgccgtttaaattttgaagataattcgagctaacttacgttnnnaatgttaaaactgacaatttaccaaaaaaaatttcttaacaaatctaacgcaaattatcttaa

SEQ ID NO: 8838 - DNA, 2287 bp, Heterodera glycines
ctgtttttcttcttcctttcctgctgttattcttttccatttatttttttgattttcttttgcttccttttaatgatattttggaaagtgcaaatgtccaattccgaaagtgttccaccttcgcccacttcgtcatccgctgggggtggtgatcctctgacatattccgctccagtgaaccaacgaagcatggctaggatttcggcgtccactcaagcggcgagtgagttaaagaactttttgttgttttttcaagtctattttagccatgatggtcaattccatcccggctggtcttgctgcgccgcaacaaattccgcaaacttcccaagtaattgccgcaactgttattagtgcgaccggtgcttctggcgttttgcaattgggtcagcaaagctcaaattctgaatttctgtcagccttcgaatgtcccgtttgtcttggtcggtacaaattaaaaagtaattcctaatctttatttttcaagattacatgcttccgccatatctgcaatgtccatcgggtcatctggtttgtggaaattgtcgtcctaaagtcactgcttgcccgacatgtcgaggtttgttatttgatagtcattcctttcttctaaatgttaaatacttctaattcaggtccaattccgagcataagaaatcttggaatggagaaaattgcagcaaggtttgcgaattcatgcaaaagacattcactttccttctcacaatcagcctgcaatttccatgcaaatttgctcattccgggtgcacccaattcttttatcatcatgagaaagttgagcacgaagagatttgcgagtttcggtatactcaaataatttggaaatttattacttgtttttacttagtccttaccaatgcccttgtcctggagcttcctgcaaatggcaagggagtctggcagatgtgatgagccatctaatgaaattgcacaaatcaatcacaactttgcaaggcaattttaaattcccatacaatattttgtctttctttcattgactcccaattctgttaatgcccaaccaacaggcgaagacattgtttttctggcaactgacatcaacctccctggggctgtcgattgggtaggctttgtgcctgttttgaatgtccaaactgcgcttataaggtaatgatgcaatcgtgctacaacgcctttttcatgctcgtcttggagaagcaagacaaacaagagttaaatttatttactttttcgcgctgatttacacaattcagacaatcaggtcaaagctaccaaatgttctacgcagttgttcaactaattgggaccaaaaaggaagccgaaaatttcgtttacaagtattcatatttattaggctagtacataattttattcaaaaaacatatttcaccactttttaaactaagaatttatttaagattggaattatccaacaatcggcgtcgactttgctgggaagccagtccacgaagtaatttaattgacatgggttattaccaaatggggcacaccagacaaaaaacaagcaaatttttatttaacaggtattcacgagggggtcgctgccgcaatttctcaatcagactgtttggcttttgacacaaatcatgcgaatttttttgctgaaaacgggaatttgggaataaatgtaatctgattttaattccgttgatgactagactaatccaatcattttaggttactattcaacgtgctgaagggatcaatcgctgatagatgcatcaaaaccaaattttgttgtgcataatgtctgggttttggagtaccaagaaaagaccaaaagtacaaatttgtatgtaggttctcgtcattcccataattaattaaacacattcattgactaataaaggagaatttgttttttgtaatgtcttcttctatgacttgaggtcgtcagtgttcaccaggccacgtgctcggttcaaaatgctatcctaaacacgaaaaacgaattagtttcatttaagtaaatgtccttactttggacgcgtcataaggcatttctttggaggggatttcgagcacggccgggatgctggccacgtgttggtccacctaaatggtacaaatttggctctaatgcactttatgagtccaatcgacttttatgagtccaatcgacctttatgagtccaatcaattgacaattccgggtttttatacaataactttgttcatgttcgaacaaaccctatctttttggtatcactcgaaagcacaaagtcaaaagaatgtaattatacgagaaaacaagagaattcta

SEQ ID NO: 8839 - DNA, 2871 bp, Heterodera glycines
aacatcacagaatcaaatcactccttccattcgagttcgagcacccgctgcaaaaaacagtacaaatcgacaagtttggcgatctgaaccaaaatctgcacagtataatttgcctgtttccccaagagaatgcgttaccgttttggtggttggtttgccggctccgtgccccgcctttgtctcaatgcgcgccagcaccggcctccgctgccattcgcttgcctccgtgcgcagcaaatggtacagctgagcaacgtactttaaggtgtgaagaggcacaacgcggtccttaaaaagtaaacgaatgaaaaaggcaaactctggtaagtacccaacccccgcgtacccctccaaccctttgggaccgacccgctgcagcagacaacttacatcatgatcggcactcatcagcagtgttgccggccaattcacgccgttcgtgaggcggagacaatgaaggggcgagtacctttgtcgaagaaacaatgaataagcaggaaaaggggtaaaacatacctgtaaatgaaggagaagtcgtccggtttgtcggggtcgccatattcggtagcccaagcagcgccgacggtgaacttgttgaaacggagcatgtcaaggacgctaaaaaaagttcataataaatagcaaatctgctgttattgcttacttacccaacacgggtgacgacggccccgaagaggtccggccgttgttgagagcagactgccgtcagtaatcccccgttggacccgccatggatggccaacctgaaaaaggaattgcgagttttacgaacggataaagcgccacaactcactttttgttgttcgtgtatttttcgctgatgagaaattcggccgcggcaatgaagtcgtcgaaaacgttctgcttacggccgagcatccccgcctcgtgccatttttccccatattcgctgaatttgaaacaataaaccaaaaaacaagcgatcatcaataccttccaccccgaatatttgcaattactgatacaatgccaaaatgtttagcgagcatcaggcgagtaacggagaaatatggagtctgagcaatgttgaagccgccatagccgttgagaattaccgggttactgccatccaatttcacgccttttcggtggacaatgaacatcggaatctgttattaatgttcaaaatgttttaaagttcgagttactcacttttgtgccgtcatcgcgtgggtagaaaacctgttttgaaaatttgttttagtcagtgaaaacgttaacttttaacacccagaacctgcttcgagtcgaatgcatcacagtccaacccgggcacattcacgcgacgggtctcagtcagttggagaggcgactcgcgggacggacattttgagaaatcgccatggaaaaggatgaacgggacgaggaacgactcgaagccgatgaatattttggactttgacttttccgcaaaaacaccgcccaccgacccgatcggcaacggcagtttgtaaagctcacgcccgtcgagtgagtgcacgtagagcgcgttctaaaaacaattaagccgttgtcctatgactgctttcgaaattctcataaacggtcactcaacttaccttaacatcctccaagtagcagatgagaagtttgtcgccgtcaacagggcacgcccaccccaagttgcgttgtttgtcctcctcaatcacaacctgccattgatcgttcgagttgacaacgccatgttcgccaagtttgacacgcactaatttgaacatcggtgcgttgtggtttgtcaaaatgagagccgaatgttcgtccgaatccatcacctcaaaaagaaaaaaacaattagaattagtaagtgatcggttacttggtatttggcatctgatttattgaacaaaggcacaagaggtatcggtccatttattgcttgtccctttgtgtccatataaaatagctgcttggtcgggtcattgccaatttgggcagttacaaaaaaaatattcttctcttccggaagaatcgcacatctaataaaagaaattacaaataaccaaaacttgaatagacaaataaaggaaacgtacttctgcgaacatggatcatgcttataagccgttgagaattgccgggttactgccatccaatttcacgccttttcggtggacaatgaacatcggaatctgttattaatgttcaaaatgttttaaagttcgagttactcacttttgtgccgtcatcgcgtgggtagaaaacctgttttgaaaatttgttttagtcagtgaaaacgttaacttttaacacccagaacctgcttcgagtcgaatgcatcacatcctccaagtagcagacgagaagtttgtcgccgtcaactggccatgctctctctaattttcgttgtttgtcctcctcaataaattcaccatcgcctggctggacgcaactaaaaaattcaaatataaaaacgaacaaaaacaaaaaagcatacttgttggactttttttttgtgtgctcatactaaattgagaaattttttagacaattactgttaaatattaccactaatctgtccggcgatcccaagcccatttcatggaaataaacacatttgtgttcaagtcttttcgtcgagctcccaccggcaagcagctcagggtacgtcttaattgctttttttattgatcatattggaaaataacgaaccgagtagtaaatgcccgtattgtcggtattaacttttgaggcatctcattgactctgacttccattttattttttcattattgtttgttttaacctgtgatctcactcgatatttattcacttactctgagactactttactgtgatcagtcatcagagtaagtggtctccgcccttctg

SEQ ID NO: 8840 - DNA, 1164 bp, Heterodera glycines
tcacgcgacgggtctcagtcagttggagaggcgactcgcgggacggacattttgagaaatcgccatggaaaaggatgaacgggacgaggaacgactcgaagccgacgaatattttggactttgacttttccgcaaaaacaccgcccaccgacccgatcggcaacggcagtttgtaaagctcacgcccgtcgagtgagtgcacgtagagcgtgttcttaaaactttttaagcgaaaaattgaaaattcgaaatttgaagtttcgattttttcgaatgtaattggagcgagtgttttttaaagaaaattaaaatttttcggtcagcgttaacgggaaaaaattagaacttagaatgattttgagtatgtagagtgcagcgggaccgggaaatttgggcaagaccgggaccgggactttttgggttgaaaacccgggactttttggctgggaaaaccgggaaaaaagccgggaatttcccggtcccggtcaaaaccgggatcttggtactcagttgtcccaggtcccggtcccgctgcccctctattttgagaaaaatttcaaaatctgaatattcaaaaaagcaatcgcttcgataaatttccttaaatatttagtcccaaaaatcgggaccaggtcgcggcgcgccgcgcaaaaaattgccgcggtcgcgaatcacgcaaaaacgccgcgaatcgcgggtggcgcacgcggattcaaaacattagacataaaaaaccgaattaaatttgtatcataaaatatttacttttattcaatgaagttcgtcattcatacatatcaattacaaaattataattaaacaaaaattccaattttttttactaatcattagagaccggatttttatgtgctaaaaatcctgaaatatgtaataaaatatgtgttaaaaaaacccaaaatatgtgctaaaaacccgaaaaatgccaaaatatgtgttaaaagtgtcaaaatatgtggtaaaaattttgaaaaatcaagtgttttaagcaaaaaaaaaatcccagtaagtctaattctttattcatttcgccagcacaattgcaaattaaatacatttcaaggtgttctggggtaaaattgcctttttttgataaatcatttctataaattgaaagttccagcagagaacttcgaaatccaatga

SEQ ID NO: 8841 - DNA, 4397 bp, Heterodera glycines
ttggaaaattcttaaaaagccacaaattaaaaattaatccactttttggccttttcagtccatccaaacaaatgttggttaaacaacgacttgtaaatgtacaaatacagcacaaaggcgccgatttgttcaattttggccatcgtttccccaaatatttgtccaaatgccttcaaatagttgccatattcccaaattctgcccatttcggcatccaattttggcttgatcagtcggtgagtgcgcatcagcgatcggcggcccactttatgccaaccatttgactgatttgtgtaaatgttggaaagttctctgcgcaggttactgtaaccgtaatgagtgaggaagttgccaagtgcttccctggcgtcgaaaattacaccgccatttttttcggtggtaatggcattttgccgaagaaattcggaaagaattaaagcagcggaagaagaattgctgttgttatttggagaagaggaacgggaagaagaagaagcttgtccacctaattaatcaatcaattaaaattttttgattttatctccaaaattccctcaaaatttcctcctctttcgtcggtattttttgtccccataaaaacgtgccatcgtttggcgttttgccttcctcctcctccccccactgctcgttgatcgccagactgagtttgatctgtgcccgcaccaccgtcaccacccaatcgcccgtgccgcccatttcgccaatgattcggccaatttcgtccccattttgcattgcctcgccgaatcgttgcgacgtttctccgtgcgttttgtccaccgtgcccaattggcccaagtgcgaattcgccgcctcatttcgtgccgatttgtcacgcgtcttttccattctccgtgtgaacgctttccccagccgttctctcgtctctttccgttcgctttccgtccgattgatcagtccctccaaatctctgcttttctctgtcaacagatgcttcatcttcgcttcattcagctcgtaactgaattttcaatcggatcatcaaaagggaaattgggcaaattggggaaggttccaccaaatactcccgccgaaggatgggccccatggagtaagtgatcagataaaggaccctttttcgggaagactgaaacaatttccatagaaatggaaaacattaaatccaatacaaagtgagagtgaaatatgctcgagcgatcaatcttagctaataaaagaggcggtagaagaagcaaagaaaatgacaaattgcgaaataaatgaatttccaaaagtttcggtaggaaaactgaaaattagaaactctctttcaatttcaatgggatgtgttcaaaatcccggatgtttcccctaatctgcgctttgacttggactgatccgtaccgtttgctgatctcttttcgcatttgtttcagccattttaaggcaaattctgcgcgactcacatcacatggagaatgaatcttaaagaaaacaaaatggcattttgcaaaattggcatttttatttgcgtaatttttcaattggactttttggtcgattatttcggcaatttgttgttcaaatgtcccgtaaattctgtcgaagagcagcaaactgaacattctgtttgggatggttctcaatttattatgattgttcttcaaagtacggtcgtccttcatgttggtgatgaatccgatcagagcaccgctcaaatcgtggtaatacgggttgtcaacgcatgcatttacaagtgcctgccatcagataattggatttcaaattaagaaaatggagatgacaccaagagcacattcaatggcattttgcaatatggccaccgtggtgctttttttgactaaagtgccgaaaaggcgaaccgcggtgcttttttttgtgcaaaatgctgaaatgtcattccccagtagaaccacctttagtcgtgccataccctgctgctgtccgttgtcccttccgacatttttgagcgatgcctccaaaagcagcaacgactcggccaagtctaagaagccaaacgcctcgaagacgtcgcccatccgttgcgacatcggctccaactctgtctcattttgatgctcaaacacttttctaccttctcgaatgtgcgattcgatctctgcgcgatcgccgtaaacgggggacaacagattcagcgagaaaaagcacgtcgtaattgcagcgagaagaaacggcagcgacaggcgagggtcgtcgtcgctgtcgccgtcggcacggccgaccaaatggcacaacgacgggacggagccgaggagaagtgcagagaagaagcagcacagcaaaagcagtggaagggacggcgaaaaagacgaaaatggcactaaaagggaggggggagggagtcaaaattcgcgacatctctaacacacataaaattgtttataataatcgtttttatcagatctcgattatttgaaaaaaaagctggacctctggacctggattccaggttggactttggcctggatttcctcgacaaaaattcagaaaaatccaggcttctcatggcctggatccaggtcgggcctagactttttcagtttttttgttaaagcaatcaaatcggtaactcgaaataacaagttctaaaatattacacaagaaatcctggttttcatgccaaacctggacctaaatttttttatatttgaattggacttggatttccgggacaaaaactcaggaaacccaagtccaggaaagcccaggcctgctggaaccaggaccaggtcgagctcaaattactattattgttaaatatttttacaatgtttttaattacctcacctctttttgctcttcgaacggaataaaaaagattaaaaaagtgaaaaattgcatttcgaaacattcaaatggattaaaataataataagaaggagctaatgatatgacaaaaaagcaattaataataataatataaaatgagctaatgacacgattatcgtcatcattacccactaatgtgctgctgctttccctcctcattgtgatgccttttatttttcttcgttttttcttcgctttttccgctggcatcgctttatagtgacagcacaaatttggcatggcatttgccatcgctttccttcccttctaataaatccatcccatttctcttccttgaggtgacgcgcgtgttaattaagagaaaatgcgtttttattggcacattaatcgaccaatttaattgtcaaatcggtaattaatgggcagttcaatttcatttgccatcatttaatcactgaatttgaattttgctttcctgtaaaaaacccttccgttttttccatgtgccattttctgcttcccccccccatttttgccgtttgcttatgaatgactcatccatccttaaaaagcgtaatgcattaattaccctcttaattattctcccattcattggcccttctccctcctcctcctcctctgctgatctgtctcttttctcctctccatcttttgcccaatttcttctttttctcattttctctctccgcttttccctttcccttttccctctccctcatttatttttgctcttctaatcgatgtttgtcccattgcctcccccttttctcccccctttttttctaaaattccaatcttttttatttttatatatttaattatttcattttaaatttgccttcttatgtatgcaaaaataaatgttttttcttttttattaaagctttgagaatggtttttttgcggcaattgttcctgttgaccaggaagaatttgttggttatgtggcgcaccaaattttgggtgctttccgagtttttgatgtgccttttatgccttccgattttggcattgatacttaaggcaaaaacagaaaattaaattaaattattaaatttaaaatttaaaaattgcagttcaatcacacggatgaacactcggaaatgagctcatttcggccggggaaaattaatggcaatttcagcgatttgaaccgacgctttggcaatgattcgataatggacttttggtgcaacacttccaaaattttggcctataggtgtaaataaatggaaaattaaattaaatatttttttaaatttttaattaaaatttcccaaaataaaaaacttttcataaattaataattccatttcttttacgttttcttcccttttttcgttatgtcggcgaagcgaatgccgaattggaactgaaggaattggaggagagattcacagaccaaatgaggggggagaagtggttggagttgaaggagttcaaaaacagcagcgaaatgaaaaaggcactgatggacgaccgaaacaattcggcgggcgacgaatgcaatcagaaatatttggtgatttggggggggggggggtgaagccgaccgaccgtaa

SEQ ID NO: 8842 - DNA, 4376 bp, Heterodera glycines
taaaaaatttctcaaaaatttaatcttgaaattttttgtaaaaactttctgttttttttaaatttactactgaagaggccatttattgacacctgaacaaaagccaaaacctaactttacacgtttgttatcaatttggattgaaatacttgagaaaaaatttaaatttttatcaaatcgcttcagggcatggagcttttttcaaaatttgtggaatgttgattaataacataaaaattgctaatcttcaaatttagcttaggttaactcaagccatgcaacgaccttttttttcttttcaaaacagtttttacggctcgcttttttcaaaaaaattttgcggaacaaaggggcggtaagcccggcggtgccgataagcgccgccgggaaaattttgtaatttttaatgcgatttgttaatgatcttgttcaaaaaatgacaaattttggcgattttgtgccaatttttttaagagaataataatttttagaggccggcggaaaattttttgcagattttatacccattttaaatatatttcgccataaaaagatgaaaaaaatttatccaggaaggtttttcatgcctggacctggacccggattttcaaattgacctggacctggatttcctggacaaaaatccaggaaaatccaggtctaggaaaaatccaggttctcaaaaaatgacctggacctggatccaggtccatgccgagctctactaactaggcaccgaatttccatgggcctctcggagcccaccatttctttggcaaatgcaaaaacagaactcaggggtgtgggcgagaaatatttttttacagggactgattgagaccgaaattgattaagggcaattcccaacggcgcttgggccaaatatttggctcttttgtactttaggcgtccaatcaatgaacagcctcagtttcataggccatcacttttttcttgattggtttcaatgcctacattcttggtatcagacaaaagcttaaagcccacggagtatgaatttttttaaataaaactaaattcttagctaaatgcaattgacaaaaagaagccctgaaatataattgaaataatgcatttttgtcttttctcattttagtttcttttttaatggcagcatttgcttgctttttatatttataaattcatgagagtttaagctttcatttgacatcaagaatataagcattgagctagtatgaaaaaagttatggcctaagaaactgaggaaggtcactgattgacgccggaagtgtcacttagattttcaaagaaaaatgcaccccgcctccatgcattaaaagctggggtggccaatttacaaataacagctgaacagcaagcagtacctgccgttgatgtgccaagtcgcatttgttgccaaccagcaaaataggcacttgatcagtaccctaaaaattattttttataaataaataaaatttctctctattggatatttatgcataaattttacatatcttacaaatttaattaattattccgtgctatttttttcttttagttaagacgatgaaccttttaaaattttgcagactaataaagaaaataagaagtgtcaaaatggtaccaagaatgctaaatttattcgggtttagcaaagttatggcaagtttatgttgaaaaaagaattggcgaattttacagaaatgcctaaggcggtgggttttacgaaaagtcctaggcgccagggccatatgttcaatccgttaagactttttttaaagttttcagacgattgggcttgaaccgggccaaataaataaataaatttaaccaacttatccatacttcataagtaaccacaagaaaaaaaaaagggggggggaggcaaaaaaaggagtgattttttttaattagttgaaaaaggagtgggaatttttaaaatacacgcaaaaaatagaaactattaaaaatattaaaaaaatttaaacatagtatttatttaatcccttttttacataaaatgggcgaaaatgggtgaaaagaccccaaaagggggaagcaaatgccaccaaaaggtggcgaaatggcatttctattacatattcagccagatcagttcctaaatctttggctcaacaaacaccttgacccggatgatttggtcccgcattgtccgaatgtcgtgaaagctctgctggttggtgatggagtagaccaccaaaaagccctgcccgtttttgatgtacaggtcgcgcattgaggcgaactgctccgtgccggctgtgtccaaaatttccaacacgcatggctgtccatcgacctgcaaaattggcacaatgattgattatcgccccggttcgatggcattatttaaggaaggaccgttacttaatgaaagaactgcttaatggcgaaaatcattcgttttcactattaatggatcaaaagttcattatttgggcaaactaatgctaatattgctaatgtgcctccgggcaaaaaccaaacaattaacacgtcttaatgcgcaaaagaaaattcaattgattacctaataaggtatgaactaattcgtctcatcaggtgagcttaaaatgccaaaatattttagttaaatattaatgggccaattaaattatacaatttcgaaggaccagttaattggcaatttgcctcagggcgagcaaatcatatctattaaaaccaattagtaattgcttgaaggtaattaaatttcattgaaagtcttgaagacaaacaaacctcaatttccttccgataaaagtcttcaattgtcgggtcatatttcaaaatgaactgttaagaaaaaaatgaatgaatttttggcaaaatcggattttcggcactttattggacacaaattgaacagtgagtgccgatttgccgactccgcccgagcccaacacgaccactttgaactcgcgcattcagctgctgctgctgatgctcactactaattatactgtgcaaaatgcaataaattatgtcgacaattttattaattaatttttaaatattgctaaattggataaaaattaaattattaaaattatttttagtaattcaaaaaattgccccaggctatttaggattatgctcaaaaagaaattgattatttttgggagggattgacgtggcagcgacggcggcagaaactttggccttcctccgctgctgaatgttacagctatatgtgactttatgcaattactcatccaatttttggtggtattggcgacattttcagtcttcgctggatttccaccagtactgaattggcaatgcttttaaattcgaaaattggttaattttttttataaaggtgttttctttattttatttgttataaatccggaaaaattcaaattggcaaggtttgaaaatgaaatatattttagtttagattttttcattttttgaatataccttattaataaattttccaaaatttccataaatacgcataatttaggcttaactcaaaccagtcggtttaatttgttaaaactaaaatccccaataaattttcttcggcttaatttttctgcaatttaacactaaaatttttcgtgataattccagaaaacttcggcttaagccattgatggcttcccttgcccatcggcttaatttcattacggcggttaattcctttaatattcttcggagcaattagcgcataatttactttacgcaaaaaaacttatttttaatgagaaaagattaattatggaaataaatttttgccgatagcaaaaattgatttttttttattcccattcaaaaatgaataaattcatcgccattttttatttaatcacgacaaaaattcccccatttttctgccattcgccacgagcaaaaattataaataaaaatagaaaaaattattgttgtaaattgggagggtcaattgagctcggtcaaatgaagaagaccttggaaatttttagagtgttcgccaaacattttgcgattatcttgcggatgtgtgtttattgatgttcatttaatggaccaattaaagggaataacaaaatgaacaataaaaaaagtgtccaaaaaaatggcatgccgaataaaaaaattaaatttaaaaatctaattatgagtagggagtccaattatatgcacatgcatatttttttcctggactgtgggaagcctgaaacgcacgaaaaacatgtttttagcttggtttgaagcttctaggacgtatttccatatgcatattttgcatatttgtgcatatttcgcgatttatgtgcatatttgcatatttgtgcatattttggcatttcgtgcatattttatgtgcatattttggcgtttttccaaaaaacctctaatagatcggcccccaacagaca

SEQ ID NO: 8843 - DNA, 1500 bp, Heterodera glycines
aaaaaaaactataggcccaaaaaattgaaaatgctctaacattgaatggccaagatacccgcccttcaataaactcgcgcattttgcttgtgaatgttttggtgtcaatttgacgaaaatgttcggcagtcagaaacagaacgatggaagatgaatttgttaatacctatttaacaccatcaccatttaccattttgacaatttgatgtgatcacacggaaaggccgccagcgccgctcaaatgcattttgaattatggggggggggggtggcgactgagcgggggcacgcactcatcgcatttacgagaagaacatacacttttactttatgcatattaatggagggaataaaacatttaattaaatcaaatatttataatttaaaaagaaattttcatttttttattgaaattgtatatttaaaaatgaaagtatttgatttcaatggcagttaagcaaaaaagaaattgaatagttcttgtgggagggtagtaagtaggtaagtaccagggatggcattccgaggccccaaaaattttcggaaatcggaattccgaccctaaaaatgtcggaagtcggaaatcggaattccgtgccatccctggtaagtacccgatgattttcctatgcattttattcaaaaggaaaatgaaaattttattagaagaaatttccctggaaaagcaagctatggatggcttatcttctctgctgatgtatttacaccttattttttccacggaaattattagaaggagaatttccctatgtcccaccattttcgccccactttctcaggtgttatatccctctcaattcacgtttgctgatgatcacactgcaccccttggatcaattatgatcatttgtttgatcaattggataacaaattgatcatcacgggggaggtacggctttttccccttccttagcccagtgtgtgtttatgcttaacgtgagaaattgcttttacaccatccgccgccgtattgttcggttcaattggcttttccccctcccctctcctctgggccgtccccgttcccatcccatcggcccctacggcgacataaatcattcccaaaaatttttttaatggggtcataaacattttcggaggcctttttgtcctgatgtgctctgctctgggattagtatatgtgtccagcagtcagcaagcagtccattagtgacttagaggaggaattgctgacgacgactgctgctggtggatgactaaactgacggatgactgactgtttgttgttgtcggatggattagatggtgttggggctaaaaatatgttatgtgtacaaattgatggcgctagtgaatgatggtggtgcacaaaccaacattcactttttttgtgcaaattgagtctgatttattttgttaaatcataatttataatgtcaaaatttaaaaatgggatggtatagaaaaaaaaaattaataagtgagaaatggaaattttcttggctaatgtgctgggat

SEQ ID NO: 8844 - DNA, 2601 bp, Heterodera glycines
atggccgcttattgacggacatcgaagcaattgtcaggattttcactgcccatatcaccgaagagtgcgaaatatgtcggggaaatgctttcttctgcgaactgtgcacagataatcaggttaatggtgctggcttgaggaattagtacaataatttataagttccacagaaattactccgcaccacttttcagcgcatctatccgttcagcgaaaacgtggccatttgaaagagttgttgtgcagtctatcaccgctcgtgctttgaccgtgccaacaaacggtgtccgcgatgttttacgaagaaaggcgagaagaaaagcggtgatggaagagaatgagggggacgaggaggaagaagaggacggacaacaacaaccgtaggacagcaaacttttttatttttgtataaatcgggtcacaatagtcaaaataaaaagaatttattaaaggaaagtaaataaatttggaaaagatttcgtacacaaatcaacgtgttgtaattgtcgcaacttttgctgaaagacccgagtcaatgtcgcggacaacgggcacaatgtggtcaatgacgtgggcagcgttcatcgatcggccgacagactaaaatattttttggaaattgttttgtaaaaaataaattcgacctaaaggtccgtagcgatgcgttgcgcaccaaaagcgaagcggcctccgccccgtccagcaaatgctcggaggaataaatgtcggcatctgaggctttccttgcctaaaatacgaaaagggccgtcgcgccgctgagaatgtcgccatggccaccgcaacggcgcatcgaagtttccgcttggacaattcgcgtttgggcggcgtaaccgttggagactatgtcaatctctctcctaaagtgccaatgacaattgttattgaatccaaacctcatatatttttcggttgcgtttctgtgccaccgaccctttctcatcacaggcacttccaaatctttgccaattgttccgccatttcacattgaattttcaattcgtccgtgtcctctcccttctgctggttagggaacatttgggtataaacccgaacaaaatcttaagaaacatgcattttgtttgctttgcttttggggtgcgttttgcctctgtggtttggcgtaatgatcactttgtctgtgcaccctttgaacagctgcgaacattctttgacgaagaacagaccgtccgcgtcaatgaccaaacaaagcttgaaaagcaaagaaaatgatgattgtatctcaataattagatggatttagattggaggggaattacattttgtttgctcctgacgaaatttacgccgtccgccagcaaattttgtgtgtgtttctgtcggccaagccccggcccgaacaccagcacgtccaaccgctcaatgctgtgtctattcgtggcgaaatcggtgctggggtaaacctattaaggaggagggcaattagcaaccccaaccccaattagttaactagtcaacatgaaaacccacgatcagttccggactgtaacttttgatcaccggagcagcgtcggaatgggcgtaaacaaaggcctaatcggcaccgattttcattggggtgatcgaagcgaaataaggcgcacctaacggggaaaagccataaaaatgcattcatttctctgcaatatgccaccggtgtagtcgggcgaaccgccgatcactccgcttttgccacagtcgcccttgcgaaggtgtttgccgaggacagggaaaaggcgctttagttgtcagggtcagtcggactcataacaaacgaaaatatcactggatctctatatctgcgcgaaagcaggtataacaaggctgtaaaacagtgtgagttttgaataggagcacaaaaaaattttttttttgaaaattgcgcaatttggcgttaataaatttgatgtctaaaaatttcgaaaattgcgcaaattgacatttttcccctctttaagtgacgcggacggaaagacgccgcccccacgcggggggtggcggacacgcgaaatgtacggctgtgtgacacagggcgttagcaggtcttgaacacatggactctttggaatggctttcatgggacagaattacattccaatatggtatcttacgtgtgtgtcgaatcctctaccaatccacgtccgctcataataacgcaaaaatttgggaacaccattattatgttcaaatttgtctacaatatgtcctataatttttttaaaattttctttctttacgtttctatgcatgcctgccaagccgataaatagctctcgaacgtccgctggtgaacaaaaggctaaattagaaagacatttaagcgacactctgaattcttcgtgtgtctttgtaaggaactgcaacgcctgaactctgaatatttctccaaattgactgcataatatgaaaatatcactcttgaattgttgcaggatcttaaaatcgacaaaatgtcttaatatcatccatctcaaagtcaccacatatcattttcagttttggagaattgcgcactacattttggatacaatccgtaaaaaaataatatctctgcagcagatttcttctgactaattatttgaa

SEQ ID NO: 8845 - DNA, 3614 bp, Heterodera glycines
aaaaacgtaactgattcaggaaaatgttctcttttttgccaaaaatggaagcatttggacctgtccggtaacccggtgaacacgtgaagcccccacatttttttggtttttttttttttgaatttttttggtgatttcgaatcccccagggctttccccttttgtccaacatttggacctttcgcgcaccggtctcttttcgctgcccaagttgcccaaactgtttaccctgcgttatttgaatttggtaggcaattttctgtacgaattgcccccggcagccatttgccctttgctgacacttcaaacgctcgacctcgcctgaaacaggcacaaaaataacaaaattatctttcctattagcgtattattattatttgtgttttatttttttttggagattggtcgaatgcttaatttaagcagtaatgtcgaacagcgttggagcatcggtcgcctcacaaaagacgtttttgaacgaatggactctttggaatggctttcattggacgtaattagcccaattatcatttttacgttaaattttaattcagttcaacaaaatgcttgaatttcccccgcaatactctttctccgctgaaccgacttaagcacctctcgatggagtcaaatttgttgcaaatgttgcccaattatgcctttcagtaatattaaattgcttttgctttttaattacccccttttttggtggcttgtccatcttcaatggctttcattggcccgtaatcggtttgtttaatccctgttcatttaattaattgccatttcctaattctcaggttgtcttcaattaatgcgaaattgttccactcaacaagtgccattcaaattcggtggctcaatttggccaataatcggatcagtcggatggagacagccgcttttcaggccccacttggaaatgttgtccattgaacatgtgtcttttcctgttttagaatctgccgaatttggaacgcctttatttgtccaacaatcggtttacaactttgccccctcaagtcaattgatcatggataattagcaataatacttttgtgtcatttcataaaattttgagtttagattctttcagcactgaagaatttgcgacaattgagcttggctcacaatgacatcaattaaacgcaggactttcaatgtcattcgaaagtaaaataattaatttaaatttattattttaaaaattttcagattggaaattcaatcggccaaacattcgcttcggtctttggacataaacaacaacaaccaattggaatttgtccatgctcaaattttccagggctttgtgcaactccgatccgttgatctttcgcacaacgatttgatcgttcgtaattaattaaattgattctaatcaaaagaatttaatgattttaattagaacctctgtgccggctctttttggggcagtgtccgtttggagcgaattgtgctgtcggaaaacaatttgcgcacaatttggtggcactgtcagaagcaaatccatctaattaattgatccttttttccgattagactctgatcgttgagcttaatcttgccgggaatgttcttcactcgttggattctgttgaaaattttaaagttttattttgtattttaaaataattaagggagtttttggccaaaacaatttgcagggcttggacctcagtcttaaacaatttcacgttcattccagtccgagcattgtcatcggtccgagcaagccttacggtgctcaaaatgtgaaaaaatggagtgaaagtgctgaatcggagggcttttgaaggaatgcgcaatttaaattcgttggaattgggagaaaatcgcatcgaaacgctggaagaggcattttcaaaggaaaacagtgaattaaaagcgtaactggttaagcaaatgttctcattttttgccaaaattgaagccttttgactttttgaatttgtcgggcaattttttgtatgaattgcatcctacagacattgaccgtttgcctgcacttcaaattaatggctaatttgggtgattttcagttggagtctctttctctttcccaaatgtcgtcactttcgcgactccccgacacttccgaaattcgcacatctgctcagactacaggggcttgagataataccatttttgtattaatttatttacattaattttctttacagatcattccaagccgttaaaaattggccacagcgaaccttcaattattgcgcgaattgagcataactggtgcaaaaaaaatgtcgaaattaaataaaattaaagcttctttaatttctgaaatttcagagtggccataataccctcggccaattgcgcggctttcgttttcgtctctccgtccaaaacacgcaaatttcggcactttctccccgaggcgttgaaacatttggtcggcgggccttttctccgtctttttctgaggaataatcgactgaaccctagggtcggagtgttaattaagacgactctcatacacaaaatttgtgttaaatttgctctgcagatcactgtcaaatttatcccttagataggacaaaatggacgaagaaaatcagcgacaaagtcaatggcaaaacggaggggaaccccgacactgcaccaacaaagaagcggcagaagggggttcaaagggagtcgctgctggtgaacagcaatagccaatcgacggacacggaggaggacaacgccggcgcaactccatggggtgctacaaaaacagcaatgggcgtggagatggacaatcacaggtaagagagagtcgtgaatcggtcttgaccaaacacattcccacaacggctacattcacaaaactgtgagtaccatacattttaccagcgaaaaatttttcggcattcagatcaaaaaccgtgtaaagcatgggcctttttttttttgactacattaatttaaaaaaaaaaaaatatatatatatatatatatatatatatatatatatatatatatatatatatatatatatatatatatatatatatatatatatatatgtatataaatatatatcggaattttcgttttgttaatgctgctatgtttaacaccgatcaaattttcacaccttatctgttccgcggatcaactaaagtgtttttacatttaaacatttattcacaataaataatcgtcgcatttcataattttaaaaaaagttttttatttaattaaaaaaaaaattttttttttttagaaaatgaatttattttttgcaacgcttctaaatatttttatttttattttttcgagtgattataatttttgtctaaaatatctttattcccataaaaacgattttggggtgccttgttatagcaatgggaacgccggatgttcgtttgtgttaaccccccttggctaaacaaagatttgccaccggcccgaatttggttttgtccaacgctgttggcggtttcgacaccagcaccaacttctgtgactaagaagcctgaaacattgccaattgggtcgggactgcctggggaaggctggtacaagcatggcgttttttttcatgaaatttaaatatctagggggacaaatttaaaataaaaatttctttattaaaatagctt

SEQ ID NO: 8846 - DNA, 1996 bp, Heterodera glycines
gggaaagggcgcaacttttcgtggcaaaattggtggaggaggtgaagcagttcgccagaatccggaagggatatggcaacgtgcagaaggagcgagaaaagaagacggcggaacaaacgacagcgtttgaattggtggcaaaattgctaagcgcggagcgcggcgtggtagtgctgtctgcagtggagcgtgccgaggttgcgaagcagttcagggcgcttggcttgcaggaaatcgtgttgaaagttgtgcttgatcgcatgcaacgtattgcaggagcgcccgaggcaaatgtggccctgaaagctttggagagactggaggaacgacttaaggcagctcaaatggaagaggaggccaagctgcaggccattttcaaaaccggagcgcccaagtcggagacaagccagaccctgaaaatggcacgagaagaagtggccaaactgcggaccgaagcgaccagggaagagttgctgaccttcttggccaccctgatggctcccgaagagtttgaagcggccaagactctgcagaaaatggcctccaaaagcacagccagcacagtggccaaggctccaacagagttggaagcagagtcaaaggcagaattggctcggccggaagaggcgctcggagtcagcgttgagaagccggaaagaagggaagcgaaggaagagcgccggatgagattggagcggcaagaaatggccttccagctggttcagcagctgttgagtgcaggacgaagtgaagcatcgctttcggaaaagcaacgggcaatggtttccgagcagttcaagcagttcggcctggaggagatgagcaccagcattgtgctggagcagctcgaagaagtggcgggcagacccgaggcaaaagtggcgctcaaagcgtggaagagcctggaagaaggactgagagtgctggctgttatggaagaacgggtcgggtttgaagcaacctggacgaccggagagacggagtcgggtgctgagaagacagtgcagttggcacgtgttgaagctgctcagaagcgagttgaagaagcgcaggagcagctaaggaccttcctgacagtgttggtcgggccggaacagttcgaagaagccaaactgctccagaaaattccatggcacacgtcagccgaataccgaggcccggaatcgcgcgaagaatggacgaaaattggccaacaattggccaaaatggaagcgattggccttgttggtgtggtgaagccactgccggtggtgggcaaggcggaagcgagccgaagaattgaaggacgagaacaggcgtttgacctggtcagaaaggtgctaagtgaagagaagggccagcagacactgtccgaagcacagaagttgtccgttttcgagcagttcagagaattgggcatggaagagacggctgccaccgttgcacttcaacaaatacagcaaattggcggaatgcctgaggcaaaagttgctctgagagattggacaaagctggaagagcatctgaaggccaaagaagcgtttgaggaagaagcgaagcttcaagcagcactgaaaacaggagctccagacgccgaaacgagtcgaacactgcagattgcgcaggaacaagcggctcagctgcgagtgtgccaattgaaagaggagctgctcacattcttggccaccctgatggcacccgaggaatgggaagcagcaatgactttgcaaaaatttgatgtggcgccaaaagccgaagagacgttgcggctgaagattgaggaacagcaacaaatcactgaacttgtggcagccgcacttaagcgtgaaggtgcgcagattgttgtgggagagaaggagttggcagtggtagccgagaagttcaagcagttcgggatggaggagagaactgtgtgcttggtgctggaacagctccaaccattggccactgggaaggccctgctgagcgaagagcaaagggaaagggcgcaacttttcgtggcaaaattggtggagga

SEQ ID NO: 8847 - DNA, 1024 bp, Heterodera glycines
ctcaagattttaataatttttgaaaattggaatccgaaatggcaaattgttcattttttggcgaaaaattcacaaaaatttactccccggcgctgtttttgagggaaaatgccaccaattttactttttaatttttacggtttcacgtttcacccaccattggggtcggggcattcaatcaatccaaccaaaaaaaaaacagtcaccacaaacctcaatgtgctcaaagtggccgaccgcaaatgccaccaaatggtggacatgcgtggagtgcgcgcaaaagagaccagttttttggttcgacggccaccgaccgccgcctcctcctccgccacaacgttcatgttggacagggcggtcatgtgcttgtccacctccaatttgatgtcgaattgagccttgtacgtgggctcgtcccagcaggggaaggcagaccgggcgtaagtgctctgaaaatggtgtccattgtttgaccaattggaaaacaaaaattttttttttgattttgcttaaatttcccaaaattcctccccatgatgcgaaatgcaaaaaatttctattcaaattagctcaaaaatgcaaaaactatatgaaaaagtgttgccaatcactttccggatgaaaaattaatgctgccaaaatttgggccaattttttaagcaacaatatttctccattacgcaaattatgtgtacaattttttttattattggcatttttaacgctttgacaacaacctcaaattgagtggacgccaaaatcttttcgttgcccgcactgtctttgtacgtcgacctgtgaaatgggaaggaaaaaaaattacaaaacattaaaaatgattgttttgtgtcagaaaattacattaaaaaattgcgcagcatttttacataaattttgaggaaaaaatgatccaaatgcaaaccaatgtccagaaaaaatccaataaaaaaaaaaatttaaaaaaattttttcacgattttttttccaaaaaatttcccaaaaatcatgaaaaactttccagcct

SEQ ID NO: 8848 - DNA, 2590 bp, Heterodera glycines
ctgaagggtgagcagcgtccatttggtgtccaactcgcgcttcaaatccgacagaactgtgcaagaaaataataataaaataatgcaaaatttgaaaaaaaaaattttttttccccggcagcgtttgggtttaacagcccgaatttttttttccataaattgcgttgagaatgcaaccaaagttttatatgaaaataaattgttgtttaaatcaatttttacagtttttgcattttttgggaaaaattttagctttcgtttgtttccatggtcgtgcaaatcccatgagttcgctgactcgaaaactgtcataaatttatgaatttttcagggcctgcaatttttttttgttgtaggcaaaattttgtgcaagaaaaagaaaatggcgtaaaaaagcaccgccaccactcgggattttctcccgtcgtttcccccgggtcgtcccccccccccgccgaaaaatttgaaaataaaattttttttttcgccaccactcacccgtcccatcctccaacttcagcgacgccttttccacctccaatgcacccgcgtggagtgtcaggaaatttgttggctttgtaatctgaaaatggagagagggaaaaattaggttggtgaggggggaggaaagtgaaatttgccccaaaattggtggggtaggtaaatccttcggaattggtgcccaaaaaaagagataaaaattttctttaattttttaaggtaagaaaatgtgctaatcatttctacactattcagaacgtacgttttaacgccaataaattttacaaaattaatttttttttttttgaaaaaatcatttgcttgatgcaaaatcatagatggaatcaatgtttatgtaaatacgagcaggtcaaggccattatcggtaaacttgggtttttctggacccgaattcgtgtccaggaaatccaggtccaggcttttttcaaaattcgggtctcaattttttttaccgccgggggacactaattccgaaggattgccccaaaattttagtgccaactaacctcaagatggatgatctcgttgcccttgaatttgcacgtctccatgtcgacactgagcataatttggtacagcgacgggctggccaactgcggcaatttgctgaatttgtccgaaccgtttgccatcgacgaaaaaagccttcggattattgcagacgaaattttgaggtatttaaaaaaggaaaattgaattgcttctaaaaggaaaatgagtaccaaatgttcagttttttgcacaggtaattaattttaaatgttggtaaattcggcacttttacgcttggggccaccgaaaaattctttgatcatacgtatgtaaataggaagaattcgatttcctttactctattgagttacagtaccaatcaatgcatcagcaatatttgcaaaaattgaaaatttgaattttttcaaatgttcgaatccgggttcggggttcgaaattaagtcaaaagaaggtcaaattcgtgctcagcgcatcaaataacccctaaaaaagtgttttttgaatttttattccttttttttgtgggaccaataatcttcatgattgccgaaaagagtgagaaagagaaaaaagtcagcgaaaatgtcgatcgtaactatgaaaaaagaaattttataaagaaaaattgccttattttttaacaaacttcattaaaaattccaaattttctacgatcgactaaactctatttgtgaaaaacttatcgatcgtaagaggaaagtgtgtaaaaaaccccaaattttgccggcttttaaaaaattccaaatttttacgatcgactaaaatcaacattttccctttcgtctataattgtctttaaaatttggcttaaaagcataaaattggtcatttttaggtgcaaaaaaaaaatttttttttttttggaaaaagtagcgtaaaaaaagtggtatgaaagttttcctaggcgttcaaaatttttaaataagactggcagaaaatttttattgatctactaatattttggttggacaaattatgattttgctttgtttgtttgttaacattagagctcggggaatttgtgccgaaggtaccccctccactttttgaaaaaaaaattttctcgagaagtcattttagggatttcagggtcgaagaacacggacaaaaatccaaggctgccaaaaatggcctagatttattaaaacggagcgggaatttttttttaattgatacagtactacttttgtccatttacagtaatcgagttattacaagaaggtggctggccaaaataatgatgacaaaactgtgcacacctctccgtggaattacaattccaacaaaatattaaatacattgaaaatgaattaataaattttaataatttctagttttttttcttcaaaagtttatgataaaaaatctaattaaggtaacttggcaacaattttaaagaaaaaaaaattaattaactaaaaagaagaaaataatttaaaattataaatatttttttcattttccaaaaatcgctgaaattttttccgtgagaactgtcagaaaggatgtcactagatgatagacaactgatgag

SEQ ID NO: 8849 - DNA, 1722 bp, Heterodera glycines
aaagtgattagaaaatatcatgccaattacgaacagatgatgaataactggaatatgaaaaataattgagcaaattaatataaagtgatcggtaatgattaaagggtaggtgtaatcaatagcatttaaaatggagcaattaaaatttatttactataaaaaagttggcatcgttgagcagaccggcaaaaagtcgccatcgtttgcaatctgattaatttaaaatttggagaaactcgagagtcttgagtgtgtacaattaatatgacatttttccgacgtcatttcattttttcgtttgttaaatgatgtcagtttttgcgcttttcagtgtcacaatttttggcactttttggtgtccaatttcacgccctttttgaggagaatgaaagtatcaaacaaaatgagcacaaacaaagacaataaataacaaaaaatgaaatcattttgatgaaatattagtatgtagagaacggattttgcagcatttgctgaaattttttgctaacttggggcgtgctaataagcatgaaaaacgcatttctaacttagtttgaggcttctaagtccatctttttcatgctgatttttgcttaaattggtattttcgtgcttaatgctgagcaggtaattttggtgctgaatttagcattttcattcttatttttgtgcttaattggcatttttttgtaaaattttcactaaaacaccgcctcctagcaataaaaacgaaaaatccacccctaagaatcgacctaaatttttttttttaaatacacccctaaaaatggaaaattttctcaaaaatccaatcctcaaaaaattttttttcttgaaaaattgctttaaaatgtacaaatttttgctaagaaaatattaaattcagtgtgaaaagaaaaaaaatgagaatttattgttaactgataaaaatttttgcctaaaaatcataaaatttttatgcttttttcgatttttttgtgctgattttaccattttcatgctgatttcgtgctgaatttagcattttttgatgctgaattaagtgcttaatcatcattttttggtgatgaaaaatccggtctttaaatattagtaaaaaatattttatttgaatttttgcttaaaattttgaatttaaataattaagtgattaaaaataatcattttaaattagttttaatgagcatacatacaatttttgcgaaacttgagaccttttttatttaaaatttttaaaggacggcggtgccgatgggcgtcgtcgggaaaaagttagtaagttttaactaagaaaaatttcaatttcaaaattttcgtcggcgaccctccccccccccctgccctacctcttttacaccggctttttctcattttccaaaaatttttttcgttttgcattcatttttgttacaacaaaatgatagatttattttttaaaccatccaatttttatctcttttttcaaaccacaaaactctttctctctctctctctctacgctgtagggattaaaatgtgtgccaattgttgtacaacaaaatgtgcacttttctgaacaaagagtgccgtgccggcacggcacacgacacccctcggggggagggaggggcttttttgtcggcactcaataaaaaatgatgatgagatttttgagtttagaggggaaaacggggaggaaaaaatagttgtcctgctaatggatgatgatgatgtgaagaatgg

SEQ ID NO: 8850 - DNA, 725 bp, Heterodera glycines
tgcatgatctgatccaggcaatgtgccaggatctgatcgaccggctcgatctgatgtatcgggcccggttcaagaagaaaatattgaacaaaactgatgtgaaaaagttcgcgcaaaacattgtgggagggcctcaatttcgtgatcagttgaatgatgagtgggagaagggcgaacagcagcaacaacggcgccgacaaaatgccaatggagaggacgaggacattaagccggtagaattggaaattgtataaattcaaacactctatgaattactgtaaaaatccaataaatttggaaaaaaatccatttcaatgttccaaaattgtttgtgccttagaattccggctttcgcgtttatataatttttgagattctgaaattacggtgctgtgcagaagttacaaaagtatcaatgttagtaatattaaaatttatttattattttatttttatttgcgaaataataaatcataatttagctcgaacttagtcaaattaatgatatggggatattgaagcgatagctcgacgtatccactattattttatgtaattttaatgtcgaaaaatttagactcaataattttgtccataacttttttgaaactcaagaaaattttttgaaattttatagaataatagagcaatcttagtaaattaaaattgcttatttatgaaataagatgatagaaattcgacgtgtcataattatatggttatac

SEQ ID NO: 8851 - DNA, 2790 bp, Heterodera glycines
taaaataataattaaattaaatattactaacattgatactttacgtgaaattacatctctgtaaatatatctatgcattattttctaaattacactcaaaatgcgacctcttatgtcctattcttttttcgaattttttatttttaaaattccaaataatatttttttacttcatttttcaatggtcaccttttcaaagcccttaccttcaaagttattttttcatatttatcataataatgtgttcttttgtcacaggagtggacattttggggcgaaacaagagaagaagacatgcgaaggaaggtgaccgttgcactgtacgaagaccacgtcaaggtgttcaagttgttgttctgggcacgcttttatgcgcttgccatcgctttgcaacgaattccagtggaagtgaaagaagtcagtggacggggggggggcaagcagtagttgctgaggatatgtacagcaacagggaccggattaaatgcccaaaaaatcttagaaattcggatttgtggggatttgcgcaaaacccggaaaaactaaaatttggatccttgtaaattggaatttcgaatttgatgacaaaattttttgaccggttttggcatcaaaataagtcggggtttctgtcccccccccaaatttggtgtttaactcttttgtcaggcaaaacccggccaaagaaaagaattatttttgcaaattccatttcatattctgttctttaatttaaactttcatggctttatcgagaaaacgtgcccttctgacatgcttaaaaatagcggcttatctattaaggatgccgtgccgcaaaagatcacaaaagatgagggcgctaaactgttcggctacaatgactatgccgatgtacaaaaggaagaagaaaatgccaacgccacaaccaaagaattggctgctacttttcgtatcgatgtgccgcgcaatgcgtggcctgatgaaacgcgccgacgtacggaggaattgcgcaaaaagtttgaacaggacatggacattttggaggagtacctcctggccaatttcaaccatcaaatgctctacaatggacaatcacgcttttaccaggtaaaacaaaaaacacagaattactttatagcaatttagctttcattaaaatccaaaaaagaccccaacggattgtaccaaattttcgaaaaaattttgccgatgaattggcgccgctggcctccagtaaggtcaccagacaggtgtccatggagtttcggtatgaaatttatgtgcggatatagcagatagcaccactgggttcttaagaaaagggtttccttttttgcaggatgagcctgagtgtcaagaccaaaaatgccataattgttagttcattttacttttctttcctctgtttacgtcttttgcatgtctccaataattatttctttaaaggaataatttaaattaattacaaattaaatgctttgattctcaaattcaggtgggctacgaaacgctgcaaaagttgggctacgatgatgtgctgcaaggggccaaattgcgcacattgttggttcatgagatggaggaaatgttggaggaggcggacaccggaggcaagagagaaaaaaaattaaatttaaattttataaataaatttttaaataaaatttaaatagtaattaaaacattaataattagggttaagaattgtatgcttttgcatatttttctgcgcatattctatgaagaaagaaatgggctcaaaaaaagcatttctacattaaaattttttgatttggtgaagttttttttagtgatataaatgtatattttggggttttctagaataaatgcatattttgccatctttggatttttgagcatatttcggctatttttggcaaaatttcactaagctttttgggaattaaaaaaaacactcttaaaatcgaaaaattttttggaaaaaatttgtttatataaaaaatagaattttataataaaaatttaaaaaattcaaaaatatatataaattaagaaaattaaatatttttttgcaaactctaaaaaacctccttagccattttgtttagtgtttttaagtcaattctgagttttttacgcaatttttggcattttttgagggttaaaactttttaaaggcatttttgtgcataattgggtatttttcgggtttttaggtcatatcaaaatttaacttatattttcgataaagtataatgcgatttatttaaatagttttttactgttcattttgcaaattgtctttaggcataaattaatttgattaatttacatataaaaatttaaataattttatggaaaatgaaaaacatattccaaatatattttttaaattcttattaaataaaatgaattttaaattttttgcacttttaagtgaataaagaagacgaagattattcactgaaaactgttcacttcacaaaagcaaatgtgcaattgttcaagaaaggcaataatggaacagaaaagctaaagggcatagaaaaatggcttcaaaaaattttcaattggttggacggactcgtggacaaatgccataaaaaatcgttgacaaaacgaaatcggatgcaacgatttttattcgagtgaatttttatccaaaattaaataatcaaaaaatttcaatttaaaaataaataatggacttaatatggtggatagaggactatgaactcgcagaaaaaaattccagttcggtgattccgttcccgtcaagcacaagcttttatttcagaattaccatatttctcgaaattatacacc

SEQ ID NO: 8852 - DNA, 2524 bp, Heterodera glycines
taaatttatatttttaaatatttaacgattatgattccgatattcctgactattgggcaaaaattccaaaaaactggacgaattacacggaaatatgtagtatttttaaatgaaattttggtaactattcattaagattcttaaaataaattcaaacaaatattaaaagattatggagaattttatcgcctacggttacgtcctaattagtttataaaattaatatgaaaaggtcaaataattatgcccaagaaaataaaattaaaaataataatataaattaataattgaagagatatttttaatgttaagagctccaaggaaaagactggttacaagcacaaaaagcaccgattggagtcaaaaaaggcaatgttcggcttattaatggaagttgacagtgcggttgaggacaacaaaaacatcagagaaaagtggcgtagaaaaggggaccaaatttgggaagaaaacagggaaaatgaaatggaaagtcagtgaaaaatgaaaaaaaaattattaaaattattattttatttaaattttcaataattattaatatatttaaattttcatgtttcaattttgggttttgttatgcgtgaaacgctcattagaaggtgccagccttacgaaatcttgaatattttaaagctttcatattggacagtttaataattaaaaaaaaaattcaatttccctgaaaaaatatcaaaattttgagaaatttttgatttcactcaaattttggtgaaccgggggattttattggacttgcgccataataagcacgcaaaacatcaattttacttcagaagtttaaaaaaataaattttaatccaacataatttttgttggattttagaaatttgggcagaacagatcgaagcagtgaagatggacaagacaaatgaattgtcaaacgatgcgtttaagcaagttaccagcatgctgaaagaaggcaccgatatgccaaagtggatgatcaatacgccaaaagattcaaaggtggaccaaattttaaaattgaccattcatcaaattttaaaataatccaaaaatttatttaaactaaaatctgtcttcattatttttgttttggcatgaatttgcctttgctgctgatgcacgtattgacaaaaaaatcaaaaaagttagatgtctatcgttgtgcatattttttttttgcatttcttttaattgcttttaagttgttgttaattagtctaacaaataagtcaaattcgttgtaaacttttaaaaatattttaaatatgctttgactgagcggcgcaagtgtcaaggcgcaaatttagcggcacaaaagtcgcaacacgtataagtataggtgcacatccgtaaactttatccttatctctaaaatttaatttcggttcttgtttttaggcaaaggctaatttttgttatgccaaattctcatgttccttaactcgagttacattttcactaacaatcaatttggttcaatgaatgactaatgagattatgacataatcttaggaaaccgaaaatttaatgacggaatgtcaaattaaaaaaatttttagagttcatcaaacaaaaatgcggggacatcctcgagagtggaaagcagcaacacgagaagacgtggaaaacgacgcgtaattcgcaacgcgacgacaccagcggacaaatcggtaaaatagaataaaaatttaattaaaaatatacaaaaaaagtatttggatgttagggtgaaaaatcatcttctgtataccgtaaccatttggaaaatgtccttattaatttttagtcattttttcgaaaaatcaagacttatggaaaatcaaaccgaagccttttaaaatacctgagctcactattcattttttaaaattaacaggaaccgtttgagtaataccgtacaattaatttgaaattaggtagaaagtttggataatacaccgtcattttttttttaattttaggaaattcgcacaccgtttaccgaagaaacgctcgtacgtaaaaagcgaaaaggcgggtttggcgcagggcatgctgccggccatgcaatgtctcgttccttttctcatgcgcattattcggccccatactatccgcacggcggatcatactgtatgggctaccattaccattcatcaacttattactactactcgccttatcacatgtcacacaaacaagtaaaggaattataaaaaaaaataattatttaattaatggcctaaccgattattgtcaatgttattgcactatgaagtcgaggcaaaagtcacaacttgtgaaaagtttcgagttcatactgcattggtctcgagttcaagacttggacactcggagtaaagactcgttatcgagcatccattaatagtttaaattattcttatgccaacccaaatttatgctggagtttatatgtaaaaacactagaaaaaatgtattcataacggaattttgaagaaattgtaaaattaaaatttagttgtacattttcgattttataaaaaacggatgttcccga

SEQ ID NO: 8853 - DNA, 1284 bp, Heterodera glycines
  misc_feature (292)..(293): n is a, c, g, or t
  misc_feature (311)..(311): n is a, c, g, or t
  misc_feature (320)..(320): n is a, c, g, or t
  misc_feature (329)..(331): n is a, c, g, or t
  misc_feature (341)..(341): n is a, c, g, or t
  misc_feature (348)..(348): n is a, c, g, or t
  misc_feature (350)..(350): n is a, c, g, or t
  misc_feature (355)..(357): n is a, c, g, or t
  misc_feature (363)..(363): n is a, c, g, or t
  misc_feature (373)..(373): n is a, c, g, or t
  misc_feature (375)..(375): n is a, c, g, or t
  misc_feature (386)..(387): n is a, c, g, or t
  misc_feature (394)..(399): n is a, c, g, or t
  misc_feature (403)..(403): n is a, c, g, or t
  misc_feature (406)..(407): n is a, c, g, or t
  misc_feature (413)..(413): n is a, c, g, or t
  misc_feature (417)..(417): n is a, c, g, or t
  misc_feature (423)..(425): n is a, c, g, or t
  misc_feature (429)..(429): n is a, c, g, or t
  misc_feature (440)..(440): n is a, c, g, or t
  misc_feature (448)..(449): n is a, c, g, or t
  misc_feature (453)..(453): n is a, c, g, or t
  misc_feature (455)..(457): n is a, c, g, or t
  misc_feature (462)..(463): n is a, c, g, or t
  misc_feature (470)..(472): n is a, c, g, or t
  misc_feature (480)..(480): n is a, c, g, or t
  misc_feature (487)..(491): n is a, c, g, or t
  misc_feature (495)..(495): n is a, c, g, or t
  misc_feature (499)..(503): n is a, c, g, or t
  misc_feature (512)..(512): n is a, c, g, or t
  misc_feature (514)..(515): n is a, c, g, or t
  misc_feature (518)..(518): n is a, c, g, or t
  misc_feature (525)..(525): n is a, c, g, or t
  misc_feature (527)..(529): n is a, c, g, or t
  misc_feature (532)..(534): n is a, c, g, or t
  misc_feature (536)..(538): n is a, c, g, or t
  misc_feature (540)..(541): n is a, c, g, or t
  misc_feature (552)..(554): n is a, c, g, or t
  misc_feature (556)..(556): n is a, c, g, or t
  misc_feature (558)..(560): n is a, c, g, or t
atatttgttttaagcttaaaaatttttttcaaattgctaattttaaacttttttttcactttttaggtgctggctgaaatttggacattcgttaacattctactgatcttcattatcccgccaatttcgtttgccttttgtgagttggattgcagcattccgagttcgtcttcccattcttcccactcctatggcggccgttattcctataactatacggcggcacaaaaattgcgcggtgagttccctaaactaatcaataaaagtgaattgtgccaaagttccgtttctnnatgccttttgttgccgtntttttgggncctttttgnnnagttttccgncttgccntntttgnnnttttcnttccttccgngngttttggtggnntttttcnnnnnngtcnccnncttttntctntttgtnnntttngccttttcccnccggcttnnttgncnnncgctnncctttgnnncccttttntccttcnnnnntttncgcnnnnnttctttttngnntgngctgttncnnngtnnntnnntnnttgctttggtnnntntnnnttctttcattactccgaattacttttaagcatagttttcctcatcattccgccccttctcccctttggcttttgcatttcgcacgataaatgggtaattttttgttgttgtttttttgcgtaaaaagagtttatttaatgttcaaatgggttttttttttgcaaattttattattacttcctttgttgttacttaatcatcattttcgtgtatttacttaaaattcagtacagtacctttcataggtcctttaaatgtattaaaatggtaaacaaaaagccgtaatttagaaagggaagaaaaacagagaaaaaaaagagcagaaaaagaagcagcgcgaagaaggcaaaaggaaaaggaggacgaattggactatgaaattgcacaatgggatgaagagataaaatttggcagcaaaagtaaaaaaaataataattttaattaattaattaaataattatttaattgaaatcaaaaaggtaatcgacgaacaaaacgcggcgccctttctgcggactccgacggaatgatgaacagcggcaacggtaacactgtggaatggtaccaggaggaggcatttggcattagcaaaaactttggtaaattaaaaaattcgcacttttgaaattaattttataggtgtggttatcctgcaaatcttttatgcctaccaaatgtgtgaataaagaacgtttttgccctgctttaattccacacacaaaat

SEQ ID NO: 8854 - DNA, 2294 bp, Heterodera glycines
atgagcaataattaagctctagaattactctgattgttgaaaattggtctttttaatttttttttttttaaatgcaaaaaatgtgaacacaattactatcaaatcttccccaggatttaatccgggatggcaccatcggaaaattgtttttttgattttccctcatttttaacagattttcaccaaaataggtaattttggtggattttggaaaatttccgcgtaatattttgggaaatttttggtgaggtagaggtaggtcttggaggtgcaccaatagtaaacagttacaatgaaaaatttcttgtttttttacaaaattaaacaaaattaaatttactacaattagagccatggttaaatattaaaaaaataatttctttttcaattattcagatggttgcattgattggcgacaatgtgccgttttttacccggaagcgacatgttctggtgaaggaaagtgccattgtccggccggcatgcatccccagcatggcacgtgcgtcgagggcgaaattattggtgaaaaattaaaataaaaaatattttttttattaattttaaacaaaaaatatttgaaaaaattatggttaaattaaaaaatttattttttatttaattgtaaatatacaagaacttttttaaagaggaaaaaatcaaaatattttaacaattatttgagattgatgacaaataataaaaatttaataattaaataaattaaagtatttttttacatgaataataaatatttaaaaatttattttatatgaaataaattattgaaaacaatcttaaaaacttatttattggtatcacatttttataagtaacacacatatttagtattagtttaatttaattaaaaaatatatttcaaaaatttcatttattataaacattgcaaattagatttttacaatttataacaataaaaaaggtgtccaacatgaccaacccccacaattgtcgggccgcgtgccgttgctgccaccaagccaaattgaccccggaggcgacacctcacccattgttgttggcattgccccaggcaaaaaaaatcaaatttttatttttaattaccattttttattaaattttagatggcaaaaggcaaaaaataaaaatgctttttgaacaggttgaaaatgtgggtggaaaaatgaacaattggaagactcctaaccttttaaaacggtcaaacccgcataaattttcattcgaaagctctgggattttcccaagaccctagtcggggtactgtaatttttttgtttggaaaatgcaaaagggacatggcgaaatactttatttcttcctaaaatagaactcccggggcgctttattctccaaccctcttcaaagagtgggctcgaatttaggaaggggagggactgtattttataggaaatacggtaatataattttttaatgcattttttaaatgtaatattattatttaataaggcatcaatcaccgaccgactgagctgggcaagtgccggatttggttctcgcacagcaccagctcggccaggttttgcaggtcgccaatgttcagcggcagttccgtcaattggttcccactgatgtccaacgtgcgcagcgcgcggcaccgcaacagttcgtccggcaaccgggcgaccatgttgcagtgcaagtcgagcagctccaggctgacgagacagtccattttgggcggctgcaaaaaaataaacgcttttttcaatagaaaattcgggaaaaaatctaaattaaattcggacaatggaacattcgagggattgaaaaccaaaaatatggaaataaataaacaatttttgggcataaaaatgaatttgagggactgaaaaatggaagcaaatttaggcaatggtccatttttgggggctgtaaatgcggtggaaaataatttgaaaaataaattaaattatattcggacagtggaacaatatttgagggactgaagcgactgaaaccccccccccccccccaacaaaaaaatgggaaaattggtgagaaaaaaatggacgccgcctacccgatgacaatgtttatgcttgaaagcatttgacaaacctcaaaaatttagaaaagaaattttttgtccatgtacaaaaaagggccaaaaatgtccgaattagcttttttgaattcttgtgacaattcgatagaatgcagttgcttgttgttgtttttaaattcgtggttcaagtgatgtgaattcttgtttttgccaacaaatcttacgccaaattgtcaaaacttgtctattttctgatgctggaaaa

SEQ ID NO: 8855 - DNA, 2589 bp, Heterodera glycines
aacacttttatccttcccaatgttgattttaaaaaaagtataaccataattaaaaatacgtatatctggtttcgaatttgcacaaataattaaataacgtttgaaaaagggcacattttaattcgtactttaaaatggtgaaagtaaacatttaaaggtaaacatatgctttggaattgcagcaaatattaatgaaaaaataataattgacatttgattaaaagtgattggagaagaataggaataatgattgggggggggaaggagagaaattacaacataataagtgaatgaatgcatgcataattagtaggtaattaattaattgctttatgaatgtgacgatgatttaaaataagtacaagaaaatgcgatggaaaaatttttaaaaaatttgccgtgcgtccgagcgtactcgaacttccatgtatttaatcggtggggttcagcgctaccgactgcgctatatgcacgacaacacaagttaatttaatatcccttttcaatgatatttaatagtgtaacgaaaacaaaaataattgtatttaattaattgtttcttgtacaatttttcttgttaaaattttaagggtcaaaattttattatttaggttttttgttttaatttcaatattttgaggaagacaatcaaaaaaaaagagttgaaaatgcaaaaagaaattaatatttttttacgagaaaaacaaattggtaaaaactagaaaaaaaaactaaaaaaagattttaatttaaaattcgttggaggggaaatgaaccgttcccaaaaagacaaacaaaattgtttaaatttacccactgaacagcattggctacgacatctgcacgcaatttcatttcgtctgaccaccaaaggaattgataattggattgaataaacaaacaatcatattaatctcccgttagcccttgggaaaggcaattttataaatatttttttttgttcataattggggcgcaaatgtgcggggcgcaaatgtaggggcgcaaatgtgtggggcgcaaatgtaggggcgcaaatgtaggggcgcaaatgtgcggggcgcaaatgtaggggcgcaaatgtgcggggcgcaaatgtaggggcgcaaatgttcagtcaccatttcgataactaaaaaaagagtttttggtgaaaatcagtttaaaattgtcaaagagacatttaagacacaattgaaaaattgactaataaattgcaaaaatgcatatcaatggggcgacataaatcgatacataaaggacgaagactacataatcgaggcttagctaaaaataaataaaaataagtcaaagcgaatcagctcaccgggatcaaaggttatttatctaaagtaagacacttaatacgtcttttaaactaattaataaaccaagaattcataatgatgaaagaaataaattaagaatcggcgccgccgtttcggcgccagcccatgtttttttgggtattacttttttctttgtaatccaaatctaacaatctttgtatcattcgaaagcccttcacatgctctacaagccttacaaaaaaacgaaaaaaaatttctagcctttaaaaaatgattaagaaaaacttcaaaaattttgacttttgaaattttcatgtataacttttttgttaattgtctaatcctgaagcaaaagcttagaaaaagcttctaaacatgttaagctttcgaatggtacccaactatgttggatttggtttacaacaaaaaaagttatttttcgaaaacttgggctggcacagaaacgatacatacccggtaaaacattcatctcggcaataaagaattgaaaaaaggatcgatggcatactaatcaatatttttctcttttttaaaagtattggaaaaataaaatcattcaaaatgggaaatatgtaaatgtgatgtttattaaatccgcatgagacacaaagagaaaatattttctataaagaataaacgtaaaataaattaaataatataaatttacaaaaagcttgactgcatgggcacattacatttttataaattttttttgatttattgaaggttttagtgcatataaaagcatattttagggttttcgaaaataaatgcatattttgccattttcgcatttttagagcgtattttggtaattttttggaaaatattataagaaaaatgcgaaagcgaaaaatacacccctaaggatcgactttttaaaaaatacacccttataaatggaaaaatttttaactttttttaagaacttttggaaaaaaatttatttttataaaaatgtaagttgaaaaataaaatctaataaaaaatcttatcatgcacctataattcataaatttgcattttttaaataaaaatggcagttgattataaatagggcaacgatttctagtgaaaaacttttttttgctcaattgatttgaagaagcttaaaaaacgcatttctgcgttaaaattttttcatttggacgtcatttttcgtcactagaaatcactattttggcgttttgtcacttaaaatagtgaaaattcacttttttggctttttgtcactatttttcactatttagagattttt

SEQ ID NO: 8856 - DNA, 888 bp, Heterodera glycines
ccgatgaaatcgtcgccgccactggtcgagtcggtgccccccaattgcggcgcccgcctcctgcgcattcagcaccttttccacgaaaggacaaccgctggaaattaaaaaaaaaattttttttttttttggtttttacttttaaataatttgtacgactgtgactgacccgggaatattcgtacccccccccaaccccggcatttcgctcttgaaaattgaaaaaaaaaattcggaggttagaaatttttcataattttttcaggggggagggagaatgttgttcacccaactgacccccgttcgagcagtacagcttcgccttcaatgaatttgttgctcaacttttgacagccttcgggcggctctgcgtacaccagcgaaatgtccttagaaaaaaagaaggacaatggctcattatttaaaaaaaaaaatttttttttcgtccgatttttcaatccaatcccaccatattgtccccattattttgttaaaaattacatttaattcgatttatttccattgtttttcgacaaaaaatacaaatgggaacccccttttgatttagaaaaattttttttttttgattttttgacaaaataatggcctgggttttacctggttccagaccatttcggcataaccctattcaaaatttgcaaaccaaaagtgtcttcctccctttggattttcgacccataatcagattttttgctatcccttactctaaaaaatgtgaaatacacatctatttttgaaaattttcgtttttttcggccaaaaaccgaaaaatttaatttgttactcaaaaattcggtcgacctattaggaacataatccccttttttgcgagaaatacctgaattgtgtaggtagggaaacgggcac

SEQ ID NO: 8857 - DNA, 3205 bp, Heterodera glycines
ccaataattcatattctcttttcgataaacgacccccgaaacctcccaatacatatatttatgaaaatcaattttttgaaaattttttggaaaaattggaagatcaacttcactattaacagcggaaaggtggacaacagataagaaataaacaaaatcaggacagaaaggaataaaagagcgaaaaataaaattaacagaataaacaaaatgccaatattaaaattcaatgccatttttgaatttttaagtaacaaaaaaaagttttcaaaaagttttcgctgccaaattgtttgcttccaaattgtcgctcccaattttcgcttccaaattttgtcgctgccatggtagttgtttttcaaatatttaaaaaatattcaaaaaaaaactcaaaaattcaggatcagagggtgctcaaaccgaactacagaatgaaaaagaggcaagtttttgtgcccatgttggtgttcagcgtgttcatctattataactacggggagtacatttacgcttattatgaggggaagcgcaaccgtttgctgcgttggtacaatggcaaatagaccgatacaatgatgatgatgatagtgatgatgttcagttgacattgttttttgttttttttttgtaaaaattaggcgaatacaaataaatggaaatgccctattttttcaattatttgatgtactgcttgaacttgacgccgccgcattgggtggtgcaatttacctttcatttgccatgtgtttttgtcgccgcttttcgatctattgtgtgcattggccgtgccgtctgtgcattggcaatatttttttgaaaattattgggcgctcccctcccgatattccaacgtctaacagcgcgcaattttaccgttcgacgccggaaaaccccgagatttcaccgattcataaaaactgcccatcaaaatccacaattttgacgaccagccaaggaaaaacaacgacaatttaccgattacaaccttccgaattcgattatttagtgtccatttaggtttttccgacattttatggtagtaattttttgcaattagcccgataggaagtaaaagacggcggattgttcaaaactaatcggtgaaatggtcgaatttcggcttacgaattttaccaattctttaaaatttgctagactaaaatgatttacttcgtgtacttctcattgtctctgacaatcttccagttttttcatgacgtttttgtgccaaaattttgcatttttacgcctcatcccgtcattaataaatggatttttaggttttttttttcaattaacttcgaatttgtctaaaacattcccaaaacaacaacggcaccgaaaaaatgccatatgccaaccagccacaggtgaccattttgcagctgagcaacgagtttgtgcagtttgtgctcgaggacactgacctgagcgtggcgaatgcgctccgtcgtgtgttcatcgccgaagtgccaacattgggtgagcgtcggcatttgcatttgatggcacggcatttgggtttatcctggccagaaacataagaaatgcccgaatttgggtaattttaatgcccgatttgtggatccgaccgggaaaatggacaaaaaaagcaatcggtctcaggtaaacctgacaccagaaaagaagagaatgcccgaatttgggtaatttttaatgctctattggatctgaacctgcacgaaatctgtgttgggtccctatcgaacacttggcgaattttattgcaaaaaaaaaaaaatcgaattcgaattttctgggcctgatcttggcaaacccaaaaaatttcattttatgccctcaatttccaccattttgaatttttggcatttggcattaaaaggcattaaaaaaaaacattttttcagcgattgattgggtacaaattgagcagaacacgtctgtgttgcatgacgaatttgttgcccatcggatgggcatgattccattgtccagtgacaacattgtggaccgcatgcaatacgctcgggtcagcgaaacaattttttcctccaattaatgagtttgtctaaaatccggcattttgggtctaattttcgagttctcggggattatactcgaaaatgaagcaaaaaaagccttaaactaatggccattgttaaattgcaaggtaggctggcctcgtaaaaaaaaaaattcggaacggagtcaaccgactttttttttcctcgaccagaaaattttttccggtttttcgaattatcgtcgtcatgggcgaaaataatacccctttttagaagtttcccctccattttaaggaattttaagaatataggtaataaaaattccaaaaaaacacctgtttttcttaaaagactccgtttttcattttagggggcgtgggattcccaaaaaaaattttttttttttggtttttaccgttttctgtgccccctcttcctctccactaggatttcattttatacgaaaaaagcccccccccccccctttttttttgctcttccgttgactttgctgtctgtattcccaggattgcacatgcaccgaattctgtgacaaatgtgcagtgctctttctgctgaacgtacgctgtgaagaggaggcgaccaaagcggtcacatcggacgacttggagtccaacaatgtcgaggttttttcaaaaaaaaattgttttttttctaaaattttttatctgccacgcttggttaggtggtgcccgcctgtggagcgcacttgcgggacaacattgatttggagggtgacaccggtgcaattctgctcgtcaaactgcgcaaaggtatcgaaaagcaaatttgtgggcctaaaaaatcaaaaaaaaaaaatttttttttttaatttttccctaatgtatgccccattttctcatatattttaattattgtacaactaaccacgaaaaatttgggttttttaaaataatttttagttataaatatttgactttgacggtttttctttaatttcccaaaattttttgggtttatttgcttgggtttttgaaatggaaattttcggatttttttttacaattaacttttttttcagtaatgattgactttcatcatattttaaggccaagaaattcggatgcgctgttatggcaaaaaggtacattacgtctatttgtttaacttggaaatttaaggtgattaaagataagaaaggggataattttaagaaa

SEQ ID NO: 8858 - DNA, 1213 bp, Heterodera glycines
  misc_feature (104)..(104): n is a, c, g, or t
aaaaaaaaattttataaaaaaaaaattcatggcattcatattggttcgatctgtcatgaaaatgaaatgaaaacatgaacttgcttgtatccaagcaaacattnttcttcaattttccacccattttcaacaattttgggtctcaggcctcccttcaaaaaaaaaaaatttttttttacccttgtccctcttcccccaaaaatttgtttcccgtccctcgtccagggcttttggcaaggagtgcgccaagtggaacccgtgctccgccgtcgcatttgagtacgacccggacaacgcgttgcgccacacggtgttggccaagccggaggagtggccccggtccgccttctccgacccggccgagtatgaaggggacaaaatgcgcgaggcgccctacaaggcggacgccaagccgcgcaagttttggctgggcgtcgagtcgaccggcgcattgcgtgcggaaaacattgtgctcaggtgggcaaatttatgatgaattataatttttcaaaaaaaaaatgctagaaaatttttaaaaagtttttttgaaatttaaaaaaaatcaattttttttttggtaaattttctgtttgagaattttttttgaaacttttttttcaggggcggggaaccgacgcggggggggggaggcatagttcacccagtcaatttacaaaaatgggtaccaatacggcaatttttggggctttttcggctttcccccaaccactcccatcgactctttaaaaattagttcatgataaatcgtgaaaaaaacaggaaaagaaaacattagaaagacagaattttttggagctgggctcggaattccatccctattatataccaaaaatttcttaagaaaattagtaaaaacaattttctttttggcatacccaatgaaatttacttaaattttttttttaattcaaattaaaatgcggtaaaaaattgtttgtttttttttgcagtggtatccaagtgctgaagaagaagctgatcgacatgcaggaacagttgaccattgaacgcagtgccatggagcagcagccgaccacatattattaatgaaacaaaaacaatacaaaaaaataccaaacaatttttcgatttattatttttattgtttctttgtttgatctcctctgttttataaaattgataaaaattgcatttttaatacagttttttacataaattttgaaatttgatt

SEQ ID NO: 8859 - DNA, 2582 bp, Heterodera glycines
ctatgcattttccttcccaggttctattccccattatgcaaataagaaaatgattaataattatattttttacatttagaaatgcgacactttttaaacaagaaaaaaaatgaaacaaggaaatgaaggtgaagaaaagacaacattgacatatgtaccatgaaaaatgtcctattttttgttacccatatctaaattaaacagcaattcatttgcatgaaaaaagacagatattttgggatttataacagcaggaaaatcaagaaaattttccaaaataaagatatcgcaagttaaaataagattatggtgtcaaaaataagcacatttttgtaaacttggcaaaaacccggcctttccttgaattataatcattatgcttttcatatgatccagtttctcaaatagtgtaaatgttattgaatgactaattaattaatttcctgtttaaagtgtatgaaaattaattaagaaataattaaattaaattctgcatatatatggttagtttttcaaatgtccttgacaaaaaattcctgttagatacttgaaatccatatcagtccttggacatggtaatcggatgatgttgattaatttttaagttttttttgttgagaaaataatattattttaataattttttagatttggaagtcatgctttacggtatgacataccgataataaaacagcgtaacaaacggtacatttaattaataagtgcaaataaaaatgtagctttggaatctttaaatttgttcagcacaggaatttctttgtgcacttttcgtccaccacattcacaaaaaacaatcgcagaaacatatgcagtggggcagaagctgtgtacatatccgtgttcattagggcaaatcggcccgatcggatcaaagtgtcaaatgattggaagaattgctggtgggtgtaattggcgatcagagtgttcgggtcgtggacctaaaacagggacaattaagctaaattagtcgcaattagcacttaattgccaaaaacctcaatatttatctgacaaattgagccggtgaaacgctcaaagtgatctggaatatttattgcgttaaaatacagtttagaaaaaaactcaaaaatttatcactttttgtttattggaacataaatatttttacaattattttttaatttaaaatagttacaagcaagcagttcaataatgccaaactctgctccctcaatgtccattagcagcaaatcaacgggctcctgttcccattttgtgtgattattcataaagtcaatgatgccaatttgtgtgactaatttccgctcaatggcatgttcttaataaaaacataaaatttaaaaaacaaatcaaaaaatgttaaaatttatgctgccgccttactgtcagcaattttagctagggttacgccccgaccccgagtcccccgacatttttgggcctattccccgacatgtgccccccgaccagggctgggcgcaactcgatttttaattacggaaatccgcaatccgcaattgcggcgattttctcagttgcggaaatccgcaatccgcaattgcgggggtcaaaaaaccccgcaatttcccgtaatccgcaatccgtaattttcctaaactttttttttgttttaaatccaatctaaaaattggttaagagtaattaatgatcagaataaaagctttgcatgttttttgaggcgaaaaatcccaaaatatgggccgcgggagaaaaattgcaaaaatagggcaaaaatggcagattcagagctgtggtcgaaaattttcaaaatttttaaattaaatttcaataatctcacccttttagaagcccttttaaaacaaaattaaaaagattgtcttggtttggcggttccgaaaggcaaataaattataatttgggacgtaaaaatccattctttttaaatttttaaggttcattttgggaatgatttatgaaggagtcccggttatgtaaattgccgacttttttttatttttaaaacagcttttttcgcggcgtgctttttccaaaaaaatatggaacatgggggggggggggggtcaaggcggtgccgaaagacgccgccgggaaaaaatttgaaaattattatgcaatttgttaaaagattttgtctaaaaatgactaagatttggagctaatatttaaaaataattaggagtttttggggtgggcggtgccgataagcgccgtcgaggaaaaattttcagaatttttaacgaattttgttaaaaaatagccaaattttttaagcacttcctcttttcccctttgctagcctccagtccctcttttatgtatgttcataatactacaaataaccaagaataagtcagatgaaattgaaatatgggtagccttttaataaaaatatttaaaaaattcattttataaaaaataatcttgcaagaaatcgtctcgaaaaataatccaaaattcaaatttcggatcaaaattgcggacaaatcccaaaagtccgcaaccgcaatccgcaatccataactccaaaaaccccgcaatttccgtaatccgcaatccgcaatagcgcccagccctgc

SEQ ID NO: 8860 - DNA, 1427 bp, Heterodera glycines
  misc_feature (1308)..(1308): n is a, c, g, or t
  misc_feature (1374)..(1374): n is a, c, g, or t
  misc_feature (1394)..(1394): n is a, c, g, or t
  misc_feature (1400)..(1400): n is a, c, g, or t
aatccgcaatccataactccaaaaaccccgcaatttccgtaatccgcaatccgtaactccaaaaaccccgcaatttccgtaatccgcaatccgcaatagcgcccagccctgccccgacggtccccgccccaggccccccgtcaattagtcggggaatcggggaccccgaacgttgaaaaattaaaaaagacaaaaattggttttttcgttaaaaaatttgttgatcactaccagggttgttccgggtcacccgaatcgcgaaacccggaatttttctcgtccgaaacaaccatgatcactactcgatcggggtccccgacccccgacaatttagcttcccccgacccgacatgtgccccccgatggccctcggcccccgacattttgccccccgaggggtcgggagtcaaccctaattttagccatcgcctaggtcgacaagaaacgaaggaatgactgaccccatggaatgcgtaccttcccatgaaatcactggttgttgattagccgtctcggcaccaattgggccctgaacaaaagtgccacctacagattgtgtcaaatttgcattaatctcagccgacggatcagcagcgatcaaatggcactcagggtaaattttgatcagttcccgttcagctctaaccgtatgtccaacacctgcaaaaatttcaaaatttagactaatttttattttcttttttaggtttgtaccgaatgtgacaactgtgcaagttcgcttttgaagattgacattgggacaaaagcgcataaaatatttaaactcatcacttgaattcaattttagaatgttcgctttgttcatttgctctttccaaatttgctaaaaagcaaaaaattaaatcaaaaatattattaaatatatttaacatgagtaagtataataggtaattaattagttaattatcccgaacattgaaatgcggttgaatttgtgtccacgtgccgttcacatctatggaaccgtccttaagccgaacatcgactaaaccacgctgctgtttggcaagtgccgcaagaaaatttgtatcattaacctttggacattctaactaaaaagtgacaaaaaataaaataatttaatttctctataaaattaaaaaactaagctgaaaaaaattatattttaatttttctaataaatttttacttttttaacattaatttttgacataatcaaattataattatgtacaaaatgaattcaaaaaaactgctaaatttcattgctattctcttcttacttttggaaaaaaatagtaatgggtccataaaatattaaattanattaattttgaccttttttgaaatattttttgatgagtcaaccgttcggatcaaagcatatacaanagcagcaataacatcattanatgcantcatgacagtccaagcattgctgcttt

SEQ ID NO: 8861 - DNA, 1363 bp, Heterodera glycines
aatggtaatatttgtcggacatgtaattgcgctaaattaaaagttatttttgtttaaagattcaattatttcgaattaaaaatatcttaaaattcaaaaaaataggtggagatttgtcaaggctaaaatttggaagatttttgaaaacatttaaaatttcgtagaaatattgtaacagattttgtccatatgaccattgttagaggtgattgttgaaaaaaaattaagaaagctgaattttcaaaaaacttatcaaacatttaaaataaaaaagaatttgtatttgaaattattttcaaaaaattatcaaataataaaaaaataaaaaaaaagaatttgaattagaaattaaaattaaagacaaaatgtaccaatgaatataatgggttcacacggtagatatccgatttgacggcagaaaaaccagtgaatggcatctgcataagaaaaaagcgattaaaatacaataatttaattttaaaatttttattctcacataattggcaccggcacatccaaaggccggtatgtcgatgttagagcgagaacggggcaactaatgaaattttaaatttaattaggcaattaaaattgcaaaagtcaaaatatatgatgaattttttacgaggaacagatttttaagttttagactttattttttttgcggatagttcttgatgagagaagtacgaaatcaatctaacattttttttcagaaatacaatcgactttttaaaaagcaaaaatcctggcgccatgatttggcggacaaccgaaataaaatcttaaaatgtgtttgatttacaattgtgcaaccgaaatggacaaagaatgaggcaattttggaaaattcacacatttattgacaggtttttccaattttttagcaattattttggcatttttcagttttttagcaactatttatgtacttatttcgctatttttagcaactaaaaatccgttctctgactattactatgtatttatggaatttaacacatttaaaaacgaataacaaatgatacggaagcgctacgtgcagccgcaaattcagtcccgcgcgattcgcttggcattcgcgcagtggacgccgaacggtaaatgccatacacgcgacgtggcattatttgatctaaaaataatcttagaagggaagaattggttgttaaataaccaaaataagatttaattattaatttaaatgattgctggcgaatgtttaaaaaagaaattaaaattaagcaaaaaattttcaacaaaaaatagaccattcaattttttcagactataaaaagaattatttaaaaaaaaaatttaaattaatataaaaatgggtaaaaatccattcaaaggaaataaa

SEQ ID NO: 8862 - DNA, 1309 bp, Heterodera glycines
cgattgtctgctgatgtgttcccagccgaacaaagcggtggaaattgtgcgaagaatttcattgacacattcgaggagaaataccagcgcgaatttgggttcacagtgcgcggaagagcagtgatcgcggatgatattaggtgatcagcagagaagaaaagaggccggggattttggggatttatctgacaaaagcggaagagtggctgatcagatcagaaggggagaaggtgatctgatcagtggaatacagtgagctgatcagagaagtaggggttgatctgatcagaagacgagacggtaatctgatcagaatacgagacattattctgatagaggaggtcagagaaggagagatcgaagtattgagggcgatttagcgatggaaagcttttaaccaataagtcattccaccatttccgcatgttccctcgctcaaaattcattagttcagagtccgcgcggttgggcgaaggtttctgttccgcgagagaaatgatcagatgcaaaagactgaagaaccgaccccagcaaaattaaccaccaaatgcatttttgtagtgagttttcacggcttatggctgctaagtttcccttattttactgtttcgacaggaaggcgaattggacaccgacgttttcgattttttcgaattgcgtttcggacaccaaatattcggccccgccattgtgatcgataagaattggtcggtcgtcctccctcgtttcctttgaaaacttgagatttcaatgcgtactgtaccgattaacgtttgcaattcttcgcgccgttaggctttaaattcaaaacttgaccgcataatataaagagccggaatggaaaatctatacatcgataatatgtcagatgatacacgttaattgatacgggattagtggtaataatgctataatgtgttttcccgatctcaagttcagtacgtgcaactggacgacttgttcatgggcacgccaacggtgaaggagcatctgatggcgccggctcagctttgcatggtcggacacacccagacggacgatgcgtagacgcgtcaatgaggagggattttggatcagtacaaaatggaaatcactaatttgctaatggattaggtaggttgctaaagtagcgccgagcgggtattggaattggcgaactgagctttttaagaatggatttgtccttttcagctggaagaagtcatttcggatggagaggcgcgccgttcgcagttcgccttcgaactgtgggacttcctgttagtcttttttgccctccatccgtgtaaggatgcaatttgtttttgaa

SEQ ID NO: 8863 - DNA, 982 bp, Heterodera glycines
  misc_feature (35)..(35): n is a, c, g, or t
  misc_feature (56)..(56): n is a, c, g, or t
ttccggtccatctcggcggaatgcaggcggcgtcnaaatttcagatcgatcatatnggaaagtccaacttccgacgaggcgatgtgattttgtcgaacagcccgcgggcgggcggttctcacctccccgaccttacgctgatcacgcccgtcttcttctccgatcagagtggagcccccgactttttcgttgctaaccgtggccatcattcggacattggtggccttgtccccggctcaatgcccccacattccacaacattggcccaggagggggccgtctttcacagtttcaaaattatcgacggtggtgtgttcaaggagtctgagctggtggaacaattgatggcaccacaaagagtggccggctgttcaggcactcggaatctgcgcgacaatttggccgatttaaatgcgcaaattgcggccaatcaaaagggcattggccttctgcatgaactcgtccgtgaatattcgctgcccatagtcaaagcgtatatgaaacatatccaacggaacgcagtcgaagcagtgagacaattgttgaaaaatgtggcggaagagagtcagcagaagggacaaaaggttttgagagcgaaggattggatggacgacggaacggagataaaattggaggtggaaattgacagagactcagtgagtgacgggagggggcggaggggtagcgattctcgaccatccatcagacccctccctctgccaaagggcgatgctttgttcgacttcaccggcaccggtctgcaagtccactccagctgcaacgcgcctccggccgttctgatggccgccctcatttactgtctccgctgtttggtcggccgtgacattccgctcaaccagggctgtctcgaaccggtcaaagtccgcgtcccccccggcaccattctcagcccttcggaaaatgccgccgtagtcgggggcaatgtgctcacttcacaacgcctttttgtgacgtcattttg

SEQ ID NO: 8864 - DNA, 3447 bp, Heterodera glycines
agccaaaaacagcgccgaagtggaagccggggcaagcgaattaggggtggaatatccactgatcgaattgaatatttaggatattttggaattggaaacgcctgggggcggtggatgggggcaaaacggacaaaaatgcacgcaacaaaagccaaatgattttgtgatttagatttgataaaattctattttcaaccgcatttttgctttgaatcaccaataggatatttccgttaaaaatgaatggttaattcattagtcaatctctgctggaccattttagttaacttgaccaaaaaacaaaccgattttaaaaatacaccatattttttgttatctcaattttctaaattttttttgtacaactttttttatattatctgtcattggttctctaaaactttggcgttcgttttgctgtgagaaagtaattctttatcgcaaaataacaacaaaaagtgtctcttctttctttttttctcttttcgctctctaatagtcttcgatgtcttccccctcctccgactcgtcaaagtcttccacgaactgtcgctgcttctcccgcgttgtctccgtctcatattccacttcttcctcctcactttgctccgactcgtccaccctttccatcgctttgtcaattgtcttgtcactgaatttgtacatgctcccgtatgtgcccttcttcagcctctgcagcagttccctttcgatggcattgtccaattttgccgcggccaatgctttttcctccctgcggcgttccctccgttcgattttcctctgaatttccaatttttccgccgtttttcgcttccctttccttttgttttgtcacctgcaatgggatgactttcgcagtgcgtcccctcagctccatcttccgcattctgttcagacattggtggtggcgcataagccgcgctttgcactttttgcggacgtattcactccaatgcagcaaatgcgtgctgatctgttcaacggccttggccaaattcctgtgcagcttcaccttctcccaaagtttgcccgggaaatgactccgttcggccactttcataaaaaggaaacacacgccttaatcaaccaacaaatcactttctctcatttcgtcaattcgcttttgatggcccaccgttctcttctcggactgttgcgtattggctgttggccagcggacatgaagcacgattgcacagtccggtcaagttgaactcattgcggcagaacttcttggccttggtcctgaaacgaatcaatcccaaagaaaagcctttggaccattccctttgtttacttacaaaattttgtaggagcaatggcctttgttcaactgattccacacaatgtcatccgattgcattttcagcaatttattagccaaataagaaagggatgaggcacggatagcaatgaaaagaaggaaccgaaatctcaaaatgtgccgattttgtgacaattccctcgaaagaacaaacaatagcaaaagataaaaaggtgaaaaccgtaaaaatgaatacaacggacaatttgaccatttttattattcaaaaatctaacgaacaaagaaagggttttatcatcgcttccattgagacacatatttgtgaaagtcgaaggagtcgtccaatgtatcctaaacagaaaggagcgttcattccgtgacttttgattactggcatttttggcgaattttttaaaatagattttgatccaaaaatggagccttttgtagtaaatgaattggaagaggcgagccaaaaatactaatttaatttcaatgcatttccggcaaggagaaaaaatatatgtaaatttggcaaactttaacgcaaatttcgttaaaagggttttggaaaaatttcgcgaattttttgggattatttgtgaggtgggtcttggagagtccaacagaaaaaaagggattgtttttttttgtccgaaaaaccaatataaaagtctttttacaaccgggtctaaaatttcttggatccgacaataattacaaagttgaatatttttttagtttttgctaggattttgttagcaattgtgtgccaaaatgtgacatcacttacaattagtttttttagtttttttggtttatttttaaatttccccatttgttccttccccgtcctctcacctcaaccactttcttggcaattggctttcgctcggctattcgcatccttcgctcgtcgtcactgagtgtccgaaggtccaccggaagttgaatgatttccctcggttcgtcgcaacgtccgaaaatgacggaaccatcagaacgcataattctaaagaaacttttaacaaattagtgaaaatcctaaaaagcgactgacttcactttgtacaatctgaccatctcttttcgtctgatctttcctaaacacaatcgccacgaagtcatcggaaagagaactctgagaaccagcaacagattagcaaaaatgacagacaatttgtaggataataatgctcattgtcagaggacataaaaaatcaaaatagaaaaagcacttttcaatttacgctttttcaatgaatggaggaaataaatgtttttcgcatgcaacaattactaaaagcaacaatattctaacaaaacaataaacgtttcccgtttttggatctgatcaaaaatcaaatgttacactagcaaaaagatcagattggtggtgctgcactggatcatcatcgaaatcatcttctggggattgccctgataaactccgctcactcaaacactcatcagctgctgtagccgatctttttggcaatctgaaaatcgtgggcattacaattacaaattggcaattttgtataataattaccccctccgtcagttcttcgacggctctcagcctctgttccaacgcattgagcaaattggccaaatccgcgcatttcgaattgatttccgccacttcttgacgaaggtcaatcgaattttggtgactctctgtgaaaatattcaaaaatgtttttttgtattttctcacccaacgatccgtgcgaagaaccgagcgcattttcaacagtttttttggcttggccgatcatttcttgcaatttactgcgtttgctctccccgtttttcgcctgttggacattgttttgtttcagattttcagcagcctttttcccagaattatctaaattccgtaacttgattacctaattgcctttacttctttgagaaactcttcctaaatcatttgaattgttttgtcctaccgtccgccgttttcttcccacttttctgtatttgctggtgcttttcagcgtcttttggtcggttcgtgtcgcttcggattaattcgggtttaatggctgtatacaaagttttgtccttgtaataaagctggtcagctgcttttattacctgaatttaattgtttctagaaacaatcgttcattaattacctgaagaattacaaa

SEQ ID NO: 8865 - DNA, 985 bp, Heterodera glycines
ttgaaattgaaccgtgaaaatctaggccaactcgacagaattttagagactttttaatctattccaatttagaaatgcttttcaagtggtttatctatcacattcgcgatcagcgcccctaaaaagagccggataaatgatatgtcttaaacatttaacccaaatgactttgcaatcaaatcacaaagccggacgacattcaactcgtttttcgctaactcttttttgctgggtttaataattgaaaaaaaaaatttagaaaattcttattttctaaattcaaaaatcttaaactatcaaaataaaaataaattcctgaattgaaacagaccaaaaatctcaaaaatttcgccgatttgactcagattttcatgtttcgaccaaaaaaagaggggaatagtaaaatgagtcgatataaaatgaattggtggcaaaaatgaggtgaagttttaccgtctttgttgaagaatcggagagattggccaaattttcggcgaatgatgaagtggcctgaaacacgcggaaaattttctcttctcccccggaaacgaacaaattgctgaaaaatgggcggttcatcgactgcgatattttggattttcttttcttaccggtcaaccgaagtcagacaattaattggatgaccatgcgtttggggcctggcaatctcgaagaaaaagtccaactaaaaaaataaaaataaatgaaaaatgctaaaagaaacggaagggtacaccccaaaatatcgcagccgaaacgtcgccgggaaaaaatttttttttttttttagctaggtaaccaaaaaattttgcggcaacccgaaacggacagacagacctgtttgtgcttggcaaaaattcgtgtcgtcatgtcggcagagcaactgagcaaaaaagacccatccggtgaccagcagaggtcggtcacttcggcaaagtgtccgctaatggggaaacacttgggcaacaccgcaccctgaaacaaa

SEQ ID NO: 8866 - DNA, 2469 bp, Heterodera glycines
aaaaaaattaaattagaaatccgcgttcttcaggattgccagcattttccctttcgcgcactttcgagtcaatttgccaaaaatggaatccgccgaggaatgaatggcacagtgcgtaccgtccacaaggcgaataagtgatgtcatagcaattgacctcgtcgccaacaatgtcgccaaagcgagaaattggaagccaaatggagtcctggagattccaaaaaaaaattattttgggaacatataagaaatgaaaaagggttaccgaatctgagtaggaccatctgaccaccgtttggttggcgccagacgaaagcaactccaaacgctttggatgccatgctaaaaatggaacacgtttagcgggaacagttcgtttcctgcccccgcccgtcccccccccccccacgaaattcaaacctagaaattttacaagaaaatttttaaagcttttttttataagaaaaccctcatttagcattgtaggggacattaccaagtgcataaattgggccggtctgcgcgtgtaggacggattccaaagtgacagagatcggatgagcgacgccatcttaaaaatagtaaaaaagaaaagcgaaatttaacaaaagaataaaggagatcagtttaagcaaaataggtttaaatagacacaaaaattttcgaagaggcaataaaatttttgagaatttttattttcaattctgaagggtgtatttttaaaattttttttttttattttcaaaagtcatgaaagcatgatttcaaggggttttggatcgcttatcacgaatccgccatccatttcgacaaattacgaacccggacccccaaattcgaacaaaaattgttagaatttgggtccgagggttcgaaatggatacaggattcattgtcagcgacccagaaaacttttggaacaacaacaaaaaagttggcgtcgcccagtcgacacccaccgcagtttaacatctgaagattttaaaaacattgatttgaaaagatttgacggtcacccccccccccaatttaaaaaaaaaaattcataaaagttaaaattttcttgttactttttccaaaaaaaaataaagcaataaaactgttagcacttactttggatgcaaaatgtttgttggttcatcttgagctgttggtgatcatcatcatcatttgcgagtggtgtcacagtgatttggtcaccgccgccgacaaattgccaaattttgattagcccatcggttgctgcggcaagcgacaaattgtggcactgtccatcttcgctaactgaatttgctttaaattttaatttttcattaaaaaatcgagaaaaagattctttttatattatatttcagcgattttttggaaattctttttgaaaaaagtcagtaattaatcgtcaatttttaaaaaaccataaattgttgctgtgaactacgtttttctctcgaaaaaacattttaaaatttttcatgaaataaccttaagaaatttattcagaaaaaaactcaagaaattttttttagttttcagcgatttattggaaaaatttttaaaaaaataattattcagtgtaaatttatgaaaaatcgcgaagaaattttttaattttttttcttgaaattttcttatgaaaaaaaattcctaaatattttcatggaaaattttcaaaattgaatttttaaaatgggacgagtcactccctaaattgttaccattaaacgccaaggcgcgggtccacgatttgttgctaccgcataagtcaagggacaatttcttctggatggagtaagaattctaaatatcgaaaagtaaaaaaataataatttaaaatcaaaatttgcttcaaaaccgaccgtttccgagacaaaaatgtcaatgagtccattcgacaagccaacagccatgacaacggcaccacaaatgtgcgaaagttcaaaagtggatggaatggcactgccaaatttgagggatgaaacggcggcaccaatttgatcatcatcgccatccatgttcagaaattggacatcaatgtggtcaaattgaagaatggcaagcagtacatcgtcagtgtcgcctgcatacgcagccattttggacagttcaatgctcgcctttttgctgactaaaattggaaataaaaaaatgataattggagtcaattttcgaatcctaaaatcattccaaggcaccctcggtgcttccagtttaacctcccacctcccgaaaaacactggaatttaatttaaaaaacaaaagggattttttttttggaaaaattttgaaaaaattagtaattcatcataaactttaaaaaaaacgctaaagtttttaaaaatttttgtagaaacatttactgttgataattatcctgggaaaattgtaagggcaaatgtccccaagcaaaatatttgaaaaagcatttacgtcttttgatgcacattacatgacgacgatcaccatcagcaa

SEQ ID NO: 8867 - DNA, 1771 bp, Heterodera glycines
tttaaaatgattttaattatttttttatggtctgtaaagtacataagtacctttttgtgtttttgcctaatgtttccctgaagttccagtaacttgaaagcatgaaaataaaatttttaagctatttttcgagttattagggcttatttttaggtttttatttttagagctaaaagcttaaaatttttgaaaaatctatttactttggcgttatgcctaaatttaaagcggtgattcaaatgcaataaaaagaatttgggtttaaaaagttttttttcttatctggggacctaacaaatccgcagttaactagattttcaattacggaaatccataatccgtgatttgcggatccaaaaacgccgtatttccgtaatccataattttcaaatttttcattttataataaacaaaaaaatcctttctcaattaatttggaatacctaatcttaaaattttaaaaatcttttatttaaattttttgtgtttaattttttaaaatattattttgatttgcaattaaattatttttatttactttttaagaataacaattaataactttatttaattcaacaataatagtaagaaaattcattacgaaatttttgtcctttcgattttaatttttataaaatatttcattctaaaatattttatttgggtctgtaaaagttaaattaaaattaaaaattgagaaatgaaggagtttgttgggaattggcatgcttccaagcaccaaaaatttgacccaaaaacaaaaatcgtcagcatttgtccagcggcgcctgtttaatttacctaacgggattttgtaaattttaatggacaaattaatacattaaaataaaaattagggtataattaaagagaggaggattctttgagaatattaatcatatgatgcttatgctggtttaatttgaaatgtgcttttaatggtcgtgagtatggtcaattttatttacaaataattaaaatcaacaaaaaatttaatagaatatatttttaaaaatttctactgaaaattagggagcggattttgaagttttttaaattcaatttttttttataaataattttgcttaactctaaatttttgcttaatgcttacaaattagctttcaatttttatttattttttcgctttttcgtgcctaatttagaaattttctatgcttaattaagtgtaaaacgattacattttttcaacaaatttaacttgtaatccattttgtttttcctcaccggatgtaccacacactccaagtttttttaatttgaacttttttgtacccaccccacccgttttttttaacaaatttaaatttaaaatttgaaatccatttgttttactcccggggatccgcccacccttctcgttttaacaaatttcaatttaaaattttgtttttaccaaccattcattcattccattgcctcattgtcacatttggcccatttatttatctcccccctattaaattgttgccactttttttctgttttatccaatcagctgctgctctgtccatcatcatcacaagcagcagtcattagcagaaacatcagcagaagcacaaaagccactcgacgacgcgacacaaaattattattaattatttgttttatacgcacaattcaattattatttttacaaaaattatataaaatccgtcgccgccgatatgaaagttttatccgtcgctgtcgctgctgctgatccatcagagccgccgccaatttgtgactgaatgactccgacgactga

SEQ ID NO: 8868 - DNA, 1738 bp, Heterodera glycines
  misc_feature (1502)..(1502): n is a, c, g, or t
  misc_feature (1579)..(1579): n is a, c, g, or t
  misc_feature (1619)..(1619): n is a, c, g, or t
  misc_feature (1634)..(1634): n is a, c, g, or t
  misc_feature (1693)..(1693): n is a, c, g, or t
  misc_feature (1706)..(1706): n is a, c, g, or t
ggactcaaactcaaaatcgaaaaatgtcattggggaatggcggaaattagatatttaggctttttattaagcgaaaaaggagtgcgcatggatccaaaacaagtcgaagctgttcaaaattttaaaccccctaaaagtctaactgaattaaaatccttattaggagcacttacttatttccgtcggtttataaaaaattttgcacacattgctaggcctctacagactttaactcaggataaatttgagggtaaaataccagaaaattggggaaatgaacaaaacgaagcattacaaacgctaaagaaaatgctcacttccgccccggtcttacaatcaccaagatttgggaaattatttataattgagtgcgacgcatcgcgcagagcaatcggagctgttttactccaagaaacgggtcccgttgcattttcttcacgagcattaaataaacacgaagcaaattatccctcaattgaaagagaggcgttagcattagtctatgctgtaaaggaattttccccttatataattgggtccggtacaacaaagataataaccgactgtagtgccttaacaggaatgatgagggcaaaagaacttaagggcagattagaaaaataccaagtcacgttacagggatatgacttagaaatagtttataggcccggaaaaaagaacaaagccgcagattttctttcacgatataatatcccaggaattgaagatgaaacagaaacaaatttaactgaaaagaaaaacaaaaaagaaaataaagcacaaaaaattctgagtactgagaatagtgaaaataaaatagaaaatcaggacaatagcaataaaataactttaaaagaaataattgaagaacagcggcaagtaaaggaattagcaaaaattttttatattttgaaaactggaaaatatcccaatgaaattttgaaatggaaaaaggttaattcggaatactgcctaataaatggcgcgatttattaccaaaaagggacagagaattctgaaaatccaaaattaatcatacctcactcattaagaaaaagaattttttgtgaaatacacgacaaaggacattttggatttgacaaaacatggacagaaataaaaagcagattttattgggtcggaatgaaagaagacgtaaaacttttgattgatgcatgtgatgggtgtcagagaaggaaagtccaaccaggtcaatcaaatttctcaccaagtgttccgataaaagcaacggaatacccatttcaaagagttcactgtgacttaatgggcccacttaaaaaaacagaccgtggaaatttatacatttttctgactatcgatagtttttctaaatggataacagcaaaagcaatttctgatcaaaaagctgagactgtctccgaagtttttgtagagacagtaattcataaattttccaccccagaaatagtagttacggaccaaggcagacaatttacttcagaaatatttagtaatttatncaaaaatttacggttttgagcatacaatgtcaacggcttatcatcaacagtcaaatggccaagcagaaggctcaatngagaattgtagctaatattatgtcacaaataataaatganaagggaaacaattgngatcaattactgactcatgcattatttgcttataatacagccatacatacagttactanacactcaccattntatacaggtatatttacgacatcctaaattac

SEQ ID NO: 8869 - DNA, 3347 bp, Heterodera glycines
aaaaaagaggtattaaaacataaatttgaccaacgatggtcaggaccatttcaatgtgtaggagtggaaaaagaaaaaaataatgtaattttacaatcgctagataaaaaaggaaaattacggaaagttcaccaagaaaaaataaaaatgtataatggaccggtcgttcttccattgagggaagcggatgaacccttaaattgggaaaaatttgtcaatgacccaaatttagaattggaggaaaaaacggaagaagaaagttctgatgaggaagaaaaaaatactgagattgaaaaattaaataaagagaaaatgcacaaaaagggagctgaatttaaaaaatcactgaccaaatttggatttgaaagcagtgaggaagagcaggaatcacaaatcgcatttgtgagaaatgtgaatgaaaatgaaggagaaaatgaattggaaattttaataaatgaaaatttaatagaggaatgggaagatccctgcacaattacggaaatatttatagatggggaagcaaagtttgcctatacgagttggccagaagcaaatttgatttcgctgacttcactaatgccaatcgatttggttcaggatcattgggaagtgtttacgaatgattttggaaaggattatgtgattggaaatttattggggaccaactttgagctatttataaatgaagaagtggacaaaatagtgctcggaatccaaattcaatttttattaaatgatgaatgggattctaaaatggaaaatgaaaaagaaacatattgggaaaaattgggagaattaaatggacaaattcttgaattgcaacgaattcctgatataaatattgcttacaaagaaaatttacaaaaaaataaaaatcgtgaaaacaatgaacaaataaatggccaaatacaaattaatgtcataaaaaataaaactacaaaagttggggaaaaggaagaaaatttggaaataatactttcaaatgatttaaataataataaaaataatgaaagaaataatttggaaaatttgggcaaaaatgttgactatttagccatgcaatcgccaaatctgcctccggtcaaagtttttgaagatgatttggatgaaaatgaacggaagttaagggaacagatcgataaattgaaagaagaattggaaaaaacggaagagaagaaaaaggagattgagaagagaagaatggagcaaatgaaattggccactgtggacgaagttgtccttgaagatgaagaggaggaagaggaggaggaaccaacctccaaaaagtcccgtcttaatccgacggcgacgaaagaaattgtgcaaaaaataattaatgaaaaatgggttgccaatgatttggtcatgatcgatccaagagggatcaatgatcggaatggaccggaagatgtgatcgaaagtcggagaattgaagatggaataagagcaaaaaataggagtgtaaatgaaaaagcaatgcgagaattcgtgatgacgaaaacatcgctcgatcatgcaaaagaaattaggacgagagcaatgaatgaagtgaaatatgctgaaaagccaactgatccgtcaaggcttttgagaggtgaaattcgtgcggcggaaatggacatttgcgaaaagcaaacgaaggcaattccgcctgaagggaagcgattggcgatcaaccaactcgaaactcccgaagaggaggccaaaagaaagcaattttgtgcgcgaaccccgccaccatttcaaaatctgatggcacagcagtgggctcaaaagagagaaaaagcggaaaatgaagtgataagcccagaaaagttggaaggaattttgcaaaaaatcgaagaaatgaaagggaagatgaatgtgatttgtgaagaagtgaaagcgttggtgaaccaatcgtccgtgagcagtgatggtgaacccggcacttcgaatttcaaccgctgggaagacaatcagtggcgcaatcgcggacacagagggcgatggtcggcaactcctcgttggcgcgggcgagcacgacaacaatttgggaacgattggaatagtcaaggaaatggattcggaacggatggctactcataaataatttggattcttatcgattaaaatgatatagaaattatattttacatattatatatttaattgtcaagtcgtaattaatttttgttgcattttttttaattttcaaaaacaaacaaaaaaataacaataacataactaaaacaaaattaaaataaaatgcaacaaataattagttaaattgtcggggacaattttctctcaggaggggaatgatatctctataattaattgtacattagatatttcttattttctgactctctgattttgttagtgcctctgatcactctgatcaactttaactccgccccttctcgtaatgtggcctatttcctagcgatcacctcaattctttcttataaccgggatcacatttactcccgatccctccccttccgtcctgtacggatcggggtccctttccccttttactcattatattagtatattgtatttctcggatatccgcctacggaataaaggacattattccatgtgtatattagtaatgtacggggaaattagggcccacattagaacgggcattacatagaaatcaaccccaatgttctcacttgtaattggccggaagggttgcgcattaaaaccagataatgtgcgttggctcttgccgttttaatgtcccgaccatagagactctgggttacaaaaattacgcttacgttccaattatgggagcccctggtaaagagtaaatcaagaaaattgttctgcatgttaagcattaaatcgtcaagtatcagtaaaaggggtttttcctgttctttaatcttattcatgtctggaatcccgttaaaagtctcaacaccctccccgattaatcctaaaatactatcattcatctcaccataacaataaagaattttcttaggcggtggttcaattagattcttatgatgttttaaaaaccgtaatagccaacgggtcttaccactcccggtagcccccgagagaattagagtgaacggaccgcgaaacatttttaattcctcttatttatttgacctatttatattttcatagggaacatatttcgcgcatttggggcatagccagaaattatcaaaaaatgatgtaccgaaatgcaaaagactgtgttttttacatctcttacaaatctcgtaatgacagggacagtaatgacaacacttaattttatgcgggcagttcatttttcaatttaattttatttttgatgactatttatagaaggggtatataaagggatgaaagga

SEQ ID NO: 8870 - DNA, 2059 bp, Heterodera glycines
  misc_feature (2003)..(2003): n is a, c, g, or t
cattaaaatattatgttttctggtttagttatctttccatttggaacattggagacatcaaatagataacaaaggttaaaaaaaagcttattttttcttcacacatatatcaattttcattaaacatagtgaattttttaaataaaaatgacttttcgggtcagtttgaccctgaggcagtttgcttcggcaaaactgtgggttccggcttgttcgtgtgaatgcctaataataataaaacaataattttattctctgtcgaaatcagccactgtcgaaatgttacagcaccaaaccgaacggactaatttacgaattgttaatttgaaatagtgaaagtaaattttgctcatgattaagcatatcttcaaaatatttttttatatctaaaattagaagaaacgttctgtgatgagtccaaattttgcattgcatttaaaaaaaaaaattttataaattttttatatttttcccgaaattgtccgcaaatgtctggacgcgatcaaaagtactctatcacttttagtcgtttcttctaaatggaacttaaaaaatttgtaaacgaaaatttaccgaaaggtgaaaaatgtttaattattttccatttatatatatatatatataatacatatacacacacaaatcacgacaaaatatgagtgaattgaaggacagcaaatgggcctatggaatagagcaatatgtacagacagacagaacatcacattgggaacaattatatacaatacatagggatcgtttaatttgcttctaatccgcggcagcgccccaatactccaggttgtcctgcaacagctccatgatcgtgacggaatcagggcaagccgcctcgggtttcgcctttttttcgttaaaagcgtcttcataagcctgcaaaattccaagcgattgatatttaaaatgtatgtccgtcgtccacctgtgtggccagttggcaagcttcggctggcaagttctgcacttcgaataagagaatggcaaagttcagcgccacagtgagacgagtcgggtgcaatgggctgagtttgtcctttgccatgtcaaatgcttcttggtacgcttgctttgacttctcgacaacatctggaataagaaattgccgtttaaccaatgcctttttccgtttcgatgcgtcgttttaccggcgttctcagctcgggtctcagccaagtagcggaagtggtcggccttcagtttcaagtagaacacttttgcttcgtcattggcagcctctttgagcagaagacggtccaacaaatcctgaaaaccaacgaaaattattaatttggaggaaaattcactggaaaactgctgaaccactgaccacaatttctcggcacttttcctccacgtcgcgctctattttgttcagcaactctttggtcatctccaactgtctctcggtggcatcattccctttttccaagatggatgtgatggctcgccaagcataacgttgtccagcgactgcctttctgtacgcgacggccaacgatttgcgttcgctttcgttcagtttggcgtccaattcgaccaccttaaacaaaaatgaaattggggttcacacttttattgtgttttcctttcacctgcttcatcgactgagccatgtcaccgaaacgcccagtttcctccgcgaatcgagcaaaaagcaaatgcgtgtttcttttacttttgtcagtcatttgacgaacaaggcaattaaggaggtcgaatatacaaaggaaagagaaagcgccaaacgaatgagatgagaaatgtaggaaagcggagtttatatactcaggaaaagttaccaaagacaaaggcaaattgagttttgaggtattgtaatgaccaccaattctttaatttatacagtatataaggatgcattttcatcagccaatcccacagtgttccatcagttgttgccaaaataggtaattaatctttttgtgcttcatcaaccaatcacagctaacagaatcacaaaaccaaanattttcgcggacttttgtcactttacgccacataaaaaaaatatttttatttttct

SEQ ID NO: 8871 - DNA, 2056 bp, Heterodera glycines
aggggggggggggtgcctttcttcccctccggggggcggggggttgcggtgtcccccctctcctttccctccccagggaccgacctgcttcccccccccccttcctcccgtcattcccgtcgtgccccccccccttccattgccctgtgccccgctttgattgcgcattctctcccccgccctttcgtaccaaattaattcgctttggcgcactttcctaaattgaatcacccaaataaaaataaacaaattaaagcaaagcgttcgtcgccatctgagttcgaacagaatgcttaattgaaattggcttaccaaagtgccgggtttttcttcatttgtcggttcgtttgtcttttccctccctttctttctttgtttctttctccaaatggctgctcatgcgttccttttgtcccctttttgcccttcttccaaatgcccttttgttttgtaatgctcgtcaccgtccctttcggcaaaagttcattaagtttttggtctataaaagcgattgccattcctcgccggactgtccatttgcttaataaatttggtttttgcgttcgttgtccctttcactgagtgactccttccttctccgattcgtccctttcgcttttgcttccgttcattggcccttcttttcccttccctttcagtgtcccctcctcgtccgtttcggtttgatccccgtccttctccgctttctccgttttctccgcccaattcaatggacattcattcattggctgatcagccaaccaaagtccgtcctcactttctttctctcttcaattagccttcccctcttctcagagttatgtgcacggctgctccgttcagccccttctttttgagacaatcgccgaaagactgagaacggcggcgagcaaatggccaaaccgcgaatttgtcattttcaaaagggagggaatccgcaaaagctacgcggaagtcttggcggatgtgagccaaagggtcggcttcgttgtccgaatttgaagagtttgtttagagcgaacggttggccgccggattgattcatttgggcatggaaaagggcgaccgattgggcatttggtcgcccaacaaatacgaatggatcaccgcccaattcgccagtgcactcgccggctttgtcctggtcggccatttagttcgaccaattggccaattgtcccgattaggtcaatgtcaatccgatgtaccattctgaggatctctgttacgctgttgaaaaagtcggcattaaaacagtaattgcctttgtcttattattatcccaaaagtacctttgacatcagtgaattttgcagttgattgctccgcccacattcaaacgaacggattattatggcattttgagggaattaatccccgaattggaagaggcgccccggggggacgggcgcctgtgcaccgacactttcccgaaattgcgcaatttgatcattttcgatgcggaaaagagaacatttaagtgagtgggaatgggagagttataaaagaccgacacataaatggacaattaattaattagtcaattaattaattggaatttcagcggcgcatgggcatacgacacggtgatgggaatggggacggcggagagccgaaggaaattggcacagtacgaagcgagcacacagcctgacggtggctatttgttttccctttggtccacccaaattaatccgtcccccattagtccctccctcttattagcccccccccccctttagacccctgcaacatccaatacacaagcggaacaaccggcaaaccgaagggggccacgctgactcaccacaacattttgaacaatgcctttttcgtggggcttcgcgccggttacgccaaccatcggacggtgatttgcatcccaaatccgctttaccactgcttcggctgtgtgatgggctctctcgccgcgctcgtccattttcagacgtgcgttttccccgccccttcttttgagcctctcgccgcgttgcaggccatccacgaggaaaggtcagcattcagtggtcggtcttagtcattcgtcatgggaaat

SEQ ID NO: 8872 - DNA, 2801 bp, Heterodera glycines
tgcttaggaatcactgcgcgaattgggactggagaaagtgaagtcgcacttcagcgaatgaattggacggcggaaggaagcagtaaaacccaacaaccgaaggagagacgaatgacggccattccctccccccgtcggtgttcgggttttttatttattccgaaagagtaaaagtaaaatgatggccaaacaacagcggagggaccaaaccaacttaataaaattgtaccgatagtttatgcgtattggaaaaaacacacaaaaatattattgtaaaaagaagaaagcatcatccaataattttgaatgtaaacaaatcgaaagggagggaatggaaggaaatgcaaacaatgcgaaggatacaaacaaatttatcgcaaaagttaatacaacccaacgaatcagcggcacctccaaactcaccaccgtttgtttatttggtcacagtgatccgatccaaaattgaagtcctttttcccagcgtcggttgtcccaatcgcccggaattgcctccaactgccaccatttttatgccccgcgttgtgctgatcaccggacgacttcttcggcttcgtccaacaatttgaatacgttcggtgattggagcacggaacgccggcggttgaaatgttacgctgttattcttgcgcacttttctgaccatttctgttgtaagttcgctgaatggctcggcggttgtggagaagtcgtcaatgtcactgctgtatcggacgagggggcgacgcgatgggatgagttgtacggagggactgacgactttccccaattgaaagcgaatgtttggcgcagcaccggagagagaggcaaaacgatttgccaaactcacactaaaacaaacgaattgcgcaattggattaacaaaacccacggtctcgagttgccagtgttgtcggccacaacggtcgttttcgtagagatcgaatcgcttcgcattgaccccaaagggacaaatgccgtcgaggaagtgatgtcggtgtcctttaaaaacattggaacaaagtccatcacaaaatgttctgacttgaagcgtgattgccttccgaccgatgactttggaccgagtcgaaattgtgttcagaggtttgttcagttcaatgccggaccgtcgaaccccagaaacgccacgcttaagcacacctacaaataagctgccataattggggacgaattcagagacaaatcctccagtaaaaacaacgcacctctgtcgcgaagagagcgattcttttccaaaattttacgcgttttcggcaatgttccaattggcatttttatgtggtaaatgtcttctcggtcgggggccttgaaactgctcgatgagtttgagtcgaccagcatcggttcatctgaagatgtgtgtcctttcgcctttttttgagttcgttcgtccaccttcgtcactttcaaaatcggcagtttcccttccgcgcgactccgactttcgctttgattgttcgaccgaattaaactccggcggattcccttcgcattgctttatgtagcgcattatcgccaacttaagtataacccaaattccgattgtctctgattagttggcccacttggtcacccaacgctgtgacgcccaactcacgcaaatcgtctttgccttaaaggatgcaaacaaaaagttaagacactaattgcaaggcgtctcattgagcatccccccctcgcaccgaggtctttcatcagtgcgggatgaatgcgttccttgacgaatcgactcgcatatttgggcaccattgtggcaggaatatcacacgcgacaaagaaacgttcaaaggcggctaaaaaatcaaattggaaaaagaaaaatgagaagaaaacggaccggacatcgcagacactttcaatgggccaaagagaacgaacgaacggacagcttagagataattagacaaaaatggcaccaatttgaaggaaaaaataatattgcaaaaaccgaaacaaatggcgagaatggacagatcatcaaacactaatctttttactattatgtttttgggaatttacaaatggagatcacggcgatactaaaaacggaggaaagccgaaatgctcaattgatcaattttcaaaaatattagtagcgccatggattgggtatttgtcaccgattttaaaggaacaatctgatcactggggaatgtcttgaagagcgattcacagcggtcagtcagtggatgcctatttaagctcatcgttgtgttgcagttaagtccatctgaacagcaaaaagaatttcgaaacaaataaaatttgttgaaaaaacagacgacgtcagagaattgtcgcgatatgccttcataaatgccgagatcacatagtaaatgaaacggtattgggcctccgtctgaaccatcgtcgccctctgttcccgcaacattcgcaccgttttctaaactcaaaacactgaaaaaggagcagcagaaatgcacaaaacacctgcacatcgcaaacacattgtggacctgaaaatgaaaaaatagaaaagtaaagggggaaagaaacctttgagaagaatgcaattggtcaaaatgtccaaagcgatgtaagtgcctgggcaaacagtcagagaatattcgagtggaaaacaaccgaaaaaacggaacctgttctgccaatcccagcactaaaacatggagtaacagcgactttaagaaaatgaaatccgaaaaatcgagggggaggaccaggagagataatacaaaatggccaaatcacctgcaatggacgacagtcgggccatccgtgtcgatttgttccctcttaacaca

SEQ ID NO: 8873 - DNA, 2055 bp, Heterodera glycines
  misc_feature (1963)..(1963): n is a, c, g, or t
gatagaatggttcagtttcaaataaattcaccttcgacacctccaagaaaacaaacgatggacgtaatcatccagtgtattctcctaaagaatgggtaagcatataaaaatcgattgtattacatctcttaaagttgcaataattttgttacccttgttaatttgcgctttgaaattgccaaaaatgaacaaatcttgttattttgagccaaattttaaaagaattaagggcttttaggggtcggcattaccaatatgctcattgtcagccggggaatttttaataatttggttaaaaattgtacgattttgaaaatttttcctctttcccccccccccctatcgctgcgtgcgaaggggtcccccattttgagagcttttaaactgaaattataaatggtatggtattgaaaattcaaatttcagagaatttatactacctgcaaggctttgacggtcaaatttgtcgtcccataattttttcgttcgtccaaatccggccagtaacgaaaacatttaacctgacaatgagaaagaaactgtcaaataaaagctgctttaattgctttacccttccccgctcgacttcttttgtcaccataacaatgagccgagtttcttcttgccatatcatttgcctggtaaaaaaagtacgacagattgggttcaaatcggacgaaagaaacatttaccaaaagtcggtcacctgtaaaattacggattcatttgcaaaagtgatttaaatggggagaaatgggcctatagacgaacactgaccgtttcctccaaacatccttgcgttgaaatgtaactccgtctgaattccccaaattccgggtatctcctcgcatccaatggaacctgaaaaagtcaattttaatttgaagcattggacaatcaaaagtacctttatgtaattcgcgttgatgtagtcattctcgcggactgacttcagttttattctcgtgtgatcaaagggcaccacatttctgtaccgattcttgcgaatgttttcggttttaccgccctctttacagctaatgaacatttgtgcgtcctcctcacggtgtaaaccctaacagaaaatgtagtgagaataataaggtgctatgcaatgatttatttttcaaataattcgcaaaaaatgaccccactgatttcaaagcaattttatttgttttcaaaacctcaaattcctctacaaaaccgtcctttgcgccggtttttctttgcgattgtaacaaacaatcgatccgatcatcgatcgtcgcggctgtgaatcgcgtcgttgggagggcggcgacgagtttcacagcacttccatcattctgcaaatactaattacaatgggaaaaaataccaccagaaaagcattggacctgaaccattggcattcggacgtaattgtctaacagatcggcaaaacccctgaaattgtccttcggaacaatgccaaagcgtccatgcttaagcaaaaatgggaagtaactgaagggagggacagaacgcgcaccgtacgatggacccgcacgtgaatgaccgcgtcggtgctcttcacactcaacgcaaattcgccctcactgctcgtactctcccgcaacagaaaagtcccttcgtgtttcagtctcagcaaagcctccgcctcctgaccactggtcgaaatgtgaaagaaacctcaacagaaaagaaattagagatgttcgagaatgaaaattgaaactcgagactaaaaactttgaaattaaaatatgaaaatttttaaacatcgcaaaatgaacgacttacgatctcttccgacattaaccaccgtttcacagaagggtatcttcagaggcgaactcaaactggtgaatacttcacaatcggtcaatatgtccggtccgttgcttaacgctttgccaatttcttcgagtgatcgaaattcctgtccgctgggaaatctgtagacatttgatgcgttgtncaagggtattttgacgtgagtcacacggctcccctggtggatgggaatggtgtaatcttcgggattcgattcgcttggtcgaactaagtaat

SEQ ID NO: 8874 - DNA, 4565 bp, Heterodera glycines
gctttattttgttgaataaaaattccatttaaagttttggaagcgtgttataaaaaatgtccttatttttgaccctaaaatcttatttttgaccagcgatgtccttatttcgggaaattttcaagggtaaccctgtttttaggtcattatttgcctcaaattaattatgcccttccacaaaaaactgcccaaatgtgcaaatactggcaatagtgtcagaagagtgcaatgttttgttgttcctctttcttcacaccatcccaaaaaacgagatgtgtaccaataaatagagaatgccagagaaaaacattatctttttttctctaattttttgtctccttttggcgtactatctaatattttcattattagcaaaaacaacatttatttcgccacatataactttttttctactcatacaatttacaccaaattttgaatatcgatagagaaaaaaattctgcatcgatttctatgtttatttttatagcttaaatgttgttttaaaaagttataagataaaaaagataaattattactgtttttaaagattttatggctaaaagaattttattacggaagcgacagaccaaaaatgcacgccaaactcgtgagaacaagcgagaggagcgacgaaccaaaatggcaaagacgacgcaagcccatttggccaagaaaagtgagttttttcaacaatttttactcaaaatcattttttaaaatttcagccgctccacagccgaatcccaatgccgaaacgccacagcaagacgaagtagggccgtcaacatctgctgcaccggccgaagaagcgatggagccgccgccaccaactccaggaccagtgccaacgccagaaatggacgaggaaattttggaatttggcttttcgctgccatcggcatctgtcacaccaatcggcgatttggtgccgttttcgacaacaccaactgcgccaatggacaccggagagacgaccccgccaccgctggccattgacgagcgatcagagcgcatcgaacaactggagaagcagctcaaggaccgggacgacaccatcaaatttctccacgagcaggtgcgcaatcgagaagcgctgatcagtgatctccgtcggcagctggatcaacacatggcaccaccgatggcaccaccaacgaccagcaaaagtgagtgaaatttttccttttttaatttcataaaatctgatcattttttcaattttagcaccaccaaacagaggaagaccgaagaaaagactggaagaactgcagcgcagcgccaggcgcggcatcgtcgaccaaattgtgggcgtcatcgatcgtgatcgctcgcgttccgcgagccacgcatcgctggatcggatccatcgggatatccggcacaaattcgcgcactacacgccaaagaagggccaggagcggaaggagtggatggaagctgaggatgggctcctgctgcttgcccagcttgggacacagatggcttacaaacggatgaaggcgactctgaggctgatcaacaggcgctttgacactttcccaccattgataaaggtacagtttttcagaattttttcatccgaccaatttttttttgggtgatcaaaatcaaacgaagaatttgctcagctttaaaatatgatgtcatttcaacgccaggcgggcctggatatgtttgctctgacattgccggggcactgcgtttcagattgtccacggcaaaggacaatctgatcagcctgatccctgcccatggtctgccactgaaggtcagtggcgatcacgggcagggattcacaaaaattaccatttcattggcccatgcattgcgcccaaattccccttccaacaattttgttgcggctgtttttcccgcaaaagattcacgaacgaatttgaagaatttctgcggatcgttgtgggaacaaattgagcatctcaatgaaattgacgggcgcgaagtgaaatggtgaaaataaattttgttttttgattttttgaaaattttccaggtttcttggcggtgatctgtgttttctgtgggccatcattggccattgcggttcggcaatgacagcattcccatccccagtgtgtaactgccgaagagaccatctgatcagttcagcaaaatgccaaattcgaactgtgcaagaattggagagacaagccgatcagttccagcagctgacccatggaggagacaaagcaacggcagaggctcgggctctgacgaaaggcattgtttgtgcatctctgctgccgtcgatcagttttgagcagatgctgttggccccattccacgtcttccaaggcctcggaaatgctctgatcaaggagttggaagcgggagaaaatgccgaaattgctcagcaattcttcagacgaataggggcaagaagggaagcgttcagaaagcgcgacttgacggggaacagcatccgcaaaatcctcgtccatgccgatcaaatggaggcccttttcgaaacggaatgggccaaaacaatttgcaaaacaatggcacatttggggaaaatccaaattttcaccaaagtaattggttttcatttttgtggaaataattttttttaatttaaggcccagccattgtctccaggtgatttggatggactggagacggcagtttaccagttcaaggcatttctcgacgaacaaccaatggtgcgaacgcttctttcaaaaaagacaaaagcccatttgctgcttcaccactttgttccgtttgcgcgccaacacggatttttgggccttttggatgagcagggtgggaccatatcatttttgggggttcaattttaaaagttgtgattttttaggagatgaggcactgcattccgtgtggcggcgacttgagcaactttggaagacgatgccggactctgaacaaatgcgacaacagctggagcatcatttcgtctcgaattggctgctggacaccggcagactcgacgaattgaagctggtgagttgatggaaggggatttaaaattttaatccaactaattaagcgggaggaggaacaacgggagcaagcggaggaagacaaaacgaatgaagaaagtgatcaagatgccgacgtcgatatcgttgactgatcgaggattgatggttatttttcattacacatgacaaataaaaatgtttaaaaatttgtaaacaattttaaaatcattttggtcacttttcattttatttattcattaaaatcatagaaatacatcaatagcatgcactgggaatcgaacctgggacccaaccctttggtgaccttctcacagaccactgagacaagtattttaatcttttttggtattggagctcatttctgggatggtgtgttaaggaaggaaagaaagagatttaagattttttttcgcgtaaatttgaaaatttttttggctgctcaaaagttcaatttttaggggtgtattttcaactctcgcctctcgtcccaaaaaacgagagacgagaggtgagagtaccaaaaatggcgagagttggcgagaggcgagagacgagaggcgagagttgtcccacccctgatataaatgcatctccacaaaattttgtttataagatttttggtgcagatgactcctttcaataatataataatttttaataccaattttaataaataaccaatgagataaataaataaataaaaattggaatttctttaaaagatttaaatttaaaaacgaaccgaatatatgtctttcgtaatattgttattattttgttgtacaaaagttttgtgaaatttaatattattaaaaaataaataaaaagaaccttggttgttaaatgatggaatcttccgcaattttttttcgtaaacgatttttactataaaaacataaaagcaaaaataaatatcaaataatatataaaaaagagaaaaatgataaggaatttctcatttcgacctattcaaaaacaaatctgataaattttaaaatattgtaaaattttaaagatgtcaaaaaaaaataaaaattattcatttcacaggatagcaaaagtaaaaaatttaatatccctttaaaactcggtcaggtcacaacccatgaatctgttaaccaacactacaatgcatggacaagatatcataatcacttgacgaagctgtaaaatataagcaattaaataagatgcaagattaaataacattacatataaatacttctttaaattaaattatatctatcaaaattaatttacattatttaaatatttctttttaaaacctaaacattgttttttaagtatataaattgaatttttaaaattctttgtttgaaaataaacaaaattaaaaatgttaaaatcaaacttatccgaagatttgagggatctttgtaactgaaattttagaataacattcatcagttagcctactttgaagttggcttggaaaaatatatttatatttgtaatattcattaattatttgattattgagagctggatgaaaacaaaaaatgatcatctttgagaaattatcaaaataatataataaaaataaataatgataaatca

SEQ ID NO: 8875 - DNA, 936 bp, Heterodera glycines
tacttcaattaattatttaattataattactttgcatcaaaaaaagaagacattttctgaatcagttttcataattaataattgaaagaaatttatttgtataaaatcatattagaataaaagaaaataattgttaaaattttttattattcaccaaaatataattacaaaatttatacaattaagtatagaaagtagtttttatttactaacagcaaattggaagaaaaaggaacaaactctatgtgaaaaatattaataatttaaaaatatatcaaaattaaaaaaaaattatacaataattatttaaattaaaattatagcacaaaagattcaaaattcaactcttcatcgtaaaagtaattaaatattatatggaattgatattacacataatttagaataatgattccttaattatataatgaaaacagagtatttaaaatttaatttactaattattaaaaaacaacttttgtaaataattaatgtgctaaataacatcgttgacatttaatttttaaatacccttaatcagctcatgtataactaaataataataaaatttatatatacttatacttttattcgccataattgtgctgttaatgtctaatattcatcattatatctaaataaacaaaaaaaaaataataataaataaaaaagaaaaaaaaatttcaaaaaagtactctttgcaactttcgcctaattttgcacaatagtcaatttaaatgaaagaatattgaattgataaaatattttttcattaattaattgtctaaaaaaagattggtctaaaaaatgaataataaattttttattaatttaattaattgcgtcttctaaacttatatttcattcaattatttgatttaatttaactgaaattaagaaattataataacaattttttctaagattttgcatttttca

SEQ ID NO: 8876 - DNA, 2814 bp, Heterodera glycines
tgcgggtcacgcgcggacttcttccgtagcccgtagtctcgccccacctacttgccgccgtagtcgagtgtgcggcggttttttagcgcaataagctaaattaaacttttatatttgacgttcttttcccattttgttgactactggtataaaaacgattttgaggacccataacatgcgtggttcgacttcattccctgatttttagacttagctcgttaagagctttcgaatgataccaaatttgtttaaaaatttttatttaaaattgatttttggctgatttttgaggcaaattttcgtgatttaaccggttcaaaaaccggtttaaaagctttgccgctcagtttttttgacggtttaggcgttttcagcacctaagaaaacctataaaagtatttttatgcgactttgagtctgggacctatgatggatattttccatgatttaggccactgtttccgccggatcaaacgtcaaactcagcggaactgaattataattgatgggaattgatttgatgctgatttgtgaattatttgatgaaatgacagatcattttgaatcactactgatggtttgagaattgattttgatgctctttttcgtcgattttttttttaaagttaaatatttcattctaaatttgattaattaaaaaatatcctttttttaatccaattgaatggtaattcatttacttttatccaccatagatcaaatattcctcatttagccgccagcttaatttcaaaaaattaatttgggggattttctcaagaatattattttaaaaatggaatttaaaaaaaatataaatattaagtctaaaataagcactttggaaattttctcttttatttggctttcttaaaataagaaatttggctttattttgtattttttcttgttaaaatggcctaaattaagcgcaatttggattttttaacaaaataaatgctattttattttttttgtttctcacccaatggaatatattgaaacgaaaaaacaacaaaaatcagtgagcaaaaacgagcatcaaaaatgatcagcatatcacttctattcatccccataattcaaagtgtgattgatcatttctcaaatgcaattaattcacttctgctgaatttactcgcccttttcgctgattaagtgcaatttgaattagatatacactttacaatggcgtggtacataacaaggatggcacggaattccaatttccgaaaatttttggggcctcggaatgctatccctggtatataatggaaagttagcttagcttttccatccccacattcttttcaagtcttaaaaaccgtatgcccggcgttttcggggttgttcatcaagaataggacatgcattctggccaacttcaaatcccggataatacggtcaaaaaggtaaacaaaccacttttgaatgcaataaaatgaaagcataaattggacagtgttaaaattgtcccaattttcttcatcccattgaatggccgccgtctccccaatttggcatcggttgatcatccatcggcggtggtcacatttatattcgtttgctttggtcagtaacagcttttcaattggtccgttcattcaccaattcaaatggcaccattgacattggcaccgcatgaacagtaaataagaaatgttctgatttggagggttcaaatcttacaaaaataaaaaatgtttttatagaattatcatccgttgaaacgaagctatcatcgtgtatttacgggctttaaacggtctcaatttttattttaaaaatttagaaaacccccaaaaatttaaaaattgaaattttttttttattttaaaaacagaaaaaccaaaaaaaaagatttgtatttgcattttatgaatgttatggcataatgttcattttttggcaaatgaaatattaaattttcagaacgcatttttttcagtttcacgccaatcaaatcaaaactttctcgccttcgatatctttagagaacataattttaatatttaatcatttcctaattacttttatattaatacaaataaaagtgttttttagttatttaacatcataatcacaaattacgacaataattgagctgttaattgccgcaaaatgaatcgacgtttaaggaaaatgtgagaatttttaaatgattgtttttttcggcacttttacagtttaatgagcccctacgaaaaaaatcacagggatggaggggggattttggggtaaaatcattggtaaaaaaccaactcatagtgtgaaaaaacagaaatttacctcaaatctcagtacgagtttgcggtttccggcttttgatttgtaattttttcaaaattacctactccctacttttgtttttcattgggcccttaaactataaaaaagtgccaattttctctttttaagtaattttttacgtttgcatttcagttggatttgtggcgacgtttggatggacattctcccatcttttgaacgtgctgaacttggcctcaaaattgcattgctttcttaccgttacgatgctttggtggacaaacattttgacggaaaaaaagaattgacaatttggagaacaatcgaaatttgcgagggcattggaccagaaccgaaactgtctgtacagatcgatgacaaatttgtggcatttccgttgccggagcgtccgctgccaaacaaaatccgctttaattttctctggattaagtaattcaactttttttttgtgtatttttagacatttttttctttcttcaggtacattgaccattccgacagtgaatttctccgttccaacgagca

SEQ ID NO: 8877 - DNA, 2363 bp, Heterodera glycines
attctcactgatcttgaccaattgaatttaatctgttcctatggactgttccccgatgcaattggcgatgatgggccaaatgcaactgctggccaaattctctccaaatggttacacacgccgagcaaaaatggccaaccgaagcgattggtttgtgcgaattttgacgaagaagtcaacttagattgggtcaacagttttaaggaggtgcgtttgttcacattctcataaaattttggtatactaccgctgaccattcaattttttgaaaaaattttgaaaatttttaatcggatgggtcaacaatttgaaggagttgacctgctggttgctgccatattttcgttaaatgaccgactgatgattgattgcatttgattttcgcttcctttttatttagacatttctcggtgccaccaccacttcggtcagctacaaaattccaatttatttgcattcggaaacatcgccaattgagccatttgaatcggtgaacgagcgaaccaaagaaaagctgacattagaggaaatgtcacgttatgatggtggtggtggtgatttgctgttgaagcgatgcccaattagtgaaaaagcgtcggcggatcaatgggaaaacgaccaaaatttggacgccaatttgaactttgtccaatttaatttgtgtgctggcaaaagttcgactgggtaagcgtaaaaagataattcacagttcacacctaattcaaattgtgtttaatttcaggccttatggccaccagcggacgaagaagaaaaagcgggtcaaagcatcgaaatatcgtcggattgcgcggaagacgaattaattacatttgagaaatggccgatctcacacaattggaatttgattttatgccatcattttctctcggaaatgcttttgtgattctttctttaatacatttatttgctactttttttggtgtgcaattttctttagtatcaatgaaacgattgaccatttgtgaaatactttttacttggttaagaattaaaaaatttagcctattaaaatatttagaaacttttttattatattgtatattttttgaaaaatttccgatttcttgcaccacataaaagtggttttgaaaagaaaaaaatagtcaaatttatgaaccgttaataatttgatttccgatcaactttttaccgtcggatccaatcgaaaaatcttagtcgacccatcagccccttttaatgcatcccgccaacccttaaaaatttatttttcagcattttttgatttttggaaattttttgaatttaatggaaattttttcgaattttccaaaatcccgcaatcccgcacgggatcccgcaaattttaaatgcgggattgcgggattaatcccgcgggatcccgtcccgcaaaaaattttgagttccagtcccgcagcgggatccgcaaatttgaaatttccggtctctatctctgattaacaaaaaaaaaatgtgggaacggtcccagtcgaaaatggatctttcactacccgatctttttacatgaaaatcgcccttcaaattttcccatattttctgcacttctgctgactgaccaattacataatttttttccactaaatttagcaatgagtagtcaagctgaagccgttaataagcgaccgcgtccttggaaaatttgctgaaaattgacccatggctaaagccatacgaaaaggaaatttgccggcgcctcgccgaatttcgtcataagcttaattacattgaagaaaaggtacacaaattggataaattaaaaagttaaaattcgtaaaatgttaaaaacaggactaattttagaaatttgtaccgaaatttgacaaaatttgttaatttttccagtgcggtgggctcagggagttcacgcaaagctacaaagtgtatggcatgcacattttggaggacaattcagtccaatgtttggaatgggcgcccggcgcggagggcatggcacttgtgggcgatttcagtaagaaattttgattttttttcacagttcatttggcccatcaaaatagatggttttgccatgccatgacaccaaaaaaaaaacaattttatgcctcaatttttcctgttttattgggtcgatttttcgtaaatttcgggagtttctggcgatgtgccaataggcgtgtaatttgggctatccgacatttgcggatttaacatttgcggacccgacatttgcggataaccccgacatttgcggacccgacacttgcggacccgacaattgcggactcgacacttgggaatcacctttttaataaaatcgtgttaaaataattagaaaaatcatttttgaattcaaaaaaaaattattttttaattaaattaat

SEQ ID NO: 8878 - DNA, 4710 bp, Heterodera glycines
gatggcagcataaaatgccaatgattttttcttactacccttgtcatgtgggaccacttcgattaaattttattgcccacctgctgtgggcataaagatgggcatgcaattcttccatggaagcaccacgtgacttcatctccttaaaatgtacaggcaaaatgattagctaattttttattatcatattggaaggtctttattgtgggaaataatccgtgaatatcaaggcgggtcggagaatttgggatgacgtttcaaaaatggcgccaaaatggccggctccaaaatgaagctcgtcccccacccccgcccccattttatattgcaatttttccaatattgccgccgtcaaagaccaaaaaaaaaaaaaatcgccggacgaatccgtccgtatacagccctccaagccaaaaccaatcctgacacaaccctggaggctaggaacaaaaacttaccgtcaacttattaaccaacagtaacgatcgacagtcccgaattcggaagaacgctttcctggccacttcaaattccatatgctgcaaagcttcagtgccaagaagctaaacaaacaggttaatgggtccaattaggtttcccggctttaaataaaacaaggcatttccaccgactttccaatctcgttcagtgacacccaacgaggccaattcatatgcctccctaaaaatttatgtaaactgaaaatatttgatcagtgatcatatgcaaaattaatatcaatgcatatgcaaatttaaatatccatgcatatgtactatatttacactaacaaaagaaaacagacttgaacattttgttgtccaaaaactgcagcaactgactaaaacattgtttaaattgattgacggttgaccatctgctgcttttaataaaaataattttaatggagatcacctggtcagcggaatttccaagctttgcttaacaaaaaggtgcaaggatttaatttgtttacagtaagtagagaatagagcccatacttttgaaaaaattccggatcaggatcaggattagaaatatttgacccgggccggatttcaggattaaaacttgttcaggactcctggtccgggtccatattttaaaatataccgggatcaggatcaggattctgaaaaactctgataggatccggtcctgtccgggctctagtagtcagttccccatccgcttcccctgccgacatttaccatcatggaatacatgtgcaaaatgtacacagatttgcccatgaagccgaccacgaagccttgctgtgagggctccaaccgttgctggtacggggtgaaccagtgggatttgatgttgagcacgccatggcccgagtagcagacgaggtcctcgttggccgaattgaacgccacagtggaaatatttggttcctgtaatttcataaatgctactgccttttctgtatgtagtatcagtttcatttttgtatgtaattggactactgtattgctcatacggtatttcctaaaatggagctagcgtgggcttcatttttcaaccatcctcgaaaaggggatagtgtttcctttatggtgggactttttttcaattgccctcgaacggagggggggggctttattcgaggggggaggaggagcgaggggaggcggctcgaattcagaggagctgtattttgcggtaatgcgataattatttgctgcaatcaatcaaatcgacagtatcaaaatttggatcagtaatagatctctctactgtctttatcctttatcatattcggtgtgcagtctaccgtatactgtatttgtttgatcagaagatgaatatttgcagttaagcgctttacaatacactttacctgatttaaaatttcacgtttctcggtgtcgtacaaaacgcaaataccctgaaaacttgaataaactatactgtaaatcgaacgcgccataattcttccaatcaccttttcatcaacagttgccaacttgcgtttgctcagacttatgtcaacacatcggatcattgtgttcagacggacctaaacagacagaaatgggaatgctaattaagtattaggaagaaatgcgtcattgaataattaattttgatcaaattaaacttccactgaccacaacaacgggaaacgggttgtccacaaagattttgctgacctaaaagcaattagtgggcacattaaacgcgtaatttaacagcaactgtaataatttatttgccaatgcccggaaagaaagaaaaggtccgataaattttacttttttcaaaaaatatgtgtggttaatttgttaatgggtttatgaaaaatttgactttttagagtcaaataatgaaaaaaaataaaaaattaaatatgattgattggctgctgttcggcggtgtcccccaacgaataaaagtttgattttttttaatgaatttcattaggtgtaggatctgcaccagggatggcattccgaggcccaaaaaattttcggaaatcggaattccgggggtcaaaattttttcggaaatcggaattccgacgtccaaaaatgttggaaatcggaattccgtgccatccctgatctgcaccctcctcccccctctctttccctctgattagggccaactcatttcttaccaatccgttgcacattccagctaaaattgtctcccgaccaggcggaccaccaacaactttgatgtatctaaaatatttcccaactcaatcgaccgtctctccctctctctctgatcattgccatttgatcagtcagtgagtcattagtggggtgacctgatcagcgactccatgctccattcccgctgcttaatgcccttcaggtcgtaacatgtcaagcgcctgttctggcacaggatcaaatgctgactggtgatcaccagcagagagcactcaaaattttgactgatccgatccatcagcttgtactccaactgttcgccctccctttcgccagccgactggcgatagatcagcacccgatcagtgagttgaattgccagccgattgttgtagatggccacctttcgcacaagatcttggcaacggatgcgcgtggacttttgttgctccaactgctgcacaaccacatccgtctggttctcgcggaacgcgtaataatcttggatcagttatttgacttttttaaaaatatattttttaaaattgacattttttggggaaggggagggcaaacagatgaaatgtatttcaacagagaaatttaacaaaaaaatccaagtttctcaaaaaagaaatttacaattttttagtttttttttactggggaaaaactgggaaattaaaagattgaaaatgttccttttggagggggatgtggtgctgcactccagggatgtgtcggcatgccgatttccgattgacgacatttttgggcttcggaattccggtttccgaattttttttgagggaatcggcacatatccctcgtgcactcgcttcaggctaggtttttttgtctgcattttgccactcgccatttcaaagaacaaaagttatttcctgacttttgtgcagtgcatgtatcgtgttcatcatcagctggtagcaaaccaacgacccatcaatacaaccaacttcaaattttgcattactgtctaacccatcattggccactactccacacttaccaaccaaaaattgttgcttgaacaacaccatgctccatggccaagcatccaactgtgccatggcacccaagtcaatgcctgtaaaaaaagtgccatacttataggcaaagttgggaaaccaatttccacaaacaaaattctcgaaaacagagccatttttttagtgacccatgctcgagaaattttgttttcaaatctcgacccaatgaaaatcaccggtggattttttaagcataagatttccaggacgagaacaatttgtttttgtttacccccgacggtgtgcaaatttaacattcgatttgatccaatggtgaggaagaagcatccgttgttgaacaaatgcactgcagtcgggtcgtagtccaattgtttgtcacttcgatgggactgcaacaataaataatggttaaataaaatgaccttggaatggtaatcagcaggagtgatcactgatcagtcagtttagagtccaaaagaagttcgggggcttacgaattttcaatcccgcggaaaaagaaataattctcgagcatcattggttccccggtaatgggctcagagttggcagagtgccaaaaaatctcaaaaacaacccacgaaccaaatggccctgtgaatgggccaagaatccaatggattgggcccaatccgccaccaccagcatttcaccactgatctgattgctgagttttcgttcaacttttttttttttttgattttgtcgttcatcccacttggaagcaatttgtgcaaactgcagtgcccatacgggttcacctcccggcctttccaggcgtgccgtctcctcaccaatgggctattaaacacaatttttgcaaatttatttgggcaaaatttgcttttggcctactgttgggcctgatgccgaccggacagacactgtgccgtcaaagaagccgactgcatagaaaaagccatccgaactccatgcacagcttgtgcactttgtgtgcaccttctgtttgcttaaatcaatttttataaaatcatcttaatatgctaatatttcaaaatggtgttatgatt

SEQ ID NO: 8879 - DNA, 2006 bp, Heterodera glycines
tatactttaatttatccaattttgaaattcagcagtcgccaacactttggtgcccgactttcacaaattggcctttgcgctgctcagcggactgcccaacgaagtttctttcggtcttaacattctcaccgttctctcccaccccggttagttcattttcatttggacatttcactttcttttttcatttaaggcccttttgtgttgaatttcgccaattgtccccagcttatcgctcttttggtcgccctttgcggcgtttgcgttaacgttgaaggttggctgtggtttctttgggtttttcctttttcccttattaaataggttcgtccaatccgtttttgctcttcgattggtggcgtcgttcttcctgctacgacttcgcctccttttgggccgactcgggcgttgaagaggctcaactttggtcgattgtttataatccggacggaatgaaaatgaacgcgacggggagtgaatttgaaaggaacacagcgcaactgatgggcgacgaccgactcgacctcgacagaccgaccaattggagggtcttcaacattttggccgtcttccacaatctttcgtttgaggaggcgaacacggcccttatgggcgaaagtcacgcgcttgtcaggtcgaaattggatcatgaatttcagtttgttttttaaattatttttcaggtttttgctgctttgcttcaattgtcggtggcatttgctgcgtaaaattgcctatgatacactgagtaacatcgcaagaaatgtttgttccccgctaataaaaatgcatttctatcagataaaattggtcgaatgaacgcgactttatgtgcgaatggctgacacagcgacggcgaaccgccaaggattcgctgtcgttggcccatttgcgacaacactccgcgcactttgtggtccatcacaactcatttgcaagtaaacaatgatgagtaatgcattatgaaaatggatactaaatgtgctcaatggtcaggatatccattgcactgaaaatgcgttggagtcggcgatgctccaacgggtggagatgggctaccacggtacaatctgatcttgaataagcgagttcaaatgcaataatccatcggtgcttccctacaaagagtacgtctatcacattcggcaacagttcgagcgcagtagggaacggccatccgcgcagaatgcttactcagactttgccgcccaagaagcgatacgacggcacgcatttgccaatttgcgcaaagagattacggtacgtacagtgcatgcagtgcaagtattctgtaggtattggcgtgattttccattccgtcaggaagattcggagggtccggtgacgcgaagcattcgcctcacttcagcgctcattctgcgcaacatttgtcaccattccgtcgccggacgtcgcaaactccgcacgcatgagagtttcattaggtgaacaaaaacacatgaccaatcaaagggaaaggcataaatggaccaggaaaacaataactgacaatgagttaaacatagctaattttcatttacttgatttgtgtattgttttttgaaaataattgcaattctaacaaaattatttcattttttactcttcctttagttggctgtcactctcacagatggaatcagctcgtacattggcacagtgtttgagtgaaatggcgcgacacgcgaacaatgaaacggaaccacaacgaaatgtcattaaacggaaaaccagctgttcgtctggtgatctacaacagaatcagtcaagctttgcgtcagaacaaatggatgacaatgacacggcctaacacaactttcatggatcatttcgtctattgttaattgcgagcgttccttctccgtcgcgaatttgagcaattcgaatttctaatctaatttgaacaaaaaatcattaatcggaaattcaaatttcttcacttttacactagcgccaaagattttctgatgagtgaccgtattccctccatttccaatttgtttatt

SEQ ID NO: 8880 - DNA, 2233 bp, Heterodera glycines
ttagagttgtacgggaccgggacctggtactgaaaaaacgtacaactgagtaccgaagtcccggttttgaccgggaccgggaaaaatcccggttttttcccgcaaaaagtcccggtcccggtttatctcaaaattctcgttcccgtgggatcgactcatttccttaccaccgtttccttaccaccgtttccttaccaccgtttccttaccaaccgtttccttaccaaccatttccttaccaccgtttccttaccaccgtttccttaccaccgtttccttaccaaccgtttccttaccaaccgtttccttaccaccatttccttaccaccgtttccttacccccgtatttggttcatttccataccaaacgtattaatagtgataaacattgagattaaaacacacaaaaaaatttattcactgttttttagacttagctcgtcaagagctttcggattatcgcaaatgtgttcgaattcgatcgtttaaaaaaaaagtttgaagtgtcaaatctctgaatttttcgaattttaaaccgacccaaaaatatgtttaaactcaattccgcaacttccgggaacccgaaaccggggtaaaaatcccggagcttcagggacttcggattcttacagtacctgctgggtgaaatttgaatagttaaacccgggccttacttcctaattttcaggcccctacaaagcgatttgaaatcaattgtaaattcgggaaaaaaattctcgatccaatttaagaatccgaggaccggataaagctggtaaaatagacaaaacattattttaaaattttttacttcggcttgtgaaaaagtttgaatggtcattgttttgaagctttgtacggttctttttttttgttagaattgcttccattttattatctgtaacattaaacataaaatcaactgacttcttattcatgataagcatccaattgttgaaaatctcttttctattgtcgaaatttttgcaaaaattttcgaaaattttttggtatggaaatgaaccaaatacgttggtaaggaaacggtggtaaggaaacggtggtaaggaaacggttggtaaggaaacggtggtaaggaaacggtggtaaggaaacggtggtaaggaaacaacaccaacccgttcccgtacaactctagtttatttcttcaactcgcgcacacataaacagaatgccaaagttaaaaagttaaattattttgcataaattttttgcttttttttcactagaatcagtaaaaaaaaatctgaatggtgagcgctcagagtgattctcctgttcctaattggctgcttaacatcggaccaatttcttgccatgcgtggaacaaggacaaaactcgtaaattattttctttttatttaaaatgaattaatactttctagaattggctgtttcgccttccaacaacgaaattcacatattcgctcgtttggagactgtttggaacccgttgcacgtgctaagagaacacgacttgctgatcaccggattggattggtcagtgggaaagtggcacgaaatgtgggatgatgttgttgtttcatatctgaaacatttcagggctccgaatactaatcggattgtttcatgttcgcacgacaaaaatgcgtttgtgtggacatgggaggctgaaaagaacagttggaaaccggagatggtggtcgttcggataaacagagctgccacctgtgtcaaatggtcgcccaacggtcggtttgaccattccttactcattcattggcccattctttaaaatgtctcattttttaaatacatttaatttaagaaaaatgtttatattcgttttaatttatttttattaagaaaacaaattcgccgttgggacgggtgcgcgtttagtcgctatttgttattacgaagtagcgaaggaatcttcccccccccccttctaattgttggcttttaattggaaattaagcgtgaaaatgactggtgggtagcgaagcaaatcaaaaagctgattcgttccactgtcacctcattgaattggcatcccaacaacattttgttggctgttggcgcctgcgacttcaaaacgcgtgttttttctgcttatgtgaaagaggcgagtgaaaacgcaaaaataacaaatggaaatttcactgcctttttagattgacgaaaaaccaacgccaaacccctgggggaccaaaatgccatttgggagaattgctcaaggagtaccagt

SEQ ID NO: 8881 - DNA, 5364 bp, Heterodera glycines
aaattgttttgtgtcatttgtcccgttttttccgtttgctatttgtccaatttgcctcaattgtccatcaaagtgccatttggctgtccaccaactcgtcccccatgccctcccattcgtccgcctcgccgtccatggcgtcgtcctcgagcagttcgtcctctgccaattggtcaaagtccgactcttccgcccccaagtcgtcgaccgcctcagtgtccaagttgttttcctccgccaccacttccgcactcgacggtcccttctgagcattctccgccgcctttggcacggctttcactgctgccattggtttgacttcaaattggcaattttggcacaatattaaatataattaattatttacttgggctctttttgtcattggcttttgccgctggggattttttgtctaaattaattcaattttaattagcatttaaaattaataataattaccatttttaggcactcctttccctttggctggcttagcctttttgtctaaaattcaaaaattaactgtttaaatttcgctttatattaaaatccttaccctttttgcctttggcgtccttttttccttttccctttgattttgcgtcttttttaattccttaattaattatttgattaattagttaatttgtattaattagtccctctctcttttctgctttacctcctttcgctgctcctttcggcgccgcttttccttttgctggcgttgcaactgttcctttaaaagcatattccaattaatatttattatcaatttatttatacctttcttatttttcactgcctttgagttggctaaaataataaaatatttttaaatttttaattaattttggccacctgtctcaagaataacagccatcaccaagcaaaccatggccaggaagagaatggcgcgcattttaaaggtttttggaaaaggaaattattaattaaattaaaataattcgaatatgtttttcgcttggctttcttttggcttttatattcctccaaaatcgtttattttcattgaaattggaaatgtttttccaaaattttttgcccggaaatgatgccaatgccaatctttttttccattggtctgtatatgctattttcgttttccttcctttgattttaaaattttatttacaaattactcattcaaattttctttttgcatcaatattcttaataatttttgatgaaaaattttaaaaaaccaaatttctctattaatttgcttctttttaaaaccttaattatccgttttccatttatattataaattaatttccgatcccttaatttttcattacttaggcatgattatgtaaaaaaacatgaacccacgggaccaatttcttagaagaattagaagaattttgcaaaatgtgaagcgaaattttttggaacattgtttggtgagaaaattaaaagacaatgatttgaattaggtattcaattatttatacacaaggcacggatttaattgtaaaaatcacaaaataggaatataaagttaagatgggtttgaagatttgattcaattccccattagagggtcccgtttctccggtttacgaattcccattttcggtgatccccggtttaatcattccccgcctgtggggaccggtaaattggacgccagaaaattggacaccagaaaattggacaccggaaaactggacaccaatttcttaaaataaagccaggaattggggtgaaaaataaatttatgaagggtaaatggattaatgaattaaggaattatttgttagagtaaatcaggcattcaacatgcacgatgattgatcaatgtgccaaaacatgcacgaaaatgggcgatggttagtcaatgtgctaaaattgcataaaaaatggcaatcctatctaaaataaaactttgtttctttctttatgaatgttatggtggctttcttctcctaatgttacaataataaaaaccttatttattcccattttattacgcttataaaaacacagggatgtgcagactaaaataaaatcttttagcaaaaccaaaatttttgtttatttatttttaatttattttatatccaataatgtccaattttccggtgtccaatttaccgggagcccccggtactaccggggatccccacccccggctggcaactcaactgaaaagtcagccgatttttgagatgatttcttttttatgtcactttttgaacaaataatttttcgaaaaaataacatttttacttgtatcataagtagggtgcggatttttaggggcgaaaaattccaatttagggacctaaataggggcaaaaaattcgcaaaataggggcgaaaaagtttcaaacgtagaggtgaaatttattaaaattgccgttttctctatgtaataagttaaaattaagtgattgcagttagaaatgaagtacattccgaaattttcggggtttaagggtcgattcttaggggtgtatttttcagaaatttttgggtcgattcttaggggtctgttttttgaaaatttttaggtcgattcttaggggtgtatttttcagaaattttttgggtcgattcttaggggtctgttttttgaaaatttttaggtcgattcttatgggtgtatttttccgaattttttttttggtcgattcttagggggtgtatttttcttttttattgcattcttgttaataaatttccgaaaaatcgcgaaataagggcgagaataggggcgaaacgccaaaatagggacaaaaacttattttaggggtgaacactcaaaatagggatttttaggggcgaacatccaaaatagggattcctagggtcggatagaggcgttaaaacgaagaatttccgaacaaaaaatgtgtttttcgtgcatttctcgtcgagttaaagccgcagaaaaaataagtaaaaacctaagaatccgcaccctaatcataagttcgattcttaagacttttttattgcgaagatagaaaaaaatggatcctaaaaaaatattaacaaaaaaaagaagataaaaaaaaagatatgaataataaaaaaagattttgaataaatattcaattggaggataaattcattcacagtaaaacaaaaattgttaaattattggtcaatttttctttatttttaagatttttacttaattaatcattttttcatttttcttcgattatgattttaaaaaaataacaaaattatcaatttttagcctaaaatttccggtgcaccccaaaacgtcgtcggccgaaacgtcgtcggaagactttttgaaccataactttgttcactgtcaatcaaattaagaattgttggtgttgttcgatagctctatgtgtttattattaatttgcaaaatctcaaaaagtttggttaaggttcaaaaaagttatggccagaaggaactcaaaaacccagtaattcgaacttttttttgctctgatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttctgctgacgacgttttgtcctactccggccgcgtcgcgcgtttcggggccattctttttttgtttaattaagacaatttgagtgattttcaatacaattttttaaatgcatttggtgcttggttggcgctggaaaagcgttaccgaattttttttttcctaaaattgaattcgttaaatttaagctatataaatcgacgattgggatttttataatttcgcgaaatttcggtgccaaaagtgccaccgatgagaattttgcatttatgaaatttgttgagaattatctaattttttaagatttaaatttccctgctaactacgactccctccccttttcaaaaaaaaaaataattgaaaatttaacaaaattgtctattctagtagtgccactgccgaaaaatgccagcataaacccttttttccgatttcggctccccattttccatccgtctatttatatatatataatttttttatttccgttacaacaggtgttcggcggagcgtcgccctcctccgtgtcgatgagcaacggtccgcgcgaggagcaaaactttcacctgatccgcgttggctttgacgacacgctgcagggcgaactgatcaacgcggcgacaatcaattacaaagtgagtgcaccggcgaactgcttgagagcaataaatgaacgcctcgagcgtctcgaacgggatcagtttccatcccccctgaaaaattattttaaaatcttcaaacacaaatttttcgaaaaaaacatcttagaattttttataagaaaattttaagaaatttaggtaaaaaattttaagcgatttttggaaaactagttttttctcataaaatatgaaaaaagcctgaaaattgtcaaaggatgtttaatttttacttttaaaacttcagtgcataaaagtggagaatggcgatcgaatgccgcagctgatcgagcgtgcgttggacaaacatttgatggacccaactgaagcgcccaactactgcttggtccaattgttgccggacggaagtcggtggcaaatcaattgctgtttttttcaattattataaatacaaaaactatctaaacaattaactacttgctgatcaatcgttttttgtctttccttctgatcaacttgttgtggccaacactcactgatcaatgttgattggtctctcaatcaattagccgatttcattctcggaattctgatcaatcatcttgtcaacaccaattattaaactaaataagacttagtgttttgctcttttcataagttcgccgattagaaaaggatcaatgacgtgaactccacgttaccacttactaatttttcactctattctttacctggcattctcggaattctgttcaatcaactaattgacgccgatcagtaaatttgatttgatatttcttctgattttgctccattgtctgatcacgtttttttcttcttacatcaaaattggatagatgggaatttcatttatggcaaatttttcattaaaaagtttcaatttcaggcgagttcgtgttccccgaccattgcaacccgttctacgcggtcgcgcccgaccccagctcgcccatgttggcctgcgtgttgcgcaagcgtcgtggcatcggccctggaggagcggcggatagcggtagcttggccaccatgttgaactgctcgtccggctccacgcgttcggcggccgcgatgctggcggcacagcagcagcataataacggcacaaccggcggtggtggtggt

SEQ ID NO: 8882 - DNA, 5768 bp, Heterodera glycines
tgatcaaatttcccctcaaccattctcaatcgggagttgagggtgttttaattgaattgcgcgcgtgacccattaattttatttttgacccgaattgtgccaaagtgccaaattttgaattattatgccaaagtgccaattttgaattgtgccaaagtgccaaatcttgtatcgggcatttattttgaccaaattatcctatcactttttcatttttgaacaaattccaggcaacttctgtcgctccgtcagccaatcttttggcacaacaattggccggtcaatccgcggccgccgccaccgccaaatttggcaccactccacaacgccaacaacaacagcaattacccgcaaaacaacagcaacaacgccaaaagcaacaacaccaacagcctggtcaagcaggtgtgccaatgccaaaatcaatacaaaatctgttgtttgatagcttcgagaaatttttctcgacaataaaatttaaattaattacatggagtttttcgaggtcgagaattttcggagggtatcaaagaacaaaagtcgttcagcagcagagatcccgaggcttacttttttaacaatattaaaaaaaactgtgaatatttatttctccctcactcacggccatttaaaattagtaattaattagcgactaattattaattaattggcaattagcaacatcatcggtcaatttccgttataatttttggtcccttccaccaattgacctttgatgtttggcgatgattttcctttgggtgccgccgccctcgcacttttgccttttattggcaccgcgacacagtcattcgttccggcacttttcagcacattttggcattggcggcgctcagcagcagcaagtgccggtgctcattttgccggaccaatcgctgctcgagcggtacgtgcagcacaagcgggacgcccttgaccaattgcacaacagcgacgacgacgaccacgacgccgcgggggacgccgctgctgctgttgacgaaggtgggccccgggggcgatgggggggggggacaaaacgccaaaaactaaccaaaacgacgacaacgaggtcagtcacctaacccatcccatcgtcaattgggtggaatttgagtaccaccaccgacccgccgccaacaaaaaaggaaacttgtgaatgaatggctctgctgcataatatcccttttgccccctggggggatggggcgacaacaagtcgatttggggctgggcgagggggaggaattaaaggaaaagtgccgacgccatcatttgtataatcctattttattagggggccatttttttgcgatttacaaattacgaattatcttaaaaatgcattgcggatcccgtgggaccaagcctgaaatttgcggatcacgctgcgggactggaactaaaaatttttttgcatgacaggatcccgtgggattgccgcggcacacattttcgaatgttttgacattattgctcactcaatctttggcactctccatttttttgtctctcttaagacaaacccctgctggtttcagttgatttgggaattagtttatttagccccgagctctcaatccctcaacatttgggtgctcatttccctcccatccctttggcatgccaatgccacggaatgccaaagaatttgtcagctcgatattttgagtctcggggatttgtaagtcttgcgattcccttttcattccgttccccttttttctcaaatttccttaccccaaaatttctctcggtcttgaccttgactctcggcatcaatttttgccattctcggtataatttgccctcctttcagcgctccacaccgccacaacgccgtcggcaccggcactgttcgttccgcgcactgctgcggccgccgccgtcgtttccgcctcgttgcctggctccaagcggaacagtcagatgttggcggcggtgccctccggcgccgaactgccccagccgttgaccggctcattccactcggccatcgaggcgaccgcggccgatttgcgcgccgctgcggcggcggcacagccgcggctaaggtgggcaaaagccaggggagcaaatgctgaaagaatctgatcaagaagataaggggacgctgatcattgggcagactctgatcggaacactctgatcagtgaactctagaatagaaaccgaaaatttcaaattcgcggatcccgctgcgggattagaactcaacattttttgcgggactgggtgccgcgggattaagccttgcgaatcgggatctcgcaaaatcccgcgcgcgattccgtcccgtgctgctggtctctagtctagaacatagaaggtagctcgagactcgaacccacggcaaaaatcatcaaatggaaattccaaattattcataactttactcaaaatcaatcaaatttttaatttttgatagaagccgatagccctaatttgtaagtgtattttccctcaaaattgcatgcaaaaaactgctaactttcaaaaaaagttatgaccagcagaagaactcaaaaaaccaaatttctcgaacatttttggtcataaagaaattttttgaaattttgtacgcttatagaaaatactgtgccaagggctgatcgccagaaaatcaactgatcaattttcaaatcactctgctgatcacaaaaatttgtctccactaaaatttttaaaactttacaatttttcctttccatttaagccaatttcatgaaattgaatttccaaatcttaccaatgagcacatattgatttgtcccaattagtgttttgttgtttggccttccttgttttgttcgaaaattcatttaagaagaagcccctcataaattggttttgccataattagcacaaccaaaagcagaagaagcggcggcggcacaccgtcaggagaaaaagagaaccgtaccgccgctcattagccattaaccaaatatgcaaatttaattacccatttaattaccccactcctcgcggttttgtcccgcgtgtgtccaaattagtatttatatgtatgtatatttatgtaaactttccattcattcatattcatagaaattgttcaaaaattctttcatttttggcgggggagaagggctgggaaatttttccttttttttgaaaatttatccgctaaatggactgaaatgtatacactaattagcgattagatcacagcaaaaatttaaattccatgccatgtgggacaattaggggaataattaccattaattaattaattgacaataattatggccatttaaagacgtgctcaacagcagcagcaacaaatccctatactcagcacacaaacgtttgagaagcccaagtcgctgtttgaggagcaaatgcagcgccaggccatccaattgcgccagcgtggcgccgtggcgcgccattcgctgcacgacgacgacgctgaggcggcgccggcagcaaagacggtgcaaaaccaacagcggcagcataaacaggcggcccaagcagtgccagcaacacaaccacagcagcggcggcagcgttcgggcgacgccactgctcgtaagttaaaattttggcctatcagagtctatgttttttcggcatttttgactctagtccaaatccgggtcccctacattttttgttcgtccccgacctcgattcatgatattgttagcttttccgaccctgcatatgattcccggcatttttggctatcccaaatccggatcccgacattttgttcgtccccgaccccaattcatggcgttttttccccttcccgaccctgtctatgtcctcggaatttttggtttttgttcgtccccggccccgatttcatggcattttttgccgtcccacaaaccctgtctccggcatttttggattacttttccttacaaattaaattttttttttaatttgaaaaacaatatttaattattttcctccaatttttgtgggaccatcccccgccgttgctgacgccgttgttggcactactcacaaccagcagctggtgaccacacgctcaaaccgttgcagcatgagcagcaacggtacgcggcacacattccgctgagcgggcgccagtcaacgacaagttgcgagtcggcgaacaggtgggagaacagcgaaaggggcataaggagacggtttttctagtcgagagcaattaaagtctcgagactgaattggctttcgaaaacccgaaaaattctccaaaattcggcaaaattattccaattcggtatctaatgagctactctgatgaggaaaagtcgcgagaatggaaaaccttgactcattcgagagtgccttcccccgtcccgaaaaataatttttaaaaaatttttatcttaaatctaaggaagaatttttaaaggaaaacctcaataaaaaaaacatgaaatttttttaaattttgaaattgccaaagaattataatttggcattctgttaaattttttcattcgtcattttttaaaaccgggaaatatatttttgacacatttgtccatctgtcccgtgaaaactgcacttttttattggtttattattgtatttgtttgtttaaaaagggtggtgtgatttttggcacgtccgcccattgacttttgatcggtcacgggcgacaaatgaatgtaatgaatgatccatcagttttttgagattattatgcattggcgaagtggtgaggcttttgggaataattgacaaatttttggtttaaattctgatcattaatgatcagaaaatgagagagagtatgaaaatgatgacagagagagagacagagagagcgagggagagatagagagagagagatgggggagagaccgggacaaagaagagaaagggatatagataggaggaaaaaagagaaagagagagagacagcgagagagagaacgagaaattaagagtggcagagagagagtgagagataaacgacaaaaaaaaaaggaaaaaaccaactaaaaaaggggattgagagacaagggaaaaatgagagggagacagagagagaacaaataaattttttatttgttgtgtcacccgccgccggcgtttgaccgtccgtccgttcattttttgataccgccgacagcggcaaggccaaatcgttcgcataaaagtgtgaacatttttgagcacctaatttaattcattttttggggtaagcgacgaattagcaaagagtacggtattacactgggacggtcattagatactgtatggttttagacttcgctaaagccaatcccgtgacccgtagatgaaccaaacacaaaatattcttcaaaacttgcctaaaaattcatcgaccctggctatatcttctagccacggtggcccagccaaatcacgggcaattttaatccatccaaaacactgtcggatcaaaaccgtgtgtcagctgatcagtcccgacaggtttcatattgtcaccgaataatcagatgaaaacctatcctctgcctcaatctgatgatcagtcagtgatcacattgatcaggcaatggcattttcgtgactgatcggtccacagactactgctgatcaccttcattattatattgatagagaggatttgccaataatcaattattctttatcatcatcattcatcactattttatcacccatttttgcttcttcttttctgtcccccgtttgtctcccgccctgctgctgcttctgctggtctctcccgtccttcaatctgatcacctttctcacccccccccaataaatgtatatttggccat

SEQ ID NO: 8883 - DNA, 919 bp, Heterodera glycines
  misc_feature (100)..(100): n is a, c, g, or t
  misc_feature (131)..(132): n is a, c, g, or t
  misc_feature (141)..(141): n is a, c, g, or t
  misc_feature (154)..(155): n is a, c, g, or t
agctgcttattaatttgggtcaattgcggcacttttcgagtgatcaccagccgatcaaaaatgctttgctgtccccattatctgatcgcaatcggatggngactctttcgtccctccaaactttttccccnngtctccccngcttccccctccnnccaccctgttaaaactcaagtccaactattgctccgttcatacgatcaaatactctctctgatccatcggtggctggccgatcggctggctgatcacctccatcattattctttctttgtcaagcggtagtcattcagtcagtcagtcccccccccttccctctgatcactcaattacgaaggagtgaaagacaatcaacacaaagggttgggttggggaggggtgatcaattgtctattgtcctttccactcttgacacaaagaattggagtaatcaggttgatcaattgtcctgtagtgatcaggttgatcaattgtcctttttttctctcgactcacttaacccctgctgctgatgagagaaagcaattgaggggacttgcttctgctgctgttcattgtttatttttgtgattattgttactttttgtccttggaaagttaggcaaaaaacgttttctttccgtgtcatttttctattgtagaatacagtattatcagagtggatataataccgtaagtttttacagtatttgtcatcgaatttcattaaaattgggaccagttgaatgtgattggaatgatttgaacttttgaaattcaatctgtgcgcttctgataagcattcgtatgcttattcacctgccccaagccgaccaatcaaagagaattgatgctcgagagtctcgagtataattagaaaatatgaaatttctttaataaatagctagcaaatttcaaaacatttaacaactgctttaca

SEQ ID NO: 8884 - DNA, 4484 bp, Heterodera glycines
  misc_feature (10)..(10): n is a, c, g, or t
  misc_feature (2668)..(2668): n is a, c, g, or t
ttccttaccntttttttggcatttcgttttccaccacaacaccagcaacaacagccacaactactggtggtgatggtgccgtttctgcgattgtgctacgcaaagcgctgctccatccgtcggccgggcccgtcgggcgccggtacagctcggagtgcttcttcacgccggtgaactgccaccattttgtgcgccgtacagtgttcatgccgagaacgttgggcgccgccagcggcgacaacacatttgccgcgacgacgacttgttggcacaatcgaaagccgaagaagcagcagcagcagcaacaacggcatgaaaaccagaagcagtagtagatggaggcggacgaggaccaaacaacaacattttcggcacagcggcgctcggttgatcacttaggctgctgcttatcagaacaacgcttttttgagacaaattattctagatgaatattgtttaatttattattgttttgtgcatttgatttagttttttttttgccattattttttcttttattttttattaatgttatttcttgagcccgaatttcatgttttatttcttttgcggctttattatggcgagagaagcccaaaatagcattttctccgaacaatttttgatttcagcgacttacatataaaaacataaaaattttgacgttttggcacaaaaaacatatggcacatatttcgaggtttggcacatattttggctttttgagaaaaatttgtaaaaaaaatacaagaagattgtaaatgcaccccttaaaatcacctttcttgctatttttacaacattttcaaaatttccttttttatttcgaatgtcgaaagccaaatcgaattcttaattcgtcattggatttcgaagttccctgctggaactttcaatttataaaaataattttaactgaaaaataaccaaatttaccctccaacacctcgaaatgtatttgatttgcaatggtggcgaaaatgataaataatgagaattttctgtgatttttaggtattaatacacttgaagtgcttccaattttcgcacattttttagcacatcttttggcattttttaggtttttagcacatattttggcattttagcacattttttattacatatttcaggattttagcacataaaaatccaggctctagttatttaaggtatgtgaattatattttcgtcacgataggacagattctccaggctatgaagaataacaaaaaaaaaaaaaatcccaagaatgttggatgcataaaatggataacaaaattccgacctttactttatttaattgcatgcatagatttggcactgcactaatcgcccaaaatgccaccggtggtcatcttcaatcttttcaacaaacaaaaatgcatttaaactttttgcccgcctttataatcgggtgcccgttttagtactgagttgaaatggttttcaatggtcgtgaccataaatcctcaatggaaaggtgggatttacgacttggcacattattttaaagtaaaaggtcggaaataatgtcgaaatttggaagaacggacgaatacaagaggctacagattgaaatggatctccccgatccttggggagagaaaagtcgaggatcagggagcaaattttcaataaaaaaaagaccacgtaaatttcttggaaaaaatctttaaaagtcatttaaagaaaaaaaagttaaatttgaaagaagtaaatattgttgttttttatttacattttgttctgattccttaaaattcttcacaaaatatgaaatttatggcataatttgttaaatattttatctagaaatttaaaatttgacgcaatcattttttggacaaaagtctgtaaataactagccaaaatttcaaaaatgtttccgtcggcgtctaccgcacgctttccttaaaaattagctcagctcaacatcacaaaatttggacaatttttgaacaaaatctgttaataaatgacactcaactcttcaaaaaaaaaacaggattacataaaattgggagaaataaagataaaaacaaaagcaacagcacgccaatttaattattttcgatcatttaaattattattttttttctttttctttttaaaactctatctaatggatacaaaaaaaggcaccaaaaatcgcgaaaaaggcactataatagcacgaaaaaattgaaaaaaaggacattcgcaattccccgcatcggccggggtcggggagcaatttgaaattgaagcagctcatacgaatattttatttcgaaattatagcattaaatttaattttgttcatctgtttttcaatctcttatcccttcccacagttcatgagtcttttgggtcaatttttggtcaagagttttgggctaagtaccatttctaggctcctatcatttagttatcaactctcggaaaacagagaatttggtaattatgattttttcgactctcgactgcctaattgaccccttttttcatcggctattctcaatgttgactctcgcctcgcttcccagtaaaaaactcttgctcacattaaacatcgtgacgaacttaattgcctttttaaaattcccttaattcagattgctatggggaggtcatttatctgtagtgtacttttaccaaattcccattaaaaaatgaattaaatttntgtttttccgtgatatcattagattagttcacgcacttcgacatgttcttaacagcataaactttaatattatacgacatcttttttttataagaacatcgtctgtcaacaatttttaattcaccaataatagaaaaataaaagttagttaattaaaattcatttccttacaccgataatctccaaataaataaataattaaatattaattttggttatgtgacattaatcagcagtccgtcaacaaataattattgttgaaatacataaattaattaatagggagtacaaattagctttttttcgaaccgaaatcacttaaaactggtcctaatctcagtgattagtgcctaacgaatgaatatcgattagaaccatgtccgtcgcttaattagtcagatcatcactctcattagtatactctctagaattttgtaatcagtttccataattatcttcgtttttctatctttatttaatcatctcgataattagcttgtggtcgatttcttcatcggtggagaaagaaccaccgagtagaatttcgaatttgtccctgcagattctcgacaaattcttgccagccactccgtcaaacagcacttgctaattggttggatgccacaacaaaaaggactcaatttttggttatttaaattttaaaatattttatttccctgcggcgcctacggtacctccgggtatgttacgctctcaattaaaacaggaacagccgaaatgctatattgcgtgttttttttatttttttatttagaatttataataaatttatagcgatgtcaagcccgaaacccttactattatccggccaaccggaaaatgccgttctctaattgtaagaaaaaaacaaaaaaccatgtttattttttatttttggcttgccctagttcagcatatccatttaagcaaccaataaaaggtggttgcgcggaatggaatctgtagcggaaacgcatgctagcacaagtaaaaattgggcacggcactaatccctcataaagccatcggtgctttctttagccgctaaaagcccccgcttttgaatgaatcaaaattttgacctttactcgttgcttcgcgcgtatttccatctcttcaactaacaaaaaatgcatttaaagattcacactttttgcccgaatttataatcggatgcctgttttactgttgaattgaaatatgtaataaatccccaatggaagggggcggcgatttacgaattggcacaccattttctggacccgataatgccatccatttccggacaatttggcacatacctcagctgtccaatgatgaagccagaaatgtgtgtgcacatgacacggacggcacaacgaataagttaatttatatttttgtggcgcgacttggcatggctaatgcctatcacttttcaacttattataagaaaaatcgtctctaaaaatgccaattttcttcggctggatagtgccgtaagtccgtgccggattaaccgcggcacatttgggggcattggcgtttgtaatagtggagagcccatacacacacacaccgtatcccgcgcagctgcggtgccaaagcatcataattctcagcaaaaaatgcgccaaatccttccgacctcacggggtcgaatagcgtaaatggacctcgtcctcattatcacaagcaaaagttatccttatcatttgcttaatggtaccatctttgccctctctcccccttctgccttgcttttgagacggcactttctgtttgtgtgtttatgccagaggcatttcaccattataaaattgaggtcgtaattgtt

SEQ ID NO: 8885 - DNA, 5699 bp, Heterodera glycines
  misc_feature (5683)..(5683): n is a, c, g, or t
ttaattgattaaattgtaaaaaaaaatatatttaagttatgttgttaaatgttctaatttttaggtcctaaaatctcacttttgggcatgatattttaattttgaaaaattctataaaaacctgatctaattcccatccctatttttctcgatctcgatcgaattgatcaattataaatattagataagcatttgaacaaaactttgcacaaaacgtaaaaaaaaattgagttttagcaaatcccgataatcccgcgggatcccgaaaaaaatcttcgggattgatcgggaccgtgattcggtcgggatcccgactcgggatccgtcccaacgtttttacaaaatgttcgggattgatcgggatcgggattcggtcgggatcccgactcgggatccgtcccaacgtttttccaaaatgttcgggattgatcgggattcggtcgggatcccgactcgggatccctccggtccctgttgtccggtctctagtcagtacgatcccttccgccgtaatacaaattcaaaaacctaagtggcccttccgcagacacgacacaccaaacaagaaagctcacagcaataaatgaataactaacaaatagaaagcataaataaattaaggagcaaaaaagcaaagcatatgttgagagagctataattatgttgattttattggcttgctgaaggcccaacaacagcttctacgatatcacaaaaatttattggccccaattatcgatgtcgtttcccgctagtctatattgtaaagctctgagatgatcatgatctaaatactgttgatcggtcgattcttcaatctcatcgaataccgttactattcgtttaattgctgcatcattttatctatacttttttgctattggtcaatgctttatcccacgtgtgttgtcaagttcatattctcttaatctatctgttgcaattctttcttcgcttttaagacattaatgagcctttaagaaatttttatattaaaatcttgacacatttttaccgtgatagagggggatgttctttggcaaattgtcttctcagtgccaaatgaaaggcttcttgtgcgttgttcgtacgtgctagatttccaatgattgaatcgtgatggttccatgaagttggcacaaacaatggatcagccccatttggccgaatgacataagttcttaaataggactcattcattttttcaacctaacctagattttatttaatttcctaatatcagtggacctgccaaaatagtcaaagattgaatccgcgttgttttggaccttgggcaatttaacaacgcaattagtactgattttcagtataaaaacgctgtgtaaccaaattaattaattaattaaaaatgaaattattgtcaaaaatcctttttctgaccaatttatttgttgtgagcaattgccacccaattgctaccctttaccaagccgccaaaacactaaaaactctaaagagtgcgcatattttaacaagcgcgacaatcggtgccctcggtggagcaataactgcacaattaatcgaggacttaatcgagatgctagtcgaaaaatttgaaaataacggtattataatcataaataaacaacattaggttaggtatttgtttcagacgacatggatttgattgagccgcttttcccaattcttttcactctcgaaaagaatgaatttttgctagaatccaaagacttcaattattcacattttttttcaatgattgaagacataaccggacggagccatgttaaggaaatttgcttttacagtaagaaattttggaataattaaatttaaataagtaatttagctaaagatggtggggatagaaaaattggacgatcacgaaaagcaatggctatagtgcttatgtatggtttgatgaatggaaaaagtcttgagttatttttatgttcataagttgtatttgtagaagctgttgttgggccttcagcaagccaataaaataaacatattatagctttatcatcctatgctttgcttttttctccttaattgtgctttctatttgttatttattaatttattgctgtgagctttcttatttggtgtgtctacggaagggccgaaacacacttaggataaaagaagcggcgtgggttgtaggtgggcgcgttggatggtcgcggggtgttgtcgtccgccgagttggcaaaaggcggtgacgaccaccgacgcatccgtggaccccgtgccgtgccacacacacaacccacagcgcgttgtccatgtccgtcgtggacattgatgcccgcctggatgcacgccacacagatcacttccgccacaagcagcagcggcacatgcttttggaccagctgcgtttgcagctgcagaggcctgtcctgggacgtttcggcatcaaaaatgcacagacggatcggcaaattgtgcgcgtcatcctcctcctcatccaccacccgttcgtcatcatcatcatcatcatcatcatcatcgctgttgttgttgttgtggccagagtgaatgcttgactgtggcgtgagcgacacgcgagctggcgcagcttgttgttgttgttgttgctgtgccgccgctcggggcgcacgccacccaatcggttgaatgaagcatggttgctccgccgtgtggggaccaccacattttcgacattctctcgcaacttgttgctgctgctgctgacaatcgtgccgaccgtccgcatatgctacgcgcccacactggcgacacacttgacgccactcacagattgggcgccactggcgcccgccccggccgtccaatggtgcgggcgcacgattggcacggtggtggtcaaagcattcgtcgttggggaacacgaactggcagtcgacacacaaacgtgacgtgctcgtcccatccggcagctaaaagaaacaaatttgtgtatgtgcgtccgtgagcaggtggtagcggcgagcgacctgttcactgtgacagggatagttgggcccaaagcgcaggcaaaggcggcacaccacccgacaatgttgtgcccgccaaaaagtcaatgccggcggcagactgctcattcaggcgctcaatcgctgccgcgagggctgccgcgttgttttgctccgggggccgaagcggcaccacgtacggtcgctcaaaaccgggcgggtgcacttgaagcccaaccagcaacggtggcggatgcccttggagcacacggtccaacaaatgttggattagtgccgtcatgagcaagtccggccgctccgcttcttcaagcggcagaaaacggacttccgcaatttccccgcgcgtgttgcgcggccggtttctcatcatagtggagctctccaccacaaaacattcatcaaccggtcgccgcatctgaattacgcaaaatgttgatcatcatcatcatcatccgtcattgcagtttggttcattccacatcaatttattttacaatgatcacagaatttaaattacactaaaaaaaatacatattttacaacacagtcttacaaattgggcaaatgcgactgatcagcagccatttctcaatacagtctgggtggaacttgtgcagacagtcaagcacggtcacaagttcccctagcaaaaaaggcatcccacaaatgctacatgtttctccttcattgatcaaatgttgggtgatgtgggcgaatggcaatcggctgattttgtgtttggggtaggggggtggcgggggtggaggagaaacaccggtgccgtccccggccaccggttcgccatcaatgatcacccatggcggttccgcctcttcatccgtgtccgggctgcaccgtattgggcgcgaaagcacccctatggcctcacgcaccgctgtccgcgcagccaccgctgcagcgcgtgggggcggccgttccgaaatgttgaggatggtgagtgagggtgagcgaatacgttgacgcggaggagcactagacgtgctagggtgagggtcaagctccaccgactctcgctcccgacgtgtacgccgatagggatgctaaattgtggaaaaaacttcctaactcaaattcaaatataagtactaagatttatggtaattaattatcaatatgcaaaaacatttttaaattgattagctcaaattcaaatataagtaccaagatttatgtaattaattatcaatatgcaaaaacatttttaaattgatagatcaactttaacgaatagttgcgtaccgcttaattcaaaaaaaaatacaactttttttcaatcattcactatcagtagcattgccttttattttaaaatgattacacgttaacaattgcaatataagagtaacattattataccactgtcaattaacaaatcacattaaaaattttacgcttataaaccaattttcaacaaataattagaattttttacctcttaatttaagagaaaaaatacaattttttttcatcaatcaacatgagtaaggtttgcctttattcaaataattacatgccaaaaaaaaattgatcaatttaattaataatcctaaagtgtgtgtgtgtgtcagttaaaacattatcaaaattattgtttaaataaaatagcattcatcaaatgtcaaatgttaacacaaatggaaaaaatcacacatgtctttcagcggtgcgctcagcagttgccgacgagtctgtgactggttcgctgttcttaaacatgaacgaaaatttttttgtttatgtgtaacaattcgtaaacacctcttgcagagcagccgccccaccaagctgaacattaacaccaccacgactctgctccacttgtacaatttccggctgggatggctgtagagaaaataaaaaattagcaaaacataataaatatgatttattgttcaccacagggcgactctccgctgccgactcatttccctgttgttgttgcggcggcggcggtgggggcaacgacaaaaactatttttttttttttttgtaaatgtaaaaaaaattgacatttgcagtttaatggaccctttttttttgtaatcttataataataaatcgaaaataaatgccggtgatcagttttacccctacaaactaaaaacaatttcttttttatactccacttattttttcgtcaggtcctttaaacggtaaaaaaaaatttgaaaaaacattacatgttgctggtcaatgtatgaagccaggttgagtcccaaacgaaaccacacgccatttgcaatcattctcggtggcaatgttcggcagttgaagaaagagtacgtgtctcctatgcgcagcatggccaacaattcggcctgttggcgccacgctgacgcctcaatccgggccccctccgcgtttccaagcaaaacatttgcaaccggcaattctccagcgggggttgactgtcgctctcgaaaatcaacaacaataaccgacagacgaacagggctgtaatataaaaaagcataatttaaaccaaaaaaaaaggagtaaattacggaagaacccggttgaaagtgtcgacgcaaccgttgagaaacgcagtgctcgttgttccatcaacacaaaattgtgcaatgtttggcaaatatccataaaaaatttatttttttttttgcaaaaaaaaattgtgtatttactccgctttgatattgcgggtgtggggagggcggtggtggtggcataaaagnggcgttgcggcacacc

SEQ ID NO: 8886 - DNA, 1181 bp, Heterodera glycines
gcgattgaaaaattttcaaaataagaacatcaaggccaaaaaataagatttttggctcaaaaatcacagaacattttgcgaaattgcttcaagacagttatttttacaatttattcgatcaaaaatgtattaaatattgtatttttcacctcccattttcaattttaacaactttggggtggaaataagcaaatcgtaaatttcagtacactcggaatgaaaaatcaaatttttaagaatttttttgcggcgcttttttcaaaaaacttttgggaaatgggcgaggggggagggtccggcggtgccgtcaggcgccgccgggaaaatttttgtaatttcgttctgatttgttaacagattttcatcaaaaaaggccaaattgcaattaaaagccaaacaacgactttttcttgcgtttaacaacgctttttttttgccgcacattttttcaaaaaattttgggggatggacggggagggggtccggtggcgccgataggcgccgccggggaaaaatttttgagatttttaatgcgatttgttaacagatttttgtcaaaaaatgaccaaattttgccacaaatcttatattttcttgataaaaagtgacattatgccacaaaatttcaaaaatatgagtttatctaagaaatcagaacaaattttggtcgataccccaaaatcagaacatttctgacaaatcagaacatttttattttatcagatttggaccctccaaatcagaacatttctgataaatcagaacaaatgagaaccctgacttaaacaaaaaacttggttttggttatttaatgaatattaatattttataatgtttttgataaggaaaatttttaaatcaaaaattttttattaagaataaataaaatcttggtgaacaatttttgagaaaatttttcagttcttaaagatatattttccgaaatttttttagatcatttcttaggggtgtattttctgaaaaattttcaggtcattgttataatttttcatttttaaaaattttctctcatttccattttagcaactattttctgtgttttttagaatcaatgagcaaacacacgtttttggctgccctttccaatcattttcccaatctatagtataccattcaatagagtttcaatagctctacaattttattcagaggagattttt

SEQ ID NO: 8887 - DNA, 6001 bp, Heterodera glycines
tataccaagagcaatcttccggtgttaaatttgccttcactttttgtctttattaaaaataatttatttgcttttttactccattttttgcagttatttggctatattttcgtatatacccaacaaatcatcagatttagactgaaaggttcggccatgaattaacaattatttgttagaaaatactttttataaatagggctgccaattttatgtaaatacatctttttttcctggcttctccttgctctaaatagcaggaaaaacactttcttttttgtgtttgcgaacaaacattgggacttttatttacatatttttacatatttcgggattttcttacatatttgtacatattttggatttttttcatatatattttcatttttttacatattttgagtattttttacggaaatttttggaaatcctcaaaaaaaaatccaaaatttcggcaaatatttttgtacatattttcatttttttttacatattttgaaaatttataaagaaaaaataagtttgaaaatgttggctaaaaataccaaaaaaaagtaatttttatgtcattttgtggctatttcatatgttacggggattttctttccaaaaaataacattaaaaaaatttttatttacatatttggggttttttgtacatattttgggatttttcttacatatttatgtacatatttggaccactttttgtacatatttttggcagccctactaataattatatttttcaacaacgtaaatatattatttcagctttaaagaaattaatacaaacaaaaccggaattcaaatttttaaattaaaaaaaattgcgatttgcgctcaagccgactccaaccgaatgcaaccgcccacccgtaattttcggtgaaatttcgtctgaaatttcggtgatttgtccttgccagacaattgagcaacgctcggtgtgtctgccgctgtcggtggtgtttttcgcacacacattctcctcacaatctctttagcggattgctctcttcactccattgtcttcaatttgcactctctgctgctctgttggacagagagaaagaaatatcactgggcactgtgatatttccacagagagtcagacacagcaactgctgttgtgtgtatgcagcgccaggcgtgcgcagacaaagtccgttatccatagatatcaacacacagacagtgtgagatagtgaattcagttagaattcactgcgataacggccagacaatgcagaaacggaagagagagagaatgaggcaaccaaaacactgatgacaagcagacactgtgcattcgtgtggacgggaaacggcgccagcgagcgcaaatcggtgagagagtattgcgttagagagcatatataggagaaggaattttatcgaatttttatgtgtgggatgaaaaggaggttagagaaagaagcatgagatgaactatttctttgctacgctgacttctcttccaccctcgtaatttctattatcttttttctgtgtgactataccaaaaatggctatttttgagtgttacataattgttccgattatcagtgatcacgcatgcataatatttatttgacatttgaagccatcagctcataatttgacaaattataaatttaaaagaataaaaaatatttaaatatttttttccatttccctatagaaattcttattatttttttcttggccaaaatttgtgatttttgtaattttatttattttggaaaaatgcatttaaaaatctcgaaaaatatatatatatataactttaaattaatgaataaattttgtggtaatacctatgagctgttattttttttatgctcaatatttgctaaacattacaggatttatcgtaaatattatataaatatttttggatttaataaatatctgtcccagcactaataattattttttccgcaactgtggaaggatctgaaatcaacaaaaaaaattcttttaacatgatttgacgtcacaattaataaattttaactttaattggaaaaattttgtgcaattcacttgaataattcgcaatttctgatgcataccagggttattgcgaatcgaaaaaaatgcaaaatacggaaaaacgaaattaaaacaaaatacgaaatgcgaaacacgaaaaggaaacgccataaaatcacgaatttacgaaaatatgaaatgcgaaacacgagatttgtttcatatggattctaatctgattttttttttcgaaaaatgtttaatttaatactaaaacatatttatcaatgtatttccaataaaaaaaacaaaacattgaaaaatcattatgggcacatttcataaattcgagataatgtaccaacgagaaaatcgctgatgatatcgggattaacattgacattggcatgcccgtaagagtcgaatctcgcatcggcgatatcaccacctcgaagtccaacgaaaagtttcaggcgaaaaattcggccatctttgacaatcagttgaggcatacgtgttcaacgcttcacacttgaagtgagaaggcagtacgtaatcaaaatccaattaattcgccttaaaaaccaaaataaatatgaaagaaattaggcttttactttgcgaggacataaatttacctgaaaaaggtggcgccgactgaaagtgccgtctgcgtacacatttttcataatacaggtccattgtgaagtcgaagatcgagcaaacaccaaaagccttaatacagaatttagtggaattttaggattttcattttttcacctttgtggacagcgtccaaactgagttgaacagcaggtggcacatattcgtcacggagaacacgttttataacctaaaataaatgaacaaatcataattttggcataaaaattaggaaaagttgacctttttgtcgcagctttgttcggaaaagcagctaacattggtgttgttgtgttctgcaagacttgcgcaagaattgtagccggcgctttccacgtctcaactgcacgccgttttagctgggtcacacgtcgctgacactccactgttcggcgctcatgtcgcatgtgtggcttccaataattttgaggacattatattttgtccccttctatcgaatcacagtttattttttagctgtctagtttttaacccgagatcggctcttctatttttacaagggaaaatccccaaaaaatttcaccttgcattttaaacctttcaaagggagcggggcggctcgtttcccccccgccgtttcccccccgaatcagttcccccccgcatcgtttccccccgagaaaatttaaaaaaaaaaaattgctaacttagaaatttttcaagaataatttatgagttacgggggagaatttataagagggaaacggaggcgcgtgaatagaagttacgggacaccttcgagatgcacttattcgtgacaacgttgtcgatgggcagagtttgttcgagttggcttctccggttgctagaaacattttgtaactatatggacaccatgccacagttgatggaaccttcaaagagacttaacccgaaaaattcgaatagtttaatttttataatattaagtgctccccagctcattttacccaagtctacacaatttctgtactgatcgataaggtggccgtcccctgtgtttatggcatacttaaatcaaaatcagaaaataataccttaatgtttgttttagatttttttaaattagtgatcagtgccaaaatttttaagatgttccaagcagttgttcaatcagtcccactcaggttttcccaaatgccacaagggtgggctgtcttttccacttttgccaggcggtttaccgcaaattacaacgcctgcctcaacttcacactcacttttttcaaaacgcagaccaacacacggatatttaatgttttttcgctcttgcctttgtgcctgttggtgaaccactttacaattatttttgtttgttggttcaccaatttccgcataacgaggaagttgaacgtatgtattaaaaactaatttgatgggctaattaaaatttctagaattggtacggtattttctgatcacatggatcggttgtcgggatgtgctaaacatgcccgaaattgatgaattcgatggccaagccgaatatggtgcctatggctatgttgatcggttcattcgaaactggatccaacaatcagcaaaccaaaatcgggcagctttgtttccgatggaattgtggaacatgtgtgatcggtaaaaaaaccaaataataagtaaatgaattttgtaaatgatagggtggaaggcgacctctgcagaaccaataacagtgttgaagcttggcacataaatctgaacgcgttattccgttcaccatcgccacgtctaagcatttttcttcggaaagttcggcaagaagaaagccattggcgtcagcaagttgaagactttgcaaacaacccagcaaatggaatacgtggcaagggaatgaaacgcaagcaaacttatgtggaccaagacatgaatcttaatgagttatacgtcacgcgaaacaatcgccatcctctgcaatatttgcgcgcaatttcccaccgaatggcagaacctctttaggacaaaaatcaatgatttttaaaacgtaactaagaacctctttaggaataataattgatttatttttcatttttaaaattaaaaataatttttaaaaatttaattttggtgtcgtattttccgggtgtcgcattttctgtttttttaaaaaaaatttacggtgtcgcattttccgccggtgtcgcattttctggtgtcgcattttcagggagccgcttttattgtatactgccccctcgctttattatgacaattaatttcgcggcaaaattagctaatgattttggatgagcttgaaaaagtcaattatttttgtgaatgttttcttttaactttttcagttgttaaatattaattattatttttttaaattattgaacattataccaatttaaaattataagggaataatgatcttgagtctcgactagagaaaagtctcgcttttttccgtctcggtctcgatttccgaaactgagcccgagacttttttttacactcctaaatgatttttcataatactaaaaaagagctgattggaacattgtgcaaatttaaaatttaaaaaatgtctgagtgtcgaatcgagaaaagtctcgggggttttgttttggtttaggtctcggtttttggaaatttttggtctcgagctacacactattggtgacccagataaaaacacaaacacaggtgctcgtccgtgttctgacgacagcgggaacggtgttcgagacctacgactccgctgccaaatttttttaaataattagattttaaaaatttcagcaaataattttactttgtagaaaattttatgaaatttctttaagtctcattaaatttttcaaatattccctattcctatctttttaaacatttttcaactttttaagaattttttaggagggggaaaggtgatagttttaaagaaacgcgcatggcttgacagttcatgtgatcggctcaaccaaacacacataaaaatccgaaactataaaaataccgagaaattttctcgatttgaaaatttttaaaccgagaaatacacaaacaaacaaaaaattgaggaattctcgagtcatagcatccgagaaattccgacaagaacttacaaaaaaaaatcggctatgactctgaaaactcgacaaattttctcaaatgaacgattccaccccctgctgtgtttaggcacacaggtgactgacaatgccgcagtgtccgcagcggccggccaagcagtggatgcagcgcggctgccttgggcaagacgacggtggaggaagcgaagctcgataaggtgaaactgttcgacgcaattgccgtgtcggtgtggcaccgccgtggtgacaccaagcgcgcaagggtgcgcacactgccgctgact

SEQ ID NO: 8888 - DNA, 3669 bp, Heterodera glycines
aaaaggaaaattaaataaaaatttattattttaaataaaaatgcaccaaacaaatatgtaaaaatgtacaacaattcaatgataactttcgagaccatttaaatatatttaattgctccaaaacgtacgtctgttggccattccgatggtcaccgcttcggactcggactccgcctcggccccgggcggtcccattatgacctgttgaaaatgacaaatgtgagggattgcgaaattgagcagccaattaattatgtaattgattaattattaaataattaattaattcccttaccgtaattgtaaatgtgtaaaaggtgttccagtcgagaccgctgaagcgatgcgtgacagcagagcctgtggcaaggaaagcattcaaacaaacgccattctctaacattaagaaatggaatacagtggaaatggatactgtaatttttattgttagtgttttttattttatatatcgtatttactgaaatggaactcctccgacccctgaaataaagccccccccccctttgagggcgttgaaaaacagaggccccgccggggttctaattcagaatgtacggtatgtgcttgtgtgtgtcattattgaactgtccaaatgtaccgttcaattccaaactcagcgcgcggtgcaaatggggcccagcactggcggtgtaactaaaaataattgatgtttttaaattcgagatttaatccaagtattacttcatgctaaaaatgattatttttaaatgggaaaccggcaaaaaatgggtcaaaaaccgaggattaaaaatttggccatttaccaagccaaaggataattttttaaaaggtttctcaatggaatccatctcattgtaattggtaaaaaatggaaaatggaattttcagcgcaattaattctctaattattatgaccacctcaagcgaaaacggcataaattgtgcgcgtcgttgcgcactgtccaaaaaagtcgcacataaccggagccaatcaacggacggaacgcggacacttttaaagggtctgaaacgggaaaaatggaagaaatatttaaaaattaaattggttaattggaaatattaaataattataaattaattaaataatgattaatttaatatttattcattttttgcggtccttcttttgctcctcacatgttgtgatgttgacgtccaccggtctgctgcgaacgccgtggagaagtgtgaacaaagcgaaagtgtacgttttgccgggcaccaatttgttgaaagtgaacgatttgctgaaaaaacaaaacaaataaaaatgtgaatgtggaagaattggcacaatgaaaagccattttggtcaccatttgaatttgctaattattttggcattttgctcacgtgtcgttttttgccagccttcggatcagtgtgtttggcgtttcgtctccgttttccaactttttcccactctttggcgctgtttctccgtccccttccgctgcttctgctccgcttgaggagtcaaaatgcaattcgtactgatcaaacggatgggaagggtcggactcgccaaaattgatgttgatcgaatgggtggagatctgtcccgcgtaaatggtggaagtgatcaccggggctacacacagtcaaaaaaaaagaataaattaattcagcaattttttttattacgttttgacatggacccgtccacgccccacccctctctctctctctctctcttctctctctcttctctctctctctctctcttctctctctctctcttctctctctctctcttctctctctctctctctctctctcttctctctctctctctcttctctctcttctcactctctctcttctctctctcactctctctctcttctctctctctctctcttctctctctctcactctctctctcttctctctcttctctctccccttttctctctctcccccccctctctctctctgctgcctctcctctgcccgctctctctctctcttacgtgtgatcaatcgtacgcccaaaggcgcactgcatttggcggccaactcgcgcgacacattgcgcactgcgaaagtgtacctgaacagtttgcatttatagaaagtgaagcactaaattttttttttccaaaaataattgaatttcatttttaattttctaacgacaaatttttcaaatttgtgcccgtacagtcgggctggctccaatccggtgatgttcactcgtccctccgcacttttgccgcccgttttttgaatgtgttcgccacggaacacaacttgttgccggcccaccaccttctgaaagcattttgataatttcacaaataaatacaaaactaattaagtaaaagccaaaatcagcacacatttcaatggcactcatttgttaggacagagttatttttgaatggatattttagaacacaaaacagcacctttcccggagaccatgcgatgtgcacttcgtacagctgaaagtgtgccgagtcggcctttggtggcagcccaaagccgagcaaaacggaggcttggaaatactgggaaaaatttctaatattaaaatgttttgagccaaattttagttggatttatttaaaattattttttagttcattattctcttaatcctttttactaaatttaacaaaagggattttaatgctctattttctcggatgaggaaaacatttgcaatttttaaaattttatttgtaaaatgcaaagccgaattgcccttttggccgatttattctcagatccaaaaaccgcattatgaaatgaataacaaatggtgaactgctcgcccacctcgtccgtgtaggagcgtataacgcgcacactttgcaccggcgcgggcatgcgcaggtcgagcacgcgacgtgcgttccattggggggacacggaattctcgaacagacacgaaacattgacctgagaaaatagagaagtttgtgcttaagagacaattgtaagcaaaggcaaaacactaataagctccattcatattttgcaaataaatttcttaaatttaaatgccaatggctaatttaaaaagtgattccgaaatcgacaatttcagtcggcggaacagattcagcaatttccgagtcggcattccctgcagcgttagttactaatccccccccccccccccgctggtgtttctgtctgtctacctcaacacacgcattggccacaagcggaagcagcgcctgcggcgtcaccgtccgttgtgtgccgattctgccgtttgccgttctattttggcaggaggaaaactgatttttgatttttaaattgaaatgtgccaacttcttgggccatattcttcaccgatctgtccccaatccaaatttatccccaggcccaaagtgttcgcttccgcctccctacccaagcggacggtgtcgcaccagaaacgcgtcacatgccaccagctcgggcacgcgccaggcaatggccaacgtgcgtgtgccgtgctggcgcatgcgaatgctcggctcctcccgcgtttcgtttctgctctccttgggcgacgtttcatctacagtctccgtctcctccgcccccgcttcttcgtcttccgcctcctccgcgccgtcgctctcgttgtctgactctttgctgctctcttcactttccaccactgtctttgtgtccccatggttt

SEQ ID NO: 8889 - DNA, 966 bp, Heterodera glycines
cgtgatggtaccgtacgccgagtgcgaaatgccaattcaagcggacacagcgaacggacgccaaaatattcggcgtacagtgccaatcttaaacagttttacaagcatatgctcatttaatgatttacaaatttattattggaataataaaaagaaattctgggtaattatataattaattattgtataattagtgatgtttattactgctaattaatgtggctgctcattaattaaattattttaatttttagtttgataattcattttttctcttgtcaattgcctgtattgtgtgcccgtcctcagcctgcgcaggcgaacggaatttgcttttgtgcgtgcgtaaaaaacgacgttggaagaagccaccgaaaaaaaagttaattgaaatttgaaattgttatttttaaactagggcttctcctcgacttcgggggacaaaaatttccgtcaatttttaaaatcctcgcccatctttgtcgagaatcgaatgccgagatgtaattttattaagaagtcgaaaaaaaagaaaattttaagcaaaaactaatttaatgatatttaacacaaatttgtattgcaaattatacaggattagttctcccttaattttgtcggggcgaaacccctaatttagacggagaaactcagaaaatctacaagtaaaagaaataataatttattatttgaaaattgccaaaggaggattgagaatagaaattgctgtttaaaaaccattttaccgggaaatactccatgtaataggcatagttttgctgctgttgttccgcttgtggcaaccgtagtgccggaggcggtgtccacgcgagtgtgcaggcacgctcagttgccgtgacggacaccagcacgggtttgtcagggcctgtgccgtgaaagggtttgcataaactttggcgactcatttaaatataaatgaatgaatgcaaatagccaattctacag

SEQ ID NO: 8890 - DNA, 1202 bp, Heterodera glycines
aattctacagtactcgagtgtgccgttccttccgaagggagtacggtgttggcggtgtttgtgccattcctttctgtggcaattcgccgccctttgtcctcgtaaacggcactaagtgagtaatggtagcgaactgctggccaagtgccattcactcggatggtgaaatttgcctccgattccgtcgtcggtgttggcccgtgcaaagtgaagggcgacgggggctgacccatggggaggccaatactcctaaaattaagcacaaaagaaaagaaaatggaagagattttaaaattaaaaacaataaaaattaaataaaaaactaaaaaaatttaattaaattttttattaattaattgaaatataaccaattattttataccatattcaaaaaaggacttatttttaaaaatattctaaaattaatgaaacttttataaatgcgctaagataagtaaattattttattgtaaaaattaatattatatatatatttttttaatttggcttttcatttgtgaaaaagattgcttaattccctcactgaccatgatcaggtaaagtggcatttctgctgcattggcattcctttgaccttcggcactgtttttgccgctgtttttaagccgcaacagagaaaatgaaatgttaatttgcaaagacgaaggacaaaacggaggtgacacaacagcagaagcagaagcattttttgcattattgccataggaaagaatcagcgcaaagagaacaattaggaaaacggcaattagagaatcgcccgaagggaaaaagaaacggcggcgatttggcggcagcgaaaggcgacggcactttgggggtgtacaaacggatggcgaaggtaatgccaatgaaggtgataatgaggatgatgaggttgatgttgattttgttggttctgttgttttactctctcgaattgtggggcgacatttgtgggcgaacaattcacttccgcacagatgacgaccacctttcccattttcgtcatcatcgactgctgttgctgctgctgcgcattggtcaacggttttggatgaagacggaaaggatgaggatgatgatgatgaagatgaagatgaagttggtgaaaatgatgaagatggtgaagatgaatatggtgatggattggtgtgttgtgggagatgatggcgggtcatctgctgatgcttcttcctctgctg

SEQ ID NO: 8891 - DNA, 507 bp, Heterodera glycines
ttttaacccttaccattcttcttaatctgcatttgctattgaaacttcactaaagggattagtctattcaaaaacgtttggtactttacggttatctgtgttcagattttcaaaaaaaaatttttttataaaattgttttagggttttcagggtcagggaaaccgattctggcacttatgttgacccaattcgaagcctaaacccggattcgaacaaaaagtcaaaatccattttttttgcaaaaaaatacatattttatgcacaaaatcgcttcacactgccacgaggacgactcgtataacctaaaaagtgtcaaagttgaatgtgttttgggcttgttttggtcaaattttatgtttctaaaaattccatttcttgctaaaatcgctttttgatgacttggtagatgggttttcatgctttttcatcattactacgtaatatctaactgttttacaacagaatttcatgaaatcgtttatggcactaaacccaactcaagcccc

SEQ ID NO: 8892 - DNA, 1744 bp, Heterodera glycines
actgatattgttggtgccttttgcagcttttccttatggagtttcgtctactctttccccgcatttttctgctgtgtcccttcaccgccgctgggcattcccccgatcgaatttggcacaggaaaaacggcaaaaagaacgaaaaaattataggaaaacgccattaaagcagtagcagagaatgtttaaaaatttgaatcgactaaattaattttattgcatatttataaatttatttatttcaattaaattccccaataatttagttttttgcttacgtaaaaaataatgacgcaaatgacaattattaattagtagtattgttatttgtcagcaatattattatgcataaattcatatttgtataataacaatggcatattagaagtgaatatgaatttacgaaaaataatatatccatttctgggtatttcccctggtgctaaagccatcatttgtgaaggctaaaaagtctgcatttttatttgctaaataataatcaaaacttagcttaaaataatccaatttatcaacctttttagacgcactaattttgtccctaactttttttaaactcaataaatttttttttaatttaacagaatatggagaaatctttgggctatcttttcatattaagtgtggtgtgaattaattgaagtttgaaccattttcatgcatttaagcgtccttacatttttgtatgcaaataaaaatatgacacatttaatttcttaataattgttttctgaaacaattaattttaattttcttgcaatgattagtagccgaaagatttctctattattctgttaaatttcaaaaaatttttggcttttaaaaaagttagggtcaaaattgcgcagtctaaatttttcgaaagtttttggttacaactttgtgtaaattttgcttgatttttaaaaaaattataatattataatacagggaggatacgtagagctacttttaataccaagattgataaattggttaagtgtttaagcaaaattttgatttattatttggcaaataaaattaaaataataattaaaattaaatattgcgaacattggatacatacttttgtcactttggctcaccacgaatgattgtaaagcacttgacaaccatatgatatcatctaatccatacgaacacttttgttgaaaattaatatcaagattttcctctaaatattttcttccatttttatcttttaatttccctctgatcaccaaaacacagacaataaataataaactacgaatgtttttaggaatcgctgttaaattaaagcacaaaaatgtgcccaattttatcttttcaccaaacaacaacattttgggcggcggaagaacgactaatcgaatcagaagaggaggaaattattggggtaattagcgggggtatttaaaaaccatttcaaaaactcaaagaacattcgttcaccgattgaattggtcgcatccgccgacatttgttatcccttcgcttctcctcaaaatgttctctcctccgattgtccgtccacttccactgatcactttcatttgccttctgctgactttaattgatcaccaaaatggtaattgcttgttcattagctttgtcaattaacactaatgaatgccctgcccctttcacagctcttcgggtgctcgtctccgccccccaatttgtccacagccatttgcacatgcattcggcaattgccgatgttttggtggaggagggaggccat

SEQ ID NO: 8893 - DNA, 4598 bp, Heterodera glycines
  misc_feature (1143)..(1143): n is a, c, g, or t
  misc_feature (1349)..(1349): n is a, c, g, or t
cttgaaaatgcctttcacttcatgtccttgaattttttcggaaaatcatcaaaaattttatatgtaatctaaaatattttttaattattattatatgacattagaaaaatttttaaccattctttttaaatttaaatttccgttttctgagcacccaccacttcagacacttctcgtcccgatgtgggatgtcgtttctggcaatcccccgcccgtggaaaaaacgaattggactcgtgcccaaagggtcattcgccactttccgaatgatgccgatgggcaaacacttcgccaaggcattgccaaaatgccattcgccaattacgacatttggaccaacgacaacgacgaggtttttactgaacgcacacttcaactcttcacagagattttgactactgcctgcagcggtacggagttaatattttgtgccattgccatctaattcatttaaaatgccatttttgtctctctcccattttccgtgccaatttgccattcgccctaaaatgcagttttatttcgtagctcttcaccgttcttcccaactcttttctgcactcaacagcagcagttcggcgcctgcttttgacgtcgcaatcgccgaatggttcgacttttcctcgttggcactgttccatcggcttggcatccccacaactctgatcacttcggcgcttccgctcgattccgtccttgcgcgttatctcggcattccaatgccggcttatgtgccaagttggaaacacaatttttaaaaccgaaaatattttcatgcaatttgagttgtcaacaaagcatcccccgagggcaccaaaatggacatttggaggagatttgtgaattacattgataaacgaagaaacacgcaactcgatcaaataattaataccgtggccaactcggtgttcggcgaaaattttccaagcccgcaggaattggcacttcgtgccagctttttgttgctgaacaccaacgaaatgctggaccttgccaggccaacttccaacaaaatcaaacacatcggtaacgtcaaactcacaataaacttaaagaacaaaatcctcagaaattctaaccatttttatgagggggttcctggggtgatcaatcccatttccctccccaattccaactccattntaagaatggctttattttggaaaaagcactgaaatcaaattataaataaaattaaacaattaaataatatttaaatacataatggaataaaatgttacataatgttacaaaataacattacaaattaaatacaattaaataaagttgcataataatgattaagtgatcagcagaaggaaagatcgcacattaaatagacataatgnagaaggggaaaagtcattggctaacggaaaataattaaatgaaatgaaacgttgcattaaaatgagtgtggaaatagcgatcaatgcttcggcagtttatgttaattagcttatcattaaatcaagtccgcttttcaggtggttttttgctcgattccgactatccgaagaatgccgtggccaaaagaatggccaaagatccctccatgccttccgcttctgctccgtctgtttttgtctctttcggttcggtcgctgaccccaacaaaatgccaccacaaatgctccgtgcctttttgcacactttcgcctcgtttcccgagttggattttgtttggcgcttcccgacacagaaaggcaccgatgatgaagcacggtgccacaatggcactctgttcggcaacaaaatcccagcaaatgttcgcctcgtccaatgggttgatcaacacgcaattctcggttttttggattgaattggtcttcaattttactaatttgctaattatctaagcccatccgaacacccgtgcatttgtgtcccactgcggccttaatagtctgaacgaggccgccaccgcgggagtgccgttgctttgtgtgcccctttttggcgaccaaaattacaatgcggccattgtacaaaaccatcagaacggaattgttttgctcaagaagcacctgaacaaagagaggctgcaaagtgcgttgaaagaattggtggccgatgaaaaagcgaataggtgagtgaattattaattgatgaaataattaatcaatagggtagcaacttttagtgacgaaaaatcccgaaatagttaactaaaatagtgagtaaaaatgccaaaatagtgaagaaatagtgacaaaaagtccgaaatagtgacgaatagtgacataattttcagccaaaaattaagcaaaaataatttttattcactgattgcattgcaaatgagtagggctgggatttttaagggcaaaaaaacaaaataggtacataaaaaataatttttaaaattaaaattcttgccacgaaaatacctttttgagaaaatttttttcatttcttaggagtgctttttgaaatttttttttgtcgattcttaggggtgtattttttgaaaaaaaattttaggtcgattttatgggtgtattttttggttttattgcgtttttgttaaggaattttccaaaaaatgtcgaaatagtgaaaaaatagtgacaaaacgccaaaatagtgattctagtgacgaaaagtgacgtccaaatgaaaaaattttaacgcagaaatgcgttttttgagctcctttcttcaaaacaattgagcaaaaaaaaaagttttttcactaaaagttgcttccctattaatcaacaattggtttgcttaattcttcaacataaattaatggagtaattaattaacgatgatcaataatcgattaaaataattcattataagcatcagcaattaagatgcctaattcacaattagctaattaaccggtgaatttaattatcataagttatttaattggttaattattaaccatcggcaattattgattgataattcattataaacatcaacaattaaaatacctaattcataattagctaattaaccggtgaatttaattatcatgagttattcaattggttaattaattaaccatcgacaattattgattggaaattcattaacagcatcaacaattaaggcatttaattcattattagctaattaaccggtgaatttaattatcatataattcattataagcatcagcaattaagatacctaattcataattagctaattaacggatgaatttaatcatcataaatagttaattaattgattaattacgcttgtccatttttgttgtcccttcagttatttgcgcaatgccaaagtgatcagccggaaaatcactcgcgctcctttccgtccccgggaaattgtgcgaaaatatgtggaatattccgcagagtttggcggccaattctccgaaatgaatttggagggtgccaaaatgggcgaatgggcacaaaatgggctcgactttttggtgccgttggcacttacaatggccgcactcattctgatcagtgtgtcagtaattggaattgtgattagaaaagtgatcagcagaggtcaactgttgctgttaacagtgaggcggcatgatcaaaaggggaaagatgactaattaaggaaaatgaatgtgatcatcccacaataacatttttatttttacaatttgttttgatgtattttatttcatcgattttatgtttttacaacgtttttttaaattcttgtatataatttatttgcattgatttaattaattacgataaaacttgcaattaatattcattgtttgtttacaaattcacttggttaacaattgaataacaaatataatgtcaaaatgttagcatagaaaaacaataaaacataattgataactttttaaatggaatttgcccattttttcgctttcaattagcttcaaagcttagcttggactgattacaattacacaaatttcctatggtaatgaccacatctttttaaaatggcgccgtttgagttgcttaagtgcaaattgcgccttcttaagcggatgaattgcggaccacggccattcgatttgttctccattagtcagcccttgggtgaaaattaattttattttatattttttgtacattttaattaattagccatttttacccgttaattgtcggaccaatgttcggaggaacagaagacaatttcgagacagcaatttgtaagtggacgggttgaagatcgtcttcaagttgttgacaacggagacaatttgtccaaatgttttttgggtgaaaatttcttttccgccgtaagaaattggtcgataattgctggaaatttaattggattaattaaagtcaaaagaaattaattattttggagtgaatcgaaaacaaagggccaaatcataagaaattgcccaataagtcttgaatttgaaataatcccagaacaaacaaataccggtgcattccgccaacaaaacgcgtggaatattccatcggtttccaaaattcgatgccaggatgatggaaatgaatttctgaaaagacagcaaatggcacaatcaccattaatccgaatgaataaaaaatagcgctaatgatctttttaaaaatgggtaccgattccgcaaatgaacagtccggcgtgataaatgccccaatttg

SEQ ID NO: 8894 - DNA, 3827 bp, Heterodera glycines
cgtcaacaccaccaccaccaccacaactgtcaatccacagaagattggtgtgtctcgtttggcatcatcaactcgaatggggaaaggcagcgtgactggcaaaccactaaaaattgtcaccaccaccaccaacaccaataccacaggaacataaccaccgccaacaccaataccaacaggaacacaaccaccgccaaaaacaacaaaaacagcagcagcaaaatcaccacccctacaacaaaaactgcaaaattggttgtggatgagcagttgccagtcgcaacactcctcccaacattgattcaccaaatgtgcaaggatcgtcccggggaagaaaacttttatcagcaagccatctgttgggcactttttgcgctctatttaatggtgattgtcagtctggtacttcatcagctttgttctatctgttggttaaaaaagaaaaaggagtatggacagcgcgcagatttcgactattttgaggcaaagtcgggaaaccgcacgagttttccggggctgtttcccaagtgaccagctcccagcgccggacacgctacggtacccagcggcgctagttgtgaacaacgacccacactacaaacaaggatcccattggtgcgcgatttatgccccttcaaagacggaggaagcggtcatatattttgatagtctcacaaaaacaattcctcctattgtaaagacatcatttatggataaatttccaaaaggttttgttacaaataagcacccgtaccagtccccactcactaccacatgtgcaattcactgtatagtgttcatttatcatatggccttaggtcacccatttgatgcatttctgcgcatattagacgctagtgaaagccccgacatgtattctttgtgcattttgaataaaatgattaatccgtatttgtgtgtgcgtgccaattttagtctccctcggggaaagggcatagggaatgattgattaatttattataccacggcgcacatcgcgcgctgttggtgcctaccgcatatatacaatgaattgacgcgggaaaggctcactttttcgcaaaaataaattaaatatattaataaataataataatgtcgttggaagaccacaattattgcggcgagatgggcggcaacgaagaaacgcccacaaagagaagaaaaagaaatgatgatgatagggaacagaaatttcaaaaaaactgcattcgcactctgagcgccgacaaacagtacaaccaaaatttcaaagtgcagagcgtaaagtcgacttttgtcatcgaaaatttgcccgccaaccccgagtcaatgctgcgcgcattgttcgctcactgcatgtcaaccgccctggacgagtcacagcagaacgggatcacaccggatcaattgggcgctacaatctcttcagatcttctaaatccgagcatatggattcctatacgccgcatttccgacaacaccgccgactcaattatgaaccgcttccttgaggtggcacagtcaaaatcgcgggagggctctctgtggggctcgccgttcactgtgaccatcacaacgttggatgttgcgcagctacctcagcggcaacaggtgcgtggcagtgggaaaaggacagcaaattcagtgcagcatatcgtcaaagaaagtgctcttctgcggatcaataacaacgatgatgcatattgtcttttttacgctttggagacaagcaggaagtaccacatcaaagagatgagccgacagaccttttctaaatatattaatcggcagaatgggcgacgactggaagacgtgtttggactgatgagcagcgcaaacattcgcaccgatctgagagaatatgacgcggttgtctatgtgccgattgtcgtggactattggaatcggaaatacgccacagcaaaccagcgatttaaggtgttcatttttggcgctacaggcagctatcggccaaaatttcaatatgggccggacaattacaacgtcgaaatcccgctctaccatcacaacggccatttcgacggaattcgaagcggggtgggcaaagcggtgtttgggcgtgactactactgcttttcgtgtgagtgcccctacgataatgccaatgatcattcactgcagtgtaaagcaaagtgcataaactgcggtcgcataggagtggggcgaccgtgctgagcggatgacaacaacgacagttattacagagaatacacagcatgtggcaaggatttcatgagccaagactgtttcagtcatcatttgtcgagcaatgtgtgccgacaattcaagaaatgcaaacagtgcggagttgtgtggaatgtcaaacaaaaccgacgaaaaggacgcagcggacacgtttgcggtgagaaattctgctacacctgcaaatgttaccataagccggagcggggctgcttcatacagcagttgaaggcgcgccgccccacaaagtacagactgatcgcctttgactgtgaaacaacacagaacacgcgaattgagggcgaccgcagacttcattctgtcaacttcatctcatgctatgtcgtctgcaccaagtgcataaacgaaaatttatggcgaaattccctacaagcgccatgtggcatttgcggtcggcagcgcaccgtcacattctcccaccgcgcctatgaacgcacacaaaccgatgcccaattcatcactccgtgcccaatggcggcctttgctcaatggctgctcagcgaattcgatccgcgctatcccacaatgctcttcgcccatttcgggggtcgctttgacaacattatgctgtttcggcagttcttcctcaacgggttttgcccgcaaatgatccgccgtggtaacaaattatacgaaatgaaaattgcgaggggcgaaaaaaacccggaaatcatcgtaagagacagctggaaccttatgccggtgccgctcggcgctctgcccggagcgtttggactcaatgtgcaggataaggagttcttccctcatttggcgaatgttgaggcgaattatgggcacattctgcagtcgctaccgccaaaagctgactacttatacggcgggatgacgcccgaccgacagcgcagattcgaccagtggtacgcggaacaccgccatcagcagttcgacctatgtgaacagctcgcagcctactgcaccaacgacacgcgcatactaattgaggcgttggtcgcttttcgcacggagttcttgacgatcagtgacccgttggagcggcatggatgcttggatgacgacaacgacgacgaagaggaggaggagcaggatgacgacaatgcatttgaagtgatcggcggtggcattgacataacgtgggagccgatgaccatcgccagtgcctcaatgagacactttcgacttaatcacctcaagagggatcagctcgccattgtgcccgagtgcggctacgacactacaaacacgcaaagccttgtagcgctcaaattcatggactggtacgccaaaaagaacggggtgagcatccagacggcacactcgcccggcggagagaaaaaaattggtcagtacactgttgacggatacattgcgtcgaccgacaccgtgattgaggtcaacggctgccactggcacgcgcacgaccacccgcgtcaccgctttcagccccaaacagtgatggcgaatgggaaaacggcgcagcggatacgggaggacgatgcgcgacggatggccttcatcacatctcaggtacaacaagtgcgcgtattttgggagtgtgaaatcaacgcggagaagcgcaaaaaggacgaaatgaagcgcgcctttgcgcagtacaaggacag

SEQ ID NO: 8895 - DNA, 1918 bp, Heterodera glycines
  misc_feature (1811)..(1811): n is a, c, g, or t
gcaaaaattttaaaaatttttcatttacttcaaaaaatactgtaaaaggcatgaaaaaaggcaccttttcgtcattttttgagtttcgttttcgaccgtcaaaaaatttagtgtcgttttcgtatttaaaatttttaaatttatttccgtttcattttctttttcgcttaatagttttcgacagtgattgatttagcagtaaagttaaacttttcctatatataaatttataaaattgatatgaattgacacaaataagctatgagactttgaagacattgatatgagatcaaacagctggttaataagaatttataattaaaaaatttaattgttactttttttatccttattaataacttattaatttattttcatgacaacaattttggcttttaaaattaaacgacggcataaccttaatatttgttacaaaagtttaaatcaatacgtaattaaaatattaaaaccaaaatatagaaatattataatatttcaaatcaaaattttataaaataaaataaagaaaaaactttcggttaataacaaagacaaagaaattaaatagtcatcaattactcaccagccattttcttaaaataaaaattttaaaataattagaatatataatattatagtaatgtaatgaaacataaattaaaaaataactttgaaaaatgaaaataaattatttaattacaacataaattaaaatcacgataatatcctagccgtatcttagaatgatgaataaccaaccccactgccttaccacagcattccgaagcccactcgccttgttaacttaatattattttctagcttaaaagtttgaataattatgattgatcggtaaaaaagcaaaataattataaaatttaagaaaaattatttaaaaatacaaaaaaattaaatttaaaacaatgaaaatataaataaataaattcagaattatttaaaaagtggcaccatcataattaataataggatttatatgtttttttcgatattcagcgacagcaggtcctaatttttttcacgacaacgcggctggtttcacgaaaaaatactatgtctccttgtggataaaatcgacacgccgtgatcaatcgtcaccttttttcaaataagacgctcaagttgcgattgaaattaaaaaaaataatataaataataaattaagagactagtaataattcataaattaaaatagataataatttctcttaaaaattactaaatatttttaacaactgagtttccattttacacataaaataaaagataaatgattctaataaaaaaataaaaataatttttttatgataacaaaattaaaaatactaacatagaaaaataatttaaaaacacatattttaacgaggtctttaatgatcgtaaataatttttcactattattagaaaataagaataaaatcacttgtgcaaattcacaaaattacaaatcatgtttaattgaccttttttcaaaaatttttcattaaaaaataaataaaacaataaatcacagaaaaatatgccagtacataagtaagttttgcagttgatataggagacttagaataactaaaacatgataaacataataattcaatttataaataaattaaaaacaattttaaagattaaaactttatgtaattgacctaaagcatactcaattaaaaaaaacaatctgtgcgttaaattttaatttgaaaagagatttaacaaaaattcatgaaaatacgaatatattaataatctaaacattgacatatattaattaaatcatataaaaaatttattanaatttttttgaaaaaactatttcactttctcatttttcggcagcatctaaagtgaaacgtgtccactggataataaatttatttaaatttaatatttgaaagcgatt

SEQ ID NO: 8896 - DNA, 4560 bp, Heterodera glycines
  misc_feature (3176)..(3176): n is a, c, g, or t
  misc_feature (4414)..(4414): n is a, c, g, or t
  misc_feature (4506)..(4507): n is a, c, g, or t
  misc_feature (4557)..(4557): n is a, c, g, or t
atattttttgttgtaatttgttaaaaaatttgtaaaaaaattataccccgattaaagagaaattgataaaataaattgattaccagcataaacttaacaatagtaattttgtaataataaaaaagctaagaaataaaattttggataacaatttaaaagctagaattaatataaaactaataaataaaaattaattacaaaatgaagaaaggatatggtggtctgagctgagccatgcaataatgactggagaaatttttttccctacgagaccataatgttcaaaatttgcagctaaaaaattcatattaatacataattaggattcaaaaaattaattgcattttaaaagcaaaaaatataaaattaaatttgtatacataaaaaaacaactaagattacctatagcgattcatgagataggtcatgtcatcgcttcatcaaaaaaaaatataaaaagtattcgcaacattctgatccaaacagtaaaaataataaattaaaaaagaaataaaaatggttaatttattagccacttaatttctttatttttttagttaaaaatgcaaaataaataattttttgaattttcaaatttttcatatttataaacaatataataaaaatttaaacttttatattaaacaaaaaatacaaccaattcaaatgcaaaataattttaattaaaacaataagcaaatgttattataaattacgaaatctttagaaactttgtaagaagtctgccaataataattgattaggtctattaattcgatttatctaattaaatccataaaagatttagtcacttaataaatcatcacacaaatacagctgaaaaatatataattagaatattaactatattttcattagtgcgtgctgacgcgttttataaatccgccaaaatgtgtttgcgcgttttataaatccgccaaaatgtgtttgcgcgttttataaatccgccaacataaattagcatgccattatacatataaaatttgttattttattcttatttaaactatcttagtaggaaaataaaacatatttagtgttctgaaaccttgtatttctgtatttccattacctctttatgcaatttattattaattaaaaaaatatttttaatataatcataatgtttcttatataaaatattataatgattttttaaaatcatatatgctgtcggatttataaaacgcgcatggtaataaaataaaaatatgtgcatgggtggcggaatttataaaacgcactagcaccgttgaactgtatctatccagtgatattgattcgtcgtaaatttaaacttacaaacgacaacatgtctttaagcattttttaaaaattttgggtatttagagaaaactcaaatattaaaaaactgaccaaaaaatcagaccaaaaaaccacccgaaaacgaaaaatataaatttaagtaattaaaatttaaaaatatgttttataaagttaataaattattattgttaaaataacccaatttaccataaatacactacaaaaagtgaaataatttttattaaattattgtataatcaaagattgttaaaagtcagggtctaaggaaaaatcaactaaacaatatgtaaaggccagcagaattgcagcttaagccgtggattgtattataaatatacttaatgcaaattgcgcttcgaagcaaattgataattattagggcttccttttttaggtaaatacctaaaattttgcgcactgaatatgttgcgtcgtttatcaataacaacaaatataatcaataataaataaataataaataagtcagaggagaaaagagagacaaattgtgtgtgtggtgaaatgcaaatgatgagatgagaatgaatgaatgaagtccgaagcgaggaaggagggaagagagcggtatttatgggcgatgaaagtggtgacgtgtcaataaacataatgccaagaaaatatgaaatggcaataatataacacctcccctcttacaaaaatcttaatcacgatccctgatctcatgtcgctggccggtgggccttggactcaaaaatcgaactttcttggttgttctttttgatcgtcgcagttccggtgtttgttcttctgtttcttggtgttgatccatctgatcagtccgttcttgtggttgcattcgtcggttgaccactcatgatcagtgccatttgctgccgataacctcactgcgtttgcgtgacgtgtgatgatcttatgtgctaattatgtggattgaattttaagaattaatccattctttgccacaattttaccaaaaagccaaactgttttaccgttttggtaattaacaaactgtacttgatcgcctattttgaactcaatcctttttgctccaattttctgtcaaactgtgttttcattttgtgtgcgttggcattgtttcctcctgtgcgtgtttgactttgatcagggcgcatgagtgaaatgtgagtgcgcaatttgcgacccaaaaacaattctgacggtgatctgttactcaatactgcaattggggtggaacggtatgacaaaagtgatttttttaaaccaatccttatctccattgcatttcttcaattgtcttttgaagaaatccacataccgttcagctgctccgtttgattgcgggtggtacggagatgagaaaatgtgcttgattgaattcctggtacaaaaatttttgaaattttgtgaaaggaattggggcccattgtccgaaacaatcgtttttggaataccaaccctatcaaataaccactgaagttggtcaatgatggcctgtgacgatgattgacggagaagaaaaacttctggccatttcgaaaatgtgtcgatgaccaccaggtaaatgttgccatcactgcatggaccagccaggtcaatgtgaatgcgttcgaaaaccgaagttgttgctggccaaggttggagtggctcttgtttgggtgattgtttggctgcttgttgacattggctgcacccgcgaacaatcgtttcgatgtcggtgtccattgatggccaatagacgaacgatcgtgctaaatttttcatcctgaactatgcctgggtgagccaagtgcagcgccttcagtgtgcgacttcgaagtggcggagggatgacagagcgtccattgaacaccagacaaccntgtgatcaatgaaaagttgtgtcggcctgaaaaatagggtttcatttcggcattaatcccttgattaggccatttggtctgtgtaaaattgatcacttctttaatcaactcatcctcctgttgtgctgttttgatttcgtccaccgtgattggcagttgttcaacttgcgcgttgaaaacatgctcaacgtccgcgtctgcttcggcacataacttagcatggtggtgcggttccaatgcgttgtttagtccggtgctgaagtcgaagcacagccggactttgccattggcttttctgaccgcgacgattggtgctgcccatttgctgtagtcgactttttgaagaactaccaactcaatcattctgtcctattcggcgtccacttcattttgtacaccttgtacaccttgtaaaattacgtcaattgcctaaaggaataaataaataaaaactaaaacaacaggctggcaatatgttaaataattgaaataaaacatggcaaaaataaaattttttctagtaataaaagcacatattataataaataaattcttcaataaaaaaaattggtaatttgaattatattaaaaaacattaaaataatgttttcaattgtaattttatgaacaaattgagaaacttgattaaattacaagacaataaatatttatgtgaaaaaatttatggagcctaaaaaggagaagacccaatttgctggtctgttcaacgaaaagcacgagcgagaaatagaacgtccttgtcttgcatgagctacaatgaaatgtcgatctagcaaataagtcgagaaaaaaagaaaaaataaactaaatagaactcaaaaagtctaaaagaattcgaattctaataaacattaaacaatattattactctagtttattgaataaatgaaaaagttaaatgtaaaacatataaagaaactaaatttaagacgattaaaattgttgtttaattaaactatcaatctatatttgtaatttattcataatgaatgtaaaagaaaataagagccctaacagaaaaataaattatctttttgaaatggaaaaaagctaattcataattcttgaatcctatttttacaccgactaaaaagacaccagccttggaacattgtttctcggtgaagacaccatgtttaaccacattaagatacatgtaaaaaaataattaattaattatatattaatttagcacaaaaaattaattattaaactanattataaatataaaattaacattgaagaaatcaaaaagttatttatgtgttaatgaattaaatataccaccaccaaaataccactttgcaanntacataaatgatatacatatcgaatttttcttatcatttgctttattacnact

SEQ ID NO: 8897 - DNA, 1317 bp, Heterodera glycines
  misc_feature (43)..(43): n is a, c, g, or t
  misc_feature (70)..(70): n is a, c, g, or t
  misc_feature (283)..(283): n is a, c, g, or t
attttggtttgtatcgatgtgcttagtagaaagatttttacgncagagtctgagtcgaagaaaagcgacnacatgattgaagcacttgaaaaagtgttcaaaaaagccggtatgatgcgtaacaaactgtaagtgaagcaggtttgagtttccaagcaaaacggatgattgaatgctggaagcaaaaggacataatcaaaaacataatgtacagtcctagcctgcattcgggtgtggttgaacgggcgaatcgaacactcaaggagcgcttatacaaatattntagcgaaaataacactctccagcttctataacctttaagaatgcttcggcgttaaaaaaactcctatataaagaacaagctgatgacaaggtaatcaaagtaaaggcaaaattcaaatttggcgatattgtaagaattagcaaagagaaaggacaaatttcaaaaggttactaacccaattttactgacgaacttttaaccaaaatcgtcaaatttcgtgtcttgggactcctaaaggttcttaacaattatttacggctgtttttacggttttcagtcactatttctcgattttaagcaactaataatctgttccttattcataaccggttagtttttgcctttcaataactgcaaaatagttcgttccattcgaatctacttgatgagtaaagcacaaaaaaacatattttctaagcatgttttcggtttgcgttgtgaagaaatttggaattttaaaagattatctgggatttttaggccgattcgcgtagtaatttcggaaagaaactaaaattttatgtagcataaaaatgaatcggaaaaatgtaccatcttatttaaacctactagtaaattctttaatgtataaatttattttttatagattttaaatagaaaaaaactattatttaaattattcggataaacatatatgtaaatataactgaaaccaataaaaaatgtaaaaccaaaacaaaattattaatgaatacaaaagtttaaataaaaatagttaacgttgaataaattaataaattaacctttataaccctaatctgaataaatttatataagtgatattcaaaaatctgtatttttatttaagtaaaaaaaaatttatttcaacatgaaagtcaaataaacaaatttattaacctagagatagaaaattacattaaatttcttctaattttaaggtataaattaaataaattctatttcgcatttaattatcactttgttataaatgtttaaaacctggacatagtattattataaattgtacgaggaataaatatttttgtgataaa

SEQ ID NO: 8898 - DNA, 4561 bp, Heterodera glycines
  misc_feature (4465)..(4465): n is a, c, g, or t
  misc_feature (4496)..(4496): n is a, c, g, or t
ttgaagagtcgaactttgaaaaagcctggacttggttcttttaataaagcgccaggccaaggaaaaccagtgaaattcacgtcttggcccaagttagggcaacctcttttttgataagattttctcccccccccctggataaatagtttagagggaatttgccattattagcagcaaattcactacctacaataattaacaaattgttcatttcttcagatttgcatcactcacaatcagtctttacttatggaagaaaaacaagcggtaagttttgttttcttgtctatcgctcagaattttggaccgtatttcggcactttttaacaccctaatttcgtgccgtccatcaaaacggagagagcgaactgtgcagaagtttgaactgggcgctaaccaactgagcgcctgaccggtttttggggtataactcatttcatagttgcccgaattgagtgaatttaatatcattcgaaagctttaagtgtcctctattagcctgcaaatttcgttaagtttcaataaagttctggccaaaaataaattcattcaattcgggcaactatggaatgccgggctggcgcccaggcgttaatttaacaaaaattttgctacttttttgaaatttttttgactactctgaaaatttttatgaagagcgaaacgcatgctaaaagcactcattttctagtaatgctgcatttttctgagccaaattggctgagtttttctttgtttcgccatgggagggcggggcgttctccgccactgacctcaacgccgtccatatctccgcgtttagttttcaatcgactcattcatttgtacatttccttttctttattagtttcttatataataaaaacccattttcacgaacaaaaaatttttgcaagagttccccccataaatggctgagtgtgccaaaaaatgcaaagttcaaattccgaccgaattggtcgctgaattggtcgatgttctccgttttgatgtccgttgggccatcgtccgcgtttcagcggcctttgacattttggtttttaaaaaacaaaatgcttttataattgccaaaaaagttgagcaattcatccctttaaaagtattttattttctctaattttagcagacggatctgaacagtgggaaaacggaactcattaaactcgtggccgggcacagtgacgaaaattcgcttaaactccatttaaaaagtgagttcttttgactgcttttgcgccacggcagccgaggatttttgaaaaacctgtagttcaccataaaattttttgcaaatttttttttgaatttctcaggggaggagtttaggctgatacgaggggaaaagactgtgtgtgagaaatgaagtgcacccgtaattcgcggtcaaaattaatcatttaacaaatgcctaggccttagcaatttcttcatgttgaatggcgttgctgtgagtcagtccgttgatgatttgtcctccgtgccaattttcaaaaatgccgttgccgaaatgaccgaccaattgcctcacgatttgaagacacaccggcatctgtgagtggattttttgggtcttattattgcaattgttaacatttaagttttacaacatttcgtacaatcattaactgtacaaaatcgcaactacgcgcctaccggtacgaatgaaaaaagattggagaggaaactaattgtctaattattcgtttagtcttcattttttggaaagcgttaaaaatgcaaattcccacgaagaattctttactcgccctgaacagtccgctggtgtttgtgaatatttgggggaattctttactcgccctggacagcccgctgatgctcgtgaacatttggacggaaaactgagaagcgccaagattaagctgtttaactatgcttacttgtttggtaatcatggtgctctacagtttcacattgaaagtgcgtaacttttgctttacttcccaaaaaactgacttcccagggttttttttgtacaaacattactgttaagcactttggaagtgttttggtaaaggcgaaacagtgaagcgctcggacggtcttcagggcggattaccaatgagctatcctatcttcatgaaggcgtttgagcaattaatcatcgacaaatgcacgtcagaagaaagccgactcgttcgccagctgtaatttattatatgccaaaaacacccttaatcacatttagttgtggagtcattcattgattccttaatcgatcaaagtcgtttgttcaattcgatatctgtgaatctatgcgttgctggtaacgagggactgcccaccggtcagtcgtcatcgaattcgtccgtttttggtgctcagcagaaggaatcgtccgttggtccgtcattcagttcgcccgttgttgatgaacaacagcagcagaaggactcgtctggtgtttcgtcggcacaacagcatggacaaagttggcaaatgcatcgaaatttccaatgattttcaacttttgttctcagagcgagccaacactactgatcagtgccagcatcctccgaagaaagaaagaggcggaaacaaataaagtggaaaggcggcaaaggagggagggatttgtgggtttcgagaaatttatcattggaggcacttttttattgagttttaaatcggcaacggaacggcgtattttgttgtttttggaaaatgttcagttatttatgttcttttaccaatatgcataaagacaatgtttaagaaaaaacatttgtaatcgcagagattctcatgcaaaaaacaagttgcaaatgcccgctgcagtgtcagtctcatcaattagcgcgctaattacccccataaataagtgcactcagtcgcttgacagtgggcgtcaaccgaggcggtccagagaggaggggagggggggggggtatttgggattgcatttgaggggcatactgtaaggcatggactaattgtaagtttatccttttttcaaaatttcaaatgttgccctctcaaaatgagtgtgtacattttctctctccttctctctatcctcttttctttctctcttcatttctctctctctctctcacagtctctctctctctattcttttctctcactctcattaatcactatgggtcaactccactgtgcagagaaaagcctagtactatctcgtcgtttctctttttctttgtaatttctctttctttggcgtactatctcttcattttaattatgtaaaaaacaacatttactttgtgacgtttaacttttttcctgcacgttaaatccacaccaaattttgcatagcgatagagaaaaaaaaattacgaacaacatttgggtataatgaaaaaaatttgaagcccggaattatttaaaaattaaataataataaaaagtatttcttttcctctccttttggcgtactatattcacatctttaacacacaaaaaatatcaaattcgtaaatactaataattttggttgtaaaggaacaaaatcactttgagcatttagaatcaatagaaaaaagaataaatttagcattttggttagaaagagcaggacttgagttataacatgataaaagtttgaaactcccacaactttttttttgagatgacaaattacttaacattcgcttagaaaaagattcatttttagtgaaaaagtgcagttgttacccagcagtggaaaaaaagttattggttaaatagcaaaaaaaaaaaaaggtcttcaggtcgggtcccccccccccccccgaaaaatgtttctagatacgcccctgattattttgtcaacaaatttgatatatatttcccatttttcagcttctcgaaaagaatttgttgtgccttcaattttccatggcagctgaacctccgccatttgactacgacgggttgaacgtaagttttattgcactaacaaatcttatggggattgtcgttggtccgttcctgaagcacgcggccccctgttttggatcgaatgtgtaatcacttcgcaacaatcggttctgttcggtctgaacgggttgaacaccccaaattttgtatggcaccctaacatatgttaaataggaatttgtaatagttgccgagggtaggacccatttttttgaaaaatcaacgaacattcatccaattcgtgtttagcgacaccgaaaaccggaattaggtagtttagtttgtctcctccattgttcgaaaatttttttattattttaagtcaaaactttttaggaggttttatggttgattatcacgaatttgacgtccatttagatcaatttcgaaccttaacccgaatttcaacccaaaaaatcgcaagttcaaatttttcgcattcttttaaaccatttttagacgaaaaatgcgaaactcgaaattttgtaatttcgagtttctgataaaattcgtcgtgttcggggatgaaattgatcgaaaagatgtctttatgcctttaaatatnttctttttttgaaagacgcctgcaaataatntgtatttttttttttcagaacccatgaaggattcctaccatcccacaaatctttccaatagaaag

SEQ ID NO: 8899 - DNA, 1110 bp, Heterodera glycines
  misc_feature (16)..(17): n is a, c, g, or t
ttttttaataaaatannctttctaagattttttcggctcaagtacagtttatgcgtccaatcgacttttatgcgtccaatcgacttttatgcgtccaatcgactcttatgcgtccaatcaattttttatgcgtcccatcattttttatgcgtccaataaaatttttatgcgtccaatcaatttttcattaaaaacctttaaacatttaattgcactaaatccaactaccagctcaagaaaacacatttttctccattcaaaaacaggcaaagttagctttatttttctctcttttcgtagtcaaaaagccgtcatttatctctccatttgccggcaaaaagctgccagccgtcattttctctccattcgtcggcaaaaagctgccagccgtcattttctctccgttcgtcggcaaaaagctgccagccgtcattttctctccgttcgtcggcaaaaagctgccagccgtcattttctctccgttcgtcggcaaaaagctgccagccgtcattttctctccgttcttcaaagtgctatggcaatgtttcgattggctctttttcttttggcctgcgctttaactcatgcaatggaatggcacggctttattattgacaaattcggataccgaagggcgaacccttggcattgttgtggaatatgccctgacaataacaacatctacgataaaggccgatgcgttaacgaatctagctatgaaacggaaaccgaccgttacattcgcaacacaacttacatttatatgactggtaattctgagaagaaatgtgtaatttaaaaaatccgtacaggaatagaaggttgttgctatttttgtgggaaaacgccctcagattacatgtcgtcatgtgcttcatcaatgccaattgacgaatgtccgcttgagcaacaatattgcaagagaaattttgagaaggcgaccggtttttagaattattttcattttgaaacaaaattttgaagtttcacaagttgagccgagcatgcgttgttttgcatgtacagcatttatcagagtgatcagagaagtgaaaagcgaaggcattggatggataaaagaggaattaaggagttactgtcgacttgtcc

SEQ ID NO: 8900 - DNA, 1378 bp, Heterodera glycines
atttttcagacaatgttaggcaccggtctcctttcttttaaattggcctttaaatattccggcatttgggtgattacttcttttccttttcccctttcaaagtgcttcctcatttctcagcttggtcttttcctgctcatttgtgtctgttgcatttgcactttcacgtgccgtcagctcgtcaattgctcacaatttttctgtcagcgaaagggccgcgaaatgatggattatgcaaacggtgagaccggcgggcgggagccgagctcgagttacaattgccgacagaaagaaatgtcaatttaaaacacatttttgaatcctcagaatttcattgcagaaattttgagggcttcggctccctttcatggattactataatgtaaatttttggtctttgtcagtcatgcgaagtgccatcgaatgcggccctccgtggataagcgaacgcggttactttttcaagtgggcgattatttcaaataaaaaccaatttatgagcaattcacagacaattggtcaactcgacaatgttcatttgtcagctcggcttttgctgtgtttattttgtttttatggctgacaatgtcaaacaagtctcttattttttcaaactattttcatttattttcttttgtatttatttggcccaatattttcagttcttcgatgagacatcccaaattcacatttcccaagctggttggatcgctttgctgctcattccaacaatggcgtaatcaaaatgaatatttaaaaaatgattttccaaaatgccattttcaattccccccccccttccccggttaagtctttgcaccattcgacaattgaaagtgttggcaccgcttgcgttggttgccaacttggtctatttgggagcggtgctcatcattctcgaatatatgatcacccatttggacagcatcgacgaattgcccgccgtcggcaatttgtccgatttgcccctcttttttggcactgtcattttcgctttcgaaggcattgccgtcgtacgttttctctccgttcgaattggccaattaagcgcaataattgccaaaaggtactgccaattgaaaaccaaatggaccaaccgcaccatttcatctctccgaacggagttctgaacacttcgtgtctgctcgttctgtgcatttacggcaccgtacggacagtgccattttcttgccattatttacatccgcttttcgctcctttaagatgggcttctacggctatttggcgttcgggaaaaatgtgaaggataccgtaacactgaacttgccatcgacaccgtaagggaatcacttttagaaaacgaaagacggacctttttagcttttaccaaaccatcaaaaatatgctggtcagtcag

SEQ ID NO: 8901 - DNA, 1721 bp, Heterodera glycines
cgaatgcaatggacagtgaagacctttgaactctccatcggatcacaatgaagaaacggaagattgtgattttccatcaaatatttatagcagtctttctgcgttctttttttattggctcattggatgataaatccaataataacatcatttctccggtcataaaaaatttattaaaaagggggataaatcggatacataatgcccattgaactaaattccccaaaggacaattaggggcatgtgaaacaatccgaccaattccttccccctccgtttttgtgaggtttttcatcgccaccctccctcatttctgcgcccattgtcacctcctcggccgttttgttgtcggtatgtcatttgttgggaatacatcggactacgagacattggcgctgacgatgccggcacagcgggttggggtggcgaaagcgactgataacgcacaaattgttgctgtgagagatgggaggaagaggcgcgctgactgtgggagggatcgccgtgcgaatgggcagcggaggaagcagcagccgcgacaatggcctaggatgagataaatggagcattactgtttatttaaaccaattactttgatcgcggcattgacgacttcctgtggcatgccaatgttgttcagattcagtgtctccaattggttgagcatttgactaccagccgcaatcggcgggtgctgttgattgtgagcagagaatggctgatttaaatgttgctgtactgaacctgagatgagtggataaaagtgtaaaataaaatgcgtgatttcacttccaagggtcgaccaatcaattctattagagagaaatgacaaccgaccggaaaacattgggcccgcggttcggctttgctgaatgccgggagtcgatgtgatcagctgatgctttggcattgccatcgacgccatttcatcgaattcccattttgtgtttgtgccataattactatacagttcacttgtagaataactatcctaaaaaacaaagaattaattaccacacattatcgtctttttttcttacatcttcagggacgaaattgtgtgggtggggcggaataaaggaagagtgatggtggacagagtgaacggtcgagtcctggggacgagtgctgtgggcggaagaaatgctgacggaggtgtctttgaagtcgacctggccaattctaaaaaaacatttaaattgaaaactggattttttaccaacttaatcaattccttggcaacgataggcgtcgaaaaagtaacgaaagcgaaggaacggaaaggacgcggaatgtaaacgtcggtgaccgatgagtcggggtcgatcctttgcgcttcttccataaagcgttttttcaattcaatgggcgtgactccttcttggagtcgaccaacaaatatttttgaggaaagcgcattcttaaattttgagataatttagggagagggggggggggagggggtaaaaagcaaacctttgaaaatgggactttcacttgacattcgcgatctccaataatgtgggactgcaaaggaaattgcaacaaaataacggtggcgggggcacgataattccgcccccgcgcggcgggggcgggggtttgctttgaattagattcaaaaaatctcacaaaaaaattaatttttatgaatgatttctttggctccacattcctttattagttgatcgcctcgattctatttattttgacataaattg

SEQ ID NO: 8902 - DNA, 3017 bp, Heterodera glycines
attgcaacaaaataatggaagtcaaaaaacgcaatagaaacacaaactttgtgtttgagcactcgcttctgtgcctccaaatcggccatttggatgaaaccgaagcctcgattggacagatggcccttttgggttttgatctaaataaaaaaattttaatgtaaaagggtttgtgagcagaactctcttatgtcctttatatagaataacaaaatcagcctcacaaacaaatgcaatttattgtgcagaggcaaaaaattgagacccaatgcattttcatgttcactaaatggtacgtagagaaagaacagacctcgcaatggaccactttaccaaacgactcaaagtgcgcacggagctgttcttcgctcagctcgaatggcaatcccatgaccaataggtcgacaattcgtccggttgtgtcttcctcctctcgctcgcgttgagccgtccctaccgcggagggcgtccccaccggcgcctctttgcccatcattcgtttttgctttgtcgcgccctgctgtcgcttcgtgaccccgcttcgcatcgcctcgtttttcgctccgcttcgtctgtccatcgcgtcgatggcgtcgctgtcgcatgaattacacaccgactcatcatcactctcaaccatcaatttacgacgcttcgcattttgatcacctaacaaaatgtcattgccataatttatgttaagcaaacaatagcagatttagcattaacaaatgcattaaaaccctcaattattttcgctgcacataatcaattctatagaacacgttcaagcacttgcgcttgattaaaaagatcttcaaatgcaaattccacggattgtgcacagttgtcaaaaaagcaaacaagcacttatagacaaacaaactttttttgactgcatttttggttccactttcggttggctgttgatattgcgataacacaacaaacactaaaataataaatcagaagcaaacgcaaaaacgtagagaaattgacgcaatcagaataatacataacaacgaataaatttaagaacctttgttagaccatccatccgaaggaggataaaacttagtccccgaggcatcgatcctgtgaatttaatttttgtaaaaaaaaggcaaaaaattgtaatactcacaacaaagcacggtatgcgcccgtctttgaatttttgtactttagcccatgtgcgcccggaaaagcaccgacaagagtctgtagaccaagtgtgttgttgtcttcattgttcgtgggcagttcaattcgttctgcttcctcatcagcacttcgtgcaacaacaacatactcaggctggaaaaaccaactacttaatgcatggacaaaggaagagacctcttgtttagtcgaatccataatcaaggggatgtccaatttataagaattgtttatcgaagcttttatataatatacatgaatacattagtcaaaataacaaattcattcaacttctagcaattcacgagattatcaggatctctttacagaactgcagatcatttagttcctttttaaattggcgtcatacatggcgttttgttttgaaaaagaaaaatatttaaattttatattcttgcactatgggttagagcccggaaatttcaaatttgcggatcctgttgcaggattggaattcaaaaatttttgcaggaccggacccggccggattaatcctgcaaatcctgcattttaaatttgcaggatcccgcgcaggattgcggattcttagaaattttgaaaaaatttcaataaatttccaaaaaaaaatacctgacaagaaattttaggggctggcgggatgcattaaaaggacgactaagatttttcgaaagacggtaaaaagagatcggaaatcaaatctgttaatggtcaataaatttgactattttttgcttttcaaaaatgcttttttttcggcgcaatttttgtcaaaaactaggaacaaaggggtccgtctatgcagataggcgccgtctgaaatttttttttgaaaattttatcaattagttaactgattttgaccaaaaaatgaccaaatgtcacaccttttgactcaattctacaggattaaggtcgatccagtggtgtcgataggcgccgccgggaaatttttttgcaaattctaggtgaaatttgagatgaaaattgaatttattttgattgaattataaatttattcaaaaactttggcattccgtcttttaaaattttcaaagaatgtatgcggatcctgccggatcccgcacaaaaatcaaatttgcggatcctgttgcaggattggaattcaaaattttttgccggaccggatccggccggattaatcctgcaaatcctgcattttccaaaaaattcaggattgcggactgggatcctgcaaaatcctgcgcaggatccggtcctgttccgggctctaatagggacggattaaaaaataaaatagttaaatctaattaaattttagtattttaacaaattaaaaattttttttttaaggatttctagggagcaaaacacgtaaaactttagaaaaaacttaattttggtcatttaaatggttacctatcatttcgtcacttatcgtttcgtcactgttcatttcgtcactgagacataatttttaaaaaacattgacaaatctcaataaaattatatcatataatttgtttaaaattctctaaaaattattcctgggtaagagtactaccggtggtagccccttttcgaaaaatttttttgagattttaaaaaatcacaaaatgatagaaggttttcaaggtcgctgatcacgaatttgaagttgtcctaaaaatgatgacgctctgagaaatagactgggattttctgctgctgctttctgctctaatttttcaaaaatttgacgcaaattgttgtcttaatcaacatagagagatttacgcttaagaccattccctctaatgccatttgcaggcgcttttacatactcagcaacgaaatattacaatcgctgaaat

SEQ ID NO: 8903 - DNA, 3598 bp, Heterodera glycines
  misc_feature (60)..(60): n is a, c, g, or t
caaacttaatcgggcattttaaacaagcacactaattcccgtaacacacattcaaattgnaaaaaagccaacaaagagcgcgtttaaatattcaaaaacagcgcttcaattgggaggtgtaaaaacaacaatttgggccaaagatcaccaaatggcatttttgcattttctcacgccttgtggccattttggtaggtaaaatgggaatgaaagggcaataaaagtgagtgggcacatcgcagaacagaaaatttatgcgtggtttggtttaacatttaaatgcgttaatataattatcagggctcgcaagttgaaacaatattttattagcctaaaaaccagggctgctaattgaaacttttcaaaatagcatttggccaataggaaaatcatcatttggcgtcaaaatcagcattttgataatttaattcaaaatgaaaaaataattgaaaatttttttttacggcgcgctttttccaaaaaacttttggtgaatgggggggggggggtgtccggcggtgccgatagatgccgccgggaaaattttcgaaaacttgaatgcaatttgttaaaagattttcaccaaaaatgaccaatttttgagattttgagccaattttgaggaaagatagacattttgactattttttaacagattttctctgaaattttggttattttacactcaagaaaatgaaataatctcttaattcttttcaaaaacgaattaattcaaatattcgcttcaataaaaatagtcaaataggtcattcaaattttgcatttttttattttcaaatccaaaaataagcacaaaataagcacgtaacgctgaaataagcacaaatcttagaaataagcacacttgcaagccctgtattataatcaacccttaattgtttatttccgattatttttgtttaattgttaaccaattaacagaaagaattcccgtcaaaaatgaattttcatctaaaatataaattataatttttttaatacaatacaatttgtcagtgctcacttgccttttcgtcagtttgggcttagttttcgtgcccaaattgctgttcatttaccactggcccgaacttaccaaggaggagcaacagcaaagcacgcagcgccaattgttggaggtgtcagcgccgaaccgtagcgaacagctacggtatcagcaactgttaaaggaaaatgcggagataaaacgtcaaattgaattggtaaaaaataaaaaaataattctatatattagtacactttccaatatttgaaatttaaatcaaaaaattttcaattttcagaggaaccttcgaattcaagaatgtcgtcggattttggagggacatatcacattgataaatccgctgaacaaagcaaaaaattcgacggtacgcagaagacaaaagcagcaacagaacaacaacaacaacaatgccaacttaggcaacaataaaaatgccaataataataatgataattataaaaatggaagcgaaagaggcaaacgaagcgacaaaaagtgaaattttaatttaatggattgaaaaatattggaaaacgaaagcttaagcacccttcttcggccttgctcaagtgccattggcttggcctgcctcgtcgacttcgagccgatcaccacttcagtcggcatggacccgaccacgaccattacgttgctggagcccacaacaaccgcgtcgggtggcgaggaattcgatgaagcaccacccaattacacaactgaagaatcggaaggtggaggaatagctggagaaaatgtggtggaattcgcatcgccgccacgcattgggaagggcaacgccgggggcgaacagagggcaatcgcacggcacgcggaccgacccccggtggaggcggaggaagagcgggagaggggtggaagagcggcgacgcgaggcggagaagacacaggcgggacaaaaattgggggcaaatggaatgggaaaatgggacaaaagtgcctttttgtaattccaggagtgtgcagcgattatgaagaggaagaagatgaagcggacggagaaggaagcggggagaaggtcgaactgatgtcgacagagtccgacgacgccaattggccaaatggcgatgaggaagaaatactgctttaaacagtgtttatataaggaaataatgtgctacgtatattattttaatttaaaaaattcaaattttctaaagagaaattactagaattcttctgcaagcaaaaaataacatctcatcatttcgcttttcttagttgtccataacacaaatcaaataagagtttcctaaaaactaccaaaacgctgcaaaaatatttatctatttattttaaataaaatttttattttaatgttgtttgccaacctaataaataatagagatttataatagatatattttatatgcaatttatacgccgtttttttgccaatattatcaacaataaaagtttcataaactcttttaatatattgtaattgttgcaaatattaatttaaataagctcaacaacttactaaagttttttggagttttttaaaattcgatattttaaataaacataatcagtaattgtttatatattaatgtattatcgtgtcattcattcagtgcttatcgcccttaattgtcctcttcttccgtccatccgttccttcatttgcggccccaccacaaattgtccaaaatggtgccgctggtcatcgcgtcggcgtacgacccggacccgaaaagccattggggccgcgcctcggacaaaatgttgggcatcagagagaggagaagcagcgggaggaggaggagaagcattggcgaaagcatttggaaagaaaaaatggaattggagatttttgaaaatgcaatttaattgctccaaattcggcctttttaaatatttttgtacgtcggccttttaaattatttttgattatcaaagatcactttttggaccacaatttgagtgatggatgacttcaaaacgcgcagaaccaaagcaatttgcagtaataattttgaaaatttaatctaaagtaattaaaactaatccaaatttggaaatgtgttaacgaaaaaatttaattatagtttcaatagaacgggaattcacaaatgagctgcgagaagaacgaacatttaataaatttaaaattaaataaaagtaataacaaaaagaaactggctttttatcgccaaaaacacaaagccgggaaaatcgttaaatactcgtataatttttttcaaaaaggtggggcgatatggcaccgctggccatttttgaaaactttggtccaatttcttattagattttttccaaaaaatatggtgatatttacaatttttactctttagaatttttaaagaaatagattttgacttaaaaatttccagtttttaaaaaataggaaatttagctgggtccagtggtgccaaaccaaaaataaataaatagaatagataataaaattaataaagcaaatttggaaaagggcctaaatttggtgtatgcagtttaaattaacaagttttaagtaaattcttaattattttatgagaaatgtgggtaaattaataaaattaaatggtagat

SEQ ID NO: 8904 - DNA, 1990 bp, Heterodera glycines
  misc_feature (1938)..(1938): n is a, c, g, or t
atataaattcatgaaaatgccattcatcagagaacggaagtaaaatggtcaagaccctgaattgtaaatgcgatactttatcaaattaattgccaaatggccacctgtccaatgtcccaaatcgccaatcctccgaggcccatcgtttgggccaacttaagacgaagcgcaatggactttcttgacgggtaataagcaatgccattgtcgctgaaagtcaattactgaaatttaagcatcaaaatgctttgagaacccaaaagtgagccgatgttcgccaacatttgcttcaaaactgagtttggcatcggacgaagaaagcaactcaatgaatctgaaaacaaaaagtcgataataaaggagaaagcataaaaaagtgccgcaacgaatagacataatactgttacagtagtctttaatagggcttccaaccaaatacagtagtaaaccaactgattgcccaaaagggccgtgctttggccattggttcggtcgtaaccgtagaaattgaggcccatcaaaattttggcggcttcttcctcctccccaccaccggcggcagtgatcgcgtagcgaatgttcgcctccacccaatcgatcggagcaacggcagacgcactttagcaaaaggtaataattgggggtaattattaattgaaaatgcactcggagctggggaaatcgtaagtcatcaaattgacataatcaaccgccgaaagcaatcgctgcataacttgcgcattcacaatgccaatttcttgcaaactgcaaaaatatttaaacgatcattttttattatttccaaaaggcacttcgcccccagcggcggagtcagcggcaaaatgaactcgaggccggccctgtggaaatgttctgaccaaaactcgatcaattcgagcaaatatctaaagatgtgaaaagaaatattataaattacatttttaattaaagaaaagtatgcgaaagaaaatattagacatttatctgtgttacaccacaaatatatttggcattttgtctagaaacgtaaaaaaagcaaatttgcgttgtgtgttaatcgcatggataccaagaatcgtgactttcagtttgtcatgaatttttagacttcaccccgatacatattttcttaaggagaaaacaacgattttgagataaatttctgaattttaaaattatctttgtgtgataaaattaatttttaaaaaataaataaatttcggccctatggctaaagcggcaaaatgaactcgaggctggctctgtggaaatgttggaccaaaactcgatcaattcgagtaaatatttaagatgtgagaagaaaatatttcttttcttacgtactgagcagctgtgccccgtgtcatggacataatttgtagccaaatttccataacggcgccattgaaattgtagcgctaaaatattatttaatttttatttaaaattgggaccacgataaaattgacctgcaaaaattcgaccaacgacctcacacaacgatattgggcctgttcttcggtgagaaattgttgaaggtgggcaccggaccatccctcgaaaatgaaacgggggacaattcgaacggcggaattgttgagcagaatctgctcaacccaacctgcgaaaagaggcaaaataatcgatggaccagcaaatttggaaaaagcgctcaaattccataattgttaattttaaataaagaattcttggttatccaacaggtgtactgatttgtcaaaacattttgtttttgttccggcgccaccggaccctatcttaaaatgttttaaatttcaaaacaaaacccaaaaaaatgtcattctggggacaatcttttatgaaaccaagcaaattttcaaattcaccctgcggcaccaatcggcaccgccggaccacaatccctattcttctttaatgctgatttttgtctgccanaatgtcagctttgaaaaatttcaagacctgcttttaatcttttcgacctgca

SEQ ID NO: 8905 - DNA, 2949 bp, Heterodera glycines
taatattgtaaggaagaagctgactgggcggttaaaacgcggaaagcgggggttgatagatcaataaaaagaaagggcggatgtgcctcggtagcttaatggtagagctgcccacggaaagggtgcatgagtgggttcgattcccacccgaggtttaacattttgcccatttcttattattttttcataatattaactactgaaaaatgcttaacatttgtaaaataatttactctgaaaagtaattcaattatattatatattgagcaatagggtgaggatttttaagggaaaataagtccaaaataaggcagtaaataagggcgaaaataaggtcgaaaaagttccaaatttaggagtataatttttttaaattactgttttttataaaaaaatttcaaattaatataagcaattttattcactaattgctattacgaataagatactattcgaaatttttgggatcaaatggtcgattcttagggttgtattttcccgaaattttgaagggcgaaacgccatttgatcaattttatttctttgtcttacttttggcaccatgtaagagcactaatgtgcctttggtttgctcgataaataaataaataaataaaacatttttttgcagccctatctattataattcaaaaaaatgtgaaagtgtgaatgggaacgaacagcaggattaagcatcaaaaacattcaaataacgatttttggcacaaaatcttttacattcgtccaattttaatgaaaaaatagtggcaaaaaaggaaatccaaaaacaaaacaaaaaaaaaatggttgacctgtaagcttaaaaattttaagtaaagagtttctttaattatttaattttttttatattattttttttttctaatcaactgagtaatatgagacatattgttatatttttataaaaatgtaaatattttatgagtgtaaattttaaaaaccatgtaaaattttataaagctagacaaattgacatatatcgatagctcttaatttcaataattaaccaaaacaaaaccatttcaaagtttgtttaccatttaccataaaactttgaactctctatcatctggatttttaattttgacactttaaaattttgcattttttttgaaatatggacaattacaaaagcttttgagggtttgaaaaatgttagatttcaaaaattaaaaaataaatactgttgccatcgacatacaaagcaaacaaattaggaattgtttgaatataatatgaatagctagtctaattgaaaaagaataagttaacattttgccttaaaatgaaatttttaaatatataaaatgcattccaaaattatttcttaatatttaggttttaatacaactttaattattaatattaaagaggtgctttttagaggagtaaatattttcttccacctttggcccttttcgtcccccctttcacaaatcagcacatcttttcaaattatcctactatttccattaaattgtccaattaaccacctttgtgaatacttagcccaagcagtgtctcaaaattagagtccggtaaaaaaatttttcgggaacgggaacgggaaaacgaaaatgaacggggcgggattccataacgggattcccgcctttttcccgcgggaatcccgttcccgccggactctactcaaaatcctttctacaaacgcacttaaaatcatagtttgataaatttagctaaaatgtttgagacataatagatgttgacatttaaagaataaaagtcatgcactcagattcgtgatcagcacatttttttaagcctagaaaaaatatccgacaaattttaacatttttttcgtcgggacaccaattattaatgatagtagtatatagcgtcaaaagcgagcgggttccgagcgggtgtttaccgcacaaacccaaacctacgggaggggtcttttgaaggtgccgcccgctcacaaacccgtggctattggactacatctgaagctgccgcacaatcccaaaaccctatgggaggggcgcagccctttgtagttgccgccccatcaaaactgtgttccaaaccaaacctattttactccctatgaagttgccgcccgtggacatttaccgccaagaaccaaagcctatgggaggggtgaagtcaattgatgttgccgccttgtggatttaaaatttccccaaattgttgcgggtgttttttcactccgcaccgcgcagcgccgcgggaaggtcatcaatcatccacctgtcaccaaagtgacagataatgaaattaattttttctttgcaaattaattccaaatctttttgctcgcacgcaaaccttattggcggttttattttatgaaatcctgagattttttatcaagattttttatcctgaaattaaactatttttgaaaatttgctaaaaccgtgcggttttttgcatatcttcccttcgccgcgcagggccgtcatcaatcatgcacctgtcactaaagtgacaagtaattttcaaaaattcaatttttattttgcaaatttaattccaattcttatttatttattttgaattttaatcaattatttgatctcccgttttccaattctcaattatttttgccacctccccagagccctaaacctcgcgggtttctcgctggtgtttcccgcacaatcccaagcctatgggaggggcacacaaactacaaacttttgaatatgccgccctaaaattccatttccccgaatccgagcgggcgtttaccgcacaaaccggtgtctatgtgaggcgtcaaacttttgaagatgccaccaagatgcaaaaccaattggtgcaggaaatttgaattcgttaaaaaggtgctatttttaaagtatccaaaaccgtgcgggtttttgaatttcctccccgccccgacgatgaggcacaattcaggcgtcgcgcaaatta

SEQ ID NO: 8906 - DNA, 3414 bp, Heterodera glycines
gggcggtattttcttttgaaattgccgctacgtgatacttccccgcaaaatcccgagcctattgaaggggtgtttccctttgaagttaccgccgcgggattttcccctaacccattgaaggggtgaaatccgttgggtgatttatgaacaggttcacaaatcaaagatattgtattagtttaaccctttaaagtcgccgcccacgtaaatccgttttccaaaaccgtacgggtatttttttgtctccatctgcatctccgccggtgtgccatgaagtcgtcctgccgcgcaccgccgcggaaagttaatcaatcattcccctgccacaaatgtgacatgtgaaaataccttcaaccaaaattcaagttcttatacatcatatcccaaatactttgtcgctgttttttgaatgctgttcattaaaatttaataatacgtgtttaaaattccaaatcctagaaaaagagcgaaagtgttctttaactgaacataaagataaagaaattatggtccgactaaaaattttaaaataaaaataataaaataagacgaaaaaattaaacgtaaagataaattaaaaaattgaaattttcaattgttggtgctgcgtaccatatttctttccaaaatcgaaaactatttcgcaaatttgaccaacaatttctgaaaactgccaagcaaaattgattgatggatttattatttcgaatttctcatttattacgcaatatgcacgcgatttacattaaaaaacgagttcaaaatatgggctgtccaaaattttgaaaatttaagcaaaattaattaattatcatcagtcagctcaatgacccaaagataattcaaatcccatttaaaaaaataataaaattgaaaattctgaatgtatgttgtttaaagtcattcgtagcaatttaaaaaataatttttcttgataatttttttgctcccttcaccccttccccataaattgttttttctgttattcatcattatttttagattttggatttagggaagttaaaaataattactcttatgtctttgccacgtaattctcgttgttcttctttctatttcaaatttaattgaattcccaaactcaatggtaggggattttcatctaaagttttcccgctgatataatttatatacaaataaagctctggtaaaagattcccttttaactctttaacaaaaactaactcaaataataattttaaaaaatcaaataaatttctattgcaagccttttcgaatttattatctttgctattaagatatgacttcatatgtttggaattttataaaaaaataaaccaaatgaagcggactgtaatttttgtggaaaagtttgtagcacaaaatggatcaacgaaagcaaggggccagccatcacatggtccataagtaaaaaaccaaaaaagggtgagaacaaacaagaaaaggccgtaagttataacatacctaacgaaaacatgtaatcagaatttttgctttaaaaaacaaacttaatttttagaattacagagaaaaatagacaaaacacaattggattatacttattgaaagctgcctataaaatttgattttgtgttattgaacggtaatttataaactaaaagaatttgaccgcgattcagtccgacgttcaaccaatgtcctgccactttgtttgcaatctgatcgccaatgatcggaattgccacaagcaccgcatggataggtcggatttctttgatttgctttgcctcccgttgtgtgctggtttgctgtcgttttgccagaattgtaatttcctttctttgatttgggctctatccattgttgtgggcaaagttggatggcatttgttgatatcggaggcgaaaggagagccaatgcactgtccttgataagctgcatggttttcaactcttcttcaatttgtccgagcgaaatccgtgcgccacttttctctgcctcctccaacattttcaaacatttttgtctcatgtcatggtgatcagatttggctgttgacgaatccggaaacattcataccggcggacaaataatgaccgggtttcggaaaacaaacccttcaatttgtcaatggactctttccaattgactgtgtccggttgcgttggtctaatgctgtccctgtacttgttatactcttcgtcagagagttttccaagcaaaagcctaactttcgctggctcagcaaatcctttccgtcctcttctatcagaattccaaacctcttgaaccattgctcgaaggtatttcccgactcggagtcgtaatggaattttgaaattcgtccatcgattgagctcgccaaatttgcatggcttaggctcgcagatgttccaccactttgctgggcactcatcatttgttgaatccgcttttcggattttgccaaaacggcatcgagaataagctttaaattgttgaaatccaaataaccacacctggtggctccctacacttgctgagtgttaaggatttttgaagatttgaagataaaaccgcgtattgcggaacctcaccacaattgtgtcttttggtttttagttgaatttaactgctatattagcagacctcacaccgcctgggtgctataggttttcgaagacttgcagtgtcttcggtggagaagattggctgctgactgcgccaaattgttgtgttcttgccaattaacacacaaagaataaacaaatatttattgatcggtcggtggacaatgcaaaaatataataaaaacgaatgaatgagggaagagacaaaaaggaggggaataggggaatgatctccttatgaacacaataaggagggttggggcgtggagaataaagtacaaatatgaaaataattaaaaaggtcaaaacgccaatttaacatccaattattatgaataaaaaatgagcgaaagtttactaaataattggaagacttaaatttccttatttttattttaaaatgaatttctcattgttgaatgaaaatactttaagtggatgtaggctgaatttttttttaccataaacagaattttatgggttttattttgattttttatcttcaaatggaaaaaagttattccagaatttctggaaattttcgaatttccagaaaaaaattcgtaactgccttctgaaaagctattcgggaaaagttaaatagtacaaaaatccacaatatttagccctattttataaattttatttcacctttttatcacatttttaaaaaagatacaaaaataaaagtgattttgggatccgggactaaaggggggtgaccaggatttttgagtgaaaaaatttttcaccaaaaatctagcaaaaacatgtttttaggcgttttttgggccgctctcaatgatacgtgaacagattttacttttgacatcgtcaagac

SEQ ID NO: 8907 - DNA, 2567 bp, Heterodera glycines
  misc_feature (10)..(10): n is a, c, g, or t
  misc_feature (2503)..(2504): n is a, c, g, or t
ttaattaacnttgaccaagattaaaatcagttaattgaacttatttttttacaagctttgcgacgtgacgggcattcggcgcattcaaatttcggcatttatgagaccaaattcattcgagtcgctttttttttaaattttaaattaaaaaaatatatttaaaatgaaatttggctttacatttgcgcaatgctttgaaggaattctccactcagctgcgactcgtcggtgttcccgacactgacttttgacgcgtggaaagaccacgaggcggagctgaaactgccgatcactgatgaaacaattgccaaagtgtttcagctggcgcagctgaacctcagggagcaacggagaagggaaacgatgaacatcagaaaaagtacggtagcaaatgatggaaaatatactgtagagaattaaattaaaagtacggaagcaaatgaaggaaaaagatgcgataaccaatagtgaaaaaggtatggcataaaaaaaacacaaaatgaaaaaagtatggaattaatttttaagaaattggaaatgatgaagggaattactgttgggtttgctactgtactttcttgttttactgtgtttgctctgatcagatcagtcggtgcttcgcttgggcgatccgttgttcgcctactccaacatgatgagggcaaagaaagttggtgcaagaatttcaataatgatcattaacaaccatgaaaatgatcaggaatcaaagggcatcgccaaagtgtccgaccttttgatcgagtcgactcggatcatcgccagagggtgggccaaaataaaaatgagaaaacatttaaatgattaagagacaaattaccgaatggagtgaaacttccaaatttggatagtggtaagtaagtgttcacaaaaatgatgaatttcatcatttcattggcatttaaattgaatattccatctttggcactgaaatttttttatgtgtcaaatttctcatctttcaaacattgaaaagaatcgttgcaacggcttttgcccgaaattgacgtgtcgtcctttgttgccaatttcaccgcttttctcagcgaagacggaagtgccacgacggaggagtaagtgaagaattaagaatcaaaaagcagcaaattttaatcattgtttatgttactattatttgtaaggttcagacagggcctgggatccggcaaaacgcattggttttataatggaaactctggccgagtttcatttatgggaaaaacataattcctttgcatttttatacattcaactaatcaaaccatttgtattttaattattattgtgttctaattcgtggtatatttgagagataacaataaattgaatcgtccgaaatttttttgaaatttgcccgggcctccctgagcatgggtttacccctttgtttccataatttaacctctaaaaatgattgttttttctttccatcgtcagatgtcttccgcgaatgctcccatgcgaccatttaagcaggtttttgaactcaaaataaaggaaaaacagaaaatgggggcaattgaaacattaagatttcgttcattctccggatggtgcaacaatctcaagtaataagcaaattattaccaaatttgctaattatacaaataatttagacacccattttatggcaattcgttcactcccttgcgccatttgttgccgccggtttatgacgacggtgagacatttaaaatcatattaaaagactaagtagggtaatttgtgacacaatttttaactccatggctaacgaataccgattgttttaattatactaattgaattaattacttttcaggttttgatgcaccgcggaatcgtgccaaaagtggtcagtctcaatttattgggatggagttacgccattcttttatcattggggaataaccaacaaatgtgatcattgatttgaacaaagcaaaaaattaataataatcagttggatgatcaatcatcgggagtctcgagatcaatcaattcttagtataaacaatgattttgattagttatcagtggggggggcatatttaaattttaaaaaacgacgaaaaatatgtaccattttagccaaaaagttgctacgtttttcaggcgttccgttgccctccccccggcgcatttccaacgcggtgcacgtcgaccgcgacttcagccatgccaagttcacacacatggtcatgcagttcggccaactgttggaccacgaactgacccactcgcccatccaccggggaccaaacgacgaaattctgaactgcacgcggtgcgactcgcacgagacaatttcagtgcattgcatgccgatcagagtggagcgcggcgatccggtacggtgcgggggatttgataatttgatttattgaaatttacaaaaaaaaataatcagaattcttattgatgtaaaaaattcgatctaacaaaacttcaacaataatttgactgaatttgatattgcatatttctctattggattaatagcttnncataagtccattataattaagggattgggatttttatgttttccctctttttttcctgtaaaa

SEQ ID NO: 8908 - DNA, 2748 bp, Heterodera glycines
  misc_feature (14)..(14): n is a, c, g, or t
cgatggcattgccncagggcaccaggagaagattgccggtgggcatttatgagaaatcagagccattaataattagccaataaataattaaatgggttcactgctttgaactaattaaaagagctcctttcttatcactgaaaggtcgttgccgcgttttccctgttttgtggcaggcgacgaaaggaacagtcatcaggttgcttaattaaaatattaattaattaaaatatattaaataatgtttaaaaaaactccattgttccagcccggcttaacggcactgcatacaatctttttgcgggaacacaatcgaattgcggaggcacttggccggattaacccgcactggacagacgagcgcatttaccaagtgtttaaatgcgcaaacaattgccctttatttagtgataaaacatgactaaatgggattctaattttatgggtaatttggaattgatcgacagcgattgagttttagtcttttggccacttttccacaactttcaacactaatcataaaatggccattcgatggtcattcattattttggctaataagtgtcaattaaatttggctgtttcaattcaaacattttttgccctatttaattgtctatcaattaaaggaaacgcgacgcattgttgtggcacagcagcaacacattgttttcaacgaatttttgccgaaggtatactgtagtttttatgctgtaaaagaccagttacggtatttcaattataaagaagtgaaaatggtcatggtaataaatttatatttgattttgaaggtgatcggtttggaccttttgcatgaatacgatttggttagtcaacaatcttcttttttattatataaagtttaatatgagttgggtttaaattattatttacgttttcactcctttcaaattccctatttgacagatagcgcaacgttctgattattatacgggatatgatgccaattgtgacccggtcaatttttgcctcggcattttattttgatttttggatttatttttaggcaatttctcatccgtttgccactgctgcatttcgttttgggcacactttgtgagtttaatatgaatatattagtgaaggaaataataaaaaaattcaaaaatggcaaggtaatttgccgtttttttattgaaaaccccataactcacctttaaattctgccagtaataaataaactaatttattttttaaaggattcgtcggatgtttccccgcatgaactcggattatcacaacatgtccgaaccggtcgacttggccaggcattttggcttcgttgaaccgttgtacaatcggacggccggcggtgagtggaagaaaaaaagagaataaacaaaaataaacaaatttgggaaatcattttgttccaacaattttaaacgccctagtcactgggcttttttagactattaacgagacctaaaaagactaagtaattaaacttaattgccattgattgccaaagggttggactcgatgttgctgggaatgctcggcactccgtcgatggcattcgaccggcacattacaaccgcagttcgggatatggtatgaagcacagacagagaaaaagcaataagtgacaccaatcaaattcagttatttgcccgaagggatgagccaacttctggcatggatttggtacgcttttaaatggagccttattagcaatatcattatttaattacaggtcgcaattaatatgcttcgggctagggaccacggcgtacaaccgtacaatgccttcaggttaagagaaaaaagcgatgcactaacaataagacatttcctaagttcgccaacaattaagaagataataaatatttggtttttaaatctaatatatttgtttgatttctaaattaattgtgccaattcaaagaatgccacttatttgccaacattggttttttggcatttacaatattaatgttttttttaaataaatttatacaaattttctttacgcctatcaccaccaaattttctcctcatttgtgccaatttaggcccctttgcggactctcccgtgccgaatccttcacagatttgcgtgacgttatggagccgaatgccattgctgcgcttcaatcggtctatgaaagtgtggatgacattgacttgttcccggggttgaccagcgaacggccgcggaaaggcgcattggtgggcaatgggaggaaaagccaaaaagaattttaaaagaaaatattacaaagcaattgagtattaatccttttattttttgtagattttgcagtttgatggacccgagaaaaaccattttttggggggggaccattttgatgtgtatttttgaatgttttacatttttatttgttttgaccgatgattatgtttacaaaaaagatcgaaaaatgcaaatagtaagggtcctcccttctatggtttttcattggtccactaaactgcaaagacgcctattaattaggtataatttaaaaaattctttctctttacattaaacttaaaattttttgaattgccatataaaataggttttctctcagttttttaaatcagtaataaaataaaaaaaaattaaatttaagaaatataaatgtttatatttgtgtgcttaataattattattgttcggctaagcttggccacacaatgtcctgtctgctggctgaacagttccggaggctgaagaaatgtgaccgtttctattatgaaaatgacaattccgctgcacgg

SEQ ID NO: 8909 - DNA, 3398 bp, Heterodera glycines
atggattaacagtatttaattaaacaattaaaatacttttgtgttgcttagggttttatatttatttttactttttctatctgtatatattttaaaagctaagcaagccacgagctgctttataaagttttcagataggattttcataattttaagtgatgagttattgctgattttctatttttgaataaaattcaagtttttagcattttgaaatattgaaagcaaaattttaaaaatttctggttgtttttgataatttgagatttttcttagttttccaatattttgtttgttttagattatgaaaatgtatatttattttcggtgaagtagcctctcgttttgcacgtgatacaccattttttgctaagccattccagtgcactgtccgaagggtagtccaaatctattgccacttatgtgccactacatatatttgatttttttgaattaatactcaaataaattaaacttaaatcttgaataaatataaaatatttcgccgaaaattaaatctaaatatattaattaattaaaatttgaaaaagtaaaatatattagttaattatttagttagatctttggattatttacaatttaaaatatgcattattcatttagctttttatttgtttttattatcaaagtttttataaaataaataatttaatattttttaaaattaaaaaaagacgtaaatgagataaattatataattaattttggaataaagtaatatatgaaatcatagaaataaaatttattgttcagctgctcatttgtagatttttaggtcttaaattaaaaaaaaaaataataatatatgtatagaaatttttaatatagaaaacttattgaataataatgttatttatgttattcttaattttttttgcctttaaaaaagtttttgatgtatttcattttgttcgttgtgtatttcatattgtggaaaaaattgttattaaaataaataaaatttctccttattattaaacggcccaaccgtagacacactaacttaaaaagcgcacacaaacaaacaaaaaaaagcaaagcaaataaattttttgattaattaatattttaaatttattaatcgataaaatataaaatcattattcatggattaaattgtcaaatccattggatgctaagcgatattgaagggctcttaagtgatgcacaatttggtctggttcggggtttgcaagtgcatcaaatctagtgacaagagtgcgtatggccacatcattattatagtatgtccttcgcctaggttgcaaattcaaaccgcttgttgggtccaactcataagtcctaactttgtcttgagcaattctttcttcctctttcaaaactaaaattaatctaaaaatgtgtactttgtgtcttattttttaaaattcaatagttactttgataatggaggatgcatattttggaattttcttcgcaatgtaagatgaaatgcttccttaattatttttataacaaagcggtttgacacctcaagtttgaggatacctgggcattgtttgttctacataaattatcaataaccgccttggtgatgattccaactcaagacgaatttcgcgttgaagatttgttcaaaaaaatcgcttcttatatggaccgtgagtcacttaaggaaatatgttttttcggtaataattgtataggaaatataaatatagaatagctattaagggaccgatggacaaataaaaagagcaaaatctgacaagcatggactgacaacattgtttttatatgccattcaaaatgacaaaaaacttgacctacttgagtgtctctgattatatttaaattgccagttgggcctttggcaagccattaataaatttaaaatattaattaatcaaaaaatttatttgcttttttttgtttgtttgtgtgcgctttttaagttagtgtgtctacggttgggccgaaacacacgtaattagttgctttttaaccggaagagaccgtactgacgaggcccactcttccaaaaaattttcttaaaaaataatttttttttattcagaaaccgtccgcaaatgtccctccgcaaatgtccgtccgcaaatgtccgtccgcaaatgtccgtccgcaaaagtccgtccgcaaatgtccgtccgcaaatgtccgtccgcaaatgtccgtccgcaaatgtccgtccgcaaaagtccgtccgcaaatgtccgtccgcaaatgtccgtccgcaaatgtctggtagccaaaaaaagagacgccgtttttcgatgagaaagatttgttggatgtgaggtgaggataggagagcgaacattgccaacaaccaacataaattttatttacatacattgatttattttttggtgctggttctatcacgaaaatgcaaaaatatttacaatacaccaggggtgtgatctgtcctgatttatcagatttgtcttgatttgaagggtccaaatctgataaaataataatgtcctgatttgtttgatttttccggcggcacctatcggcaccgccggaccccctcctctcacccatttgtctaaagttattttagaaaaatgcgccgcaaaaaattatttaaaatctgattttttgatcacgaatgcattaaaatttacgatttgctaatcccaaaattgttaattaatgggagatgaaaaaatattatttgataaattgtaaaaataattgatttgtaagcaatttcgcaaaatgtctgatttaaaattgttattaaaataaataaaatttctccttattattaaacggcccaaccgtagacacactaacttaaaaagcgcacacaaacaaacaaaaaaaagcaaagcaaataaattttttgattaattaatattttaaatttattaatcgataaaatataaaatcattattcatggattaaattgtcaaatccattggatgctaagcgatattgaagggctcttaagtgatgcacaatttggtctggttcggggtttgcgagtgcatcaaatctagtgacaagagtgcgtatggccacatcattattatagtatgtccttcgcctaggttgcaaattcaaaccgcttgttgggtccaactcataagtcctaactttgtcttgagcaattctttcttcctctttcaaaactaaaattaatctaaaaatgtgtactttgtgtcttattttttaaaattcaatagttactttgataatggaggatgcatattttggaattttcttcgcaatgtaagatgaaatgcttccttaattatttttataacaaagcggtttgacacctcaagtttgaggatacctgggcattgtttgttctacataaattatcaataaccgccttagtgatgattccaactcaagacgaatttcgcgttgaagattt

SEQ ID NO: 8910 - DNA, 1238 bp, Heterodera glycines
accagggctggccgtgatcacggatcacggaaatcacggggtttttggggtgccgtgatctcggatcacgggtcacggattttttcaaattttccgtgattttgatccgtgattggcattttatatagggaatttttattgagacgaaaataggaaagtggtgtgaagaaatttttgagaaaaataaataaattcttttctgcttaactgctaaaaaccctattttttctctccgtcgcttaaatttaaaacgacaggcctaatcaaaattttcagaaaattttcccaaccctctaagaattttttctaaaattttcccgacttatacataaatagatttttggttaaatttaagaaaaatttgaaaaattttcttaataaattagttaaaaataaaaaattttcattgagatttctataaaaagctctaattttcctcaaaaaattgccaaaaatcgtaaacttagtcattttttggaaaagttcgccgcaaaaaagcggtttatatgtttagttttctttttaatattagcagtattgttagtcttatcctaatttttactaagaaaacaaataaatttaaataaattactctgggaatttttcccgcgattaaattccgttttttaaataaatttaaataaaaaatcattagaaaattttttttataatcacggatcacggatcacggaaatcacggggattttggggtgccgtgatcacggttcacgggtcacggcaaacttcaaaacaaaattatgtccaatatatgcttatttttttagcagttttcaatttttataaaatgaattgacgaaatattttgaattgtttgtttttgattccttaacataatcaatgcaaaatattatagatattattacctattttttacataatttcccaggcacaaaaatattattttatggttatattacacatgttttttatgcactttgatgccttatcctaataaatgaaaatattatacgtatttaccttttttataaaattttccagacgtaaaaatattattttattatatagattatacacatgttttttacgcactatacacttcctatgccgattattaatcaagcgatagcataattatttttcgctataaataatgaaattactttgattaattattgaattataattatttaatttacatggaaaaattcatatttttgtctatgcatattccatttgatttcttcaatttcctcttt

SEQ ID NO: 8911 - DNA, 3635 bp, Heterodera glycines
gcatattccatttgatttcttcaatttccctcttttcaataatattgggaagatgctttttcttatatatttatattatttaataaatattatatttacaacaaattctgagcctataaaaaattgtaatgcattatcactcagatggactgacggtaataaataaagttctttttgcatagctctgtttttaagattaggattaactttcaaaaattaaaaaatttcgacgaaaaaataaattgaattttgataaaaaaaaataattttatgattattgataattaaatgtaatgacatacaattaaacaaagggtaaaattttttctaatcatttaaccccctaattttaatagtttttaaatgttttatttatcgattagaagtgtgcacattctaacgcttcataattaatttaacactaaatagttaaaatgccgaatatttcgttttgttgttccaaaactcgtattttgttaaattatcaaccggtttagatttaaaaattcaattttctgtttgtttggacaaaacatcgaaaaactttaagtttagtttgctttgtgatgcattaaactgttcccatacaaatttatttgctttctttaattacccaatttatttatttttatcttaaaaaaatgatatttcttgtttttaataaatttatatgacattttttacatcacttttttaaggaagtaatgaaagcgatgggaatgacgacacgtggaaaaaatgggagttggcagatgaatttgggaatttatttgtcagagcatttattaagcccatatcgaaagaagaggacagtcaggtaattaggtatttttccctctaataagtgggtttgttcaaaagttattaattaattaaattattgccattgttcggttgctcaaaaatttttcgaataaaatgaattaaaagaactttcaagtttaataatatttacacatatttattaagcttataagatgataaagaatacatttttaaagaaaattattaaattaacagtgatttttaagtttagttcaattaaaaattgcttaacctaatacttatgaaaataatttaaatttcttttatttttagtcaattttcttagcaaattttgtaaaaattcaaaaaaaaaaattcacccattcctacctatcacactaccgatgactttttggactttgataaacacattttctcagtcaaaaattagggtttttgagtaattagttaattaatcaagaaaaagcttttgtctatgtattcattggattggatgtttttgtgggatttgatgaattttttattttttagattttttacggttgtgtgattgattttccaaagcacaatgaacatttcggttttccgaaaagtgttgcaatcaaacaagtgttcttcaggggtgacgaatattataaggcaaaagaaatgttgatccatgaagttgaaatattgaaaatggccgtacaaatggaggccatttacgtgatcaaattaattgattagtaattttttaacaaaaatatgctaaaatttttaataatattttagagaaaaattattataattatttttaaattaaatatatattttttaagcattaccgtaccaaattcactggtcatggtgctggaattgggcgaagaatcgctaaagcatcgcttaaatcggttgaaaattgagtggaaaaaacatgggaatttggatgtaataaattcggatatcaaatccattttcatccaaatggtcattgctttacgtgatttgcatcgatgtgagttggactcacaaaaaataaaattatattattgggataaaaaacttttcatttttaaagtaattattttaatattacatatacatttttaaatattaagtatttttttatattaattaattaccttagtaattctatattatacccaaaattttaaaacgaaaaaaaaacatgataaaaaaattattttctaaaaatgattaaagatttaaaaaataataatttaataatttcagttgcaatccatttggcactgaaatccgaaaattggctttatgtaaaccgaaatggagaaaaaatgttggcactgattgactttcaaacaagcgcactaattcaaacgaatggcacaattgataacagtagcaagatcaagcggaaagaattgaggtaatcatcagttttaaaagttgtaaatattaatttaatatttcgttatgaaactaaacattaattgttagaaatacttaaaaaccctaataaaagtgtttcttgattgcttaattaaaaaataattgtttctttcaactctgccagcctccaaagattttttttaattttgaagaatttcttctctgtaacatttgaagaattgagaaaattttcctgctttttatgttcccgttctcaactctctagtctttaaaatttcgaatcccgtctatctctgtaattataggcaaaaacattttagttacctttagtcaaaaacattggatttagcatttttttcttttgactataaatagcggtgtattattttttaggtcctttatctgtaaaacatttgtcggacgtacccatctgccgcgaacacgacgttttgccagtccggaacacaacaaattttgtgaatctcatggtaaaaataaggtaagtgggatagatgagtttgtataaaatatttaaaactgcaaatataattatttaataaaaaaaatttaaggtttcattttcaaataattaatattaaatttggttaaatttaataaaatttaaacaaaatcattttctgattaagctcgatgttcaaacggacatttggtcacttggcatttcgttgttagagattttggcatatacaccacaaattgatgccgttttcgattttgaattttctgttgaagaaaaaagaaaattcaaaattttgcgaaattcttttgtcgaagaaaatgaaaacaaaaacaaacaatttgccgaaaaagcgaaaatggcagtttcagaatatttccccaattttagtgtgctgattaaggtaaataaatattaattatcaattagcaaactacttaaaaaataaaaccgatttgggaataaaattagattttcattttaaaattaaataataaaagtagtaaaagtttatttttaaataaataagatatgtttaatatgtaattaaaggtattaattaatgagttatgttttctatttaatgccttttatatttttagcaaatgttaacaactgacccaaaaaatcgaccaacagttgatgaactgctaaatgaatttcttgattgaaatttcaaatttttccaacggttaatttttattcactgttaatttagaattttagaattttttttattggttagattatttcttgtataaatgctataaatatatttcaaatttatcagtagcttcttgatgtggtgtgtttgaatatggattcccaattttgaattaaattaaattttatttgtgtgataaaattagaataatcaatttaaattagaaattttatttttaaatttgtttgtcatttataaagcataatttatttctgcttttttaaggttttctcattaaattttttttttcttccaaagtatgtagaaggaagcaat

SEQ ID NO: 8912 - DNA, 2753 bp, Heterodera glycines
ctagagaaaaaagaaaaagaaataaaaaaggaatttaaagcttcttatttcaattatttccaaaaatgaacacaatgccaatgccaaattgtcataataatttgtcacatttcgttctctctccgcccctttttcacctgcgcaattcggccggctgcaaaagcacaagcgcattgccaaaggagaaaagcagcaccaaaagcgttgtgccggccgcactgctcagccggtgaagcaaacggcgaagcgcgagggaaacgtcgccgctaccataactggcggcaagagagttaccgtaccaaagggagtaggcaccgtaaccggtggcagtgccaaggaaaaggaccaatgggagaaggaaagtgaggccaaaggtccaattgaaaggcaacaaacaccttaaaataaaaaacaattaattcattaattaattggagagacgaaagaaattacggttctgcgaattccaatccgacgacaatttgaccctccaaaaggaagcacagaacgcacagcgcaaaaggaattactaaggcaattaagagcaattaaagtcatttggagatacggcgacagatcagttgccatgtgccgcccccccttagccccccgctaattgtcccttattccagccttaattactccctaatccttctcccctccttattccctttgcccattttcaccaattgaaattgcgagcgttgaaaagagtcgcgcgttgcgcgacggcactttcggctgctgttcgttctgacactgcgtcaactcgaggcagacaatgcgcgagtgaatgtgcgcattgagcagtgccaatgcggcggaagcggagagaagcgcaaattgaaaagtgaagaaaagcgcggcggaggaaggccaaagggaagggagcggaagagaaggcgcggaagagggggacaaaagcgaacggagcaaaaagggaacatggaaagcgtggagaagcaattgggcgaagagcaaagcgatcaatgccggatcagaacgcctgggcgagatgtaaaacgacgacggcaaaatgggagacaaaccgatggtaaaaggcggaaatgagcagcagaccgagcacaatgccaagcgaaaggagggcaccgaccaaaggggcgacggtgccaagccaaaagtcgagcaaagactgcgcacggaaaagcgactcctaaagggggtaaaggaaaagcattgggggaaatgggggggggggggagcggaccggaagcaaagcgaaaacggacggagagcggacggaagcggaacggaactcgcaaagcaccgcctgttggcccaggggacggagctcgcgcgaagtgacgcgaacgccagcaacagaccaagcgcgagctgaaggggagacggtgagaaaagggagggcaaaaatgggatgccaatcaattggaacgatcgatcaattggtgggaaaaggaccgatcgatcattggggaaaatgatcaatcaatgaatcgatggaaaaagagtgaacgatcggtgattaattcatgccgtttttggtgcaagcactaatcaataaaaaggtaattaagcatcaaaaactaataaattaagaatgaacttagcacaaaaatcgggaaaatgttcacgacaacgcactttgctgatcaaagaatgcgcatgtcatattttctccgtccacttctccgttggcttccgctcgtctccccacgctttgccgttgcgtctgttgccgtgcgctccgtttgtccgtcctcaatcccaccacaattcgcaatggcaccgcctcccccgtgccatcgtccgcccttttgccttccatctgccgctgatcacttccgtttttgtttttcattgcctccatttctcccttttgtgtccatttgatttccatcattagcaacggactgtgcccatttaattgcggcaaaagcgtcgaattgcgcatgcaaattgccctcgcaacggcgtgcccttcgggatttggagtgccgaaaaagggacggacaaaacatgggccaaattgtaagccatcctgcagggaaacgaaactaaaattagggaggaactgggaatcaattagacattttgttgctgttcgattggtaaatcgtcgccgttttgtgccggggacggcaaaatgtcccacgttcgcatttgaaaccccccggcggcactttgcaaagagaaaggcacctaaatggcatatgatcaattaaaaaataattaatcatttatcattacaggtagtcgacgagcgaattcccgagaatagtctaacaaatgggcgcccatttgcgttgcatttcccccggcaaaagcggacaaattacgagagaccaaagagtcgagcacctaaagaaaagccacactaaaataatgaaaactttcattagtagtccacctggacaacatgttcggcaattttggggtcgaaatgcgccgacggaacggagggatcgaaagcggggaaaaggagaagcgagtcgaggaagcgcagaacggactgaagaccggacaaagtctgttccgcacgttgggcgtagttggcgaggacgccgagatggacgagcacggaactctgaagcggaacaattgcatttaagaaccaaagtctgactcttcctacggttacgtaaccgtacggatgaccaattcagaaatgcaatgccaatttgcctttggcgcccacctgacttttgcagcggccttccgtcgcgccttctttcgcttctgccgccccttttgcgctttccccgccggtgttg

SEQ ID NO: 8913 - DNA, 1534 bp, Heterodera glycines
tgtaagccatcctgcagggaaacgaaaccaaaattagggaggaactgggatcaattagacattttgtgctgttcgattggtaaatcgtcgccgttttgtgccggggacggcaaaatgtcccacgttcgcatttgaaaccccccggcggcactttgcaaagagaaaggcacctaaatggcatatgatcaattaaaaaataattaatcatttatcattacaggtagtcgacgagcgaattcccgagaatagtctaacaaatgggcgcccatttgcgttgcatttcccccggccaaagcggacaaattacgagagaccaaagagtcgagcacctaaagaaaagccacactaaaataatgaaaactttcattagtagtccacctggacaacatgttcggcaattttggggtcgaaatgtgccgacggaacggagggatcgaaagcggggaaaaggagaagcgagtcgaggaagcgcagaacggactgaagaccggacaaagtctgttccgcacgttgggcgtagttggcgaggacgccgagatggacgagcacggaactctgaagcggaacaattgcatttaagaaccaaagtctgactcttcctacggttacgtaaccgtacggatgaccaactcagaaatgccaatttgcctttggcgcccacctgacttttgcagcggccttccgtcgcgccttctttcgcttctgccgccccttttgcgctttccccgccggtgttgtcgtcgtccgcccaccgcgtctcctcccgcgcctcctcccacccgcaccgtcgctccactcgctttccgtcctcgttgtacggacatgggaccgacgcggaccgattgaccgccgtcgtgggccaatcgacgccaccgtaggactcaaaggcacgccgagcggggcaatgttctggaaaagggagaaggcattggcacaatggcactatcggtgaatggactatttaatttggcagtgccaaaagcaacttcggcttacgatattgaaacaaatacagtaatctttaattctagtatattaatgggtgttcatttccaaccgatatgttcgcattgtgggcccgaaaagcccgcgtaacaaaggcaatgccgttgacccagcgaatcgcggtactgtaatgaggcacaattaattaccatgcccaaagcggtgccacttttgccccctttccaacctgttccatttggtgggtgtatgagtaatggcacatcggttgtcccgaattggcggcgcactgtcccaaacagtgaaaatctttggacaaaaggcaaaaattatagccggcggaaggcgatgagcgcgaaactgaccattctccaccacttggaaggcaatttcctctgaaggcgtttctccgtcgccgtccatcacggatactgtagcagtcagtacggtactcaacgggagacgaacctcaaagtttgaatgcaccaattagcgtcaaatgtcattgcgccatgataacgccaacaaaaagactcactcgactcattgtgctggtttctgtcggctccat

SEQ ID NO: 8914 - DNA, 1473 bp, Heterodera glycines
  misc_feature (54)..(54): n is a, c, g, or t
  misc_feature (108)..(108): n is a, c, g, or t
  misc_feature (1440)..(1440): n is a, c, g, or t
aaaaagtaaatttaaaaataaaaagaggaaataaaaaataattaaaaaagaganataggcgaccttattttgaggacaaagcaagtgaaggacggcaaactgagcagnccgcgaattgttgggcggaagttcagcgaccgtttcgaagaccaaacggacggggtcaaaatcgagcctagggaaagcaaagcaaagcaaataaagcaaagaaaaagtggaaaattaaaattaaatgaattaaataaaattaaataaataataaaattattttaattggtccgtctccccaccgaccagtccaagtcggactccaactgcgcaaagcaggaactctgctcccgaagagcgcggtcaaacgcttcgttcggtgtcccttttgtgcccggaggggcgccttcgaagacgcgcaattcgaaaagctctgaaaagaattgaagaaatttaaagttattcaaataattatcccttaattgcccctcttcaccggcactttccaataaattattatttatttgtttttaggtatttgcatttccccccccccctttttcccattcttccaaaattaatttcccatcagaagtgtgtcgaccctcgacgatgccataaaatcgtaaaatttgccacggaatgatgggaagccgtaaaattatgcacctcagtgcccaaatcgagcagaaatttattagactaattggtgaatgggttttgatgagatttgcaaaaaaactcaaatgaggcgaatgttctttttctgtcgaccttctttaactttttcccgatcattcaactttctcgattcgccgcaattaacagccgtataatttgataattaattaattaattaattaattttatttacctccgccgtttctccgatgtatcctttttttctgctgctgagattggagcccaaaaatgcagacaaaaagcaaaagtgccaaaatgtcacaaatggaaacacaaaaagaggacatttgggacggactaagcgaagggacaaaaaacggacgaaagcgacgcaatttttggaccgatttcgcctcgagggaagcgacgaatgttccccaaaggcatttaataattaaatatttttgacctgaatgataaaaatttaaaaaacgaaaatttgtcaatgaaataaaaaatggaagagaagggaggggaagtgaagaaagaagaggagaagaatggaggaaggggaaggaaaagagagaagagaggaactgaagggaagagaagagaaaggaagagaagggagggaagagaggaagtgaaaataaaagaagagggggaaaagaagaaaagaaaagggataaaaagtgcagagaatggatggagaggggaagggaagaaaagagaagtgacgggaagagaggggatgggaggagaagagaggaagggaaagaaagaggagaaccaggaagagaggaagtgaanaataaagaagagggggaaaagaagaaagaaaag

SEQ ID NO: 8915 - DNA, 1194 bp, Heterodera glycines
  misc_feature (32)..(32): n is a, c, g, or t
cgaaaggaaagaatgggatcgaatcgcagtcnagccgaatccgggcagaatcactttgaggtgcgccgacttttacttgaataaaacaaactttggagtgagcgcaaaggcacattcatttgagagtgaactttgaaattgtgaaaatcattggcatttttggatctttttttgaacataaaaggtaagcatagaatggtttattaatcaaaatttaattttaaaagtattttaatgtaaggcaatcggaaaagacgcgcggcgaataaattgtaaatttgggagggggggggggaagagaacggcacggcacaacacaaaagtccattcaccgacagtccctttaatgggggagggcactttgaaagggcccttcggcacatttccgcctcggggtcaaaagacagtcaaaacgaagcgaaaacagcggaagtctttcgccggtccatcgaaagggccaaaagctcttttcccaacagaggaagcaaaaacggacaggttcagcagagcaaaatgggagacggagaaaaacataggcattaaaaatttattgaactcgtcctctccacgggccatccgttggcacaattggaaaaacgcgccaaatggcgagaaaatggccgaattattccgtgggggtgcactgaatttgaatgggaaaggcattggcattttgtaaaaaaaaaacggcgccaaagggcacaaattgaatttggcgagggatcatcaacgaaccattcattcattcactttttgcctcaggattaaggccaatggcactgtaactgttgaagatggaaatcccaacgcttcgaaatgccaaagggaaggacggaaaccccggggaaagaaaggaaaaagtaataaaccccgagggggggggggaattctttttgaggggattaagcgaatgaccaaccacttcttctccccaccgcacttcatcattccccatttgcccatttcctccactcattcactcatcggccaacactttggcccaattttgcggcaaaaaacaaagtgcgggaattgtgcccggggcaatctgaggaggacaaatttgggcaattagtcgcatttggaaaaggaaaagcgcacgcggatgagaaagggaagggaatgaacggaggaaaaaaggggtaaaaaaagcaaaaggcattccgagtgagaagagaattcggcggggggggg

SEQ ID NO: 8916 - DNA, 6692 bp, Heterodera glycines
  misc_feature (79)..(80): n is a, c, g, or t
  misc_feature (5466)..(5466): n is a, c, g, or t
aaaaacccgtgaaattcacggttttcgtgaccatgaccgtgattttttttgaaattttggctaaatttttaactgattnntgtttaaaaatgaccaactaaaatctagataaaattattaacatttgtcacagggtttccatttgttttgatttatcagaaatgttctggtttgaatgtattgattgtcaaaatttggttctgattcgttaaacaactcataattttgaaatatttaaagcctttacataaacctcaaatttagcaagacatttcatttcaaaaccgatacttttcatgacgtatttctcacaattaaaatgtgggattctgccgagcgcaaattttaaattgtctataaatcagtgtagcgttaattcttagttcattaaacgataattacttttcgtgtgtcatgaaaagaaatgcggcagttgtcctgcgcaatttgtcaagaatttttgatttaaaaaattatttagctcaatattgtctttaattatggccaatttgagcaactccggcaatgatacggtaattatgtggtaaaaatttttatcacatccaaatttgcagttttatttggccttcaaagatgtccatcccagctggtctctgattggatgcgcactgacttatggaaccattgcattaattggcaccatcttcaatttttctgtgatttttgtcaccatcaaaacaaagtatgagatgattttatttgttcgaaattataattttttataatatttaaattttttggtcactcaatggcacagccaattacctcgtggcactttgctctttttatgaattgattcaacaatttggcatttttctgtttgtgtacaccatattttctggccaaaacttcattaaatgtcgcctggcagcaaaaatattattcattccattgattgcacttggtaattaaaattccctcataaaataaataaataaataaatatctcttcaaaattttaattttagctgcaattgttccgacgatgtttttcactggcgttgaccgactgattggaattgttttttcggaattgtatgaacattaattatttgtgtcgttaattacagtaattttcagtcacgataaccttaaaaagagactgtatttggcactgttaactgtcatttctctgtcctatggtttctgtttctctattccggtgtaccaaaaggcaattgaggatggtgatcagatgaccaccggatcatattttgattttataaaggtttgattttgttttttatattttaaaaattatatatttttagagtgtttcacttataatcacaataactttttggcttataacaatgacttgcatcatttatatttgtcttggaattgtggtctgtatcaaagcttccggtaaacaaatatatttttaagtaacatagggctactgtaatatttcttgatttaaactgaattctaacgccattcaatcaattttattaaaaaacgggaggcaacgcccggagattgggatatatattttttagaaatcacaattgaaaatgttggtatgcattgccagttaatttgcttaattatctatctttttaataggtttgccgtccgctgattcgatcaatcgtcgcacttttcgcgcactttttttcattatcactgtgaatgtcggcggttattggttcactactattgtgttcttgcttttacttcccataatttcttctccaatcacacattggttttgccatgtaattatctcaattcctttgaacattggcgcagcgtcaatcggaccaattttatattttacaaggtctaaaatttattttaaaaatatttaacatttatttgcaattttagtacggattatcggcaggcattccaagcggaatttccattcgttttcagacgaatttcaaatgtaactcaagttattccactgcagaatacacaatcatgagaatttctttgaaaaattaaatgaaatttaaatcttactgatattaatagccactttttaaaagtttgaaatgacatcagtttgtctaattgttgtcaataagtattaaaattacaactaattaatgaatttacatataactcttttgttgaaattatgaaaatttcactgaaaaatttttaaataatttttctttgtccatcattaatttatagataaaaggtaaatttataaattcgaaaataaaggaattaccgataaattttttaaatcctaaataaataaatttaacatttaatgaaaaccttgctaagaaaaagaaaatgttgttaaaataaaaagtgttgccaagcatttactgacggacggaacaatttatcgcaggcattttattattgacaaaatgtggcacgataattgccttaatgaactaagaattattgcttacaataattgtttgaacaatttaaaatatgcgctcgaaagattcccgcattttaattgtctgaattcgtcccgaaaaatacacttacgtaaagggctttaaaataacttttgacaaattgattagggtttttactttttaatttaagtttttgtttttgtgagttccaagaaaattaattaattgaataaaaattccttcattatatttttgattaacttcttggtcaaatcatttgcattgggaattagtatgtaattaaggaaaatttagatttattccggattaacctgaaaatcaattaatctttagcttttttaccatacaaattctatatgaccaacaaattaaaattaattaattgtgaaataaatttgggtttttatcatcaaaaaaaaagcagcagaaaaatggtattttttcataaattggaatatattttcgaaacgtcaaataccttctgagtaaaatttagattttttttttgtaaattttcatttttgaattttaaaggccccggtaagaatgtatttgcaattcaacaaaacccgttcatgccaatgcttcgtcaatttcttctataacaaaaatgccaaatgtgaaccctttggcacaaaattcccaaaatcaaccagcagggtaattaaaaaaagaatctttttttttaatattaaattcattaacaatccattaattaggcaagagcagagtttcgatctcaaaattttgaaaatcctcatttcagccataaaaatcctcatttgccactaaaatacctcaaaaaaatcctaagggaagaaataatgataataaaaattttaacaaaaattggtgcaaatcttttttttgaagtcattatttaaaataacaaatattttatattgataataactagggtttccttttttaggcacaaaaaatcgcgaaataggcattaaataggcacaaaaatcctcaaataggcgctaaaataggcatataaaattttttattaacgctttttaggtaacaaaacactttaaatcttaaatatttcaattgaaattattaaatattttaatgtttttttcgaatatgaacaaatttttaaacccaaaaaatttttattaagaaaaaaatattaagttttgggaccaatttttgaaaattttttcaattcttatggggtgtattttctggaaaaattttttgggtcatttcttagggggtgtatttttcgtttttattgcatttttgttaaggattttttcgaaaatcctaaaataggcacattaggcacaaaaaccacgaaataggcaaaaataggcattataagagtcatcttagacacctcaaaccaagcggaaaacgcgctttttgtgcttatctttgcgtatcaagtgcgcaaaattttaggcatttgcctaaaaatggaagccctaagaattacaaaaattcaaatttagtttaaattttaaaaaaaataataatatttaaaagttgaaaatatatttattttttaaatttaaattttgaaaatcctaagaaaaaactttgtatttttttcgtcattagaaaatagtgtacagactgcattcttttcttaagcaacccctaaaactgatcagaaccgggcatatgcagcagcagggatatgtgcgtacgctctcaaaaatcggcaccgaaatccgaggccgaaaatttttttttgaaaatcggaattccaacggctcaaaaaacctcggcaattgacaatcggaatttcgacggctcaaacaatctcgacaatcggaatccgagtgcccaaaaaatttttgaaatcagcggaaaatcggcattccgacatatccccgactgactggtctgtattgctctgattatttgtgtgatggctgagcttacatttctgtcgttgtccgtgtgccaacgcattttggccaccgccgtggcgaacagtgccgtgatcggtccgaacagtgcgcagccaatagtctgcgcgccaaagtgtgctgcgagcgcaaatgcgctgatcagcagggtgcgaacaaagtgtgcggaggacgcgtcggcacgcggaaacgcgcggaggaggagaccaacgaggatgccaaagatggagccgatcagcagctcggcaggcagccgggtcagcgtgtagatgagtgcatctgtttcggaagattgttttatttggagcagagtgaatcagcggaaaaatggtggtgatcaaacagactcaacagacataggaactgatcagcaataaataaaatgatcaacataatacatgaaaatgcaaaactgatcagttcgttcaatgccaacaattgaaaattaagagagtttttagttttaaaatcccatcatgatttgttttattaaataaaactatggaaaactttttttacaattttccatgagtgagaatgactgatcgatcgattaattaattatggatctgaaatgattaaatagttttttttaaaattgaatcagatccaaaattccaattaacactggatattcgtcattaaccgggtcaggattttaggttttactaaatttttgaagagtataatttattagaaaagtttggggttcgaaatttatcgaaatggatgttatattcgtgatcagcgaccctgaaaaccttctaaaacattttttttctttaaaattaaaattttttttcaaaaaatggaggacaaggcttataaccaaaataccgattttctaagaccacctgcgcggggtgacaggacgccaaaagtggtcaaaaagccggtcagtgcaacgatgttgtcaaatgatgtgctgatttgtggatggattactggtgatcagagtgagtttaagggctgaatttgtgagaccagccgagggcatttttggtgccggacatttaaagtgccgtaattttgtttttatggtttgaccaagctttaggagctttttgtattactcaaaggcttttcacgcgcaaaaaaatgctaaaaaaaagaaaaaaaaaatcgaaaaaatcatgaaaaatagagaaatatttgaaaaataattttttcatttggtatgacaaccccatgagcttaanaatttttcgacatttattttggtcatgaattttgggtgcgcgaaaagccacctggtcaatataatgctgtccagccccgaatcggtgccccgttgttctttgcgaagacgaagaatgatcgggctgatcacggccagggacgaagcgcacaaagcaaacctttgggatcatagatcagtgttaattggtcataaatcttggcagattaagcactaagggctcagtttatggtagaaacttgaaagagtacagtagtaataataccgtaatggctaaaaacaaacccaaaaaggattgaagcaccaagtgggagatggaacaggaaatgcgaggccaacacaatgatcaaacactcaaacagagggcacacaaagccaatgccaaagcacagagtcttgggggggggggcaaaaaacaaattatttgcgcaattaaatcaatattttgaataaattataaataattaattaaccaaaattacccaattaaaaaatggtatttaaaaaatttttcaactaagctaattgaaaaagccttaattttaattatttaatctttttatccaatcaataaagcaattttataaaattttgaatattaaaaatttcaaaaaaaaaaatcggaattaagccccattttttgagagaaaggacctattaagataattgaatatttccaaacttggtgaaatttaaatttggatattaaaattcaaaatccaacataaaattgccggacagtggactgatcaatgccaaacgctgatcggatgatgatcaacagaaaagcgatctcgtagatcagtgttgacagttgataatgcgggaaatagtggaacagtgaacggaatgagaccaaatttgtgaagagaatgccgatcagtattggtcctaaaatgggttttgtgaaattgtgccaaaattggaagaaatgccacacctgtgatgaagggaatgaagaaataggagagaagacggccaagcagcagtgagagagacagaaggatgaacagagaaatgagggatgaagagacaacagggcgggaaagatggtgatcctgatcaggcaccgatcgatggtcgtgatcagccattggttgttgctggtgatcagacaatggtcgatgattttgatcaggggaaaagtctgataggtgatcctgatcaggcactggtcggtgattaagatcatgcgaaaaatctgatggataatcttgatctgcagcg

SEQ ID NO: 8917 - DNA, 1250 bp, Heterodera glycines
aatgggggagaaatggcactgaaattaattaatgcgcttaaatgcattggaggattaaaaaatattgcctgcgtaatgcaaagaattgccttttgcttttaaatccataaatcaatgttattttaatattaaaataatttctatggcttgaataataatatttcatgcatatttactttaatgtattgcaggcgacgcatatgcgtgcgtgcgtatgtcaaagcgtatcaatcaaaaaaaaaagaattattatttttttagatgtttaaaaatggagactgatgatggacggtagcgcttggcaagatgaatgagtgcgtgagagatacttgataaaaattactagagcccggatgggtcggttatcccacatgtgcgccccggacattgcgccccggacattgcgccccggacattgcgccccagatatttgcgcctatgtccaaaatcgggtttaaacttacattcttcaatccaagatggactaaagagctttgaataagcgattgaaagtgattgtatgcgataatttgatcatcaacaagtttttgaaaaaaataatctttgaaacaacagaattattgttcctaataaaccaaaagaacaacttttcttaaatttatgctgtaagatctctaagactgaaaaaatgtatttgaacccgatttagtgcatgggcgcaaatgtctggacatggatgggcccgggcgcccgacagcaggctttgccatgccgggccggccgggccccggtcaatttagaaaaaacaccgggcccggtaaaacgaaatctttttggccggttttgagcggactaaacgggcttcgccagtgactgtcacaaattttaaaatatacaaagcttgaatggaaggtagaatttaaatgatttttgattatttgtacaatttcaattgcttaatttttttaatttttcccgccggtgcctatcggctttaaagtgaatttttgcctttcccagcctgtcaaaaattttgtgagtaatttttttaattaattcgaactaatgatcatttttttacaccaatgaattccgagccctattaacatataattattcataacgtttatctcttcctgtctctctctttaacggtttctctttccgtccctctctcacccttcctttctctcacttctttctttcttttttttctctcttttctcctccctcctacactctctctctctctctcacacactcactctacgtaatctttatttcattct

SEQ ID NO: 8918 - DNA, 4168 bp, Heterodera glycines
aggggaccagagcgtttgggcccccctttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaaatcaatttcacattattttggagtttctccggggaatttctcgcaactatcgaatgaacccgtgaatttctgttaatttttacattttttattgttaaaattattgttgaatttatttttaaaatgtttattttacatttttatgctgaaatttaaaaagttgtttttactgtgatttttcatttttctgtacttggggcccaaacgaccctggggccaaaaacgagggcccaaaaacgggggcccaaacgcccccgactcgggattgagatccaaaagcaaattcccgcgcgagctctcgtcccgccgtgctgctttttacactttaaaatattgtttcctaaaatttagcataaaaatttaatttgaaatgttggatccggagtacgttaaatctcaaatcaaaaaattgggcggtgcttctccagtttttgaacagcaaacaaagaagcggaagcgttcagcaagctccgcttgtatgtaaatattcgtaaaatggaaaaaaccaaattttaaatggacatttaaacattttttttttgtgatttgggttcaaatgaaccacaattaacagtaagaagcaattttctttaaccaaaccttaaaaaattcacattaaattcctatttttgagattaacaaaaaaaatttgtcgaaaaaaagaaaaaaaaattcggcctcataaccttggcccatttttagcttccattgcaacaatctcccattctgtgagcagtgccaaccatcgcaattcgacgggtgccgccaaaaaacagtcgacgatggacaaatggctggtgccgaaaagcaaattggttgccgcggcggcggcgttcacaaaacggagcattggcggcgttggaggccaaggcattggcggtggctgcggtgcaaatgcaaagctaacaaaaagtgccatcgatgccagcggaattggcacggaaatcggcgccgttgatgaggcacaaatggtgaattttcaaggcatttttgtaaaaaaaaatttttctttttacacactatcccataattgtcattttttacattttcggtctttgggttaaccgctttttcgtacttatttataaaagcatccttaattaaaaaagttggtgttttcatcatgaaaaaattaaaaaaaaaatcaatgtttcccctaaaaattaagtggagtgggttatcaatacgaaaaaaccaaaaatttttaatgaaattctagttttcatttaaaacactggcccttccatttcgttaaatttttgagtcatgtaagtcgtgaaaacgaatttcaatggcatgtcatttgtcattgtatagaaagcagcacgaattgctttcccgggacggaacctttgcagaccgacaaaaacattaaaaatggtgaaaatttttcagaaaaaacgagtcagaaagtcgcccagaatttcaccggcgacaattgatcaaaaggtggagacaaaacggcgcaatgtgaagccaatcggaaaagtgacttggctggaccaggtcaaacaaaaaatttcaagatttttttttaaaatttcgttttacaaaaaaaaattgtagttttttttttttttaaatttttcagccttcaacaagtcatgaggacagcagccacagtttgatgccaagttcgagtgccaaatttccatcgaaatcggatgtccaatgggtgccaaattcgtccggtcaaaacatgccgaattcggatgtccaacttgtgcctgattcggatgtccaatttgtgccgaaatcggatggccagcaagtcgtgccgccaaccacgggtggagaacaaccaatgggcacggcgacttctgccgttgcattgctgttgaacgaggcgcccgagccgagcacgtcgaaagcgcgtcgcgaccgactcctccgcgaagtgtttggccaccggaagttccgcagcagtatgcaaatgcaggcaatcaacgcggtgatcggaagtgcgttatatacacaccccatcaagggcctgtgattagaaaaattagaggggaaacccgaaatcgaaaacttttttttttttgctttcccccaattttaggagtaattgcggaaaaatattaattcgcttttaatttttgtgcattttgggtcaaatagaaatatttaagcaatttagcggataatttagttggtaagttttctaagtttgtctgatttgtttaataaaaaagccgataaaaatttccaaaaaaaatttttatttagtttttttaaaactttctctcaaaaataaaaataaaattttttttcaattttcatgccttgcccataaccaacgaggtcgggtggggtgaagaaataatcgaatttgacccaaaaatcttcaaaaattggcacatttttaggcctaaatcttccaatacattgcctgataaaatgccatttccaatttaatccccgactttttgcaaaattccgtgccctctctctcatccatttccattttttctcctcccattcttcagagaccgtcgacgtgttcgtctccttccccaccggggcgggcaagtccctgtgctaccaattgcccgcctgcttccattccggcctcaccattgtgttctccccactgctcgcgctcatccaggaccagctgagcgcgctgcgcgcgcgcggtgtgccgtgcgcgtcgctgaactccacgctgggcacggagcggcgcgcggaaatcatccgggcacgcgcatttttcctctttattttccaccattttttggatgcaaaattgtaaaaaaaaaatcatattttctccgcaaaacaattccgatttccaaaaaatcggatttccgatttccaaaaaatttttaaccctcggatttcccgaaatttttaacttttgccatcaatttgaggacctcgaaagcgacgcgccgcgcattcgcattctctacctgacccccgagtccgccgcgttggacaccattcgttcgctgatcggccgtcttcgcagccgtggacagatcaactatttcgtcgtggtccgtactggttgaccaattaacataatttttcttgccgcctttattttccaaattgcccccacaaatgaccacttatgggaaaacccaaaaaaatgaaaactcccgtaaaaatgctctcctcttctcggggcgggagcagttcgtttcaccttctccgaaagcacgaaaattttttagttttctaaatttcttacaaggaaacatcccgactgtgagtgtttttaaatatcactttaaaacaacttttatcgtgtaggagggtgttgtgtccctgggtttacctaagtcttaaagccatttcaaattatcattttaagagagagggatttattgaaggaagagcattgacaaataattatatgttaaaaaccgggaatagtttcggtcaacaacaacctcagaacattttgggtgggtcaatgcaattggttatttgggaaagaattgccaaaggcaaggaacggcactgactgacccaccgcagacactcgcagcccccgaggcgggaaattgagtggacttatatactggcacaatggggatggactttggataggatgagggatatgacggcaaaaacacaaaggaaatgaaagagaaatggatggcaaatgcaacagcggtgaatgggagaaatggcacgataacattggaaatgagagggataggattggcttgggatgggatgggatgcacagacggacaagtttataacgggattgggtttgggaaagtaggataatttacattatgcacaaaatatgaaattttgaatgctgcggatacagca

SEQ ID NO: 8919 - DNA, 232 bp, Heterodera glycines
ccccccccccccccccccccgaaaaaatttttcataaaaaaattcttagaaatttttagtaagaaaatttcttgaaaaaaaaaattttagaaaattttccagcgattttttcgaaaattttttttaaaaacttggtagttcatcataaaattttgaaaaaatcgctgaagaattttccaaaattttttttgaagaaatttttttactaacaaattccctaaaaattttttta

SEQ ID NO: 8920 - DNA, 4807 bp, Heterodera glycines
agagaaaacatcttcaaggatctttttaacatccacccccaccgggcgctttcagaagaacctaaagacaaagtttaccccttgttttttccttaatttttcagcaatttagaagccttgtctcaaatttgataacgaacaacaacagataaagacggaatattctctccgtatttacccattgttcactgttcctttgcttataaccgaaggtgccgacgcgggcattccgcaaatttgtgacgaaattattgcacatgtcagtgccgaattacagcagcgtcttaacagtgggattagcgaatgggacggcgaagagcgaatggttgcgaaagctgcagaagaccttgttcaggtcgtttttaggcaatcttgaagaatgggttattttttactagtaattcgacgtatttatttcgagccttatacttcatcgattgtgactgttttctaccggaaaaacatgtttccgccggatccttacttttagaattttttgggtcctcatctggttcttaataattttctaaaaaccccatatttaaataaagtccaaaaacgcagacggaattagtgagaggattaactttttataattttttagctcttgtatgacggtccgccaatttcatattcggaatgggaatgcgcacagtgtgggctaaaggagaatctttggcttaaccttaccgatggtgcaataatgtgcggtcgcttttctcaattagctggcatcaaaggcaacggacacgcgaaggcacactttgagtcgacgggctttccattggtcgtcaaattggggaccattgagaacggagacggcgatatttacagctacaatgaggacgtatgatttgcagcattaacatgtttataataccatattagatgaatccgtaactaatttcaattaggggtttagttttaaaccggcctaagaatggacacactttaaattgatttgtgttttattttagtaaaaacggtgtatcggtacaaagcaggcgaagaacaattccttttgttgtgaatttttcgaatttaggcgccggtctgcgacccatggcttggtcaacatctggcacgttttggtctcgacatcaaaaaattccgcaagaccgaaaaaacgactttggaaatagaacttgatgcgaatttaaagtagacatttcgaaatgttctgttttcattccgttattaggcacgaattctcggcaattcaagaagaaggattggagttggtcaatgtgagtgggcctggctacactgggctgatcaacctcggctcttcttgttacatcaattcggtgcattctttttccctttttttgcctgaatgttccttttgaggctctccaagttctgcttattgtccctgactttgtccgtgcgtttactgaagaactgttgctaagaaaacaaccacccgaaataaatgaggatttcgccgctcaattggctaaaattttcgtcgcgatgaaatcgggggattattcgcgagaagacaacaaacatggtgccgaaaaggagaagggcattcgaccgacgacattccgtcggattgtgggccgaaaccaccccgaattttcaactgcaaaacagcaagatgtggaggtgggcaatcattggaagtgccaatggacaaatgtcgttttccacaggaatatgttcgctttctgtttgagaaggtcgacgcgtgctccgacctctcctcggaaaatcccgtcgctgcgttccgatttcgtctggtcactcgtttcctggacgaactttcagattgcgttcgctattctttccgtactgacaacattttatcggttgcaattccaatggacttgtgcaaggaggtgaacattaattcgttatattcatttgagaaccaaaaccttacgttttgtcattcctttttattttcaaatcggcaaaatttgtcctcgtcgtttagtttaacgaatgttaattatgttaatttagtctgacactgttgtgaatggggtcagacgaaagagtgtcactttggagcagtgtttggccgccacatttgaagaggaaatcatcgacgattatttctcacctgttttgaaaatgaaaggccgagcgaaacaacaacaacggatgggcagtttccccgactttttgcttttgcaacttcgcgtgagtaggcattccagggacgagcagcattgttttccagatttaaatttaaaaaaacttaaaattttctaatttataattagatgttttcctgttaaaaagggattttttcaaaagaatttgatttttattttttatatttgtaaaaaataattttaaaatccacgtctttcaataaccattttttgtagatttttcttcatgaaaaatcctctaattgtaagagttagaaaaataaaaaatttatatttgttttttaatttactggtgcggaaacgaattgcttaaacatgtgttaattgtttttaattttttagagattcgcatttgattggattctcggtacgcagcataaattggacgtggacgtgcatgtttcggacgaattggacattaacgcgttcttttcaactggagaattacagccgaacgaaaaggcacaattagaaaaaccatggaaattaaaataaagattaaaattgctttgttctaacagagtttgcctgttgacgacacttcagccgtcataaaggagcgcttatggcaagagccgaaccatgaaattgtggccaaggcaagcagtgattattacttttgtaattttgataatttataatcagttgctttcgatgggtttcactgaaaacgcagctaaaaaagcggcgcttttcacaaagaacgaatcagcggaatcggccattaattggattcttcaggtgcctctttgccccccccccctaacattccttaacaataaaatacgaaaaggcacgaaatgctgctttttgaaaaaatttaaagcatgagaatttcacccgaatgtttatgaatgatttatttttagcattctgacgacactgatgtaaacgatccgcatccgatgttaacgaaacaaagcactccgccactgacatccaaccaaggtaaacagacaagaggaacacatggacaaattaaatctaacaaataaggagtactcaattaatggtctaattgcatttttaggccagaacgcgtctcagaaagttcgtcacggcaaaggtcattaccgactgcgcgccttcatttcgcacattgggtcgacgccaaattctggccattatgtcgcacacgtaaaggcagacaatggccagtggtgagttcgcagagttcggtctggactttggtccaggctatacattaaacaaggggggggggttcaaccaaaattttggcgaacgggtccggcggctctgtaaatcgacgacccattttttgctttcgaaccgctttattagtgcctaaaaattaggttttttgcgattacgaattaattttttaacgaaatagggattttttgggggccggttggttgcaattcctaaattttctatcggttacttgataatattctttgacaggcacatttttaatgacgaaaaagtggccaaatctcaacatcctccgaagactcttggctatctttacctgttccaacgggccacctgaacagtcaaataaatgctcttttgatatgcttttttgttgttattgaattttatttggcatcgttttattgactcaatttttgttttaattggacttgttttctcaaaatgttaaaaaaggtgtgacaaatattgtttttttaaataatctggaaaataaattcgttgtagatttgtttatttattgtttgctttgtctaatttaattaaaaaagcactctcagatgggcattgtcactttggtcctccgtttacccctccggcggtgtttccttttgattcttccgttggcctttttgtcctgcctttttctgttcttcgtcatttcccctatcagtatcagaattattcatcagaaaggtgatttccttttgcctttacaaatgtgtttggtattaaaatgccaataatcactaaaaatgccaattgttacggtgtttttcccgtccgtttctttcgctacgaccgtttgggtccgttcggcaatttcacaaacgtcgcattgcgacagcgcgtcggatgcgtcgacccttccaatggtacctttggcgtttgtctgtccatttgttgtttttgtttgaaggtgttccgatgagtgtccaatgggacaaagttccctatttctatcccatccaaataatccaatttgggctgggacaatacaatttggacagaaaaggtaagacggaaatgtggacaaaaggaaatgaccaacggaaaaaaaggggcggaagtgattgtccgaccattggccaacagagcgacaaatgccatgggcacggaaaatgccaacggaacgatggcattgggcgacggcgcgacaggtgacagaagggaaaggcgaaaaggggcaggcaaacgtaaactgacagaatgaagtgaagaatcgtgtaccccccatccgaaaattaaattattacggcctctttttcggttcgaccgcccctccccccccccccctttcacttttcattttgttcgtttgaaagtccgtgtcaaactattccgtcgactgccacttttgcttttttctttgaaaacgcatcgaatggacagcgaatttgtgttggaattggaaaaacgccggagggaaggcggaacgatggaaatggcactgttttttaagcattcggaagcaaagggatgcgtgtggagtgatgagagca

SEQ ID NO: 8921 - DNA, 842 bp, Heterodera glycines
atttatgtgacaaaaggcgttgaaaaatgttatgtgcccgaaaaaacggactcaaaataaatgcggcgacacaaagggaattgtgcggaaatcaaacgaacggtaaaaagcatttgaattgaggaaactgctgaaaatggggggaatcctgcagatttagcgaccgacgaaggctttcttccgaaatcgctgctcttcaaaggcccttgtcagcttcggctgcactctctccgacaacaaaacagcgcccaccccgaactgttccaaaaagtggccgattggcttctttcgacgcaggacgaaaaagggggatggtagtcaaaacacaatgagccaatttgaaccgcggttaaggccagtgcccgtgaggagggtaattgccgagggaagacaccgactcgtgttgaacttcggctggcaaagtgccatggcacagggtcagcaaccaattcgaacagaaagaaaatccatgcattttcaggcctagccctctcttttctgactcgcgcttacgccatggcaaaaaatggagagaaagagcgctttttgctgtccgctcaaaaagcgatggggccgttcgaattggtcggccgatgaatggttcccttctctgtgcattccctttaagccttcggaaaagggcggagtgctgagcaccgtttgcgatttgccctggttcgaagagtatccgacgcttccggggacagggtaaaaccgaacggaacggacacttcccacaaatgacccttgatagagtgctcaacgggtttatgtacgcccttttcggcctcttcgacttcgctaaggtagtaaaaagtcccgggcatgtttgtccgcggtct

SEQ ID NO: 8922 - DNA, 2489 bp, Heterodera glycines
ttttcatcttcgatttttatcgacgcaaaacacatgaaaaattcgtttattattggaggactacgccctaagaggagctatgcaaccaatccgatcttcgcgacgatccgtttgttgaatgagattacaatcgaattccacccccccccccctcccgcctttgtccgcttactattccattcaaataaagaattgtaacgcaatcttttacatgaatttcataaaagaaatatacggtgaaaacatcaaaaaatatagatgggcatcatatgagtcacaaagtcagctcaatcagtactgaatgaatggagcaccactgccggtcggaatgcgctgcagaaagttcggtggctcatacattgggttatactaacaaataagaatgatcgaattggtttagaagataaaatcattagaaaacaactcacaacggcctgctgctgttttggattacgacggtatgattgttgaggttttccacgaaattgagaatgcgtaccacgggaaggctgttgaacgatgacgtattgggtagaggcaggctgccggcgctgacggcggggagaaaatttctgaagagaaaatatttggttacctacatctctacaaactcgtaccataaattgaggtcctgcttgcacgggttggtcaagaatgaattgttgtttgcctcgactgcgatttggcataacgggggtagtgatggcctgccgccctcgaaactgctgacgaatcggtagctgctggttaacaaactgagtctggagttgttgcacagtagtcgcacgacgcaatgcattgacgtgttgacgaacactcatcgatgaaaaggacggaaaacggcgtttcggtgattgattctgtacaagtaggacaggctgctgttgttgcataggattgatgcggaaacgtcgcttcggaaccctaaacaaactgattaaatttactcagttttatattactttttcacatgaaccccttttcttacattttcatcgtctgaggaactaacgcagcatcggacgcataacgaattggaccacgcccacggacaactcgttgaacaaaaacgggctgctgttgcggttgtacggcaacaattcgctggcgttgacgagtgatcacccgagaacggggactgactttgttgagcataattgtgcggacacgacgggcagaattagcgataaaacgctggaatgaaaataagataaaataataggaaaaacgaacaaaccatgccacggggcgaaacattcgatttgttaagagctttctgagaaattggatgttgttgatttttttaacacaaaattgctctcttcccataccataccttgacgagtttattcactaaattctttgtagcggaaattacggctctgttcttcgcagcgaaattttttctcatgacaacaacacggttagactttctcaaagggcgaccacggcgaacattaattccaacgcgtttaagtccaaacttcttccaaataaaatttaagtaatgaatgacaggagggttaaaaacaaaccttggtctgattctgcccattgatttgctttcggatgaatggctttcccttcgcaatattgccgcgaatcaatcgctttccagtcatttgagtctttcgcccattaattgaagcctggttggtcttgctcttatttgctttgatgatctcgtcttaaatgtgacattttgtaagatacttaaaagaaaaattacccaagctcatttccaacttgcaagcagtggccattatgtcctaaaatgcgatgaaacatgaccacgattcgagcatgtgcgctagagccattatttgacgcgtattgcgtttccgctcgccagtaagtggcaagcatttggaatgtttctgctctgggtcttcgcagttttgaaagccattttgttgttgtcacattcaccaactggctttgcgacataattagccgcacgagatcagaacctcccgcccgagcgacttttaaacataaatcctgaaaatcgaccgcctccccattttggcaggattctgtcaaacattaaggttaaaagaaaactatgggtaaacattcaaacggatgaattgaagacaaatgaatgtgaaaccaaaacaccaaacaaaggattatctaacgacccaaacgcttactgaacaaaaaaaaattgatttttcaattagaaacttaaattagaaaacatcggtgacttaccctttttgtgtcaattttgtcgatgaagacaacagaataaagaatattgtcgcaagtattttatccaaatatgttttaaaataagtttttgttaccgctaatagctttcgaaatcacacataacaaaggtttaatcgattcacttgaaaagagagagaaatggcagtggttaatgaaggaaatgggaatgcaatggaagattgggaactaaaggggtgctgcctgcctgacaaaatgagaagatagaagaaaattagggcggtattagaaag

SEQ ID NO: 8923 - DNA, 891 bp, Heterodera glycines
  misc_feature (881)..(881): n is a, c, g, or t
tcccgttgatcaagagggaagtcgatctgctgataaagaatctgctcaaggccgactgattgaagctttacaggcgattctcgcataaattatttatattttcttctttcctgtccttccttttggcatctgtgaagaactgtccttttaccccattaaaagcttaggcccatttttggcacatgaaattactaagtcacggaaaccaaatcaaaaattggcaaaagtttgttgttctcttactatcgtgtctaaatctgaaactccatgtaaattttcttttatacattcactctctttttctgactgatcatcgtttatttcattttttgtttgaatgatcatcttttctctccgtgaactattggataaaggaagttgttgatttgttgagaaatttcattcgtgtaacgattaaatattcgctttcgttaggtttcgtctcatataatttcttttgaatgcccaatggatgttgagtgccatgctccgacaccctctacttcggcctcaaatttgaatgaacccgaaatactagccaatttggcagcttttgaatccaattttgtttccgtaagtttgtccaatttaaacatgcgttatttgtgatttccttgaatataattgctatgcttccgcagttcctaagttcaattttcaggtcatctctgaacaactcggcacggacattttgccatccagcagcagtgccgtcgctttgcatgtctcttcccttattcgtaacgtcctgcgattggctcggaagttccaacggagtgcccgacggaaatggctttcttcggaggacgtcgaggcggcgttggcttattacggacacaccgtaatttgattcatttggccaacactgaattatccattanagtcacttat

SEQ ID NO: 8924 - DNA, 1777 bp, Heterodera glycines
taaaaacccgaaattctgcagaattctgtagcaatttccctcagttcctgccgcgcactatcaagaagttgggcaatgccatagagaacaatggcgtgtaggtagcacacgtccatactgactacaatctgttcaacgggcaaagggacgatacatcgttcatgagaactgaaaaaccgaagaaaaagatagaggggtaacggaaaatgggtcggtcggttagatcacctcggcccccgaaggctatatgacattagcaaaggtctttaacatccatctcctatattctctatatttattaaaaattctgttaagttatttcgtagacccatcacggccccgccgccccccccccaaaaaacctgtttttgttcctaaaaaattagcccaaaatctcaaaatttggtcatttttagacaaaatctgcaaacaaatagcaataaaataaaaaaaaattccccgtcgccgcctatcggcgcagccgggctctcccccttgttcccaaaaattgtttaaaaaacgcgccacaaaaaatgtgattaaaaagcaaaaaagaaaggttgtcaatttaaaccaagatattgtataggaagtgagtttacaagaaagggcaaatttttagaaaatttcgcgaatgttcttatcaaattcaattaaaatttccaaaaattttcccggcggtgcctatcggcaccgctggacctcactatatcattatttttgaagatttgaccccaaagtgacaaaaaagtgattttttcatagaaacactaaattcctgctttttggccaggcgctgaaaattttgaaaattaacactggagaaagaaatttttaagccggaagagcaaaaaaaaaaacttcgggtgccctccccgaaaatttttctggatactggttatgcgtttgtcccctctttcaggcgttatcgtctcccccacattcacactcgggtcatccgcgcgctttcccgtgccttctccgacacttcatgtcctttgcccactttgtatggctccgcctacgccctttgtcagcttgggatggatgtgagagaagcttagtgatgatttttgtgccttttttgttgtcagaccatccaacggattgtccttccgaacattgatttcatttggcaagcgattgaccgagtgaaaaccgacaaattgtacagcagcgaacggtcgttggcttcccacttcaacatcaaaatggtggtcagtttttttgttgcttaatttatatcaataaatagatttatactttttgtctttttttaaagttccatcaattttttttgtccaggaaaagttggtcgcctttgccgctgattcgaactgtgatttgcggttgtcttctcgtcaagacttttcggaccatttcggtggtttcggcgacgaggtttttgccacactgcaacagaagcacagcaacaacagttcgtccttttgtaataacaacaacaatagcagcggaggtggcgacggagttcggcaataatcgagcgaaaggaattggcattgacggtgaatacgcagttgggcgacgacactcgccattttgttttgttgtaaatgttacgatgactcactgtttgtttgtttttttttgtttatttattggtcatcggatttgttttgcctctttccctttacaatttatgctcgttttgtttttttccattattgtgtttctcctctccccaacttccattgtctctcaatgccagcctaaacaagcagcagccgtacactgtctccaccaatctcgtttctct

SEQ ID NO: 8925 - DNA, 1803 bp, Heterodera glycines
ttctatacaattgaaattatcactttcgctttgttacattgaacattttttgaaaaataagactcaaatacaaaaagattttgtctctggctgtcaatttctggacaaatggtctgagtggtaaaaagggaaggttctggtcggtttcaagcgtcccattctcattttaagtaaaatgccatgcaattttgagttccttctccctataatcgcgaatgagttaaatttggcgcaagtttcaaattgacagttttcgaatttatcaaaaagcaaatgggggacccttttgtttgtctagccctgtgaacttttcctaggggttttaggggtcgctgatcacggacctaacctctatttcgaccaattcggagtattaacggagttagaaacgaaaattcgaaaaattaattttcgaacttttgttcgagtttgagttagggattcgaaattggttaaaatgggtgaagattcgtgatcaacgacccctaaaacccctgagaacaataaatatcagatccgagcgcctaaattaccaaagaaaaaagcatttttctcttttaagtgtgtctctttctttgccctttcttcgctttgtttgcctttggcacaatcggcgcattcattcgtcaattagcactttttcctccgctgtgcttttgctggcaaatgttttgttcgctttgagtgccgtgaccgatcttcgcccccgccaattgcgcgtccggaaaacgaattattgagcagagagagagagagagaggggtcgccttttgtgctaattgccccgggcacaatcggccggtcaaattgtcaagtgcccctcttccccccggggggccattaatttcccccaattaatttggccgaagggaaagggacaaaagcctttccggacgaagtgcgaagatggaaagttctgtgatcatcagcagaaggacaatacaacaatggcccagtgaatgcttttttgtctgctctcgaattcgcccccccccccctcacttttctcgactataaaagcgaatgcgcttcgaccgatgtttgtcccactcaatcatatcatttgatcgttcactgcggactgaattcggaagctgagtcatcaatcactttgtcacggcaccatcgcaaatggcgtcgttctcccatcggtcgccgcttggcctccgccgtttgtttcttccgctgattttgctggtgccattttcccattcgttttccccgttggtttttggggttgattattcggcccgccctttagctttgcatttccaaatgcccaggcgtttctcccgtgccgcgccgggccctccgcccgacatgccgccaccaccaatgtcggcagctgttgcgcctgttcttcggccgccctcagctgcgtccatgtggggtgccattccggatcctccctccgctccgcttccgccgccacgcagcactttgctcagtgagttcgctgtggacgcgcgtgttggtgacccgccagtacctccgccgccaccaccgccacaaccggaaccaccaccaccgccagagccaccacagccggaaccgcctcaaccgccccctcctccgccgcctccccctccgacaccaccaccaccgccacacccggggatagaaactgcatgtgcaaacagtgattctcatccaaaacaatcttttatattcttcaagaaaaagtacggctacggctatcagaaattcggaggacctccgacatacgctcttccgccgcctcaaactgcggcgacacattttcttaatattttttcagaatgacccaagtgttttttgactaaa

SEQ ID NO: 8926 - DNA, 3055 bp, Heterodera glycines
aatcagatagttaaactttctaaatgggtgattacaatttgtttgatcatgttaatcagtaatcacgcattcaaaaaatctcagtcttggcgcccacgcattcattagacgcctttttaaatgccaaaatgcctaatttagtcctctgccggaggctacgaatcggacgagcattcgttgggcagctgctcagccgaagttgcagcaatcaacgcggcggatcagcagcgccggcggcgccacaaccaacaacagcagcagcaggcgaagaaaaaggcaccggcggcgccggcacttcagcaaaaggtgggggaggaaatcagtgatcactgatcagtcgagaattgtgattaggcaaaaaatccggattaaaatagcaaaactgttatcccattgtcaggcggtcgcaactgttgccgccactgcgtcggccgtgtcctccaaagcggcaccgcaacatcagcagcagcaacaactgtacgccaagcaagcaaacgtcaacggcaccgctgctgatcgaccgatgctgccacaaattgttgccgctccgtcgtgcgcgacttcaagaccgcaaccatttcggccccaaccgcaacttggcgtgctgccgcccgcgttaattgctgctgccgcgtcgacaagcggttatggtgatcagcaacaaatgctgcaaaaagtgccgtccattgaacagttgcggttgatgcgtagcagtcaagagcgggctggatctcaggtgaagcagcaaatcagtgggggcgtgatcaatcttggacagatttatgttattgattgatcagaatggcattgagagagagaatagaggtagagagagagggagagagagagagggaggagagagagaatagaggtagagagagagggagagagagagagggaggagagagagaggagagagagagagggaggagagagagaggagagagagagagggaggagaaagaggggagagagagagagaggaacaacctaattatctgatcagccaatgtagtaatgtttcacaaataccccactagcccaatgattaattttccatttatcagttaccattatcaatttatattatctcattgatcagtcaaccccagtgatcagtttttctattgatcattggatcagttacccttcgataagtaacccctttgatcagtgtcccattgatcgtcattgatcagttaccccattgatcagttaactctgcgctccgtttttccaggactaccacagcatggccagctcagtacactcccaggacggtttccggccggcggccagctgtctgtccacgctttcgctgcaacgcatcggactgatgggcggcagcagcggaagcggtgcctttcactcctacacgcccaccacagcgcagcaaaaacagtcctccgtgccatttcagccccaaccacaacagcaccaattgaagggctccattcagtcgttgcccgactctgcactttgcacagctgctgctgctgccggactgaaaggtgcgcctgcccggcatttttttgtctcgggacggcaccacaggcagcgcgggcatggcacaaaccatggctgattgcgagaccggtgcacccctcaaaacggcgacgcaaaaaaattaaaatttttaaaaatctcaaaaaaattcttaaaattttttgaagttttttggaaaacctaaatattactgaagataaaaatttatatttcccgagaaaaacgaacgaaaaaattccctgaaaattttttgttttgtttcttgaaaatttcgtaataagtttttttgaattaggttaggtaacgaaaaatccggttttttaataattttttccattccaattccatttttttgcggcaaccttttgccctgtccgggcgctgagacttttcttagcgctgaatgcctgaaaatcttaagaatttctcgcctttatgatgacaccgacaaagacgagacaatagattctcgaggaaatattatttttgttgctttaggctatggtgccgctgtttactcccggcagcagccgtcttcgtttggcaccggcaccaccgtcatggcacagcaacaacagcagaagcagccggtgaacggcattaccacaaaccatcgccaatttgccacacttgcgcgtatggactcgtccaacagccggcccaaacagggcgctggtggtggttcatctacagcaacaaaggctgcagcaacatcaaattgtctccgaccgacagcgcaacggcttctgccaacggcggtaacaacaacagcaacaaccgcgcctgctgaccacgcgtcggcaattgacgcgctggtggccgagctggagctgaacacggcggacacagtgcgttttaaaagaactcggattggacacaccccgacacatccggggccaaattatcggggattcgcgctgggtctgactgtccccttcctttgtttcaactgatcagtagggatgcgatttttagatttttacatatttttttcctgagatccccgtggcctgaaacgcacgaaaaacatgtttttttgggctgttgttaagctacttttcgagttattagcacctattttctaggtttttatttttagcacctaaaaaacctaaaaaaaattttaaaaacttattttcacctattttggcattttgcccaaaatttgttaacaaaaatacaataaaaggaaaaatagacccctaagaatcgacccaattttttttcaaaaaatataccccgaagaatcgaattgaaaattttcaaaaatataccctgagaaatgaaaatttctcaaaaattcatctacaaaatttatttgtttaattttttgacgagaattgttgattttgaaaattatgtatctcattaatgatttggcgtaatatttttgccttttgaagaaaattttcgattttacacccctaaattcgaaactttttggcacctattttcccatttttagcacctattttggggtttttttataacttaaaacctacctattttggcagtttttagcacctaaaaatcgcatccctactgatca

SEQ ID NO: 8927 - DNA, 3824 bp, Heterodera glycines
ctactgatcagcatcaattgattgattggcacaagaaaattgaccagcagttggtccaatcagtattgatcaaaagcagtagagtgtctgtttccatttagtgttctgtttgttttttttgataattgttgttggtattgtccaaatattgatcaatgctgatgacagctaaactgatctgtctgaaggtgatcagcaagtttgatcacaatcactcaactgataagggggggggggatcatcagtcaaaacggtcaaatcattgatctggtgatcatcagtgaatgaatgacaagggataaacttaatctcgtcggaaactcattcattagcactaaatgctcggagcgggacgggatcccgcgcgggatttttcgggattcccagcttgcaatcccctaattttttggaaattgcgggattaatcccatgagttccaatcccaaagcgggatctgcaaattaaaaacggtctctacgcccatttttaagtcgttcgcatcggccgaaaaacgccgttccttccccaccatgcagacggaagtggccacacggacgaaggcggccaaaattggcggcactaccgtagtcacacggcaacaactaccatcccacaacttcactaatcggtgtgcactgttttattacgataatccctgggtatagaggtgggattttctgatcaaaaaaaccatggattcgaagcacggagtcagcaatttctcaaacagctccactaagcattaggaaaatgccggtttggccactacggtattttgtaccaacgtcagtaggcgcccgacggggggagactgactgtaaacaaagtcattttcaggcctgcgcagcaagagaatggcagcagtaacagaagcaagccgttggaaaagctgaacgaactgatctccatggacgatgagtcatcgacgacgaggcggcacagaacggcacaacagcagcagcaacaatcggctgattcatcggcaccggcaccgtcggcgggtggaaatcggccatttgaaactatcaaccaggagaagctgaacccgtccaaagtggacgcaatggcacggatgttcaatggcaagcagcagcagcaatcggcaactaccgccgcaacatccacaaagccattcacaagcggtggatcagccggcaataatgccacatccgatcatcaggggtgggccacgcgtcgcgcggcaacaatcggaggccgtgctgcggcaccggcggtgccatcctggtccgtcggttcgacgacggcacgggcatggcggcaatgtgccgccattgcttacaaatggacaccacgcgccaccggtgacggccacgacggcacggcagcataaccaacaacagcactcggcgttgaagaagcagtacacgctgcccgcaatggcatccgtggcggccgctgctgccacaatggcaccgctgtcgtcacgaatttatcggggcaacggtgcggcagctggactgcttgaactcggcgggacggccggtcgatgccgaacaaatggcactgggaggacaacaactgcggcggcaaagcgtgatggcgccggcacaccaacggtggtggacgacgaccatggcggcggcacggcggctggcccaaatcggcaagaagggaatggcattggcatttgtgccggcagcaccggccgaagcaacttctacgacaatgtgcaggtggcgtttgccaaatgaatgggcatcgagtttcaaaatcattttgtcgggaccgggaaagtcccgactcgcgactttggcatttgtatgcctttctctgttttatcattttgtaaatcattttcatagagtgccgcgcggaacggacgctgcggcggcgggcgaacatcgccggctggctacagcttcagcaacgactccgtgtcgttgtgcagtcagtcggacgcggcactacctccggcgacgagcaaaggcggcacaaatgctgccagcaatggcacgggcggcggagcgggtggccgcatcggacagctgatcagaaagttgggcagcagcgttggcggaggcggcggaagcggtgccaaagtgccgtccagcgccacctcaaccctctcgttgaacagggtgagccccagccaagccaatcggccatgatttgatcaaaatgggttcagccaaatcaatcatcccacccggatcgccaaaagagataaataaacccatgttaaagcatatgatcaaataatgcataaaagtgatctctgatcaatcaactaattgatgaatcgatatggaaatcactttaaattttttgctagaccccgtctgatcatcaacaatgatcaaattgtataggtctaaatcaattagaccaatttaaattggtttgctcggtttaatcatcaagcaatgatcaattgttgtctgatcaactttaattagtgaccatcccgttttgctcatcgatcacttacttgatcaggtgttctccaatgaaatgtcatcgtcgtgtgtcggcggcacagcaccgcgcgacgacgccgacggcaaaaatcgcacatcaaaggccgccgccgccacttcgtgcgctgctgccaccgttggcaccaacggaaacggcacattgacaaaaagcacaagtctgagcggggatccgtggcgttaccaagtgatgatggcggaacatcagcagcagcagcagcagaacggaggtggtcggagaatggaggaacatcaatgtaaacatcaatcagtctttcttgcgatttccgatcactgatcattattcattaattggcccctcgattcgagaccaagactgaacccgagattagataattgacccctaagagtcgagacaaaaagcccaaaaatccgagaaatttctcgccccgagaaacgttcaaccaagttgttgtcatcttttcggctaagtgccaacttgccctttcaagatttgatcagctcggcctttctgataaatgccgattgaccggttcccgaaatccgagaaatttctcgacctaagaaccggagccaatagaaaatcatccgatcggttcttgccatcctttggctgtgtgccaacttgccctttcaaaatttgatcagattggcttttaggtttttcgcataaatgccggttgatcgataagtccctgaaaatcccgatcactctgatatacttcatcacaaaacaaatcatatgtaaatccagtgatcaaaaaaggcttataatttgcagccaagcaacttcaccaccacaacaacaaccgcaacaaaacggcggcatcggaaaccgtttgaagcagaccattttcgggagtgccatccgtcgtcgggtgccaacctaattagaccaaaaaacgagagatgccgaccggaccaccgatctgatcaaccagccagtgatcgatgatcagctgccgaggtgccgcaatgatcgacgatcaaacaaacaatcagtcatcaattaattaattaattgcccttccccaattgattgccatccattcatgattattttattaaaattgcataataagcgcccaaaaaatctgccaaagccaaattttgttgctccccctttttgcactcatcaaaactgctgatcaattagtcatttcgttatcattatcaccactatcattagcatcatcgtcacaaattatgtgattgtttttgcatacagtatctgacgacgatggtgaatgtcgtgcattttgtacagtatccctccaaaaaaccaaaaacaattttttatattaaaatatattttgtatggaatatgcctatgtattgtaacaatatcatcatctgctcaactcaaccattggtggaaatgaagtg

SEQ ID NO: 8928 - DNA, 6196 bp, Heterodera glycines
acggaaatcaaaataaaattaaccggattcaaaatttaaaaatagtgtttgttaatatttgtttctttttgcctgtatccgagtgaacagttcaccggccggtcatacattccatgaccatcaaaaggcacggaatgccattgtaattgttctaaataagaaagcagcaattggatggatgagaatggcaaaaccagccgcacctcgtaaatgtcgtaaacattcacaatgttcgcgtgcccactggccacaaagtgcaattcggcctcgcgctttgccttcggaatgtcccgcagaattttcaatgcgaatttcttcccgtccgtccgatgttcgcattccaccacttttccgttgattccgaccccaagaaccttaaaaatacggatgccattatttattaacctcaaaacaatcagattttgggatggattcgtcaattatttctaaatgccatttttgtgaatttgttgaaaatgccacccaaacacacaataaactcacattgttgccaattttgtaatcggctttaatcggattggttttatatttcataaccactgcaaattgatgagttgactattaaaagattaaagattagcccggttggtcctttttaaaggttagaatttttataaatcacgtcatttcaaaacaaaatttggtgtttggccaaagtttctctgctttagcttttatttttctatgcccggcctcccatccatatataattatttttaaattatgattggttggttcaatcttttttgggaaccaacttcgccaaattaccacccgccgaccaaaaaaacaagaccacttccgtcccaaaaatgttttaaataaattttacggaaagataattaagataaatcatttgtcagtggaatttatttaattttaatacaataatggcgtgtatacaataaaatcaaggcacaaaaagggaccaaaatagattttgaaatatcagcaaagtaagacgaagtgatattaagtggatatttgaatgtttaataaaaaaatgaaaaataaataataaaataaattaggtaaatattatgggaaaagtgaggagagatttaagtgcgaaaaaacttccaaagtttgaacactcacagacttttgtgaaaacgacaaatttgagggtccggtgaagagatttcgcggaaaacaattatcaacaaacaaacagccacaaaaagggcgaagatgacgagggcacaccaccacgcgtacttttcccattccaatttgcgaaagttgcgtaaaagcacaatgccaagcaacagaccagtcacaaagccgccaatgtgagaaacataggaaaccttggaaagttttataaacacgggcgaattgttggataaaattcatttgtgccaatttatttcgtcccccttttccccatttgtcatgccttttcctcaccctatttggcatgtcgctaaagtaccgctggtaaacggcaatcacaacatcggccgtaaccaaagtagaaagaatggaagcacggacccaattgaattgcatttcgctccaattaatgatgacattggcaatatgcgcagaaagtagagtgtaactgaacttagaatcaatgaaaatgaatgtgaatcatgctttttcaaattattttaaaaagattcaatttaactctcttttcttacactcctccggacgcgccggccaaatatacttctctgtcagtgacaaaaaagagcaaagcgccgctcatcacaccagcgaggtacaaaaagccaactcggccgtatttgtggaccaattccaacggaacccctaatagaatttgcacgacgagattggtgagcaaatgtacaaaactgtaagaaagaaaacacttaaacaaagtgtctcctataaaatgttaaaaaaactcacccgacatgtacaaacactaaaaatgcaaataattgtgcttcaattgaaacggcgaaaactgactgtatgtaaagtatcgccagatttgccattttaagcacgggttcagaatcagcggagactgagtgggtgtacatttggtaggcaaaaagcggtcgtttccgcaataatggaactcatgataaacatagagaccaatttggacaatcgagattaaaaccttgtattaaataatgatttgtaactgataaattaaaatattataccatgaaaatgggcggaggaatgcaattgaactcgagcaaatagcgggaagcctcagtttgttggcttcgcggaaggaccgaacgagcggcgtacaaaatcacacgcttcaaacgcattcctttcgcataagccatctgataatggaaggatgaagcgaagggtggaagaaaggaaaaggccaaagcacaccaatcgagtaaattcgggaaagtccacaaaactatcgccatttgcatcaacatcggaaagcaacgcattcgcctcctcccgcgaaagaccgaaatgtgaagcactgttccggatagaaaatttaaactcggcgacagggacgaaaccatcattgcccaagtcgaactacacgcaaaataaaaagtcagagcaataaaaggacgacaaaaacccaaccgatcgaaataattcgtaccaatcctgacactcctgaaacgattcacattgaaatttgtcaggcactgattgtgagattggatgcatttggcaacaaaccctaaagaacgaagaaatagtaaaacgaacaaaatgggagataattttacaggaataatttactgtttaaaaaatgagctaattttaaacagaattatcgacaaaaatcaatcatattcatcgtcgtaatcttcttcttgcgtatgtttctgcatttctccgtttgtatatggcctctttctttgagtagcatttttgtccgtcatcaagagattggacacagattcaggatcaaaattgtttattgcattgaatttcgacgatccattttgtctgggccgctcttccatctttaaaaaatattttacaaaggcaaaaaggaaataaaaaaaatcacatggactgcttggtcttcgttgttcggatcatctccgatgtatatgtaattgggctgcagttgacagaaacggtcattcggtaaacggagtccataattttgacgtatcggatgtaaaggcagtgcatttttttctgcggctaattccgacacaaaagcttttggtgggcgatcattactgtgcttttcatcttaaaagatagaaaaaaagctgagatcgataaaagcacaaaaatttaccaaatgttttgatcgcaaggtcaacgtcgcttctgtccacctgtttcttgccactaaactcggaaacagaacgagcatcgacgagaatctccttggtcaatgagtaagaaatatcacacaactgaaagtggttaacgtggataatattgggtagatctttaataactaacttgtaagactaattgcggttcgtactctttgattcccaattcgtggaacatttttttgattgtttccgcacattgaggtatttttgaggcggaataactttcacttggtttacatgtattattgctagatgaactaacagttgccattgccaccatcaaatgaagtttgaattctaagtggacattttgttttgacaaaaagtttatgtttaaaaatcatgaaaatattatctggagtcgagagtattcagatcatgaatctgaccaatttttaccaatccctaacccgaactcgaacacaaaaatcgaaaatcctattttttcaattgattctgaattgaatgaaaagatgttaaaataaattaaaaatttaaattttttctttcgccaatgcgcttacaaaaaaatttggctcgacactaattgactatggccatggccatgaatgacatcaaccacactaaattttaagcttttcgcctactaccatttttaagttcaataattattaattaatatgttaggagaagaaaaattaataaaaatttcgctagacaaataatatgcccattgactattctgcttggagtaacatcgaagtgtcggatgacgaagatgacacgcatccaaacgttgacaccgcttcattgttccgctggcgtcatcaggctcgtgtagagcgagaggcggagatgaaacaggccaaaaaggaggtgaaggaggaacaatcgaacgtgcgcaacaaaatgcaggtttaatgaatgactcgaacaaactgatatttaaaggatacaaattcggcactattaccgttattcccctttaggaaattgaggaaaagttgaaaagcgctaaacttgaggagaaggagcgcatcagtttggaactcgagttgaacaccatccgtactcaggaggaggagttccggaagaaggaaaaggagttggaggaaaaggaaaaacatcagccatggaatgtggacacgatcgcaaaggaagcgtggagcaaaacgatcgtcaacaaaccgaaggagggcaaggaacagccgaagaagggcacgaccagcaaaagcgaagaagacgaagagatcaaccgaatgcagaaatacttcaaagtcagtaaacgcagtgcacccattcatttttcaattccaaaattagatgaaacattttttctgtttgtttgagtataatgccctttctgccaaacttaggacaatgaaacacttttgcaccaactttgtgtcttggatggttttgacaaaatagaagaattcctgctggagcatcctcagctcgccagtgagtacgccaccaattttctgactgttgaagcactcaattatgctatcgatgcgaatgtgagtttgtaattttttagtttttttaatatattttttgtttttattattaaatcacttccaaaatattttttttgcgaaaattctttttttttttggctaataataaacagctggtttttattaaacatttttttatactgccattattttcgaaggatttctttaaaaacaaacaaacattatgattaaggagataaacatgggtcgggttgcggagaattacataatgattcaatacgaattggaattggccaaatcgctgcacgcgatggccaccaataccaatgtgataaagaacttcttcaaaaagtttgtttctgtttatttttctttcataatggcttaaataatcgtttatttacattcagaattcgtatcgcggaacaaaattatatgaaaatgttcacggacgaagtggaagcattcaaagaccgtctgagaaaacgcgcgcgggacaaaagggaggcgatgctaagcgaaacggaggtggaggagaagaaaaagcgtgtggcccagtcgccaggagggcttgacccgcaagaagtgttcgactcactgcctgcggtgagttattctatgagatggaatgaggaagcagtccaaaattagaaatttgcagcgattttcatttaatggaaccacctgaactattcaaaaagtgcatatattatataccactaataggtcagggccgttttgtattctgaatttttaattttacgtgctaacaagggcaataaacctacaaattatggggccgcaaaaatcggaattttattgtctgatggcgcccattttccaaatacaaaacaaaatgttcaaaagcagaaaatgcatgtgctatccttgatctggttactggcgagttgggagattttttcttagtaatgaaacttgaattttaggaaatgcaagaagcgttcgaaacgcagagcatgtcaaagatatttgaagtggcgaagagcatggactccgaggtgttcaagtaccatttggatcgctgcactgcctccggactttggattccaaacgcaaaggaagccgagggacatggacaagaggaggaggagaagaaggaaacggaggagaaatgaccgatactcaactcaaagatatggtaaaccatgagaatacgtttaagtcgacttataatatttaattatttatgaccatttaaatgcaaataaagatattttcccataaattcttttacatttatcagcttgtttctttaaaatagcttttctcgttgaaacttagccatagctgatggacaatgtccgccatatggatttgtcctgtgtttgagtcgatcagtcgaaggacgagaattccatgcaatttcagaaatttgtaaacaaaaacttttctatgggaaggcttgggcggatgtttgaagctgaaagttgggga

SEQ ID NO: 8929 - DNA, 3391 bp, Heterodera glycines
atgtggactaaaaacccataataattttttaaaaattcaaaaaaaaatctccaaccaattcgattaatttgaatcacttcacagcctaggtagcgaagctccgaaagcgcgaagcgctttttcccagctaaatagccgacggttcacgcacccgctagttaatatatacgttatattgacaaggagtttcgtttgcaaaaacaaaatctcccggccgaaggccgggagcgccctgaaaatagtggaagggtcttacaactttttgaggcgcatctgggaaaactatagaaaaaaattcagcgcggacgactgagtcccggggaccgatttctcactttttcttgcgtttgaaggcccctaactttttttctaaaacccgaatcaaaaaatgtctgctgtgagggggctaagttgaagtgttttttaaaaaacaaaaaaaattccaagcctctatctgcaattggaaaggctgtaggttcgtggactttttcagtaccaactttgtccagttcagtcccggttgaataactcattagggtttgatctgggcggggagttaccagcagacttattgtagagttttgaaagccctgatttttcacaaatttaaaaaattcgaaaattttcaaaatttttcgagttaggcctaaaaaacggttttcgggttttttaattttatgattttttaacgaattttcccagaaaaacggagaccacttccaaaacatagtttttcaagctctatcgactggtatttttttcggaaaaatttcggtttttttccggaaatagaaaaaatttttggcctgagcgggacatttgagtcccgggcctataactcgtcagggatcggttttagccaaaaattgccttagaacatttttgtagagcattttaaatgctatcgaatggtgtactatatgaaaggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatgaaggactgctcaatttaagtgaattaaagctttaaaaatagcaaaaaatcgggagaattttatgggatttatttgggatttctatcttctaaagaaaaaaagttattccagaaattctggaaattttagatttttcagaaaaaaattcagaactcccttctgaaaagtcattctgtaaaagtaaaatactacaaaaattcgcaatttttttctctataatataaattttattttacatttttatctcttttttgcgaattgttataaaaataaaagtggatttttggtttcgggaccaaaggggggtgaccaggatttttgggtggaaaaattttttcaccgaaaatattccaaaaacatgtctataggggtattttatgacgctgatcacgaatacgtgatcagtttttacttttgacatcgatcaaacatcagaatccttgtgtgaggggggattctgaggcatctttaggcggggggggggtcttaaagagtttcgtataggatgaagttccggaacccagcggcgttcattcaaaataattggcgattggattttcgcaagaagcataaaaatttgcatttcaccatgaaatagtcagttttacgccaaaaaacgatcatatctgttaaatatacgccatttaagaatcattaaacatgtttttttggtttaccccttaaaccaggggtgtgatcaaaaaattttcaaaataagaacattaaggccaaaaaataagattttagtgtcaaaaataagaacattttgcaaaattgcttcaaatcgttatttttacaatttattcgatcaaaaatgtatcaaatagtatatttttgtctcccattaacgattttaacaattttggggaggaaattagcaaatcataaaatttagtgcattcgggataaaaaaaatcagatttttaacaattttttgcggcgcatttttccaaaaaacttttgggaagtgcgaggggagggggtccggcgatgccgataggcgccgccggaaaaattttgtaattttaatgcgatttgctaacagttttttgtcaaaaaataacaatattttctcattttaattgttaaaattgtgattgaattcccaccgaaaagggaataattttgaaaattagaagaaaaaataactactttttgggaacaaggggggagatggtccggtggcgccgataggcgccgccgggaaaaattttgtaattttaatgtgatttgctaacagttttttgtcaaaaaataaccaaattttgcgcaaaccttatattttcttgataaaatagtgacattctgccataaaatttcaaaattttgaatatatttaagaataaaataagaacaatagcccgaaataaggacaaatcttacaaataaggacatttttattttgtaagatttggaccctccaaataaggacaaatcttataaataaggacagatccgagccctggtttaacggcaccgggaaaaggccgtttcggcgccgacgtttaggtgccagggttggttcggcccaggttgtttcggagcaaaaccaaaataaaaacattcaaaattcacgattcaaaatttttttaaagtaatttctacttaaaattctcaaaaattaaatccaattttcatgaaaaggcacttttttgtgtatgtaaaatcgctgtgcaggttcttggtctgggccgaaacgtcggagcctaaagaatgaatacaaactcagaggtggcattaagcatcaaccagactagcttttttttaaaaatttttcatgtcatttcaaatatttttccaattttttggtttacttttcattgcccaatttttcctaaaaaataaatattctttagcccatcaatttacaaaatccgctggtggcaaatgtggcatgtgttgagccgttaagacaatgggcccagcaattgttggaccggcagcgcgatttggaacgccaaatggagtgcggtggggtgggccggaaacggcacggcggtggcgccaaaggcagtcgcccgaccgcgttgaatacgagacgctcaacatcgtatcaatcaatggccgatttatacggtagagaggagactgtagcaacagttatatcacaatgtttataaaaaagtatcgaagaatttgagaacgaacaagaagaatactctatccatttttggtattttcccacatcagggtcacttttgcgcggccattttgacgtggagttttggcgtcc

SEQ ID NO: 8930 - DNA, 2591 bp, Heterodera glycines
ttgtaaagcaatgtctgcggtttcgaaaaaatggccattttaattttccatctcattttggattttttagaaatttttgaatagaaccctctccgatcacttttattgtacgggtcaaaacttgctttgatcggttgaaaatttattaaaagcagtttttctggccaaatcaagtccggagaatccaaatctggcctcagatttgatctctgaattttctctggcattgtactgctccatgtcgttgacaagaagttgaagcagtacagggtcatagaacagcaactgactaaatctgaggcgatattcggattctccgggtttggtttgcccatgaaaacatcaatttcattttattaggtcctttcagaacaatgttgtacaaagtgtgtgctgaatcttggcacttttgagcacccattttcagacaggacaactttaaaaaaataacccgtcggtcttggtgactctttttcagcttgtcagatagccccaactttgcgctacaaaacaataatttgttttgtacctttagccttttcttggccaataaatcagtggttgaatttggccacttttttaagtagaccgatcaatttatttgagtcaaactatcttgaatttaatcaatagatcatttttaaattctcaaaaatggcagaagattgtggagaatcagtggagatactttgagtgatttatgggtttcgttttgatttgttataaattttaataaagaatttctcccagctatgacagaacttagtttccaccccaatatcatcattttctctgaattttgtcgacctgttcgccatttggtcgagcgcttcatggtgctgagcaattcgaagactgtcagtccgaattttgtgcgcggagttgacatggtttcttttttggcttctccttgatcaggcgcttcatctgatttcgtttcgtctcagcatcataaagcgatgaagcttaaccatggtgatgttcttttaggcccaaaatgccggtcatcaaattgttgtcgcccaatttggctgtagctggtcaattgcgttgttcgcacctgaatcagctaccatattttctgtttttgattaatcggaagcctgaaaataatgaaacaaaaagcaaaagacaaagcgctcctcagtttgtttcgccacctttgaattgaacagactcacaattttattcatcatcgctcgaagcgacgttcaaattgttgctggtcgaagtgcctttcacctgttgttctgcgtcagtcctcttaacattcagtacgccgtcttcatttgcagaactctcaaatatttccttgaacagttggcatttcctattagaatctgaaatttattttttttttgggaagaaaatgacataataaagtaaaaccaacattttcccaattcatcagccttttaatcatcattttattattgcttttttgatcggaatttctcgaaattatgaaatgagaccgtgatttgaaacagataaaatgttatttttcttggatttttaatttcaatgtcttaaacttttggtatggaaatggcctaaatgccttggtatggaaacggccggtatggaaatggcggtatggaaacggcagtatggaactgaccccaaccctatttttgacagagtctaaaaatttaagcagccatttggttaaaataagaacatatttccttagctaataatcaattagtaaaatgagtgtgttttccttgttagaaggagccaattaaactgtttttgctattcagctgcctcaatgttaccgacgccggcggagcccgcatttggtgcgggcgccatcggcagcggtggcacttgctcagcccggggtgccgcagcgacggacaccggcacaacactggcggaggccagtgccacgttggccgcgctgcacccacaagtgcagcggaatttggccgaaattgaatacgattggtcagtttgcagtacgcaaatataaactttcggaggacttgctgactcttcgccaaaatttgaatttatgaaaaaaaatgatggatagactctaacaataggcgccgcttatgaatagggcccggatttataagtttttccttattttttctgcggctttaactcgacgagaaatgcacgaaaaacacattttttgttggaaaattttgcgttttaacgcccttattcgaccttagaaatccttattttgggtgttcgcccttaaaaagctacttaaaaagttgcggctattcaaaatccaatgaagggacccttttggtttgccaaattattttgacctaataaatcgtcgtgaaaacttattcgcaaggcttttcgtggttgttgatcacaaatttgacatcaattttgaccaattccgagtccctaacccgaattcgaaaaaagtcgtaaatttattacggaatttctatttttttttgttcaaaattagattaggaattcagaaatggtcaaaaatgatgtctgattcttggtcaccatggttgggccggcacgtttgggcaccagcaagcttttccaatataacttttttctttgtcatccaaatccaaccttttttggtatcttcgaagcat

SEQ ID NO: 8931 - DNA, 1124 bp, Heterodera glycines
  misc_feature (71)..(71): n is a, c, g, or t
  misc_feature (76)..(76): n is a, c, g, or t
  misc_feature (127)..(127): n is a, c, g, or t
  misc_feature (130)..(130): n is a, c, g, or t
  misc_feature (138)..(138): n is a, c, g, or t
  misc_feature (145)..(145): n is a, c, g, or t
  misc_feature (147)..(147): n is a, c, g, or t
  misc_feature (151)..(151): n is a, c, g, or t
cgggagtgtgttggctggccagcagttccacccatgttcttcacagcgcttgaccggcaggctgaagacgnacaanaatatttaaaacgccgcagaaaaacggacggagggggagggccgaccgganatncagcaaancgccagncnctgngaacaaattgcggcggttgatgagtgtatgtgctcgcctgcacaattcgctccaccaaaacacgacagaaacgaattggaggcatctgaattcaaaacggtcgtgatcaatttatgaatatggggattacattatgatggtgaagtacaaattcgggggttaaaagtttgctgtggtacccggcaccggcacgagtgccctcctcctgctccaatttcagcacaatgttcaccacaaatttccgaatggtttgacgcccaatggacgagtcgcggttaaacgagtccaaagtgtacagcgtttcgtataaaaaagtcattggctgcgctaaattcaaattaaattgtatatttactattatttcaatgatttatacggtggagacggtagagagggccgaaattgcgtagaaaagagtccaacactttcgggccaatatccacctccaaagcacgttggaaaatgacatcaattagctaaaacttttccataacttcaatgcacattttgcatttggacaactgaccggaaggatccgatcggccaaatggccgtaataaataggcaaattcataaggtctctttgttgttccggagactgttgaaaagtcgagtccattgtttttcgatacaactcagtgtacgaatattctgggtatttctgtaaaaaataaagtagaaattcctatggccaacaatcactttgctaaagtcggcgatttggataaagaattcctcggagtttgcgctcgttgtgttcgaatgggcgggcgcaaaggaatggcacgcgtgcagtcgatcgtagaaagaggagagtttgttgtcgaggagggcggccaacagaaagagcgaagtgcgaatggacgagtcatcggacgggtggagggccaacgagagaaggaaacgctccacggagacgaactgatggacgaaaagcatgtcgttgagcaccccaacccatctgttgacggaa

SEQ ID NO: 8932 - DNA, 3983 bp, Heterodera glycines
  misc_feature (1396)..(1396): n is a, c, g, or t
acgccaatgcaattaaatgctaaatgtcataccctcaagtcaatttgctgcagtgaaagtgattcgtcggtaagcatccccgacggcgcttgtgacgcgtccccttggcacttccaaaccaaatagtccaccaaagcgtttgttgaccggtgcacgtcgcggttgctttgcagagaaagaagtttgtagcaaagggccgggaaattgggcgcactttggtgggactgcttgccggggggcaattggggatggaaattggtgaattcgtggaggcagcgaaagattgagacgagcaatgacggagaagtcggatgacagggcggtgagtccaactgaaactcggaagagggatgtggattgatggttgtgtgtgaactgctcaaaccccaaaaaattcagcgtccaagtgcatcagtcgttgtgcttcctggaaggagatgttctgcagttcgaccatctcttgtgcctgttgtgccgattgcatttgctccaattgcggcaggtcactatcatttggcacaattgaacggataatgttgggcggaaaccatcggagttccgacagaggccaacgctgaccaagatcttgcgagctgaactggaggtggtcggcgccgagcagtttgacagcgcgaaagacagccagcagaaagagacggtaatactccggcatggccatcaacggattgggcagcgttttgcccatcaacagttgggaaaagttgagcagatcttgtggccacgtgcattgcacaaagcgttggatggtctgttcaagaagggcacacagttgcaacgtattggaggagggacacggggcagtggagataggactccgtactaacgcctcaagcacctgtgggacatggaacaatgcagtggaaaagtgaccgtatatatgacttggtaaagaaaacgggaacgcatttcgatgctccacttccagccaaagacaatgttttggaggcgaaagttgtgcagctccaataaaaccttgaatttgagaacaaaccaagtgaatttggtgtgaaataattgcacggaccgctaagaaatcaattcggacggggtaaagtttctgttcactttcattcgttggaacgttggtggcataatgaagagcggagacaatgtgcgtgtaaaagacggcgccattaaggtcgatctgacatggttaatagtggaaaaaaccgaaaaactgaccaattccgtgctcaacaaaagtcgtgccaaactttccacgagtgccggggttggcaatctgaaaaattccgtaaaaagacaacaaaatggagtaacattggtggaccaccttattaatgcaaaattaggtgtcgcatctttatggaataattggctgtagagacgaaatgttgactgttaatttgcaaattgngcatggaaagtaagtgagtccagaaaagtcagtccaatgcacgcaaattctgttcagttcgccgtccgccggggcaaaacccaacacttttcgggtggatgaggctaaaaacagttagaggaaaagctaaaagagcctttgtataaatagcacttgctgttgatgaacaatgctctggccaagaatccgaaacaccgcggagctgacgtgttcctcgaacacctcgcgattgttgctgtacgaattggcaatgaccgccagaagggccaacgttttgtccagcggtttgcttgcatccaactgtttttctggataaaataaataatttgacgatattttcgttgagtttaaaccgatgaaatcgatgagtggcttcagtttttccggtggctgaggctgactttcttccgaagtggacgcaatgggaaaagcgactgggtgcaccaaattgatccaaatggcggccggagcaaaaaatcggacataaaattgacaaagagtcagtcaaagcaatggccaatatgagaaaaaccatattcagagggttttccgtggaacaggtggtagcccaattcatgttcttgtcagtgtacaaaaccttaagagcaattagagtgaaaaccaaattattgccaatttgtgaccaaattacgttaaaaatatccaaaaccaattcccgattctgtgcgcccaacccaacgacggagagtatttgtgccccgcattggccattttgttgctgctgctgttggaccaaattcttctcgcgataacgggcgtaggcaaccaattggagcagaatccacatcaactcgtccttcgctcgcaaatactattaaatggagaaataaataaatgaacaaattggaaaattgggcgacgatacttgacaacttctcaactgtggcagcaacattttcaacagctcactgaagttgaaaataaattaagaaaatgtaataaattgacacaaaatatttgacctcaatgtgcagttttgcatgtacagagcatgagtgaccaagtgggaaaggtgcagccaattgtactggttgaccggcgccagcacgggctgttccgagtcctccatggcgcacatcgcctccaaaatgagcagttgaatgacctcatcacattggatacgggagcacggagtctgtgaagttgacgaacggagaatgtgcttaattggagaggagagtgaacaaaactcactaaaaactggcgattacgttcaaattgtcttggccatggggctgtttgaagagaatatactgcaagtaggtttgtggggtggtattttcactgaaaatatgatttaattggaatgaaaatacaatttattcgaaaagttctgtttcaaaaacccaatggattgttagttgagtgaatcgaatcacctgctgtacggcaagtgcgtcttgaagtaaagtttgcattgcttttcgtctaatttccacgcactgcacgtcggagaactccaagagaaggagggcgaagcgggcacgggccacatccaggaacggccgagcatggaaccaatttcggcgaggggccgaaacgaagcgatcatttcgcggattttccaagaaacgcgctaatgatgggaaagataaagaattttaatagagaattgggtcattaccggtaaaaaatgaatggatgtgtggcacgggtccatgcgactgatttcgttgatgaaaaaaagagccggacaataatttttgcttctgtcaatcaagtcgatcactaactgaacacacaattaatcactcataaatatccttatccaatagagttcacttctcattttgagccacctcttcaatcggtgccaaattcctctgctgatattcggtcaattggcactgcattttgtccaacttttccaccaacaactgcttgagcaagtcgcgcatgtttttgtagtccaattggtccatgcttttccgtacaaatcttatcttttgcggattaagcggaattttcatgcgaaagtcgatgctggcgaccaacaactgacaagtcaatctgaaaacgtggtgatggtaatttccaaatcgatgattttgccatcttttctcacaaaagtgtgatgactttctcctcatatgctgccatgattattttggtgatgatgcgatccaatgcgttcagatgggtcttttccgtgctcaacagaccaatcagagagaggcacgcctgctccaactccacgggctgtttgtttcggtcggtctcagagggctcataaaagttgaaaacggtgtttttgcgcatcaaaccgcggaccaccgaccaatgattggaggagcatgcacgcctgcacacagaccaattcgtcctccaaattcaccgtccgtcgcctcttttgcatcaacggctcgaacatattctttaacgcatttggcctcacgtgattcagcaccaaccatttgagcttctccgcctcattaccaatgcaaagaaagttgaaattggacgaagtggcggaggaagaggaagaagcctcaattggggaatgaaagggaagagcggacgaagaggacaaagtggaatcatccatctgacaataaaacagcaaaat

SEQ ID NO: 8933 - DNA, 1935 bp, Heterodera glycines
  misc_feature (95)..(95): n is a, c, g, or t
  misc_feature (1901)..(1901): n is a, c, g, or t
tgtaaattgaccaataataacccacctcctgaagagcagtggccgcttgggtctccaccgggtgagagttccatgttatttcgcttatcacttcncggatcaagcgtcggaacggctgccggggcatcaaattgtctgtggatttttggtacctccgaatctctttaagtgccctaaaagattaagtttgattgatgtcgtgtttgtcctcactcattttttaaaaagatttaaatttaaaaataagtcaagtcattttgattgttatttcttttttattttttaaaaatgtctaaagggtcgattattttggctatttgtgatttttgtcaatccaaatgaaaagagctctccatttgtggtttaggaaacaaaaaagttaaggtacatgaaacccaaacattatttaatttaccttaaataaaaaagaaaaacaaattacttctcccctggtcggtaccgctttcgccgttgttcttcctttttgttgattttttttttcatgatatgaatagccggccgagaaaaactaaaaaaaaatctttttttaatcatacgcaacgaattatttacaggcaaaaaaaagtaaacataaatttgtattttatttgcataaaaaatatgttgatcattttggtgttcctttttatggatgttattttcatgatatggcgaggatttttagaagcgaaatcccccagaagagatgccttaactaggagtgaaaaaagtcgaaaaaaccatgttgtttttccaaagataaaaaaaactgagaaaatttaggactttcaaaaacaaaaataaggaaaaaatacaaaacgccaaacaaaggaacagttcgaaaaaaaatttcatttcttcccaaatattgatagacagaaaaaaaatggaaaaaagcatcctagaagcttcaaaataacctagactagaaaatgcaaaaaaggaagaaaatactgtaaaattttttttttatgtttttcatgaatccacaatatatatttttttggtgaaaatattaactcaagtatttttcagagaattacataacgggtaaaatatcgctgaattgttttttttcattataatggatgtggatgtaattgtcaagaaattcaagttagtattttggcctgcacaagagtttcggaacgtaccggaagattttgatgaaaagactcgaaaatttgtcgaggtttaatctcaagtcatcaaatttatattacctaattcaatactttaggatgctttgtcctgtaaatatctcatcgagactctcaaacttcaaattggtgtcgaaacagcgcaacggatgggcgaggaggaatacgacgcgcgagtggaatactcattgaacttggagattagtgaagggaaaaacgcccatttaatgaccaaggcggacgaggagagcattcggcagaacaaccatttgctttacatgttaaacttcttcattgtgttcataaatgagcgtgttaaactgacggagcacgcattcacttgcgcattaatgctaaacacaaaggaattctttgatgttcaattttggtacagttgtacaaaatgttcgtctgttctcaaccaatttgctttagttcggctaacatggagattcccacgaaatgcttttcattcgtcagtttggttgaccgtgaccaaccacttgttcatcgaactgttcaacttgttgaggatcctaaccgaatcatggatcgtttctacaatcgcacaataagtggacctccaacacttagcgattttgagcatgacaaaagacaattggtcatccgttttccatttgtcgacagacaaagtaaaaaactaaaggaattgtaaattcaattctcaaaaaaaacgaatttgactgttaagagcgtgaaactggcattgaagaggcaaantacgtggtttcattactgtgagatacaatccatc

SEQ ID NO: 8934 - DNA, 1578 bp, Heterodera glycines
  misc_feature (1472)..(1472): n is a, c, g, or t
  misc_feature (1517)..(1517): n is a, c, g, or t
  misc_feature (1535)..(1535): n is a, c, g, or t
  misc_feature (1544)..(1544): n is a, c, g, or t
aacattttcttccattttatgtttcttatttggtctccgttttttaagtatgtgcgaagaggtgaacgagtcctcggtttttcgagtccaatttgacctcgaacgaagggtatgttcatttgtttaacacccctctgtacttatccttttgtttagtaactttatgcgctgaacatgaatctgacgttcatttttgcaagttaatagctaaaaacggacgtccgattcgttttaagtgcataaaattaccatagactcagtttaaaattttattttcccttttcttacggtcagtctgaggactattgccaactgatcaatcgtcttgcaatggctaccgaacgttccgtggaatttcgcacttttgcccccgaaaaaatcctacgcttccgcgcttatgttgagtcgcctttgatcaatgagcaatgtcgccaaatgtgtgaaaacaacttcaaattgatgtacatgattgctgcacttctgtcccgggggacggtggtcaaagactatttgctggccaccgaattggaccgtgacagatttgtgggacggtgcgcaaacgatttccaaagggacagagcggtgaatttaaataatttttggatttgtttaaatttttacaacattttacaggtcacattggatgtgttggagcaggtgctggctgagattgacaagcgcttggattgtttgcacccgtccctaatttacgattggatattcaaaagagtcaaccgaagtgccgacgcaatgcgacaaatccacgacgaaaacaccaaggagggttatgttcgcatcagaaaagtccgtctcatcagtttttgacttataatcatactttttgaggtgctcatcacaccgtcacggatgctttttgttgcgcctgaacttttgatgggcaacagagtgttgcgcatggaccctaagaaatatcccctggacaaattcttgcgtgtcgttttccgagacgacgacgggcgaccggtccatgcgacgaatgttggttcgatgctcatcgaccgattcattggctcgaaattgcgcaatagcataaccgttgccggtaactgtttacaataaaagccaacattattctaatattttgtttaaggccgcactttcaattattttggttcgtcaaattcgcaaatgcgcgacaacggctgttatttcatcagtgcttctgtggaagagatcagagagtttcgtaccaaattgggctccttcaaaattcagtcagctcctaaaatgatgtctcggctggcgcaatgcttcacacaagcgagggttagcaagcgaaatttaaaaaaaaatagagattgtgatgggagttttgtttttaggaaaccgggattgagttggaacgccgtttctacgccacatcttttgattatttgggtgggcgggacagcaaagacgagccttattgcttctcagacggagttggtcgaatcagtttcgaaaccgcgcgngaattgagccgcgaattgaaattggaagactgcactccctcgtgntaccaagtgaattcattncatttttanatattgaaaacacataattttcagatccgattcc

SEQ ID NO: 8935 - DNA, 1172 bp, Heterodera glycines
tatcgggcgaattgggaacgcctttctcattaactcagatttgtttggcatcaaaagtgaagtctgctaccgggtacaaaaaaaatatttaaagacaaatttacacaataaatcatttagattgcctgtaagcacatggaggcggtcgatttcccaaagactggtgtccctccgaaaccgctaaccaccaaatgggagactgttaacccagaaaacgaagatgcacccgccaagcctacagcaattcctcccgagcgagctgaacgttctccggactttatggagaagaacaatgaacccatgcatgtttctgtttatttgaccaataatctattggtgaaaattcaggtacatcagttctcgattgaatggtcaactttacaggtttcactcgacaaatatttcttacaatttcacccatttatatcattacttacagacgagccagagaaattgacgacattttgaccattgcatctttcgacgatgagttcaccgcggtggaagtggaccaattgttgcaatggccaggctgtgaagataaggaaatattggaagtggcagtgcagcaatacgaagcttactcggccaatattcaggtcggtttatttggaaacatttcgttgaattttttatttatatattcagaatattttggactgttacgggataaaaactgagggcgaactgttctctggtcatttcaccgctttgcgaaatcgaatcagcgagaaggacagtgacgacatggtgggtatttttggggggtttatcgttgtattccctttgttttttagtctttttacaacacgactaatgcgattgaacagcaactgttcagtgtgtttggcaaattcagacgtcagtttttcgaacttctattggaaggccaacagaaccgttacgaggaagtgacggtgccggtgtatcgttacgtgcgcaccaatggggcaaaggtgttgggtgtttggttattcggttattatgattagatttgtttaggaagtttttcgtcgcatttgtcacgatccgtccgatgcttacaaaaagttggcttgcgcttactacaaaatttcatatggtaccttgtcaattttaatgatatttttcggtttaattgattaatttctttccattagattccacggttcgtcgattactttcatttccgt

SEQ ID NO: 8936 - DNA, 2325 bp, Heterodera glycines
ttagatccacgggttcgtcgattacttcattttccgtggttggcttgggatgtgttgaacgttgtgcgacggaccaactcagtccgctccaatttgaatgccgatcagcgcttctcttttgacccgctttgtgaccggatcaatgttcatgttgaagaatacattcaccaccggaaaaagcaatttaggtcaaaattgggaccataactgttaattctctacttaatttttgcctaaattccaggattttaaacgaatttatccgccatccagagaaagcctcacctgaagaaataaagggttatcaaactgttcagctttattgcaacaaatacaaaggtgattttaggttttattaagacacaaataagtagttttgtcttaggtcttgacaaattaatgtttttcgctaaaaaatgggctgcgctgaaaggtcttttggaggaaagcagtccgttgaaggatttgcacatttgcattttggtcattcaatacggactgaaccatttgccctgcgaagcgattgaatcgtcgcccaattggcttgaatttgtttgtttaaatttcattgtcagcctttttatgcaacatttgtaagattgactcttctactcattgcaaaaaaggcccccaaggcatctcaatcaacttggagcgacaacatggcggcgtggggaagaagtttttgcgttttttggagtttttggcatcccgtcagttcactttgctgccttttgtggatttcaatgaacccggaattggtttctcttctgtgctccagcagaatcaattgttgcctcttcacaaggtgccactgttggtgaattatataagcaaagaatttgttattcaggcggcacttcactgttaccatcaaattgcgtttacttttcgtttcgagggattgccaggcaccaaagaccaacgggacaaaaacacgagtccagtgcagcaagtggtcggcttttactttaacatcatatttttataattagatccatatttatcccatatactagtaattttatttaccgtttttcagcgtgagggtgagccgttcataatcgaagtgcccgcatcgcgccagcaacaagtgatccacaaccaggacttgttgaacaaactgtgcgagaagactggctgcactaatattgtattccgtgacttgcccaaatataaaggtgcacaaattgggaataaacccatgtatttatcaaatagagttgttgtttagattatgacactgttcgactttatgtgtcatcgaccggaacaatggaagcgctgaattcattgcgcgaacttttggctgtgcgagcaccgcttaatcttcagggcgattgtcggcaaattttcactcagatggccgagcaggtatttcgctacatcatcatgtgttggttcgacaactccctttttagcttttcgatcgcctgatcagtctttgaggggcatttaaatttgaacggattaccgtgtttgaccactttccgtgatgaaattcagaattctttacattcttatattattctgtattctgttgctattttttgccgggtccagcattttctcatcaatgcctcaattttttcgtattctagagaatatacatatgtaattcatattcaatatttgatcgggtattcggtattttattcaatttgatctctttttattcaataggtgaaaatacctaatcacattgacgattgataaaagacaaacaaaacaaatatgggtaatttgtgggtggaatgggaattaatggacacttaagattaatggcatttaaatttaaaatgcaaaaagagtctcggaatcgatcgtcagtttccagttatgccgtagcactgtcaacgtggtgcatgtgtttctcttcatagactcactgattaaaataacaaacgcacaaccgactgagccatgcagcacaaaaaagaaattttgaatagaaagttaagacttgcgttttacttggtttaaatatcccactttttaaatttttgttctattatttgaatctacttgtttaccttttaaaaatgctaattggagcatttattatttatttggtcttaataatttgctgtaaaattttactagataatttgttaattactgcaatggacagaaaaagcaacgaaagtggcgaggacgacacatctcatgctgatgatgagcaacagcaacaaatttctgctcctcaaaattcgttggatgtcaaaagagaaaacatttcggataaaagaagcgaagaaaatggagcaattgaggaggaagctaggaggtggacgagctcataaaatttgacgaggaacgggagga

SEQ ID NO: 8937 - DNA, 5316 bp, Heterodera glycines
  misc_feature (14)..(15): n is a, c, g, or t
  misc_feature (34)..(34): n is a, c, g, or t
  misc_feature (69)..(69): n is a, c, g, or t
  misc_feature (84)..(84): n is a, c, g, or t
ttggattttgctcnnccataattgtttgagtacnccaaacggacactgaaaaaaatcgatttttttatntcataaatatttttntagaaagtgctctaaagcgcaccaaattttatttacaagttaattttagcactctgatgctttagtatcaaaaaggaagatggagaaaaattttttcaaaaatttttccttatattttggttatatcgttttgcttttgatggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaaggcccccgcgggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactcccacaataaaaaaatataatatggaaagacagacttttgactagacaaggcgccaaaaaatttgctttgactgggccgcaaatgtgatgcccacaaatataagtcccacaaattaaaataattcggaaacaaatatgaaaaattattttgaagcaattcaaaattagataaaattaaagccaaattgagatatatttaaataataccttccgataacagaaaggcacagctttagtccatttctaaattaaactgatccaaaatccgcaatgaatgctaactgtttaacaaagtgacacacttcaaacattggcaacgtctcttggctacatgcattcgcacaaatataaatttaaaaatttccaccgataagacatcttcgagcgaaagagttgaattttaaaaaagcaacatatagacaatacaatttaatcttaaaataatcataatataagtaaaatagataaaaactaatatttcaacagtcctaattaaatttatcgttttaaaagttcttcaatttttcaagttgtcattattctatttaatgttctaataaaaatttcacagaaaagataacaattaaattaaaaagtgtgttttgagtttatatcagtttttttatatattaattttggatattcacatgtttgtcatatgtgcgctaattacaatagatatggcgacaaaataacaataaaaaaaataatcagaataatttaaattataaacacaatttttattaaagtaacaggaatatcaactttcctattcaaaaaaaacttttaaaagaattgaattaattgcataaaatacattgcacagttgaagaagttccagcatggagcagcaaattgtgccgcacgcattgctccattagttataaaatgttaaaaaaattcatacatgcattgaccaatttggcacatattttcataattttgggtaattgtgaaagaataattggaaaaataactcttctggtagtaaaaacttatttaacataatttacttttttgttgtgcccgcctgggcttgggccacctgttgaaagcacctccacggatttcgcccttcccttctcttcccaatctttctatctctctctctctctctctctctgttttctctttatttctctttctatctctctctcgtgcattactctttctctgattgctccatcccaaaatgttgctattgtccccgcccccgcccctttccccaatcgctctaatcagatttaaggggagtgatgttgggatttgagtcagttgttgatcactcggccattttgatcattcaccatttcccttgccttttgctacacattctggtcaataaaccttttgttattggcttgacattttggggagcagcattttgggggagggatgcgctctcccacatttcaggttctgcctgaaatgctgggagggcccaacatccctcgcgtatttccccgcttattatggcgctcctgggtggatgtggaccattacaccgtaccattcccatatatatatatttgttttgtttttatttttcgctcattttcacatttatcaaattccaattaatttaattttttttctcattttaatccctttttgtccacaatgcaaataaaaaaataaaataaaataaaataaaaataataataaatataaaatacatttcacatcatttgttctaattaccatatatactgcatttccaaatttaattattgactaccgtaaaaatccattttccacagttttctaatacaccaattcttccaatttccaacgaatttttcctctcttcgccatatttaattcgaaaatactcaaactataaccagcaaattttcaattagcaaagtactaattcattaactaaaaattaacaaatcaattcaacaaattatttatttaacaaatgtgtaatttaataaaaaaattaacaaataatcggcaaatgcttactaaagaccactaacaatagtggcctcatcaaacacagaaatgcgcttacggtcagtgagacggcggtgacactggtcacagtgaccaacagttttaaccggcacaggacggttacagcgaccaacaagcaagacggacaaaacaaaaagcacaaggacaaggacaaaattcaacacaacagaggtgtggaaggcccacgctggccaaatcggatcgtcagtacagtgcggcatgtcatcggcacacagaatgggctcctcccactcttctaagccaaaacagcgccgactgcaattgtggcccgaacagctgacgcgccacagttcgagctcctcgatttctgttaaatcgcttaataacacatgctaaaaatccctttccccctcgcctctcttctctcattttttccttttctctctctctttctcttacaccatttcccaatttatcgtaccgtacattcgctatcccatttgaagtgacagccgccccatttttgagcctggaggttggtattgatagtaaggaatttggccaggaaaaccccaaattggtcccggaaatccctgctggattgttggctgagttacagcaggttgtggaattgcttgttgtactatgattggctgttgagctggaagtggctgagggcgggcaagtgaatgcattgcttgttgctgtatggcagcaccaccaccatttactccagttcgcgcattattttgcatgacattttgagttttttgggcattttgcgcaggtacatgttggacgagtaattcaggagtgatgcggttttcaatgggggttgaggttcttggtacaatacgtggtgaaagagtgtgagttatgcgatggccatcaaaattttcgtttctcaccaaccattcctctctaccaacgttgaatcccaaattttgaaaacacaatctcaaacctccgcgttgtggttccaaattttcatcgaccactgcctcattctgcctctgctgctcatttcgtacacccgctggttccacatttaaaagtgcatcggaatttgttccgagtccaagtttcggtgtgatgctgaaatttctccctcaatcaaagaattctcaaaaaccccattgttagcggtgttaatcggtcggttttcaaaattttctcgctcttcctcgtcaatcagcgcctgttgattcaatgcttcttgttgcctccgaagtctttgtctcgtcagtggtggagaattaggaaacattgtaacgtttatcaacacgagataaattgagaatttccaaatttaaagcagcacgagctttttacaaaaaaaaattcaatttggcgaagcacaacacgagtgcttttggcgagaagaaagttgtaagctcggacaaaaatccgaatggagtcaacccgacacgagggttatcaaaaatttttgtttggatttttcacaacaaattttacgaccgatgtttcccttcaattgaaaatgccactaagccagacctttgtcgtccaggagcgccatgttggaaagtcaaaccaattcttcttcttttggaattaactttaacacaatgcgagaagaccaaattggaaaatgtctgagaatcggagaatacctgcttttgaataaacacgacaaataaataatttatgtgaacaagaataatgaaaaacaattccaaataaaagacaaagcacaaacgaaagaaaatccaataattaaaatccacggccaaattaatatccacaattaccgaataaacaccagcaagcgaatcatcaaatcaaaagaattgaggtcatttcaaataaacaaaacgccaatcaaatataaaaataaaaagaagggtccaaataaatccaataccacaaaaggtaaataaaaaatcaaggttaaaaacaaaaatgctataataaattttgaaaaaagtattagtattaacatgctatactgtttgttcatgaatatttatttctattaaaaagccaatttgtggtttaatagtaatttttattttgatgaatttcaccaataaataacaattttttagagataaaaagttgaacaaatttttaataaataactgtacactttcgatagcaacaaaaaattcgacaaataaaaaagtgtttattttaaattattattttttcatgttttttaaaatataagctttcatttttcatgaatttaaaaaaaaaaatgtatttttttttaaattttaaatacccggttttaccggacaccttgagccggtttaaaaatgagaacacggaccagacccggcttttctggacccggcataggtaattagcaaataataattaattgattaattaaatatcaatcaaaaaatacttgaagaataatattatttataatttgaaataaaattaaaaaaatgtatatacaagaaattgtattaaataacaatatataatttaataatttagtttttttggttgtaaaaataatgaacatgaatactcaatcagaataatgaaattgaaaaaataaaaattttatgtaaatattgcaagaataaataataaattagtaaatatgtttcaaacctgaaaatataaacaaattttacaaacaaatttaggctttcagtgaaatacaaaaccgggtgcaaaagcgagaaaataaaa

SEQ ID NO: 8938 - DNA, 5059 bp, Heterodera glycines
ctgagtttttccggaacaacgatgaacaattggaagactattttgttggggactttgggcgaagtcggtttttggcatgaaaaggattaattgtttttttttgtagtcaacacgaacaattatcagcagccatttcgacggcgcagaagagaggcgacttcggcaattcgcaacaaatacaaataaagaacagaagattaattggataattatttaaatcaactttttgtgtttgaagtttttctttgcttctgatgtctaaatgttattttctttaaaattcaccgcaatttatttgctgattaaaattggtttgttccataaatatccatataaatgtgaatgcttgaaatagtcgctgcttaaaatctttgttttagatgatggccaacataaatgaagataatacggagtctgaattggtgtccattttgccatcacttggaccgttcgactcgtcttttggcattttgtctgattgttgttatggtcaactgatcttgcttgggttcgtttaaatggtctatgtaacgaatgcatttaaaaatttatttaattatctttacgcgtattttatttgtcctttttgggtcaatagtagttcgtataatggcagttcgtacaataggatggatgtccgtacaatgtattgttattttgatgaaaagtatgtgtcactatcggaacccgtcagtttgaccttcacggttcggccccagcacttcttcccactatagctttttattttttttattgagaaaaattgaaaatttcgactttttttcttgtgtaacttttttggtaattgtctaatctcggagcaatagcttagaaaaagcttctaaacatgttaagctttcaaataataccaacaatgttggatttgcttgataacgaaaaaagttatagccaaaaacttgggctcgtacgaaaccgaccccgacctggggccgaaccgtgggggctaaactgacgtagactggtcactatatcacatatcttttaaaatttgattattgtacgaaacgccaaattgaaacattgtacgaactggcttttgtacgaaactccattgtacgaactgcctttgtacgaactgccatgaccccgtcctttttggttaaaggtacggcggtgtctccgaaacatacagtaaccatcggagcactatgaacggtaatttatcaccaaaaaagcgaaaaatattattggcagccacagactcttcaggtcgaaaacattttgtcaaaatgtttttcaaacgacggaaggaaccaaatggaattcgaaaggggtcggcgatgacattgagcagaggagcgaacgaagcgccggcagtaaaggacgccacacggcacaccgtttcatattcatacggaaaatcgggcacagtactggtggaatatttgcctgactcgagtcgcgacatgtttcaagtgggcccatggggggagaacggagagagtaaaccaaagaatggacaatcatttcgccaatgtcctctttgaggagggatatttactaaataaaacgctttcgcattttatttttcggatttgccattcattctctgggtacgtctccgtgtgctttttcctctctcaaaaccaccaaattcgcttttcaggtcggacgctcttctgaggaccaaattgactttacgattgtggacacttggctggccatcggttcctcaaatgtttcctccccggccgggaacagtgcgcgtcatcttcgcgacgatgtcaacggacaaaagtccatctcttccacaatttcgcgctacgcctgcagaattttggcagatcgtgaccgtccaaataaggccttcatttttgcggctggtttcaattcatccaaaaatgtcctagtgaaataagccactcaaattttgcgaatttttcagatatttttgggagaaaaagcgacaaaatggcaaaaagcgaacggtgaattcgatggtttgacaacaaatggcgtattaattttgcatccaaatctgtgcaataaaagtgccgaccatgatcagatagtaataaacaggctaatttccaccagtcttgcttttgaattcagaaagttttcaacgaacgtttattgtggcgcgaaggtatcttaattcgattgtttattggaacgggaatcatgctaattagtctcccctatcgaatcggtcccctttctcgcccatctatgtggggggggattgggatactgaaagcacttgatgctatttgttaagtttctgttgatggtgacatttataatcttcgcgagactcggtcatccatgcaaaagggcactttggccatgaatgaaactaacgagcttcaggttcggatgtctcattgtcaacatatcaattcgaaatgggcattttttcaggatgggactctcatcgatttgtgcggcgccacccttttgtggaggtcggccgaagggctgaggcgctgtccgtcccgggaagcgttggagcgtcgtctggacgaactgaatgccgggaagccgcaatgtccggtcaatctgaacacgctggtggtccccagaagaaagcatccgaagaacagctcttcaagcaaacagccatacgtactctgctggggttgcggttgttcgtttgaattgttgtgcctttttaggtgtatttcgggtgtggacacgttcaaggcaaacacacttggggaggtgagtcggcattatgccagtttgtctaattgtttttaacaatatctaataatagtcaacaaatgcgggtcaataacgacattccgttgtcccatttgtatggtcgactcaaaaggggtcgccaaactcgtcatgggaatggagtcggtcttccatttggactccgactgcctcaaatacgccttcaacccatgcgggcatgttgcctctttccgcaccgtcaggtgacattctctccctctccttggtacactgtaacactcgtttttcagtttctggtcaagaattccgcttccccacgggacgagtagcttcttccccgtctgtcctttctgcacttctctgctttctgccgaaaaaccattcgttcgtttaatctttcaggacaattgtggtgagtgattgtatggtcccctccccctcctttcccatgtgtcgtcaattgtttttgaaattccattcgtttatttctattccactttcaacttgtccgcttctttaatgacctccctgttttatatgaccagcttattcagtacgatttcacggcatcttttaccaaagttcgcagattcaacgcattgtcagtgggaccgaaaccaatagaaggcataaagcaaaatttaaaaccccaaaattaaatagacaccaaattccgacttttttatcaaaaattaagcggtggtcccactacagagcaattgatgtacgtaaagtgtaaatcattttttctactttcatttcatccaattaaaataaaaacccattattgtattctgaaaatctgttgatatctaaagctatagttttgtgtatttaataaagtatgccctaaaaagacgctctaaatctgtccttcttatcatattagcaaaatgatactttatggcttatatataatttttgtcggggatagtaattccagacaaaacaaaaccataagcttacgtccgaataacacagtttaaatacaagcaaaaaacaataagtgaattaataaatattatgggccgaaacttcgttttcttacatttagacgacattgtgtatatgagggttaggattatttatatttgccaaataattgaaacagttcgaaaaatgtcaattggttttgttcaattttattatcaaaattaaaaaatcatataaatcttaaccctgatcatgtaaaacaaaattatggtcggagtaataatgaaagggattttgtggtgctttgaattattacgaagtttcacttgaagctgagttttttcatacagtacgacagcccattttcttcccattcgcgcctggttacccaaaattcctgaaaatttagtttgttaaaaaaaacttcggtacttataagcactggcctcgtcccggtcgcgcatcaaatgggccaaaacagcgccacccaaaaacaccatgtgtttcctccgtggaatcgcctcgatttttgatttgaatttctaagaattggcagttttctccccctcagtcctcttcctatcaacttacctgaaatgaatcagtgttccctttcagcacacgttcaaggtaaagctgcttaagttctcgttcaagtcgcgatggaaatccgggatacattgtggtcccgccggaaaggacaatgtgtttgtagaactccagccgagtgtctgaaatatttgccagtgtcattcaaagccgtttgttttgaccgatgtccgctgattgtatgacattgaaaagaagttcggacagtccgagtttctccacattgacaaggtgtggctggaaaagcacttcgggcgcctcaaaacgttcactgccgagttttatcatgcgtccatctgggagctggatttaggggagataaatttaggaagagaaaaatgaagaaaagtgtgcgaacggtgtaagattcggtgaggacggtcgtttccagggccaaccgctgctcctgctccacgtcgtagctgaaaataccgggaaatacgcgaagggaaagtcatccgccgttcactgacgccacgtaacaatgcttctccttcagctgccgcactgtttcaaagtcagccgagtgattgaaggcatagccacggagcagaagcaactgtagaaggacaaagagtgagcaaagggaaagtggagaggtggagggagaagagacagagacggactgagagagcgaaggagagatggggggggaagagagagagtggagcagaagagagggtgaaagaggggaatggagagaagacgaaagagagaggggaaggaagaaatagggcgaaagacatgaacggatggaggaagagagagacgaagggaagtactaagcattgcttgtggaaaaacctttatcaaatagcgagtgatatctctgcctgcaacgtccaatcgt

SEQ ID NO: 8939 - DNA, 5415 bp, Heterodera glycines
tttactaggctcgcccgtggacggtgttcggcaaaagaccgtagccgtactctgcatcataatcggtgctgcaaatttatatgtttgggtcttgttttagcaaaatgctgccaaactttccgtttttcgttcgagaaaaccgatatatttctggcaaaatccaaaatttattagacgctttttcattcattgtctatggcttatgtcatttaaccaatggtaaaatggtaaatgaatttgccatcctctgcatgtattgtattaattttatcaattgtatttttctttatatttcagaaactttacccgaattcgatttttctttcattgggttggacaaaattgaaataatggtaaacaaatatatgttaatataaatttaaatatattattttatttcttataataaatttaataatttattttccaccgttttcatattgaatttggtgctgtcaaaacgttttgtaattttctcgaaaaatgggacatgcgctaaatcggaaagtgtttcaaggaataaaaaatgtgctaaaaaatgaaacgaaaagaagcaaattgatcacagagatggaggaatgcgacggtaattatcatcaattaattaactaattattttaaagaaaaaggcaataaaatattttattgggtttagggcttgacaaaattgaacaattgcaaacaaaagaaagctatgaacttcttaggatggtggtaagtgtggcacgatttttactcaaaaaaccaccaaaaatggaggcttaggtgctaaaacagccaaaaaaacgaaaaggcttcctaaacgatttatgagatatttttttaaacgcacaaattaaaaaaaaacactttttgatataaaaaaaaatcgagctgtattttctgttggccattgtttaagttacagtgcttttcggatccctaggggctcttaaaaatttttaatttaagaataaaatcgtctacttggtgaagaaagggaatctttataattaatgtgccttgattttgcttatttttaatcggaacaattcggactgaaatttggttcaataaatatatgtatttagcccagggatgcgatctgttctgatttatcagaaatgttctgatttgaagggtccaaatctgataaaataaaaatgttctgatttgtcagaaatgttctgattttggggtagcgaccaaaatttgttctgatttcttaaacaaactcataattttaaaacctcaaaccctagagaagtgtctttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgatttttttgaaaagcaaaccttctgactcaaaacacctcaaaccctagagaagtgtctttcaaactctgccatttttgctattgtgcactcttttgccgaaaacagacgatcccaatgatttttttgaaaagcgaaccttctgacccaaaacacctcaaaccctagagaagtgtcgttcaaactctgccatttttgctattgtgcactcttttgccgaaaacagacgatcccaatgatttttttgaaaagcaaaccttctgacccaaaacacctcaaaccctagagaagtgtcgttcaaactctgccatttttgctattgtgcactcttttgccgaaaacagacgatcccaatgatttttttgaaaagcgaaccttctgacccaaaacacctcaaaccctagagaagtgtcgttcaaactctgccatttttgctattgtgcactcttttgccgaaaacagacgatcccatgatttttttgaaaagcaaaccttctgacccaaaacaccttaaacaagtaattaattaattgaatataaatgtgtaaaataataataataataaatctatttaaaattagcttaaaattctcatttctgaatcgcaccgctctactctggttaaaaaatactacaatttaccaaataaaaaatattaattataaaaaaattgtcccattgaaacatctattcaactacagtgtaaaaagaatggtggtatttttgtatgatcaaaaattgtctcccgaattgtcttcatcagcagcttcctcgtccgtttcctcttcatcgacgttttcttgtcgcatctgccgatcattggattgatttaattaatgccttttttgtcattaacttaattacttttttgctctcaattaacgcccatcgtcgttttgtggtgggctcttctgctgcagctgctgttgaaccgttaccgccgccacggataaaattgttcatataatcgtcattgtcatcatcatcatcgtcatccaattcttcatcatcctccatttcaatgattcgtccacctcctagcccatcctcgtcctcttcctcatcctcctcatcgtcgtcggacagtcccaacccagtcatgttgccgaaaacgcgcacttctgtttgcggaaattgagattttacagaaaaaagaacaaccgccatagggacattgtctttacgcattaacgggaaaccgtgtcctagcaaagccgggatcgggatcccgggaaagtcccggccttcccatccaggctctaattactttatttcaacacattttaaatattgtactggaataaaaaatttgtgtccaatttttccacccacctcctggtcgtcgttgtcgcccattttgtccatactcctccaatccgtcgtctgcagcttggttcagctcatcaatgtgcagcggaatgccagcaattcttaaaaagtggctagacaaaccaattgaatgattggccaaattattggggccagaaatttcattaagcgcctacaatggagccgcctgttcgctttccatgcgcatttttcccaccatttcgcgcattgaacgttcagcctccagtgcctgctcgcgctccgcgtgctcagattgtactagacgactttgcaacgcatgcaaattgcggaacagtatcacatactaaaaatcagttcaaaatttggcatttggccaaagtacggtaattggccaactgtaccacagcgtagcgaacgcgcagctgtgcctcgtaacgttcgtactcgtccaaatagggaggacggaatgcctgcagtttggccaaccgcttctgcagttgatccatttcgcgccgacgccgttcaatctttcggcccaactcctgttcgtccgactcgatgttttggagccgttccttcacttcttcaatgcgttgttcggttgtttgaatgcgttcccgaagttccgtttccacctatgcaacagaatgtacccactgttctacgaggtcggtttactggggaggggaggaggcgggcacagtatttctcggtgagggtcaacgggccacggtacggtttttttggttataattcatttcacagttatccgaattgagcgaacttggttttgggtccggctggacatttgtctgatattttttgggtccggccggggccattgtctgatattataaaaattccaattttaaacattccccaatttctttcttttttccccctaaattaacgggaaatacgtgtttaaataggctctaaatgggaaaaagatggtgaaagtgttcaattgcacctgcgctgcgttcagcggtctgcccagtgctttagtgcgcacttcctgaacatttggtacatttatacactgagaatgccttggtttctcacttttgcaaatatttcctcccgaagcagttcatacagagaagctgccgtctttggcaattctgtggccaatttgatgatttgatggagctcttgacgcttaagcatccatcattcatttcattgtttaaaaaccaagcgaaatttaaaattataaaaacgcgaccttggcattcacttgcgagcgaagcacattgatctgtaccgggaagggaataaagataagtctttttgcttgtagatttttcaatcattttttgtttgtactaaaattttccaatagcaaattgattatgcgccgctacaaaataaaattgttttagagtgatttggacactggcagttcgggatggtcccttgtcagcttgagcattgtgatcaagattttttctaaaaaatcgctgaaagttttacaataattttttgaattgttaagattttttgaaaattaaagaaaaaatttggtgaaagaggaatgctattgaacccagctcaattagccacctgtaatgtgcctcccccgtcctccgctgcctttcctccgctcccctcggttccgttgctccgtttctgttccttcacactttcataaagcattctcaacacgggcagcagctcgcgaattgcatgcccatccgcttggtacaaatattttgggttcaaccgaacatgcgccttttgaagcagtgtgagcacaacctgtgcaggtgtaaaaatgatttatccattaatccataaaaattatttgttttaagtgttttccatgggttggcaataattttgtttgtatttagtgttgtgatttgtatttttcttctgataaatactgtattttagttttgggaagatgcattttgtgattttcaaaaacatttatttgtgatgtttggcttttataaaagtgtaattcttgttctgatttgtatggaaacacctttgatgttttagcttttcagaaacaagttttgcaatgtttgactttttggtcattgatgtttgctttttcagaaacataatgttttgttttttggaaacatcatttaatgttcttttcggaaacgatattgtattatttggtgtttttattggaaacattctttgatgttttagcttttaagaaacttgaattgcaatgtttgactttttggaaatttctttgatgttttggcttttcagaaacaagttttgcaatgtttgactttttggtcattgatgtttgctttttcagaaacataatgttttgttttttggaaacatcatttaatgttcttttcggaaacgatattgtattatttggtgtttttattggaaacattctttgatgttttagcttttcaaaaacttgttttgcaatgtttgactttttgcaaatttctttgatgttttagcttttcagaaacgagttttcaatgtttgtctttttggtcattgatgttttgcaaatatttattgcagggttcccatccgtccttgaaatgcaaggacgtccttgaaattgggccctctttcttgaaaataaaaaatgtccttggatgccaaggacgtccttgaaaatgaacatttagaaaagttttaaaaaaattcaaagaaatttgagaaatctttgtaattttca

SEQ ID NO: 8940 - DNA, 2540 bp, Heterodera glycines
aatatgcggtcggggtcgtttttccgccgccgttttcgctgccaggaggttttcgcgccgtcattctaaattttttaattatatggcaaattatgcaaagaatggtcaatttttttattggtgtttttgtctattaatcataaaaaaaatcaattcaatttactttattttataaaattagtcaaagatggttaaaaaaattataaattgtataaattttttgcctttatcccacgaatatgccattcttagtcggtgtattttcactcccgcacccccgcggggggcgaaggtcgcgggggtctgagtcacgggggtgtgggtgaggccaaaaaacctgtcctgtcctgactgggggacgggggcggggctcgaaccctcgttattaggaaactatcggaattaaatttaaaaagttttacatttacttactgtaataaatataaaaataaataaataatttataatgtgtgggttgaaccaaggcaaaaatcaaagaaagagtggaggtttaaccacaaggctaagtttctcgttttttaagaaacacagacgccataaaaagacgaaaatacaaaaaacacaatcaaaattcctgttaaaaagcaacataaatagtcaaattttatgcactgggcccgttaacaaatttcactgccaatctctctcctcaaccctcggactccttcgaaaaatcttgccgatccattcattacccccttttaataccctaacaattttttaaagaatcttttattcttgggatctagcaaattttagctggtgatttgcgggtttaatccagcggaccttgccccgcgaaaaatattcagttgaaatcactcaacgggacccgcaaattttaaattccaggggccttaatatttatacaaaaagtcaaaaagtattttgcgttttgagaattgtaaaggcaaatttgtttattatttttatatcaaaattatttcgttaattattcatttcactttctctaccatcatcacagctcgatcagataaaatgtgaagcaaaaaaaatatttgtgcatttttacaaattaacattctttggtattagtcagctttggtgggaattgaattcatttggctttcggaaaaataattattttattttaaaaatcatatgagttggttgacaaatgttcgttattattacattcattttccattaaaaaaaattttaacgaaatcaaacaacgaatataaccagtaggtctccactttgcaaagacaaacaaaatttcaatttttcgaaaatataaacttagtcatcgtagaagccaaatggataggcttcttccatgcttatcctcaacgtaccaatagcgaaagaaatttcaggatttgctgaaaatttttttcaaagacattataatgacacttattggagcactggacatgattctttttgcctacggggttattaccctgttcggacattgctcaggtaattgaccaaatttttttattatttcataagcaagtataaaagtatttaaattgaaaggattgaagtgcaaatccggcgctgctatggacgtgacgggctattcgccatacataaatgccacaaccgaacaatgcaaatttgatcggcgatattgtttggttgcctactgttttgctggtgaatgaattttgaatattgcacagtagtgatcggatatgtggtggacccattttcgtgtgacttttgtcacaattcccgtgaaccgaccgatctaaaatttttaccgtatgctaaggaattgataaaatcagtacaaatatgataattcatgtcatgtcacaacatgtccttaatttatttttcactctcttcaatcttttcggctcttattatcattttttcagtttcttttataaaaaaagacaggcgcttgaaaaatttgaaaatctgagtttataataatttttcgactgaatattcggcttgtcattggcatctactttgtcttaatatttttagaactcagctcgatttgtaaaaatttcagttttatctgtttacgggaagatcacgaaaaatggtgtgtccttttgtaaaatacgatacagtaagactgactatatgtaacaataggtgacgtggaggccagaattttgtacgttcaacagggtcagatcatgtcccccgtatactggtgttgtgccaaatccgtttttagcgaagcaaaattttcacgagaaatcaaaaacagctaaactcctcagcttgagaccaaatcagtatcgagaatattcccatgagagttgagctgagactccaaaagttactcgtgaattcatgacaagagtcaaaacaagcggatcagcccgtttttaaattaattacaaattgatttagagggcaatccgtctttcgcagtcacttattggcaatgtcattggatcaaagaaatcgaatactgtcccatttttttccaaaacgttatgaaaaatgagcttaatttgacaaattctcattgcacatgcgagtatggcaagccgaatgaggacatggccaatgacaaatctccg

SEQ ID NO: 8941 - DNA, 1132 bp, Heterodera glycines
catgaaaagctttgaaaatttgtgggttttgccattgaagcaaattttttttaatttttttgatagaaatataaaaattcttttaataataatttcatatagacatagtgtcagttcactgaaggattttcattcactctcagattgtccttaattaacggactatcctcttctggtggattgtccttaattaacgcccctctctcactcccccgaaataggcaaagctaaggcgaagcccccctacttattgtcaattagtatcctttttgattttctaaagcagattaattgttttctctggcttttttttgcattttgagtcgactttcataaaaatccagttctagtctttttgtcgaccttttcaaatcattcctttttcttcttgtcaatgttcatttttatattggatgttttcttcctatctttgtcctccttcttctggtccgtttgattacttccttttgtcttctttttgaatttgtccctttcactccccaaaagtcgcaccacggaatcgagcacccatgcgttcttaagaaagtggttttctttttcggcacgggtttcgcaaggaggttcgcgcaggctctttctacgcagaatgtttcggcgcgaccagaatttaatttttaatttttatattaaaaatatttttaatttgttaggtggtagatattggttcagtccataggagtttttctggattaaaaaggctgaaaaagaacgctatgaacttttttttcactgctggcgtcataacccacatatttatattatacaatagttcttaatgggctctccaagttggacattttttaggtttctgaaaaatagactcagtttctcgaaaagaatgaaattttataaacatattcattcagtattgaaaagaaaaatcttagtttcaaaaaaatattcaaaaaataaaattttgtagtaaaaaagaacattttttaaaaatgaatgcgcagcaattgcacataaattttcaagtaaattaatatcaaacattactcataatcattttacgcaaattggactgcaaattagcaaactgtacatttggggcaagttttttagctgtcaagcattgaaatgagaaataatttgcaaaaggaatgatcag

SEQ ID NO: 8942 - DNA, 1759 bp, Heterodera glycines
  misc_feature (8)..(8): n is a, c, g, or t
  misc_feature (1692)..(1692): n is a, c, g, or t
  misc_feature (1708)..(1708): n is a, c, g, or t
  misc_feature (1717)..(1717): n is a, c, g, or t
aacccccngggcgatttcagtcccaattcaaaaaccaatctcttcttttcaaaaatggcacacaactcaaacaacaaacacaccaaaaacaggtgatgaatgtggtgccacaaccagcagcactgtggagctgaacaaagcgccgacgctgatgagcaaaatcatcaagcaaccgttgggactgactcggaaggttcaggtgtggccttcttcaccaaaaagcacacattttgccaactgagcaccaccgatcgcacgcgccaaacagggccatcagcaacacacactgttcgagactgaatttgttggtgctctaaacaacttcctcgcgattgccactctggcattctcagtctcggacagtgtgtttgtgtgtggcccgttggcgccggcactttttcgttccgtactcacacgccgcacacaaactgtcaaaagcgcctctttcatgttaaagcgttaaaacgaatccttcgctttctccaatcgctgggagctgctcgagacttagggaaaatatttaggactcagaaataagtaccgtatgcgtcatttaaaagattcggtattaaaaactatgcttagagcattgcgtacgtatgaaagtctactctcgggactgaaattgagtgtcgagactctcgagcagctgctgtattcgctgctttcttaccgtatcacacatcctcttgacccctctttcccaatggcttacgcaatcacaattttgttcattctgagcgctacaaatttgagtactacttatgccatctccccatcaacttagttatctgatgagtcattcatttgccaaaacctgttggtcctcacaaaaaaacaactaaactaaaacagcgttcctccggcacttttgttgcgaccgactcatcgggcggcgctcagatggctcgccagctcacagatggcactggtggtgccaccaccaagcgtggttccgcctcctcactgctcaacctggtcagcgctcatcaccgtggtggcgaaaagcgctcattccggcacccctctgtcgtgcagagcaccagcgccaattccaccgccgccgcgctgttggacgcgcagccggcggtgaccgccgccggctcgtcagccaagaagcggagcggtggtagcggcactggcgctggcggcagtgttaataatgcgttggagcggctggcacgtgccggcggtggcggcagtgttaacaatgcgttgattgagcggatggcacgtgccggcggtggcggaacggctggcaacagcaaaaaggcatgaatgattagcctgatgacgcttgtctgtgcgtattgcgtgtgttgtgtctggcggctttccatgcttgtgccattgaatgaatgcgtgttgaatagtgccaaccgccgcgatggacacgatcataaatcatgagcagtgaatgaatgatgctaaaatcccctaatttggcatttatcttcccttgccgtgacttgtgcattttttgcttttaaccttccgtgccgtgccaacgaatgtataattatttcatttctttattttacccattggcattcaaaaaagtgcaaggaccaaagaaccgaagtggttattcgccaaaatgccaatgttgtcccttgatcagcttattggcactttgtcccctgcattaatatgtcttattgtcgctccttattttcttggcattggcatttntctttagtttgcctgnatttctttntgtttgcctgtttctgctgttgcctattttgctcattttttt

SEQ ID NO: 8943 - DNA, 4601 bp, Heterodera glycines
atccgtatttatcgtatcgctccttcccaaatgtgaattatgtccttcttttcccctgctggtgttgctttgtactgtcagggcgttaataccgtattatatatgccaccaatcacctaccgtactctcagtttttgtttgtagattctctctcccccacagcgggtagtctctctttttgtgatcggtgatctccccttttccccggcttttcctccttttatgtgttgctttgatcagcaccgattgatcacttacgtgttaaaaattggcccgccccttttaagccggcactgtccaaggaggaggaagagctcctgttcaagatggtcagtgatcaggaggaggtttcttctgatcaccgctttcatgtgcccaaacccttcattttctcccactgatcagattcaagaaacgtaccgttacccgggcgcaacaatcaacatccatccgttgctttcatcgttggtcaactatacacatcccatcaaattttcaggtgttttttttgggctaaatgtgcgaaaacccctgaaaatcccaatccccccccccccccctcaggacggaaaatccattttttattgggcgatggctcttcaaaatgccattttaggcggggaagggtgatttgaaagttcatttaaaatttatttaaatgtagatggtaaaaatcttaaattgcatttatgtcaatgaacttgggaaaaaaattatattcacttaaaattaaaaattattttttttcccgtttcaggctttgatgtggctgaacagaacgatttgcactttcatatgtcgtccttttcggtacaaacagttttaagttgggggtcattagtaagacggggattttagttatttaaatattttttctacagctttattttgatgagaaatatacgaaaaaaaacatcatttttagcggtaaatgtggttcattttaattatacattatgcaaaactagagtgccacgggaccgggaattttgggcaaacccgggaccgggaccttttcgggttgaaaaccttttcgggttgaaaaatcgggaatttttggctgggaaaaccgggaaaaagccgggactagtcccggtcccggtcaaaaccgggaccttggtactcagttgtccgctaccaggtcccggtcccgtggcactctatgcaaaacataaaaaaaacatattgaacggttttcataaataaaatattaaaaaaatgttttatttttatcaatacatttgtaaatattttgatattttaactttttatcaatattctcataaaaatattttggcattttcgaattttttgagaaattccttaactaaagtgtaataaaaagagaaaaaatacagtccctaagaattgagttttttgaaaaaaaattcaatttttataaaataaatctcagccttagtcatttgcatagcaattaaaagtgattaattataaaattaattagccaacttttacatattaatccttttttaaaggaaagcaccggacttggactgcttaagcagagtgcactggaatttgtcaactacaacaagcgccagctgagcagaatttaccctaaaggtgcacgggtggactccagcaattttcttccccaggtaaacaaacaaaacacaattgtgtgccattagtgaaaaatcagtctcgagagtctcgactcgatcgtttttttttgcgcatattttggcagtttatacaaaatttgttttcgaattcacgaggaactaactgtctattaaagctcaatttttaagattgaaaattatttatgttgtataaaaaaatagttgaaacattgatttatctgatattaccaatttaattaagttaattcccttaatttaatttaataagacaatttaaatagggaaataaaaatatatattaattatttttatgtatatttaattgagcggtttatggcttcgattcccatttattttagtttaatcaccatcgattaattaatcaatcaattaattaattaatcattccccgggctcagattttttggaacgccggctgtcaaatggtggcactcaatttccaaacgccggatgtgtgcatgcagctgaaccagggcaaatttgaatacaacggccaatgcgggtgcgcgttgtttcgcccatttttttgggaaatattacgggaaattttaaaattttaaaaattggcttaatttttgcttgaaattttttctacccctccccccgttcattttaatttttcttttattttgaattccattttccctttttcaaggtatttgctaaagccggattttatgcggcgtccggaccgtacatttgacccattttccgagtcgcccgtgggtgagtttgtgccaaagcaactaattacagaattaaatacctaccgtatttgttaagaattagcttatttggggacggggacaccttagtccacgccttttcaagcccagtcaaaatgccaaaaatttataagccccccccccaacttttagatggcgtcattgcggcacattgttccgttagggtaagcagcagctgcctcagcaaaaattgtcccctaaatattttccgtttttttcagataatttcgggccaattcctttgtgagcgtaaaacgggtacctatgtggaggtggaaatgtaagaaaaaaaaattttcgatgcctaattaattattttcaaaaaatttttttgcataggtacggcttgccgacggacaccatccgcaaggagcacaggacaaaattggtgccagcaaacgggctcaatcccatctacaacgaagaagtgcggtgaaattaatgggcacactgacctccgctcttttttcttgaagggcctagttgaaatggattttattttgaaaaaaaaagtaatttacaattttcctcaaaattttatattttccaaatttttcgcccatctaaaaaatacaaaatttttcttcgtgcgccaagactcattacagatgagagtttcggaacaaacatcattattcccccctcccctggggggggggggggggatgaatcgtcggcgaatagggaaagatggaaaattaatgaaaaatcaaataaattttaaaatattattttacataattaaatccgctggtttgattaatttgactttgtttgatcacttttaattttgatcactaactaaactgatcattttccctaattaactctcctccccccaaatatttcagccatttgtgttccgcaaagtgatccttcccgaactcgcggtgcttcgtttcgctgtgtatgacgagaacggcaaacagttgggccaacgcattttgccgttggacggcctccagtccggctaccggcacatttcgttgcgaacggagcacaaccaagcgagcacgttgcccacattgtttgtgcatttgcaactgaaaacctatgtgccggacgaactgagtgtaattataaaaaaaaaaattggaaaattatgttaattttttgaaaattttttcaggggttggtcgacgcattggccgacccgaggcaagtttttaaggcttgtttgtcttaaaaaattctgaaatttttgaaaatcagaaaaatggaagcctaattttagggctaactttttctttgttttttttttgagtccactctaactttgctagatatttgaacacttttagaggagttatttatgaatgtttgggatttaatttttcaaaaaattattttaaaataataatttaaaaaatgcaaaaagtggcacaatttccaagggcttaaaattagcaaatgccaattaattccgctttgtttttccgcatgtaaaattttaaataatttcaatgaaaaaaaaaatcaagaaaaaaacaaaaattcatagagaaactaaaatctttttcggacttagaaacggcggattaatgggggataaactgactattaaaatttcccttttattaattagttcctaattacttatatgtccagggcatatttgtcggcacaagaaaagcgggaagaggcactgcagcagatgtgcgtggacgagctggacattgtggacgatgttgtgccgtcctccaatcagtcccagccgcaacagcaacagcttggcgtcggcgcccgccgggaccgaatcggcggcgccggcgcggacggcgtgccgttcgactcgaacaactctatccgacgtcttcagaatggttccacccgggaccatcagcagcagcaacagcagatgaacagcgtgcagactacgggcacaataattgagtgagtacggcataatataaaactgtataacaatgattgagataaatgggggaaggtgacatggtaaaattaagacaagatgaggcacacaataattttctgtacaatgacgatatggcacaaaacgatacgatataaaacatacaaaacaaatacgatacacattacgaaacaatactatacatatatgatacagtacacggtacaatatacaaaacgatacgatataaaacatacaaaacaaatacgatacacattacgaaacaatactatacatatatgatacagtacacggtacaatatacaaaacgatacgatatgacattactctaca

SEQ ID NO: 8944 - DNA, 5545 bp, Heterodera glycines
tacgacggcactagagggtcaattcatcgttttttggctgctttgatttggtcagccgattcttttcccgatcagtgtccatgatccatgatgatccatgtcttctctccatcccatttcgctgttccttttctcagcttgtcctccacccgtccgcctccatgtcgggcttgttcaccgacttggaatccacccggcgtggactgctcgcatttgtgggccaactgaaggcgggcaaagggctgacgcttgtggccgaatgtgtggaggggaaattcgcccaaatggcgggcggcgaattggacacaatccgacaggtcgacaaacaacactgtcaatgcaatttttggcattgcagagctcggtctcgaatgcacagtgtatgccagggatggcacggaattctgatttctggcattttttgcaaggaattccgatttccaaaaaatttttggacctcggaattacgttttctgattttcaaaaaattttggggcctcggaatgccatccctggtgtgtgccatttttggtatctttagacaaaaaaagaattaatttgccgaaaaatattttttgttccaaattttcatcgagtttttgggagcactaatctaatgagcaaattaattattaattaattacccattattatttttgccacagaatttgcacgacgaagtgaaggcgagtcgcatccgcggcttctgcgacgtgttggtggccgaccagtacatccagggcgtctcccatctgatccaaacctcggggctgggcggacttcggcacaacaggtggccaatggccagaaattggccaaataattttgaaaattaaaaaaaaaacactaattggtttttcagcgtcgtttgtgcatggcctcaaaattggtcggcctctggtccggtaacattttttgactgctattttttaaaattattaattccttttacaaaataaattaaaatttgtgccaattttccaattttaggtgccaaaaaaaccagattttataggaaattttgcttgattggggtgcctaaaatttctcattttaaaattttaaattggttccgtccgttttattttttaattcttttattgcgtgaaatattaaattctcaattttaaaatacgttttctgtacacttttcagggcaaaaacccaatgttggaggccaaccgatttgccgaattggtgcggaccatcgcggccgcgggctgtgccgttttggtgccaaaatatgccagtgcctttcccagccacggggaccgactcacggggaccatcgacatttattgggtggtgaaaagaaaaaaaaagccattttaggaagaaaaaaccaacgcattttcataatttaggtggtccacgacgggggcctgctgatgctgatcccatttctgctcatcaaacataaggttggccaatggcaccgattttcggcacttttttattaaaaaatttggcattttgggaatgtttttcgagttaaaacgaattttacggagacaaatcttatttgtaatcagtcattttaataatttctatttgaaatattttaattgctttttaatggctttccgaacggatttttaaaaaaacacaaaaaaattcggatgaccacggtgggactcgaacccacaatctcctgattagaagtcaggcgccttgtccattaggccacgcggccccacgctgacgggcgttcccattaagcaaaagacagtggaataaatgtgagaaagtgtgtgcattaaaaattggaaaatgtgcgcagcggcggaaaaggaaaagcggcggcgcaaaatgtgaacaaacaaattcagacatggaaaaacacgacggtgcgactgttcacttttgcacagccggaggacaacactttgcaaatgaaaagagtgggcaaatttaagaaaagcattgaaatttaattaattttttgggccgggggaatttgcgccaaaaatttaacgaaatgccatccttttaaattgaaacttttgaagcgggaacgaataaaagccatggcatatttttggaatgtttttgtgccccgttttcatttggaaaattcgcaaatttcggttcaaaatcgatggcaccaattttatcgtttaattcgctaattgatcaccaggctcgtaatcagaatttgaaggcctttttttgccgatgtccaaattatttttacatttggaatttctttggtcaaactttcaaaaaattgagcaatattcgttctggaaaatcccaccccttggcatatatttttggcactgtttccatgtcaattccctccccttttggcatttctttttgacttttggcactgttccctccccccgtgccaattcctaaaacttcacaaatttgggcaggacttggaacgctttctgtaccatttgcgcattgaggcgcaagtgttcgttttggaaattgactccaccgaaattgagccgtacgtttaccaacggacgctgaaaattgaggagagagtgaaactgttgagagaaatgggcaccaaaagcaatgagagagtggcggacattcaggtgaaaacagagagtgggagagaaaaagaggagaaattggaatttaaaatttaataattaaacttaaatggaaataatctaaaataatcaaaatttaattctattttctaagcaaaatgtttaaggaaaaaaactatgatagaaaaaatatttaattgaatttgaatttttaaatatattttatagactaaaattaaaatttattaaaaatatatttaaaatattataagcaatagattcaatgaagtccctcatttgtcaggtgacgatggacgaggcggtgttggagcggaagtactcgcggcccgactcggcccggcgacgctcctcaaccgttgatccggacgcgccatcgcaagactcggccaaggtgggcgagaattggccaaatctcggcctctaagacttgggaatgaccactcggaaatcttggtcccgagtctcggcacaacgctcccgtgccaatcccggcatcccttgtctcggtgaagttctctattatcgacttcaatttggatgccggtgcgattctcgaccaaaaccttgcgcactaatcccgacgcaatctcggtgccgggtctcgaccaaagactgcactcttattccgacataattacccggtgccgagtctagaccaaaaatttacccctaatcccggcacaattatccggtgccgagtctcaacctttgcgcccttaatcccgacacataggccggtacggagtctcgaccaaaacttttcgccccctaatcccgacacaattggccggtgccaaagtctcgaatttggtgcaaatttaaggcgaacactctgtgggcggtgcacgaagaatctgaggaggagggaaagcaacagcaaaggcagcagccgaggagcatagagcaaagccaagcggcgagaacggcaccagcgaatgacgacgacgacaatggcacaaatgggagcaaagtgcgcttcatcgacaattcagtggaggtgaaaaagcgcataaggatactgcagaacacagaccaaaaaagagggtggggggatactgtaaaaacttaggcttttggcttgtgcctttagttttaagacttttttttttaattggtgcatctcaaatgagcaatatatttcaattagggcacggcgggaatggcatttccgtcgggaattgcagcaattttgttgtgccaacaattattcctgatcaactcaaaatcacacacagatccatcggccctcgttggactctgccgacagtttgttgccgtcgcctgttaaagtgccacctcgggcgacgacaacaaataacacactgacagtgaacaatgatgctaatggggtgcaaaaagcatttaaatttatttatttaaattgacgcgccgccatttcagtcccaacccgtcccttcgacggtggcacgaatgcacacggctatgaagctgaaccagcacatgcgggagctgagcgcggacgcgcagctgctcattgtcaatttgccgggcccgccggaagttggccaacacgacgcttactgtaagaagacagtgcctattgtaaaactgtgtttgccaaatctcatctccccccccccatctcgcgtagtctcgagagtgccattctcgtgttaatctcgagagaaccattctcgcattagcctcgcgaattccattctcgcattagcctcgcgaatgccattctcgcgttagtctcgcgaatgccattttcgcgttaatctcgcgaattacattctggcgttaatctcgagtgccattctagcgttctcggcctgtgctgtgcctcaatcatcatccatccgtttttcagacatggaattcatcgaagccttgacggaaggcattcgtcgtgtgctgttggtgcgcgggacgggctccgaagtggtcaccatttactcatagcgcgcggcacagtctgccgccggtcgtccccggccaattcagcccgatcacctccgatcaatcaatcagtcaatcaatcaataagcaatcaatcactcagttcacacacaaaacacacatctcaaatggcctcaacaaattttgaccccccaaattcccccctcaccaatttttttcattcgtttctcattttttagtcctgcgcaagtaaatggattttattagctctataaaatgccaaattttcgccaattttgaaatttttcgcatgaaattcgtttcccattttttggcggttacattttgtccatttttttgcgcaacttttttttatgatgcccttttgtttcattctctttctttttttggttcaccaattttgagggtgctactaaatacacaacaacgcattacttctcttcttcttttgctttctttgcatttatttccccattttgttacggtactatttactgtttttgcaatattgttttgttacggtaggcacttttcgcgtgttcacataaatgactctcccaaattcgcagcagtttatttaacacggttttgttacttatttttacatttcctcccccacttttttcgagaatttctttcgcccagtgtaatttttattgcaaattttaattatttcatttaatttttgaatattttggcaatgatttttgtcgtacgatgaatttcttcttttctttttattttcggcttcttttcatctcaaaattgcctccggcactttggcgttttgtcgctccgccgcattttcctcctcccgccgacggcaaatctgtgcccaaaggctgtccaatgcaaaaagcatcgtggttgtgtcctaattaattcaaacaaaattaaattaattgggttcggagctaattggaatgccatacttattttttaaaatttaattagaaaaataatcattttttagaatttattttaattattttgttgggagtgaaagaacagcaaatttggcatttaattgtgactctgaaaattgcattttcgattaaaacttttaaatttttaaaattcgtttccaatttcaccgttatcacatg

SEQ ID NO: 8945 - DNA, 1750 bp, Heterodera glycines
  misc_feature (55)..(55): n is a, c, g, or t
cagccataggatttgaaaaaaaagaaattttaaaaaatgtcaactttcgtgagtntaattatcataaatatattatagcaaaaccataatgccgaagttgtccaacaacaacagcaacagtcacaaatggcacatctgcttgcaacaacaccgcagcagctgcagctgaacaccttccagttggtgttcaagtcgttgaagcagcgcgacgaatggagggatgtgttgtggaaggccatgtacgtccgtgttatatatagactgtgtcctctaagcctatttctaattaaatttcaaactcagactatgacaatttttgaaacattttcacatttttttgaaaaaaaaatggaaaattcataaaattattgcttgcaataaaataaaaatttaatttacaaaattatttccgatcgctcttggctcatttttcgagttcaatcatttttcagcgaaacttgtaatccacgagcggcacatacaaaagggcattcactgttcttcaagacgtacaacggcgtgacaatttgtgccatttgcaaaatgttattgcgcggccaattcttccagggctatcattgctcgggtaaaaataaaacaaatttggaatgctaaaaaatgattaaaaaaattaaaaacacttagacaaatatggattggaaaactggaaaattaaaaaaaaatagccttggaaaatttaaatttaatattaaactcaatcccctgaaaacactaaaaaatcaaatttgacaatcatcatttcatattcaattacaagctttcgaaattacattatttatttgaatttaatttttgcattttttaatatatttatcaattttaaaatatttttcttttagcagtttgaagaaattagcctaatttttataatttttatgcgccgtaatttgtagtaatcaaatccagggctcccccatttgtccctaatttcaaaataccctacattttcggctttcatccattgatcaactactaattcgcattaaaaattaacactggcatcgcatatcggcatcgcccggacccactttcctatagaaattttcaaaaatttaatccaaaaacatcctgaaaatttgttggcatttctttaaaattctattttttgtgcaaattttcccaggcggcacttttcggcacgccgctctcctctcgaaaaaatgataaattgcctcattacgcttacaggctgtaatcgtgacatgcatcgcgagtgcgcctgcttgaaggagtgcacattgttggcacaacaacaaaacaacggcactcataacggcaacggcacgggcacgggcagcacaagcagtagcagttgctgctccaacggcggtgggacctatcagcggtacaggacgaagagagcgtcgatgtcgtcgatcacacgaaattgtaagatcttaattattcggtacaaaatatatggtactacagtattgagttattcgagttttttgattcgaatcgaactctcggtgtaaattccttggtctctcggagtgattcttgatagaaatttcgaattcgaatttcaaaaatgagaaagttttatgtgttttttgaaattcggtcaaccacttacggcgttaattctgaatgatcgacttacgcgtgtttgggtatttcaaaaataattcaatgctcagactcgggaaattcctttaaatttcaaaccggaatacctattaaaaaaattgttagaaagtttttatcaactaaaaaaaattctgaa

SEQ ID NO: 8946 - DNA, 1950 bp, Heterodera glycines
  misc_feature (35)..(35): n is a, c, g, or t
  misc_feature (53)..(53): n is a, c, g, or t
  misc_feature (95)..(96): n is a, c, g, or t
tagtgctttgatgaatctaaaaagtctcaattatntaattattatatttattngcagaataataaatcacaacttggcccaagcttaatcaattnnaccaatctttcatatttcgaaaattaaaaaaaaaaaaaatttttgaaattaactgagaaacagagaaatattttctatattaaaatatttttttaaataaatatttaaaataatcatgtttttttggcaatatttagctgccacgtcacagtcgagcttcgagttgttctctgaatgatgtgatcccattccaaatccgtccccccaaattgtcatatcaaataatgggcaccaatcgccaaatgtgccgaacctatttgttaccaagtaaatagatcaattctaattttctaaaattctttgatagatttggattttttgaaaacctttgaaaattgtaaaaaataagttaaaaaattattgaaggaaattggaataaaaaaatttaattttttattagaaaaatcattttaagacattcagaaaatttaaataattgtgataaaaaaaaatttttttttgaatccaatgaatttttttgagaattttttagttttaggggaaatttttaaaaaattttgcatttatatgtctcaaattccattatatattttcgggtttgataaataaatctttaattttcgggcatttttcccagcgcaatcgtcgatttccacaaaaacaatccgaatgttgtggaacaaccatggtattttggcgtcatggaccgtgccgagtcgcgacggttactgtacggcacggcggacggcacatttcttgtccggtggagtgccgaagtgcaaaaatatgctctttcaatcagtgtcgatggttcggtaaagcacatgcggctggagtataatgcggaaatgaaaaagttattaattatattaaatttaaaaaattgtaaaatgccaatcatatttggcttgccaaaaattgaacggcaaaattttaaacggcacatttttttttttgttaacttagccaaagtatgaaaatacggttttttggacatttgggcctagacttttcgtattttagggtcaattttgggtttcgcgtctagaaaaaaaaaataataattctggacagcccatattctacgtactttttcccgccataagggccagaaaaacccaaagttttaggctttttcataattttttttatcctcaattcagataccatttgaacgatatgcgctttttcaacacaatgcttgtaagtttggttggaaaaggtttttcgtgaatttaaaattaaaatttttttgtttttgtcaggacctgatcaactattttcgtgtaaataatctcagcgaggccattcatggcttggatgttgttctccggggcaccccgctcaagggcaccctttaccgcgcggtggcgccatttgaacggtttttggcaaaaaaatgaaaatcaaaaataccccctaaattatcctcccgatttttcagtaccaatggcagggcaggttacatcacactgaggcctggtgatctggtcacactgttggacaccgccgatgatgacaagggctggtggaggggttctgtcagcaatgcaaacggtggcacacgggtgggtaaaattttatgccattctggcaccaataaatgggcaaaatttcattcagactttaaaatttgtttgttaataaaagaatatatatatatatatatatatatatttactaacggcgctgaatcgccgatcggcgatgaactttgcgattttaagcctttttgttattgaaaaataaatatttatagggggcctgcggtgtccattggcgtcgccagggaaaaattttggaattttatttcttgttagtaaatgaaattaaaaacataattattatatttttttaaatcatacatgataataggcttataatttatctaaa

SEQ ID NO: 8947 - DNA, 2603 bp, Heterodera glycines
ggcactgctcacgaggaggccaaagtgtcacgcttttgatcagtttttcatctgcagctgatttggacacatctcttctgatcagtgttgggggctgtagtgtgaaatttttcagttagtagagttaattggggctaattaattgcaaataattggttttatttttagaccaagaaacccaattagtcatggtcagagatgggtctgatcaaattatttggacagaaaggcatttctgatcacaatatatgccactttttttcttcataagttaagttaccaacgcaataaaaattgtaacatcgacaaattacctattttatcaaatcacgcaaactgatcaaaagcattgatcatagagagaaaggatgtccaaatcagtttttaggatgactcatattccttatgtgtaagtgccaaactttcgttttatcaccaaataaatgtttaattttcagctgctatttgaacattcaaaatgccattttcacccttttttctagaatctaccttaccattttttggcctttttatacaaatatatattctttaaaaaacaaattaattccataacaaaaaagttatatttataattacttttggcttccatgacaaattccttcccaaataaaattccattttttcattcgatcttttttctaatagatgccatttttgtgttcacatattctttttttatcatacactagagaacggataaattaatctgatcattaaataatcaacaaattttggttcttgatcaaataccggaaaattatgacggttttacattgaatcgaaatttagtcatataaatctcgcaaaaattatgaaaaattccaaaattctgaagctcatcaggtgaccgattttctctcgatttctctagtgtattttttttcatctgatcaaattaatctttttttcataattgttttttaaattttattttgtgtgattcgaatttgaccttctgccggagcattataatttttctataataataatttttgtgatttaacaaattatttccatgccttcacaaaacgactacaaatttatgtcttgagatcggacttaatctgatattaattaattttttatctcaaaaaaagttatttttttgattttttcacacatttttaattgtccaaaattaaaaaaaaaaaaaaattaagtccgatctccaaataaacttttatacattaaagatataataataattgctcgaaaatttgtgaaaatttcatgaacaattaaaaagttgtaattacgcattttgtcccattacgcatttgccttaaatgattttttataccaaatttttaatcaattaaatgaaagcaataaaaatttattttttatttttataatttgttgaacaaattaaaaatattgatccacatttatttcttgttttctgtgaatgtgaatgtgcattctgccgaaccaacaaagaaagaacagttaatttgaatcgtatgatcattttaatgactgaccttcaaattaatttttgaaattaataaaaataataaaaaataattttatttatattttatagaattcacttttttttaaattgcctttttatacattccgaattcttgctcaacaaatgtttcggcaaccaacttctaattctgctgcactcattttgctccagcttcaccataaatcagttaatttgttggggcaaatgggaaaacgttgtaaaattttattttttattttttttaatttttagaaggccccaaattgttggcaccaattcacattgtcggcacagatttcgaccagcgcttatagaaataatgccaaaatttttgagagtgctgcggatgccgttcgggacatacccagcggcgccacacttttggttgggggttagtcagtatttgaattggaattcaagaaatagcgaccggaccaggcatgcacactaactatgcttgtgggtttaagttggcctggtccggcctgggcctgaaaatttcggcacgatgaaaattttaaaaaatcgaaattttcaattaaacgaaaattctgacgcatttccattaaaagtattctttccttttttggctttgggctctgtggcattcccgagcatctgattgatgcggttgctggcagtggcgtgcgcgaattgacttgtgtcagtaacaacgccggcattgatggtgttgggcttggcattttgttgcgcaacggccaggtctctcggaattaaattttcaaaaataaaattcgagtatttcaaattggattaagaaaattttgtgaattttctctccgataacatttcccaatttgttcgatccctaagccatatttaatcaggggtcgaaaatcgggaccccgttcggtgaatggccaaaactttattcgaacaaaaaatcaaattttttacaaatacatttacttaatagccctcaaagttaattaaaaattttacttaaaaattcaaatttgctttcttcctgacaaggtgcgcaagatgatctcctcttatgtgggcgaaaatgccgaatttgcgcgccaatatttgggcggtgaattggaattggaattcacaccgcaaggtgctctcaatttgt

SEQ ID NO: 8948 - DNA, 1355 bp, Heterodera glycines
agggtaaagtaaataaacggacttgaaaagggatttccgaaatttagacgatgacagagaagaaattgagaagcaaatggaagaggaggacaaaatcctgcaaagtgtgactcagacgagtgcactcgcaacggtaaaccatcactttaaagccgaaagtttcactgcttttcccctgtcaggtggcggaaatagcgaagggtgtcaaatacacagagtccattaaaacgtcgtggaaaccgccgcgtcacattcggcaccaaactctccaggaccacgagaagttcagacgcttgaaaggcattcaaattgagggagaagactgccctcaggcaattggcagttttttggtccgtgctcaaaaatatatatttgtaagtactaaatttttctaggaaatgaaacttccccgtcccatcattgccataatgaaagaaaagaaaattgtgtgtccgactgtgattcaaatgcagggcattccggtggctctttcgggtcgcgatatgatcggaatcgctagcaccggcagtggcaaaacactgacttttgtgctgcctgtgattatgttcgtaatggagcaggaaattgcgctgcgtttcaaacgcggagaagggccatacggacttatcatcgtgccgtctcgtgaattggcgaagcaaatttacgacgtgatcatgtggatcagtggggctcttccaagtcccgattatcccgagcttcgagtgggcctttgcattggcggctttccgataaaggaccaagcgcgggagtttgaacggtgccgttgtcccaatgagaaaaaaaatatttctcatgagaaattcaaaattaaggggtgttcacattgcggtggcgacgccaggccgtctttcggacatgctcaacaagaaaatattcaatttgcaagtttgtcgttatttggtcctcgacgaagccgaccgaatgttggacatggggtttgaagaggaattgcgctcaattttctcctattttaaggtttgacttctttccttttggttcaattttacaattttttaagggacaacgacaaactttgcttttttcggcgacgatgcccaaaaaaatacaaaactttgcaaagtcgacgcttgtcaaggcggtcgttgtcaatgtcggaagggcgggggcgggtgagtcgccaaaagtcattcatttgaaataattacttttgtcccaattaagcatctctcaatgtgacccaagagtttgaatatgtgcgcaacgacgaaaaattagtcaaaatattgcaatgtctgcaaagacggcgccgcgtgttcttatttttgccgaaaaaaaggcggacgttgacaacatttacgaatatttgcttctga

SEQ ID NO: 8949 - DNA, 3994 bp, Heterodera glycines
ttattatttattaaaaacacgaatttttttttaattcgcgttctgttgaaaatgataattggacatgcaatttttgagaactttaaaaagctgtattgaaaatttagcagtgtgaatgaacaatgtgcgctttttagttttgtgagtgtgccgtataattgatggtggcttcggcgtttttcaactaatgctcaattaaaaaccgtcatcccagccgctaaaattttaatttagaaaattacttaaaaaaaaatttcacctaaattcgtcaggcggaatgtcttgatcgggtgggtaattgtcaaagttggacacgtcagcaggattgcttactttctgaaagaaagaacggctctctattaataagtgataaatgtgatagactcactgggataatgggaggttttaatgttctcgaccgaagtccatcccaatcgaaacccatgaaccatctgaacgatcatttatcattgttgttcagaacaacgtgactacaccgttcacctgtgtttcctaatgtcattaacacctcccgaacccgagccgagtcgttctccggggttgtcacggcacagcttcttcaccaatgccgttgctgttttaccaatgcgtcgattgggtatctccaaagcatcaatgccctgctcagaatagccaatttagtcaaaaaatttcgaatgtgacttaccttcagaatcaaagtgtatgttttcattgggtccgatgcttggaacggcggtctgcccagcatcaactcgcagatgtaaatgccgagtgcccagtagtccgctgcttggtcgtggcccttgttgaggatgatctctggcgacacgtactccggcgtcccgcagaaagtccatgtcttgcgacccgaggctagctttttagcaaagccaaagtcgaccagcttcaagtagccgcttgtggttagcaaacagttttccggcttcaagtcccggtaaacaatgttccgcctgtgcaaatgctctaatccctccaaaacgcaagcgacgtagaaacgggccgtgtagtcgtcaaagtgaccccgatcgcgcagcgttgtccacagctcaccgcccagacacgcttccagtagcatgtaaactgtaaaagatgattcaatttttaaattgaattcactcaaattaccatatttagagtccctaaaagttttgtagagacgcacaatccaatctgtccgggtctccatcatgatgttacgctctgcgaaaatgtgctccttaaacgagagaactgtcattaaaatgcctaaaaaacttcgacgctgtaaaaaaaagcgtagtttaaatgaacgttacaataactttgcaaatgaatggaaccacctgttgccttgtgtcgataatgtgcttcttcttcaatgctttcaatggcgaaagtccgacccttgtcgccgatgatacatacctttttgagaaatggtcctcaaccatttaattttgttccttctcaccaattcgaccctcccaaatcctccgacgcccaaagtggcgatgcgcttcagatgccgcagtagaatctgtgagaattcgtcttccaacgcgggaatctctgtttttgtcggggaaacgcgggaagagtccttctcagtgcgtgcgctgcgccgttttatgtcctcctcgcggtacgtgcgctgttgtttcagcagcggttcaaggtcgccgatcaacttcagaaagctttccctgtccagcgtcagaacctcgacgccgggggccatggcaattacatttgcagtgcgtacttcctcacctgagaaaagcaatcgtcataacatttaatctggtagataaagccattttaattgattcaactcaccaagcaaagccttttcgccgaagaattcgccttgtttcaaaatgcgcacctcacgtggctccaactcgccttcaatggactgagtgatacgcacttggccgctatttatcacaaagaaagtgtcgcccttctcgccctctcggatgatgtaatgttcagcggcgtagtagtcctggtccatcacatcggccattttggacagtcggtcctccggcagtgcggcaaagatctccactttgtgcaagaaattcatcaattgggcgtgccgctccattcccaatcgcatagtgatctgagaaaaaaaataggataatgacgaaatcagttgctatgagagaccatttgaaaaactgaacggtcgagacagaatagcacacagtcggtgatcgcttggattgatgccgtcctgacaatgagtgggaatgtgagaaatgccgccgtcggcattgccacaaaatgcgtttgattacctagcacagttgtacagaatagcaagctctcccatcgcaacccctggatttagcacctaaaaattgcggggcactgctccgtctcaccgtccgattatctcttgtacccctaatgattggccctctcgtgacacttgcagttgaccctcggcgatcacgaacagccgatcgcccggttcaccctcttggatcacccattgaccagcccgtgcacgcatttcgaacatacattcgacaagctggcacaaatcagtaaatttaagccgatcgtttggcattgccttgcccgtacctcaatgatttgttccttggctaattggcgcagaaaatcattcttttggacagcgtcacgaatgagttgcttggatctggaaagggatgtcgtgacgtttgccatcagtttgtgatgagtgtgcccttccccaccctgctgatttggtgtggtgctgtaacgtcgctttgtgctggtccaaatttgtcggttcagcggatacggcgatttttttggcacgcacttcagtgccaccttggccaaactccggcagcaacgcggctttctgtagatacgaaatacaaattctaccaaatgcttaacactcacaacctgcttcatctctgtgtgcagttcgcctgaccgcttttgactggctgaagtggcggcactttctgccttgaaaattacattttgttatttaatttatttgccatgtagctaaaattgtaaaaattctgcccaggggtagtgacaagggaagagggttaacaagggaacattccgagctgtgagtgggaaaatgcatataagctatataccattggatagagcggggtcgacttgtattgtgaattttccctggttggtgcattatgtttcacccctccccgtaaaaaacaactcttgaacgagtaaatggatcattctctcccaccttctgattaagcaccgatcgcagtttgtcgcactctgatgacagacctttcacctccacttcaagttcgccaatccgtttctgctgcgcgtccatctctttttggttctgccgcaactgtcggtcctttttctccagttggtcttccatctttaagaatggagaaatgcaaaaatagaataaaaacagttttggaaaatacctgggggataagcttctgcaactcctgcgcatcgtacactcttgagccaatttgcacctgaaatgccaacgaattgtctatcattggccaaatttgaggaaattgagcttttcgtaaacgatttggttttggtaatttaaatgcaatctttgcgcataatttagttgttaaatattctcttctcaaccccccccctccaatttttacgagtatgacaacacttactgttgtaaatgggtattttatgatgcttttgagcattataaacagatgatttgtgcttattataaatacttcattaatattacatcaaatatcaaaaagaaaaggatgaaaattaggaatttgagaaggaaaattgaagtagcaaatggcacaagtaaatacgcaatatcaattgcttacaaattaggactgacaaaatgtgagcactaatgccagaagaaaaagagaatgaatgggggcacatttgcaattcaatgaaaatatgaataaaaagactaacagatgaatagaggaagggggggggggaattgaattgggagggggggggg

SEQ ID NO: 8950 - DNA, 2474 bp, Heterodera glycines
ttgtcccacccactgcgcagtttccgctttatctcgcgctctgctccgcccgtacgttttggttttatttgcactcaaggttactttactttatctctttttctcgcggtttcaaggccctaaactcatcccgaacgataatagcgtcaattcttttctccctctttcagccggcattacgattgccatgctttatcccccttggagacatgcttttgacccacccctctttctcggacattaccatgctttatcctcccttggtccatgcttttatccctcctctctttccccaacattaccatcaccatgctttatcccccttggagacatgcttttgtcccatcttaccatgctttatccctttgcggctttatccctctgctgggcgtgatgggccgtttccttcttacacatccaacaccggtccatgccaaaaaccaattcaatttttcgcaattgttcgccataactcacgcatccatcccataatccgcgccctttcattcatccgcccacaattccatcatcccccattttttgtcccccgcagcgctaaaggggcaaaaaccgtccgccgccgtacaaaacaatttgttgtgtgactcctctcttctgctgtcgcgttctgctggctgaacagttccataggttttcgtttcgtcgcctgcagcgccgctggcggcttttccctttgattgtaagcccccgggggagggattaattacccctctcctcagtcgccgcaacgacgccataggcgacggcacttcagcagcagaggcccaccccaacaaatcggctccattatttcgaagaggcttcttcctcgccctcctcccccgcatatgattcgtttgcggttggatcatggtccaaaaaaaatgatcagaaatttatatgatcacacctcgtttgtctatgttcaattaatagttctcttgatcatctcccttttttcttttttttcctccctcttcgctcctttttctcctttttttctctcccttcctcttcatcctctcttctctcttcagtgcagtttttttttctttcaccttccttacatcttctattctcatatcttcttcgtcctcctttaccccttctcgttttccacgtttttcccttctcttcctctcccatcataattttccttcttcgcctcttccttttctctgtttcctcttttttttctgtaccttccccactcttttgcactcctttctttccctcttcctttctcccttctcttcattctccttccctcttttcacttcctttttccaccatactctcttctctcctccttttcctcccctctctctcattgcactttcggcacttcatcctcccactttcattatcccaatccaaatctgtgccaaagtgtgcggtgccaatgccaatcttatcccctctggctccccaaaatccgttgtccatttgtccaattggcagattattatgccatttattattattattattgtgcccgccatttttggcaccaaaatgccacggcactttcttttcatttttgctgctcttctgttgctaggcactgctcctttctttaacaacaacagcaaaaaggagcacatcattgtcaatttgttctgtggtgccgcggcgcctttcaactgcttttgttgccctcggcccaataaaaaaatatttttaacgcaatttatttgatttatttttattatttttgcgtaattaactctataatgatccatatccgttaatttcgtattaacaggcatttgtcggaagtttcgcttttagactcgataattttttgatttttttttctcggtctcgactttctctatgaattctcaactctgaaaatttcgactcttgaacgcccctaccaattagggatagtggggcgggggagggctaagtcttgaattacaagcatggcgtaataatgccaaaatagtcgtttgatttcaattttcaaattgaattcctttttgggattaaaattggcttgatgtttggcttaaaacactagaaaatgaattaaccttaattatagctttaattaacctaaatattataattacccgctaaattgctggcaaaattttattgtccttttttaaaattaatttatctaaacaaatattatatatatatatatataaatgatcagcgcaagcttattaaccctaattacttaaatttatatgccataaacagaaacttaattggccctaattacccaaagaaatgccgtaattgtataataaatacatcaaaattgtccaatttatcatattaattacccattttttagtgtaatacaatttgtcgtccaaaattggtggtccatagcaaaagcaataaacacaaattgtttggggcggatcagcaacagcagaaagaataaagatttgtcgcccagtgataaatggcgcgcatcagcagcgatcgaggactgcagcccacaaccacctgct

SEQ ID NO: 8951 - DNA, 3467 bp, Heterodera glycines
  misc_feature (3364)..(3364): n is a, c, g, or t
  misc_feature (3374)..(3374): n is a, c, g, or t
  misc_feature (3422)..(3422): n is a, c, g, or t
  misc_feature (3438)..(3439): n is a, c, g, or t
gcagggggtaattacgggtattaggggacccgcggggggacgcggggaaatgggcgggataaggacgaccaccccataatgatgcagcactgattgtgggcagagaaggcgcacggcggcggaaatggacgaactcgtgcaccgcccaacggttttgatcattattcattcattagaagaaaccttgatcaattggatgatgatggatcggtgatcagccatccgatctgaataattgttatctgatcagatcagtagcaatttcattagtcgttcatccgatttggacggagcagtcgcactgatcggtgaatgatcaccatagctgatcagctaaggtctctgtcattttgtttgctcccttctgatcagcctagaaccatctgctgctggtgatcattaattagcgatccattcgattttaggtacggaatccactaattccttttttcattttctattttccggtagtttttagtccgtttttttcatgcacagaaagcccgattttcaacaaaatggcttggaaatccattttttccctgatcaaatgtctatattggccgaatcatgaactctgatcaaaaatgtgtccatgtaattagggcataattttttggtcaaagcattgccaccatcaatttggccaatgtgccaaattcggaccagtccatcgcattttcctaatctctgatcaccaattccatttttccaggactgaaaatttgatcaacaaaaagaaccctaaaattttaatttttcacaatcattcgcccagaaaatgcttttggcgcaacgccatgcccaattaaaccaacagctgaccatcagccgcttattcctcatcattatcatcttaattagcgctaatttatcaccgctaatccgatcaccatttttatgcctcgggcaatcactttgtggcgaattggaggtccaaaaaatttgaaaattaaatttttcaaattttaatttattttttcccagattcacaagcaacagaaatggctgatcagcccatcagcggcaacagcagatggtgtccgaccattgggcactgctgaaccaagtgccaatcttcaacaatgcctgcaacagtgttgtgccaggccgggtagcactttttaaaatttcaaaaatcaaaattaaaccccattaaagatgacaggaaacggattttctaggaaattttctccgcctaattttcaattttagaacgagttataatcacctaaaaaaacctattttatgaagaactgtaaacacaaatttagggtcaaattcgaattgaaaattgataaatcatttcaaaaaacaatgcaaaatttttcgcaaattaatactaattaacgctaattatacttattcgtgtatatatttttttgattacccaatttacacaaaatccccgatattttttttcaaatttctccaaccatccccgacaaattttggtgggaatttcctccccgatccccgacttttttctccccgagaatcggagcttaaccttcaaattaaaacaatcagaaaattaattttcacaaggggtggtggtggtcgactgtccatccacaaattttcccaaaaatgcccatttattaaggtcattagggggtgctcatcctctctctaatcccatttcgcgaccaccgatggcgcaaaactaacaaatccaattttgagagtgccccgcggggggtaaattttcaactttttgcctccccccccccacgaaatttggcgttttgacgcaccggaaaacgattcgccacgccttttaaaaagtttttccgccaaatttgtccctcgtcggcgcgcactcttttcgcgcacatcaatggatgggatgggatgacctttgtttcttcattttccattgtgttgttgtttgggcaaccacaaattgcggcggggcgcttaatgtaacaaaaatgggttgggaaaaggacaaaaatggacaaaatggagaaaaggaaattgggggggggggggaaagattgcgtaaattaaattaaattaaatttaaattatgcaaataaattaattaatttaaattataaaaaataaattttaatttaaaacttatgatgcaaattgaaaagattatggaaaaattcgcaattgcaaaggttctttcaaaatccgtaagtcgcctttaatccgcgcaattttgggcataaaatgccgtatttccgtccctttttagaatttacgtaaaagtactgatcactgatcattctcagatgtttacaatttgtctttaactgatctgatcctatcattatttttgaactggaatctgatcatttctttgccattagattgttctgcaattagcttttccggctttttaccattgtcctctgactctggcaacagcagcaccaatggcgatgatgacacttcatcctcggcaagcagttcagcagcaaattgtgccctttttgagtgccctgccggtgccaacagtgaatgtgctctgacggatgccactgatgcggctgatcaggagggattgctcagtgtacggcttagacggaaggacacgcaaccaccggtaagaacagcaaatgatcaaagagctgaattggattgaccaaaaaactgatcagatcgatctaggaatttgtcgtactgatcagggtacactactgtactctgatcagtctgtgatcagttgagatcagccatgctaagctctttcagtcagtgaccaattatgttaagtcaaataagccaagataaacactgatcagttgggatttgcttgtgatactcctgatcagctgctttgagcattttaactcagcactaattaggtatgataagctcggattagctatgatcaagctttgattacttgagatgggctctaatcaacattaacatttctgatcagttgatataggctctgatcaccctgaactgttacctttttagccaacatcatcaccaacaagcaacaacaacacttcatctgctgaacagcaggatgacgaagaagatgatggacaaagtgccgaaaatggtggtgatcaacggcacatcctttcgttaggcaatgatggcacgtcgacggaagacggcaccggcggcgggacaaccgcggaacagcaacatcagcagcaggtggcgagcggaaatttgaaaatttaaatttgaaaaactcgagagggatttgttttatcgaaatttaattaaaaactaattttaaaattaattcaaaattcaaaaaaatatttaaaattatatttagaaaaaacattatatttaaattttaaatttagctttcggttcacatatttttttattaaaatgctcaaaaaattctagaaaattttccagaaatattttaaattanaatttttcanagaaacccgtcatttaataataatttccatgaaaaattatttatttanaggaaaattttcctannagcaaaatttaaaaaatcttttttttta

SEQ ID NO: 8952 - DNA, 2048 bp, Heterodera glycines
ttttcattagcgatttgttttttcctcaccctattagaagtgtccccccaatgcagcacatggccccgtgttgtgtgcacaaaatcaggcaaaacatagtcgacacggttggcactggaacaaaaatttaaaaaagtaagggacataaaaattttaaattttttatcaaaaaaattggaaagaatttctccgtcaaacaacagaaaattgatggtttccatcctcttcatggaccataaggagtagcaaatataaacagaagtcatcattcggagaagaaataatttttttgaattttatttaaaaacttcgacgggaatcgaaccctttgtaaatttaaaaacagcaggaggcatagaccactgagccaaaagaggaacaagaggccacccagcaattgactaatttatttaataaaattgtttaatcgagttttttatttaattaaagagacgaaaaaatgggaccggagagaaaattttttaaataaatgaaaaaccaagcaatcaaaaagggaaaaacttgaatagttgttttaatttatttaaattaaaataatcggctaatttgaaatatttaactgtaaaaccgctcgtttccttaccccgaaaaattttttgaaaaaaattttcggaaaaattttatagagaattatgtgtaaagattttcaaaaggcgtaccgccatcggtccatgtcccgctgaaagtcggtggagacgaagcagcagtcctccttgcactgtgttgtgatgaattttaaataatttttaaaatttaaatttaattttttcaaaaaaaacgattgcgcttacacaattgaccaaatacgtctcgtccatcatgtgcagttggcggtaggagatccaatccttcaactgattggtcaatgctttgccaccgatgtcaattctttgttggtggttttaaagggattaaatggggatccccaaaatctcgccgagacaaaacctcgtcccgaaatttgtttttttttaaattttcaaaagatattttttctagcgtttttagagttttataatgaattactaatatgtattttcaaaaaatttttctaaatcgctagaaaatttttaaaatgaaatgtttaagattttttttcttcaagttttatttttttttcatttttaaagaattttgcctttttctaacaaaatgcgttgaatttttcaaaaactaggcaccgctggttccttcctcgctcagaaatttttttttttttttttgaaaaagcaaccaaaaatggttgaaatttttttatgatgctcaactcccctccgcataatttaaaaattctcttttggcatggatttaccggacaatgccctcgcgcacaatttgtcccccaacaaatggcacaatgtgagtgaacgagtgcctgtaaaaagggtaaaaataaataaaattttgtaaatttccaacggatgagaccaatgagaaaccgaccccgagtcgacgacaacacagcacggattgtgggccgagcagtgcgcctgggcggtgcaggcggacgctaaaaattgcattttttagagttaaatggaccaaaaaactacaaaaaaaatttcaaaaatgaagaaattctcacacatttttttgaaattatatcaattttttcaaaagatttttttttctttttaaaaataatatttttttaaaaagatcttatgtaaaattttaagattttttgctgaaaaattatttttgtatttttttataggcaatgaaaaagcacaaattttcctcaccggacgttcggaggaaagcgttgaagcagtaattctcgaacacaatctcatccgtgttgtccgcaaatgccctaaaaattggacatcaatttttaattattattcccatcacattaaaccattttttgaagttttcctaaattttttttgcgcctatttaagaccgttttgaggctaaattggcgaacccccccccccccgaaatgactttttaaaaattttccagcaaataatggaaaaatttttcgaacttccccccccccccaaacgaaaatgtaaaaa

SEQ ID NO: 8953 - DNA, 2789 bp, Heterodera glycines
aatgccacttcgtgggggtcagtgagcaccaggcggcactgctgacagtccacgccgaggccggcgccctccgtgccgaacacgcggttccaaatctgcagctgcgtgtcccagttaactgaaattggaaaaaaaatttttagagtaatttttgcatggttttggtcctatttttgcacaaatttatggaaaaacatcaataatttttgaaattaaattttaaaacattgaaaaaattttttcatgaattttctttcgggtcccaaggttttttggaaatcttatagggagggagggaggggtatttttcgtattttgtaaaggcaaatttccgaccccctccccttttccatgtatgaaaaggtatctaaatttggcggagacccttccgcaaaaacaagaaaaaaaatctttttttttctttgagaaaattatctagattttgaaaattctaagatttgttttttagaaaaatttttggcctctgatcttatagggggggggggtatttttcgtatttcgatttttaaaaaacagttaggagatgggcacaaattccaatgtaaatttcccaaaaaatgtgacccgaaaacctgccaagatatccccgttcgaatggcaagacgaaaaacagtgccgaacggtcggtgcactggtccaattcgtcggcgacaaaaatgcgcttccgctcgcccttcgatttgaacacagtgttggggaaaattctaaaaaaaaaacggggagaatcgagtgtaattattgtataaaaataatgtataacctccgcaaaattttccgagtttttcaatttccaaattaaaaaaaaacttagattattttagaagaaaaaaaaattgtattttttgaacttttttgccatagttttctaatagaaaacccatggaactatgaaatatgataccaaaaagactgtttcattctctaaattttgtcaaaattggagggtcaatttgtcggcatcgtggccccatccgttccaaaattgtgccaaattggtacttttactgtttaaggcccatgaaaaatatacttaaattttatttcttttcctaattttaaaaaacaaaattcaaaagacagttaatttctcgacttttttcgagtttgggttaatgacttggttcaaattacaccagaacttgttatcatgatttttcaagaaaaaatggctatttttttttttaattttacacaattttcattaaaatttggaaaaaaaatctatgtcccaagaaaatgaatgcaacacgcaaatacctggcactttggtcggtggaatagcccgcctttatgctgtacgcgccgttgtccatgatcaacgtcggttgcgacgacaacatttgtgccaaagtgtggttgtggcgttggaggaattttttaaattttttttttagaaaattagattcgttggtaaaataaataaaaaagtatttaatggaaattatttgagaatttgttcgatatgcccaccaggggtggcgcgcaaccgcgactagcgatttaaatgggttactgctagagcccggacggggccgggatcccgccgggattttgccgggactcccggtcccggtcccgggttttttgggcaaaccgccgggaccgggagtcccggaaaaacgggagtgccggtgccgggatcccgcccgggtccattttccaagtcccggtcccgatcccggtcccggcaatttcaaaattccgggctctagttactgcagattttttcgcgatccgcggcaattgggattaaattttattcattgagacgattgtctttgaaatattcaaatttatataaaaaaatttctaaaacttggtattctcgaaaaatttcgttcaaaattccgggtttccccgtctacgctgaccaaaaaatttaaaatatggctcaaatcacaaaatagatcattttttggtcaagtcttttagcaaattgcactcaaattataaaatttttctctggcgacgcttattggcacccggattcccacctgctccgcaaagtttatgggtttcatatattcctaaccctagctatgaggaaatcagaacaaaaacaaaaaaatttgcaattttcattttaatcatttgtgttattttttagggtttaaaatatttctgaatttgttgtggtattttgtccaatgtctgtgctaatcaccgagagaaatcagggtaatttttttttttaatttcccaattaaactgacgacataatgctttgttttgggcttccattcatgagacggttgggatttgtttcaatttggactcttttttgagccaaaaaaaaaattgtaaaaatcagggctcggaatttttgattgaaaaatgcggcgccttcattttttcttttcagatgcgacaatttatgttggtggtctggacgagaaggtcaccgaggcgagtgagtgttgttgcacattttcaattttaatgaaggatttggaattgagtgaaacaaatttacgaatcgcaatcaatgacctcaaaaactactacaaacaaattttcaagaattattattgagaaaaaagattagaaaaaaatcccactagttgtagaggggtcttttgaaaagtttaaaaatgttttattcaatttttgagtttttttttggcttgcatcctttatttttcttttattttttgcagtcctctgggagttgttcgtcaacgctggtccggtgaccaacgtgaacatgccgaaggatcggatcaccggcaaacgccagggcttcggctttgtggagttcatgagcgagg

SEQ ID NO: 8954 - DNA, 2719 bp, Heterodera glycines
gcagacggatgcaggagggatcactcacttcagaagtggaatgacacacgacgaggaccaaatcatcccaaatttgtacagatacattcaggtaatgctgaaattcttaaccctgatattttttatgtcgtatttaagccatgggaagcggagtttgtcgattctcaacgtgtgtgggctgaatacgctcttaaaagacaggaagcgaatgcgcaaaatcgacgtttgaccttggaagacttggacgacagttgggaccgtggcattccaagaatcaacactctgttccaaaaagaccgtaacacgttggcttatgacaagggctggcgagtcagaacggagttcaaagcttaccaaatactgaagcaaaatccgttttggtggactcatcagagacacgatggaaaattgtggaatttgaacaattatcggactgacatgatccaggcactcggaggtgttgaaggcattctcgaacacactttgtttagggtttgtcttttcattatttctttttccatgattacattctttagggaacatatttccccacttgggaaggtctcttttgggagcgtgcgtctggtttcgaagaatcgatgaagtttaaaaagctgaccaatgctcagcgttctggattgaatcagatcccaaaccgtcgcttcaccctttggtggtctccgactataaacagagcgaacgtcagactttttaatccttaattcgaaattgttttgttattcaggtgtacgtcggtttccaagtgcagcttgatctgactggaattttcatgcacggcaaaatcccaactttgaaaatctcattgatccaagtaccttttttgtacttggcttttctataattgtttttcagattttccgtgcccacttgtggcaaaaaattcacgagtcagttgtgatggatttgtgtcaggtgttcgatttggagttggatgctttggaaattcagacggtgcagaaagaaacaattcatccgcgaaaatcgtacaaaatgaacagttcttgtgccgatatactcctttttgctcaatacaaatggcacatttcgcgtccctcgcttttggccgatacgaaagacgtaaaactgaggggctaatggggcattcgttggttggctaatataaatattgagtctttattttacaggtaatggacaacacgaccacgcaaaagtactggctcgatgttcaactgcgctggggagactacgactcgcacgacatcgagcgttattcgcgtgctaaattcttggactacaccacagacaacatgtccatttacccctcaccaaacggcgttctcatcgcaattgatttggcttacaacctgtacagtgcttacggcaattggtttccgggcatgaaggtgctcctacgtcaagcgatggccaagatcatcaaggccaaccccgccttttatgtccttcgagaacgtattcgcaagggtctgcaattgtattcatccgagcctacggaaccctacttgacttcacaaaactatggcgagctgtttagcaatcagatcatttggtttgtagacgacacaaatgtgtaccgtgtgaccattcacaaggtcattggcttttttatacggttgttacggttattgttacaactttcagacatttgaagggaatttgacgactaaaccgatgaatggggccattttcatttttaatccgaggactggacaactgtttttgaagatcatccacacaagtgtgtgggccggacagaaacgtctcagtcaggtgggctgaacgccgatctatgtttgtttctacttttaataatttagctggcaaaatggaaaacggcagaagaagtggcggcattaattcgatcgctgccagtggaggagcaaccgagacaaatcattgtgaccagaaaagcaatgcttgacccattggaggtgcatttgttggacttccccaacattgtcatcaaagggtcagaattgatgctaccattccaagcaattatgcgagtaagctgaaaagaacgacatacgatttatagatctgctgattaaacttaattaatttctttttcagattgaaaagtttggtgatttgatattgaaagcgacagagccgcagatggtgttgttcaatttgtacgacgattggcttaaggttgtttcaattttacttttttaccaaacttagtattttttagactatctcgagttatactgccttttcccgggtcattctcatcatgcgtggaatgcacattaatccggacaaaacaaaagtgattctgaagcctgacaggaccacagtgactgaaccgcatcacatttggccgacactttctgacgaggaatggatcaaagtggaattggcattgaaggacatgatcctgaatgactatggcaagaagaacaacgtgaatgttgcttcactgactcagtccgaagttcgcgacatcattttgggaatggaaatcagtgcaccgtcccaacaacggcaacaaattgccgagattgaaaagcagacaaaagagcagagtcaggtgaccgctacaacgaccaaatcggtcaacaagcatggagatgaaataatttctgcaacgacgagtaactacgaaacaacaacattctcatcacgaacggagtggcgagtgagggccatcaggtgggcagtgttttcctttagctaatgcttttccattttcctttccagttcgacaaacttg

SEQ ID NO: 8955 - DNA, 1132 bp, Heterodera glycines
tcccattacgaaaaagtgcaaatgcttctttccgaccgctttttgggctactttatggttccgtcggcgggtgtttggaattacaatttcatgggtatgtgtcacttttattccaatgatttggtcaaatggttaattgtttttccaggtgttcgacatgatgcaaatatgcagtatgatgtttgtttatcggctccaaaggagttttaccatgaggatcatcgcccacttcatttccacaatttcaatgtgttcgaagatccactcggtgtatccacagccgacagagaggatatatttgagtgaataatcaaagatggatgggattgacaatcagtgtgacaactgtcatatttattttcattctttgcagtttgtaccaccattatttgttttattggtaaatgttagaaattgttcaattgcttttattatttggtaacctccattttcaaataacaaagaatcttatatgaagtgatgaattgtttcaattcaattttggggtttaaataggtagccaaagcctgattctgattctaatttccaattttcgaatacattcctttcttcagtgatgcagccgcagtcaaagcgaaagattcaggtgttttctcctctattttgctttagtatgtgcattttttgcgtttcgtttgtttttaggtttcttttctgatcagaaatgggtcggtcgagtcgaagcatcgcggcttcgtcaacgccctccaatttgacccgacgacgcgcagtctcttttcggccggttcagattcggtcattcgccagtgggacacttcggcgccgtcgggcagcgccgcctttctccgctcattggagcaccactgtgactgggtgaacgacatcgttttgtgcagtgatggcactcgacgtgcggactttgtcgggggggggggggaggggtgggattttatttttttggcgattttcccgtgtttggactttgtttgtgtgggttaaaatgcgattgacaattgagaaacaattgaaattattagcgcttcagtgatctccgcctcttccgacaccatcgtcaaagtgtggcacacgcgcagaaatggcgcgtgtttgtccaccctcaaaacacacaaagtatgccttgccaaccaat

SEQ ID NO: 8956 - DNA, 1958 bp, Heterodera glycines
  misc_feature (38)..(38): n is a, c, g, or t
aaacattagggcaatttcggtgaacagagacggcactntggtaagtgccgtcgaatggctgtttccatcccttttgtttgtggtcagtgtctgtccggcagcagcgatggcactgtcaaattgtggagcatcggccagcagcggtgcattggcaccattcgttgccattcggacagcgtttgggcactgcaaacggactctgtttttgccaccgttttttcgggcggacgcgaccatcgcgtgtttcgaactccgctgcgcaacctcaacgactcggaattgctgttcaccgaagggaaacccgtgcagaaattactgatggtcgacactgaccaacccaaacatttgtggacagcgacttgggactcgtccatcagacggtggccaatcgacggcaaagagacggaacggacggaggaggggccgcgggtcagagaggcggacatgacactgcaaggcgagaaaggggcggccgggaactgtcccatgggggggggggacaataaaaggaagaattttgaaaaaaaggactttttgctaccgtaatgcgcttcattggacgaacaaagtttagtaattaaagcaaatgattagtgatttgcaaagcacaaaagattcaattatttcaaatcttgcatttggtcaagttttattctttaggtgctccaagcatccgaaaatacgctgtactgaacgacaaacggcaaattgtgacgcgggacagtgatgggaacgtcgaactgtgggatgtaatgcaatgcggcagggtgaacaccttcccgatgggcaccaacatggaggaagtgatcaaggacaatgtgcggaaggtgtggatcccgagttggttcggcgtggatgccaagtgcggggtatttgtttttacggcgtattatgcctccatgcccattattcctcttctgcttgtgtgatgttcccttctgtgttcaaggtgttggaaatcactttggacgagagcgacgcgttctccgcttgggtctccgcccgtgacgcgggtttcaccgacaaagccaacgatgccaaaggtcctctttctgtggtccctttgcctttgaaccctttgcattcttcggcagttaattacggcggtctccttttgcgcagtcttttcgagcattggccccacgcgtacgttggcgacgacgaggactcgcccctgcagggcttttactcgttgccgctgcacacgcccattctcatccggtgagagtgtaacgattggcacagttatttgcataattacaccaacacaacgtttcatcagtcaatgcaacgacgacattgcgaggccgctgttccgcaccaccgtccatgacacggcctcccaagcggactcagccatgctgcgcgatgtgctgccttcgtgggtgttgcaggtccaaaataccaacaaaaagtgaaccgaaaagacagttgattaaggtcgtggagctcaaccattttccaaagttcaacaaaattcctttttacctgcagccgcactgttctttcattccaaagttccccgttaaaaagtccgtttatttcgtttccatcttttttggcgttaacataacatgacaattccacgtttccacagagaccgactgagtgccaccgaaatgttgcagttgcgaaaagtgatggagcacgtgtgggagaaaatcctttacccggcggagacggcgaccgacgactgcggtggaggcgcaagcgcagcgcattcgctggcaacacaattgcaggaaaacattgaagaacgtattgagttgttctgcaacgaacaggtggacttcccatgtacaaattgatgggattgtaaatgctttcgtcgcttttcagaagttggactcggagatggacctcaggacggtcaaacatttgatttagaagcagggcggcgatttgcttattttttaccgtcccgagaaggatttatttctattgtaaattgtccataa

SEQ ID NO: 8957 - DNA, 6225 bp, Heterodera glycines
  misc_feature (11)..(11): n is a, c, g, or t
ttatagcaccnggtaagatgcatgctttcattttctgacggagttttattatttttaataatttcttcggcattatctgtactagtattaataaaaaatttgttgtaaattttttttttgacaacttacttaatttatttttcgccaattttttctgtttttctcttacttgtcgtgttaatttaaatttttatatgtttacctttttccttaaatatagcacaaattttactttttagttaaatttttattttttgttttattacttttttctatgctttatagttattagcatctaatttatgagaataattttgtttttaaatcaactcacattctctgtggccccttctcaatattatattgagcagaaactcattttattaatattaacgaaactttaaccttgactcatttatttttttgcataaatccttttgagttaaattattaatatatttaatatctaaaatttattttttcttatcataatttacagttatactttattattttttaaccaaacgacaagtctcatgattgaagagccgcgacgcaatatttcttagaaattttctaaccatattttttgcaacgatttcttaagtatgaaaacattaagctttccaaatttatcaaaaaaaaatataattcatcatttattattaattatacaaaaatttatgtttaatgctgagaatgtcaaagtgtcgcagtgaaattatttaaaataattctcatcagattaaattaagagtttgcttattctcaaacctgaactaatgattaaattaattagatgattcatcctttgcttgaatttatttttctaatcttggacaaaccaagatttgaattgaaatgatattattattattattattattattatttaagttaattttatgtatttttgtgagattttatttatattattttcaaataaaattatttattaatttattcattttattcagattgattactataatttttatttggatattactattgttatgataatagataaaaaatttatgaacaaaaatatttattaatatattttctttttcttgatggtaatgagcagtcttcttgacctgatttatgctcaccagggatgggccgaggtttcgcttttcgcatttcgcctttcgcattatttgcattttttggcgtttcgcatttcgcatttcgctttttggcgcgaaatgcgaaatttccacccctaagaaatgaatatatttgaaaatttaatttttaaaacgaatgcttcattttattattttctgttaacatattacactcaaaattgcataatggaaaaattcttcgaatttctccccacaaacgagaattaaaaaaatttatgggtacatttttgaatataggcaatttttcgtaacaaagtgcactcaaattttcaaattttttttcaaaaaatttcacttgtgaaaattcccggttggtcccagtcccggacgaaaatcgaggtcccggtcctgacttttctggaccggtaagtcccggtcccggtttttgtcaaaattcccggtcccgtgcaactctaataattaccttttttgctaacttgctatagcctaatatgcacgaaaacgagtttttaacttggtttgaagcttttatcttgaactttttggtgcatttttttgccttttttgcgatttatttttttgaaaaaacagaaaatttttgaaaattttgcaacttttcctaccatattttattacaatttccaaaaaaatttccggcggcgcttatcggcaccgccggaccttcattttaccttaatttttgaaattttaaccacaaaatgggtagaatttgtcattttttatctgagaaaaagatcgaaccggaaaatgcagattttttttgcatcacaacctaaaaagctattggtaaaatttttaaaaaaaatttcgcttttcgcatttcgcattttcgcatattttggcttttcgcatttcgcttttttttcatttcgcatttttcagtttcgcaaatttgctttttatttttcaatttggcccatccctgatgctcacctattttcttgacaaagtcctttttgcttttttagtgtaaataatttataagaatatatcttttagttactttttctatttgtaatcttttatcttttaaaattttttaaaactgtccaaaatccccccaaaaataacaaataaatatttgttgaagagaagaaatgaatattttaaatgaaattctggatgtagccaaaatttccaatatactggtatttttaatttgttttttttttgtctagcgagaaaatttaaaatttatttatttctatgttaagttctggcaattcaaagtaaaattttttaagttattccaaactaaaatatttaaataaatattatttcaaatgttatttcttacaaaaatttaaatagtttactaaatggcaacatttactttttcaataaatttattttgaaaatttctaatacttttttttcgttgttataagaatacatctattggttatttttttaaaattttctttttaacttaatttcggacattgatattttccagactctgagtccctgcccttctgagaatgagtctaataaaattttataaatatttaaaattctttaattgttaatcattttgttataaataagtattttattttacctttattgcttaagttttagtatttttttcgtgtgaatttgtttaaacttttcaactgaaaaaaaatttatttcacaatttataattttattcaattctgttataaatgtcaatgaagaggcttcagatttgtgcatcaatatttgttttatttaattcgataagtaataattagggggaggatttttagtggcaaaaaatcccaaaataattaacaaatagtgacaaaaaatgccaaaataatgacaaaattatgataaaaagtccaaaataatgacgaataatgaaataattttcagccaaatattgacaaaaaatattttattcacttgttattgttgcaaatgaggttacactttcttctaatttttcttaggaaatattaacctttttaagtccgaaattttacaattaaataatattaagtttttttttcttatttttggtaattaattattttttaatctaaagtggcagtgatgcgtcttttaagtagagttgctcggtaatcggtaattgttaaaaaaccggtaccggtactgaccggtaatgcaaaaaccggtaccggtaccggtaccaactttttccaccggtaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattgagggtgaccaagtttttttttcaaattcaggataaagaacactaaaattcagatgtagacctcaaaattcagattattgcaaaacaaggggtcagcagccaattttccaattttgcgaaggggtctccggccatgtaaattaatgtaaatcaatgaccttttttgctttcaacaccgcttttttcgcggcacgtttttctcaagacttttggggaacaaggaggggccggcggtgccgataggcgccgccgggaaaaattttgtattttttaatgcgatttgttaagagaatttgtaaaaaaagaacaattgattaatttttgggtttttaggatgcttaaaatgaaagaaaaaaagttggaatattttttttaattaaaatttcaattaaaataatggtaaagaaaatatgaagaatattctatccaagtggggaattgaacccaagcgagaaataataaaatcagaaggtttagcaacttgaccacttatgcatatgaacaaatgctttaaatgaaaataaataatttaatttttttttcaaaaatttctccttcttcaccattccctactcttttctcacccagacccccattcttaccagtgcaaatttttaccggcggtaccggtactagacaaaccggtaccggtactttgatttttgaaaaaaccggtaccggtaccgttaccggtaaaaaccggtaattaccggccagtaccggtaccggtaccggtaccgagcaactctacttttaagttattatgacatatttatgagttttttaaaaaaatatttaaaagtattgccttgataagtctcgttgatagcattctgacgtaagttaatttttttctcttatattaagtaatacttggaattatttttcatgaacatgcttattaatttattaattctgttaaactgaggtttcttctataatcttacgcgaaaacaaagcatcgtatataataactttgattttttcacatatttttgatatatgtactcgcggctcgcaatgttcattcgctcacgcgcgtcgtgattttatatataataattttctttgcgctaatatcttatacatatccttttttgagtattattaaatattaatttaagatttgtttaaaaagtcattagttagactattttatcatttcatttttttcatagttttattatttttcagtattttttctttgtgaattttaaagtttaaaaatatttttttatgttttcttttggtattttgtttttggtgtataataagaaatattttatgatgtcatataaaaacacaatttaaagatatccttcgcactttcaatccaaaaacgaaataaagaaaacttttcttaataactgttatgtccgaagataaaaattataaaagtttatttgccggagaaataaataaaaaaaataattcagagataaattggagaggtcaaattggtgggcaccataaccgtgctgagtctatccacaaaaaaactcagtgtgggcgatccacaaaaaaattcagtgtgggcgatccacaaaaaatctcagtgaataattaaataattaattttaattatatagaacgtgtcactgaattaattataattaaatttattttataccattatatttcaagataaatttaaaaagaacaaataaaaatttgtcatttttgttctaattttttacggtttaatgtacaaaaacttatcttaatatctttttgttgcatttgttcatgaagtttttttaatgttttaatttctttattttgatagcttttgacgagttctatagctccatgattttttataaattcttcaaaaccagaattagtagtaaccgaatactcaaatagagataagaaaaaaataaaaattttattcatttttctaggtcagaataatattataaatatatatttttaaaataaaattcatatgtatattaattttgcagttacaggcatataattctgattaatcatcttgtgaattattgatttcctgaagtcaatgtttgttttataatattaagagttttttaaaatatgatttctttaacatgattttttttattcattaaagaaaaagccagggattgacaacgtcctccaagatcccagaataggtttcgaatttatattacttatttgaaaagatttaataatttttattgattattaagttaatctatatttttttttgtggtcttgtttatgataaaaaggagaggtttatataaacaattgtttatgataaaaaggattggtttatataaacaaaagcaaaagataagaaaattcgatgatacaagtaaattaactattaaatatcggtaatattaaatacaaaatgcatgaaaaaatattaaatatatgaataaatttaaaatttaatcttataatttcaaaattttctggaggtttggaagcagggctgcacgcaagtggatttacaattacggaaatccgcaattgcggcgattttctcagttgcggaaatccgcaatccgcaattacgggtgtccaaaaaccccgcaatttccgtaatttccgtaatccgcaatccgcaattaaaaaaaattttttttttaataattttaaattttattttaaaaaatcctataaatcttttaaagcaatttaaaagcatattaaaaagcaaatttataaaagcaaaatcattcaattgaaaatccggttagaagcaagttatggtgaagaaacaaaagctttgccagattttccgcctgtaaactctttctcaagtcatctgaaatca

SEQ ID NO: 8958 - DNA, 1050 bp, Heterodera glycines
tatatattttttgcaatttttaaaaaaatccaaaggtgagaaccatattttttgcaatttttaaaaaatccaaaggtgtgaaccatattttttacaatttttaaaaaatccaaaggtgagaaccatattttcttacaatttttaaaaataaaaaaagtgaaccaccatttttttgcaataaaataaaaaaatatgaaccattttttaaataaagtgtgaatcatttttaaataaaagttgtgtgatttaaaagaccattaagaaagtaggtatatttctacccctattcagagggaggaggggtggggtaaatgactcaaaaccttttagtggattttttaacataaaccttacggcatttttttataaaattgttttaattacgaatccagaattctctgtcagaggggtggtctaagggtattttcccctttttttcgctgctgataaaaaattaaattaattgttaaaaataatggctgaaatataaagttttcaaaaacctaaatataaacacaccataatttaattttttaaaacccattaaaaaagagtagacagatttctatccctattttggtccttaatcataccgtatttataagatgaggggggtaatcctttcccaaaaaaacctttggtggacctgttactctgtgcctatgagatatttttaacaaaaacaaaaaagtatttgttttttttttatatccgaacataaacaagtaaaataacaaagaaattgaaccgtcaaaaaacttgtcccctcatcattacaatgttttcatccagtagagatactgaacgaccagagtggcgaagatcaggaccaacacgatgaaaattcgttctttccacaaagcacgaagaagttttcgagaatgcggtacgggtgttgttggcggttgctgttcctcaacaatgcgctcaaactacctaaatttacaattaagaaagagtaaaaaaaattgtcctctcaacataccattattactcatttgcgtagatgaaaattgtactttttgtatatattgtttagctttaaatatg

SEQ ID NO: 8959 - DNA, 4651 bp, Heterodera glycines
  misc_feature (28)..(28): n is a, c, g, or t
  misc_feature (4634)..(4634): n is a, c, g, or t
aagtttacattttcaaatcatttttacngcaaaataataacaaaacgccacgccccattaaaaccatggcggataaaaacattcaaccttttttataaaagatgggcggtgttattattagtgagcgcaatgttaaagttaaagtgtgaaacaataaaaattatgagggagggacaaaattttttaataaatatatcctttaccataaaattaaccaatttttcataaaaatagataaaataagacattaatcaaaatcagaacattcttgataaatcataacagatcaaaaccgttgcatataagtagagaccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccggtctctacatataagacattttttacctaagtttttttaacatcgtttaattttattaaaaaaattggctgacttttttttgacattttattaaagttgttttaaatttgaaaaaatgtgattgatcataatttttaagattgaacaaagaatgaggaccagagcaacatacatacacaaatggattaaaaaaatcagatgaaaaagtaattaactatggtttttttaaatattcgtttttataaagtgagattgtatttaaccttgggttttaacaatttgctaattgttgtaatgaataaatcaacaatggtttatcaatgttctgtaattagttggtcaccggaggagaagcataatttgtaaatgccttcgtcctaatttggcctcagcgcacttttcaaagggcgcctttttgatgtggggaaacaacactcaaaaagggacgaagttttgtccaatgctttgctgggcactttttcgttgacaattcgaacattgggccccgaatgggcgcattcgcaacgcgacaaaaagggagagaaacggcgacggaaggcaaattcaaagggacggcagcagacaaacgctaaattagcaacttaatgaaccgaaacaaagcaattaactgaggctagcagatgttaaatgacttttttgaataaaaaggtgttacattccccgttcaaaaaaaagaaacgaaacgaaacgacggcctatgaccccccgccccgccggtgagtacgagatacgccgcaacccccagttcaatacccctaattattggattggcttttcgtgttttttttgccccctagattaaaatgccggccaattccccgccccctccccaatgttcttttctcacctgtacccattccgtgtgcactgctcgcatcgctcgcacttttctccttccttcaattcggccttctcaaaaagtcggagtgccgtgcccttttcttccaaaggacaaatcacttccacacaaaccgaatgatcagattcaactgcttcaaggcaaacaacagttaaatgagaacaaaacttagaagagaagaaacggtagtcaaatagagaggaaaggaagaggtacggtatttgtgagacattctaaaaaaggacggacaaatgacaatgaatgagtattaattattaagtaagggcttcttcttgagttgacgatgacgtaaataagcagaacaattagtcttaattaatacaaaataaaaataagtgaaaaataaaaaatttaaattaattttgacggttaaatcggaaaacaaaataaatcttaggaaagaggaaaaggggaagcgattttgagggaaacggatgcttagggataagtgggcaaaaacaataaacagtgatgagaacagaagaaaaataaacaaagggaggcgaaagtggcgaagacaaaaaatgacttatgaagcgattggagaagtgaaaacaaaaagagaagagaaagtgatcagagacaaaaccaaaccaaactgatcagaaaggaaataaagagtgaacagaaggaaaggatgaccagaagagagagagagaaattaaaccaaattaaattgatcagaatagaaagaaggactgatcagaagggaaggatgatagaaaatagtcgggaaaataattgaaaaaacaattctattttaaaaatagttcatgaaaataaaacttaattttggtcatttaaatgattattaaatattttatttattacattttaatggaattttttaggaagaaaaggtcaaacatagaaggcattaaaatcgtaaaaaaaacacaaaaaaatttaaccatacaaaatttatttaaaatttaacaaaaaattaaaataaaataaaagtttgtcattacagtagtcatggatagaaaaacattcctacgaattttactttgatttaaaaacaagtttttattgaagaaataagtaaagagaatgcgcagatgcaggcaagtgaccaataggaagatttaattggaagttgtgataatgagtattgtgcgcggttaccgtggaggggggaggggattgccgccgaaaggccatttaagatattgtaaacttttcattaatattgtgccgccaaagagaaaatgacactccgcgaatttgtgaatgataaataacaacacattcttttcttcaatattttattttaaatttgttttgaatcaaacaagaatttatatgggcgggcgtgaattcataacatcaattacgatactattttaatagcaaattgttaaacactcttatcatttcttagaatttatttattaatttaaatattatatttaatataaaaatatttttatatataattaaatagaaataattttttatattagagaaaatgttctcctcattaacaaagcttactacttcggatgaggcaattattaacgaatttcttgcgttcgacaatataagtactaattaattttagaaattatttcttatacaaataatatttaaaaaattttttttaattttatcaatttttttgtcaaaaaaatgcaattttactttcttaaccaattttttatcgttgcttttcccgccatttttcatgcttattaggtgtatatttgaaacattttgtttcaaaaaatcctaagcctttgataaaaaattaatttgtttcttaaaaatataaaaattatacaagtgaaaaaattatttaaaaagttattttttattctgaagataatttttaaatgtgcaaatttagggtccacaggtgacaattcttcaggctatgtcaatgacccgcagctgagcacctcaacagttgaaaatatttttgaagtatttttatcaaaattaatataaattaaaatcaatctttttattaaaataattaaaaattaaaaattcactatgcccaaattggtctgataaattttaaaaattttatttaaataacttcttaattaattttttgttatttatattttaaaacaaaaaaaatcagattttttcccatttttagaatgctaatacctcggctgcttctccgatcgtttttgctgaactgcaaaacatatcttttcaatcaaatttaaatttatttcaatcagaacaaattcaggttcatccacaacatttcgagaattgtacccagacggaaacgaatgaagcttcagacatttttgaagtggagatgattctgaagatgagaacaaacaatggattaaaggaatttttagtaaaaaaaattaaaaataatatatatttataaatgtaattaaataaaaatttttttattaaaacaagtatataaataatttaacatctaaatattataaagaataataataaattattttgaaaactatttagttttaatgtttttttttaaagaaaccttaaaattatatatttttttcttacaaatcatattataaaattaaattttaaactatgttttaaagatccgatggaagcactttgattcctcttctgacagctgggagccgcttgccaacctacatggatgtgctgatgtattgatgaacttttttttggatgaggaaaagaaactgattcgaaaaatggtaattataataaaaaaaatactttttttaatgaaattatcatataattagaataaaataattttcaatagtaccgtagtgataattcaaaaatttcacaaaanttaatttttgaaattgg

SEQ ID NO: 8960 - DNA, 2949 bp, Heterodera glycines
  misc_feature (31)..(31): n is a, c, g, or t
  misc_feature (2903)..(2903): n is a, c, g, or t
tgaaatgaggtgtacaaagacgagcagaatncggttagcttttaacaacacgaaacgtcaaaagaaagcaatgcaaccgccagttataaatggcttttctcgtaaacggagtcggccggaagatgttcaactttgatctgcttttaaccggcacccctgttgagggcaattggcatcaggctgaactatagtagcgatttctaagcattcgtactgagcaagggtttaaagcggatacttagtatggttgtgcgaaatcgatttgtaaaaaacccggtaccgggtactgaatggtaatgcaaaaaccggtaacggtacctgtaccggtaaaaccggtaattttccaacgctaaaaattttggacaaaatttttcaaatacaaaattttattcggttttcgcgcgagtgccttttttagcattagaattattcagaagcatatgtatcttccgggtgatcaagttttttttttcaaattcaggataaagaacactaaaattcagagttatgcgctaaaattaaaaaccgcttttttcgtggagcttttttcaaagacttttctgggaataagcggggcggaagccggcggtgccgataggcgccgccggaaaaaattttacattttgagtgagatttgttaacagtaattgtcaaaaaaggacccaatcttttgttaatttttggtttttcgggtgtttaaaaatgaaagaaaaataaagttgatgaaaatcagaaggttaaccacttaccacatatgcatggtcatgattacatgattaaatgaaataatttaatttttttctcaaaaatttcttcttcaccatttaaccgacggttgctcattacgcttcggtacagcggccgtacagagtcagaaggcaaattcccactttattcgacattattatttttaaatagctaaaagagtaaaattaaatgtgaattacctagaacatttgcattttctccggtgacaacagaaaaaagtaaatggcataccggtccatgtttgatattttttagtccatataatttcgaaccctactcattagaaataatggagagtttaacattacattcgttaaaaatttgaacatttttattacaaactctataaacacacctattggctcaaactcacaaaaacttgtcattttttcagcaaaatcggttaacaaatcacaagtaaattatcaatttttcccggctgtgtccttggcaccggcggacttcaaaattctcattaaagattccttacaaaatcacaaaaaaaaattttgttttggaaaaaatctgttaattgtacaattttcaaaaaaattttcctagcgatgcctaacggcaacgccgcccaatccctgctgttcatgaatccagaatccatttagcctattctcaatcccagattcgaattcgaacaaaaagttgcaatttgctggtttttcttgaacaaaagcttattttgaaaactcagctgggagccctgctccccccccccctatctctgctttctctctgactcctcccaattcgcttctctctctcttgctttctctatctctctccctccaactttttcttctctcacttggctctattccagtttacgcgtccaaccagtgaccatcctgtttctcaggtcataacttttttgttatttaggggaaaaatagtattttagggctaaacattttcaatctttcttattgaccccttccaatacctacctcacccaaatttttccaaaatattgttgaattttatgaaaacccagagaattatctattttcccgacaaacacacaaattaacgatttttgacgaatatctgcttaatatggccaaaattctcttttttggaaaaagcactgcagaagcgcgaagaataatgaatttcgcgtcctcattgcaattttctattcatgcaagtatttgctcttttcttgtatttaaaattccctaaactaagctttctttttataccaatgtatggattaaccacgtgagaaatttatggcctaagaaactgaggatagtcactgattggacgcgaaactggaattgacactttccattctcacttttcctttctctctgttttgacttaattatgattttcaagctcaattaaacttaagagtccctatagctagcttttcatagacccactaaacagtaaacgaaaattaagaaaaaaacaattatagccaaatgttctttattaatctattcaaccaaaattatttacggtcactttaaaacaatatacatgaaatacagatcattttaattacattttttgatcatctgactcattcttcccttttgagctattcctccacaatccttttgttgcatgttgggcagcgaactgttgtggcaatgtgacggaagaagcaccggcggtggagcacatgtccgcacgagatttttttctcagtctttttcgtccgcccttctcacactttgcgcacttcggacgggcctgtgccttaacaaccttaaaatagaacaacaaattaggctattgggatgcgcttccatttttgtttacgttgccagcacgtccgacggcggctctgcttttctttgccgccaactttgcgttcttaacgcgtcgcgcattagccgccgcagccatctgttttgccgttgccataatttacaaaacgaattatatgcttaatattaatagcttttaattaaaaatggaacacagaaaatcaacaacattaaaattcaggacgtaatagctcgtttggattggagtattattatgtataataatgctgtttttgtctatttttttttatcttatatactcatttgagattggtgcattacgacatttgtctatagaatcttccaccaaaaaaaaagctttataagggtgaaattctacangtatttgctcattattctgtaatgttcggtttttataccttcattt

SEQ ID NO: 8961 - DNA, 4282 bp, Heterodera glycines
atcattcatttttgtggagcgggacaaaatgtcgcctctcctaagatcgctggacgattttttggaccgaccataacttttttctttctcagccaaattgaacattcttggtaatgttcgaaagcatttgataaactctattaatctgcaatttaattttttttttattcatttataaaaaaactcaaaaattttcgaaaaactgttttttgagttattcttgtcataactactgtattttaaaacttgacgaatttttttgagatttgataaaataataacaaacacatagagctatcaaaaaatatccagagtgcttaatctggttaacaaaaaaaaagagataatccaaataatcttccggcgacttttttggggttcaccgtcattttctgataatggaattgactatttcgaagaaacatactacacggagttggaatatggaaatttgaaatatggctgatatattgtattgatattccttaattaacggaattttcatttttaaatcgccatttttgatttaaaataaatccaaaaagggagacgggggatgatcatccatccaagcatttaaaaagcatcatcatcatcaggtggtgctgttgatggagggaggacattggcgccggcgggagggcacccacaataattcgttgcattttgagggcaggggcacatacggcacagattagtgccatggcccattgccgatggaggaggattgagtgatgatagccccgaggatgggttgtgggattgaaagtgagtggatgcagagatgaggagaagaagaccttcgagaatttaattgcagttttcattcgccctgaggggacggaccgacggacggggaaaatggcattttgccgggcaatgagttcagcggtggggggcggatgggacagataatccaccattccccgggggtgatagcaatgaaaaccaatttgtggcacattaccgtatgaatttaatgggtgccgattggttagcacagcgcttcgggacacgccccttttgccttgggggcatggaaaacttcaaaatgccttccttttaagtgcaccctttcaccattggcactggttgagatgcttaaagccataatttagtggtgccaaggacgaggtgtgtgctggtggatttcaggaaattttagagtttccccctagggcatccttttcccgggagtttcaagaaaatttgagagcttcacctagggcatcctttttccggtggcttcaaaaaaattcgagagcttcccctcgggcatccttttcccgaagatttccggaaaatttagacctggggcatacttttctctgtggtttcaagaaaattcaagccctctctttagccagaaaataaagaaaaattcaaagatttccggaaaatttgaaaatttccccgtggaaatcacaggcaaaaaagaggtcaaaaaatccattaaaacattcaaaaaaaaaaatttcctccgtcatatccttgagggattttcaacaggaaatacattttggaattttccttcatttgtcagagaagcaccgaaaaatttgcaaaattttgaaaaatttctaaaggaaaaaattaaaaaaccctcgagaaaatctcgaacattaacaaggtttcttgcctatggctttgttagagatgggttgtggccagcagctgcagccgccgcttggccccgccgacggggagggcgccgccgaagaagaagccgccgccggcacaggcggcgtggccacgacaagcgcaacaatggcactgttcggcttctaccatcccccagcgacagcaccgcaacaattaacgactaccgtaccaccaccaacagcactacaacacaatgccaaccagcaccagcatcactacggtaggggaggggagagggggtacggtaaggggaactcttgtaatatgaaaaagcttggcatggctcaactcttttgtccgaatattccaacggggttaacgccagggctgttgctaatcggaaaataaaacgcgaaaaaaaactaaaataaatacgaaatgctataattaaacgcccaaaaaaaacacgaaaatattaaacgcgaaacaagcaattttttactgaaaaattctaaaatttataaatcatctcgaaaaaaatttgaaaattttgatgcaatttgttaacagattttgtccataaaatgagcaaattttgcaattttaagccaatttttaaataatttaggaatttttgggtccgatagtgccgcgatttttggcttaattgttaaacgattttcacctatgcaaattttattgtttttaaatggtaataaaattacaaataaataatttttacatttaaaaaatatttacaaaattaaaagagattaaattaattattttttaaaataaaatttgtttcggattatttttttcaaattttcgtaattttattgctaccgtttccgcacagcatcccatgactaccttatgtcctcctcgtcctcatcttccccatttgtgccactaccgtatccctttgccatttgcgacgcacaccatcaacagcagcagcagccgcactcatctgcggcacaccaccatcaccatcagcagaatcaagtgctgcttgatgatgatggtgccgttgtgcaccagccattgttcggtggcggcggtgccgtgacaagcgccgcaaacggcgcttgttgctactatcacaaccattctcgtggtgtgtatcagggatggcatggaattttgatttccgaaaactgggccggaattccgattccccaaaaaattattgggcctcggaattccgatttccaaattttagcacctcagaattaaaatcgagactctcgggggttgcctcgcccctggttttcttgatcagtcgaggcgatctccgatcactatcccagtgatcaattgggccctccccaataattctaatcagtttattaccatttttgctgattttaatgccgaaattgcattagaaatcgttccaggtccattttggcacgctttcacatgattaattagtctgattaattaatattaacgatactactcacatgtttatgtcacaatgccgaaaaggtgcggccgtttcgtcgtcctatccggcacggccgctcaaatgtgatgggacgacggcaacacacaacaatttcgcgcagttcagtgcctattccgctggcgtgccatcttcgtcctcttcaatgactgagtggcgcgggccagacttgtacttgcgcgtcggtgccacaattgaagttggcgcaaccgctccagtaaatgtattatgggttgggtttatcggctcccggacaatctgtcaatggacaatccgtcagaaactgccaacccaaaaactttttgagcctcggatttaccgatttttaaaaaattttggggcttcggaatgccatctctggcaaatattaacgcgttctttgttgataagaataattattaatgcttaattaatccgttcattgtctcactagtatacaattaaactactgcttattgcttaattagccggcctttttcagggaggctgttggtacggcactgggccgacttcggcactttcgcaccatcaccaaaaccattccggccatcattaccataatcaccaacaccaacaccagcagcaacaggcgttcaacaacggcacggtgacagccagctttttgttggcaccaacaaatcagcatcacaatgctcatcaacatcatcagcaacaacaatcgtcctatcatcaccaccaccaccaccaccagatccaaaatcatcacaacggcaacaataataataatcattttgttgccgccgccgcgagggttgtgccattgtcggcggcggcggtagacgactacgacgaggacagtgatcagcaacagtgccctgctgctggcggcgggatgatgaccattgcattgcagcagcaacatcagcaagtgtgtggtggtggtcattagagatctgggccccgccgagtacggcattttggacacggggtgcccgcaggagtcctaaaaaacggcacttttcgcccgttcccggcccaaatatagtcgcgtcccgttcatttgaaaattccgttatttttaacagttatcaggagattgaatgttggacgttaatccgattttgcttacgggcgggcaaaattaagggcaaattacccacacgagtacagtagagcaaggcaccgtaatccgctcggttcgccacagtagtacttaagcttacacaacatttaaatgatgcacaaaaa

SEQ ID NO: 8962 - DNA, 1365 bp, Heterodera glycines
tttcaaaagaataaaaaatatatattatcaaatatttataaatccatttcacatttttttaatacaaaaaaaaaaatcattaaaattcattaaagaaaagaaatttttgtgcataattaaaaaaagtggcacgcccccccccccccccccccccccctcaaaaaattcactggatttttgtcgggaattctcttaaagccctaatttcatgcgacaaaagatttttaggtcaattctgggacacaatattttcttatttgttaaccaaaattgtttatcccaatcaaaacttctattatcagtgctcgaaagtatgttttttagctccacgctgaccaaacatttgcgcacacacaccgggcagaagccgtacgcatgcgcactttgtctaatgcaattttcgcaggttaaccccactgtgtacagtgtaaatattgtggaattaaaaaaatgtacagggaattttcaggaaattttcaagagtaaatttaaaatgcatatttttaaattttgtttagtcaggcaatttgcatcggcatatgaaaacgcatgagcaaaggcgagaagccagaatcaattaatgaatgttaatgttatattgttatataattagctaattacagtgttcataaaatatttgattaagaaaattactgtacaaataataaatgcgctttttcttaagcagaacgatatattttaaactcactgaaattaacttacttatttatgtataaaagtcgtagagacatggtttttaagtagagatcggatacggacgggatccgtatacggatttttacggatccgtagtccgtaatccgtattttttcggccaatacggattttttacggactacggatttttaatccgtaatccgtatgggtgcctagtccgtaatcccgatcctgatccgtacaattcttgatacggattagggattttttttttggcctttttaaagtgaaaatggattatatttttaaaattttgtgcggtcaatttcgcccaatactttggaaattggcgggttcttatttcgttaaatattttggccgaaaaatcgaaaaaaattggaaaaaaagcgaaaaattttttgcgaaaaaactcgaaaatccttacgttattgaattgcatttagttgaacctttacgaaattctatttcgatttttttccaatttgtaaatttttcaagaaaatgaatttcgtttttctattttcttaaattttttacgaacttggttttgtaaatttttcaaaaattattagattattttttatgaattatttgtcgacgaaatttcgatgaaaatggttgaaaaatcgcgaaatttgctcattttttggtgaaaagtctgttatc

SEQ ID NO: 8963 - DNA, 1607 bp, Heterodera glycines
atatggtcccaaattaggtcacctgtcaatcaaaaccgttctattggttctctttttcgtaatatccctattgatttcgcaatcgtcacgtgactttttggtacttatttcgcaatccgcccactttggcgcgagcttttttggcgcgagcttttttggcgcggccattttggcgcgtccattttggcgcgtccattttggcgcgtccattttggcgcggccattttggcgcggccattttggcgcggccattttggcgcggccattttggcgcacgctataaagtgttttttggcgccaatggtcaaaaatctcaaaaaattttcagttcttgcacattgataaatcatttattataaaaaataatacacgaaaaaatgaaaataacaaatcacggatccataacacagttatttgaaattcccctcagaaattcaataatttttgggcatcaaaattttcaataatattcaaaattcgcttgtccgccttctggaacttctttttcttctttggtggttcttcgccattttcttgtcccacgacatcgttcagcgcagtaattgcagcagtcaaatgctgaattggcacaaatgcgagcgcggtgatcatacgagcagtttctgcgaaagcggggtcacttcgatagcgctaaatgggatggaatttctttcttttaaaaacagaagggaggtttgtgttctccgattaatatgcacattcagccaaacaaatgtgagaattgcccctcccccttacaccgtcccccgtccaccatttgttgttgccattttctgctcctcattttgagcttcgtcgttggcggtggaatggagaagtgggaggaggagcgggggactgttcgggggcgttctgccccctccggtgatgtgctgttgtgatggtgccaatgctgtactgatggtgaactgatgatgaaggcgcacaaatgcagtgaaaaaaggtacaaaaaaatcgtgggggaaatgtgatgactgggttggggttaggaggtgagaaaacggttggctgacttgaatttgaataaaggtcgtggttggggggagagattaggaaacggataaaaaattcttagccacccccccatgtatgataccgtaaatgagattctgcgtaagatgcatctgccgaagacatcgtacgcatggatgataccgtaatgcgctttgcgtacgatcaataaactcaatttattaattggcaaaggtccacttggcaattgtccaacccctccccaacatttggcaactgcccaatagcccccttggtaattttgtattttcaattgccgacactaccatgccccccccccaaatctttcgaaaaaatcgataactaaattggcaaatgtccaattgccgcattaccgccccccccatccttgggaaaaaccgatattttaatttggcaaatgtccaatgtttagccccatttagcgcacgcgttctccccgggtcaatgcgtccccggttacgggaaccggtacgcacggacgcgcccgcccgcccaagcatacgcgtcactgttagcagcgttcgcgtcgacgggacgtaccccccccccccccacacatacacatacacacc

SEQ ID NO: 8964 - DNA, 3017 bp, Heterodera glycines
ccaccccgtccaccatttgttgttggtattttctgctcctcattttgagcgtcgtcgttggcggtggaatggagaagtgagagggggaggtgggtggggggattgttcggcaccgttctgccccctccggggatgtgttgttgcggtggtgccaattgctgtactgctgctgattgatgatgaagacgcacaaatgcagtggaaaaaggtacaaaaaaatcgtggggaaaatgggatgacggggttggggtgaggagatgagaaaacggttggctgacttgaatttgaataaaggtcgtggctggaaggagagattaggaaacggataagaaattcttagacacccccgccccctcaaccccgttctgttccatctttcaccccctctgatcattcattcattttccttcaatttttgtgcactttattaataaatgttcaattatttatttcccacattttaagcagttcacttcaacgcaatttgttcatcaacagcaaaaagtgtgtcgacaacaaatatggacaacaacagtaacaatggtggtggtggcaacaacggcgggcgaaaaccgcccccctcccggggtcggaagaggctgcacgagagcagcagcaacaatagcggcagcagcagcagcaacagcgccaacaattttgtggacggcgacagctcttcaaccgtgcgcgcatcaaaccgtcctcagcaaccgcagcagcagcagcaacacaactataacgacttggagctgctgctgatccccggcattgacgacgtgaacagttcggcactgcaaccgcagcagactcagatggttcaacgaccaattgcgacgggcaatggacgtcaaatggtggtgagttcaaattggggggactcgttaaaataaaagccattttggcacgctgttaaatatattttttgtattttctaaaatttttggcaaaaaatttaaataattttcggaaaacaaattaatttgtttttttaaaacatttggtttaaggcggtcaattcggcgtcccatggcacgcctgtggaaggaactttgcaaaatgtggacggcggcggtggcggtggtggtgtcttgtctcagcgtaatgtaagccgggagtgggggcgggtgtgtgtgagggataagtaatgggatctctctagccaaaaaaaaattgataaacgggtgaccacaaatattttttttatagagaattgaagcaccaaatgtcccctccctatttgagtgcaaaaaaatggtgtgcccatgtggagtttgaacaatgtacgtttttttggggggatgtcaaagggtagcagggcttttactagcatttcgggtgggccttcatttttgtcattgtaaaccgggcccaaattcgaacaatatatgttatttgatggattttatttatttttttgtagtctgctgtcaattttgccgctctgatgacggccggcgggggtgacggttcatgtgcagcccgtcccggtggtggaacgctttcggtggtgcgcggtactgttggaggcggacttgaggtggtgtttttaaatttttttgtgtcaatgtggagggggggggcaataccaaattttaaaattaaacatttttcttttaaagtcgctcccgcccagtgtgcgtgaggcggttgcaaataataatttttcccattttttttttgaaaaaaacatttttgatttaaaaaaataataatttttccccatttttaagtgttcaatccgccgtcagcaaaaacagcacagcctggtcatgcaaatcgacgacgatgatgagggcgaggagcagcaggacgaacaaagccgcgggagtggcggtagcgacgatggaccggcagcgaattttgcattgtcatctgcgggcactgatgcgccgcgaaccgagaccggcgcttcgtcaacggtgagccgcaagtgaacaaaaagaaagaaaagaaagacaaaaagaaaaagcaaagaaagaaaaaacgcgctcgcataccatcattatacgcacacacacactcacacaaacacatacaatttgttctttgtttttaaaaatacaattgttgtttattcttctgttgtgttgttgtttttgggttgtttaatagtgggggacgggggaattgagtatctgcgggcgtgttttttgcggaaagtcatgcattttcggtacaaaaatttaaaaaaatgattccaaattttttagccatggctttccgcaacgcgcccgcccactccacctccgccacgaatggatcatcggcggcggccaacgggtggtgcgcccgtcatgtggacatttcctccacgcctgctgttttgagcgtgaggcgaaattggggcgagtgtgccccatttgttcagcccattttataagtgggaagaatgactcgctagggtcaaattttcggtggaggacgccattgaccgctcaaaataattaattaaaaaataaaaaacattttaattttttcttcatttcgcatttttgctttttttgttcaacatttctcattcattccattctttttatcatatttttatgttgttgccaatttttatatatttttctgccatttttaattaaacttattcatttttatatttcaaaattcagtaaatttattcatttttccttgtgtgtgtgtatgtgttttgatgtgattagggggggggttgcttacagaaaatgagaagcgctagggctttgggggagagaaatggtgccatttcattggaagggctttcacaaaaagggaaaatagggacatgcgcaaaaatgactttttgcatttatagtgtaatgcctggcgtcaaattgggcgaggtcggccctcgttcaccaatcagtctgatcacgacagcagcagcaccaatcgctccgaccatcagcagcacgtcagcggagcgccgccgatgcgcgacagcagagatccggcggtgtcaaatttgggcagcagcagcaagcagtgtaagtgccgccgagagtgccaacgttgcgccgagcgatgac

SEQ ID NO: 8965 - DNA, 1570 bp, Heterodera glycines
  misc_feature (75)..(75): n is a, c, g, or t
acatatttttgaagattttgggggaaaaaattttacactcaaaaatcctatgctcaccccttttgtcccgaatcnccaaaatcacttttatttttataacttttttcaaaaaagtgataaaaatgccaaataaaatttatataatagagcaaaaaattgcggattttatcaatatttttttataccttagcactttgtttggagtgagttatgaattttctagtgaaaaatagaaaatttccagaatttctggaataactttttttgtttttgtggtataaatttcaaataaatctcataaaattctcccgaatttttgctattttttatgctttaaatgagctgaattggaccattttgaggcgagttatgaattttcaaagaatcacttaaattcccaaatccaaaaaattgacgatttttcaaaatttttttacctccctccaaaaaatccaaaacgcaatataaagtgcatattcgtgttcagcacctcaaattaccccagaaaagtattttttggcaattttaggagcaaaaaaatttctcacgaaatgcaaatccatggggtcccccctttggttttgcatttaaaaattcatttttgttttataactttttttatattacagataaaaagatcaaataaagcacattagatagagctcgaaattctctacaaaaaagctctgggacgatttttcgctaaaatcaacccctgacgagttataagcccgggactgaaatgtcccggtcaggccaaaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcccgaaaaacggaaaatgccgaaattgggtgccaaattttgccattttctgcagcattggcatttacagatagaacccccaaaccaacggcattcagtgccaaacagtccaacttaaaatcctacctccaagcattttccgctcccgcttcttcccgcaaagttacaggccaccaaagacggacaaaaaaaatttcacgccgtttcagcgccgccggcgctgaaccgtccaccggagcggaaaacccatatttttcccagatgcgcctcaaaaagttgtaagacccttccactactttcagggcgctcccggccttcggccgggagattttgtttttgaagacgaactgcaacgtttctctatagtaatataaactagcgtgttgcacagtgggggatgttgtgggcagtatactttggtatttaggaaggagacgctgacatgagcgcttcgcgcaaaggacttcgttgctagtgcatgcgcggcttccataatcgatgcgtgtattgaacattggcatggcacccccacccttc

SEQ ID NO: 8966 - DNA, 1182 bp, Heterodera glycines
aattttgacgatttttcaaaaaattttaaacactctccaaaaagtctgaaactaaaaataaagtatataatcaagttaagcaccttaaattaggccataaaaatgcattttggctaatttaggagcaaaaaaatttttcatgaaatgcaaaaccatggggtcccccctatggttttgagtttcaaaatcacaattaattttataactttttttaaactcatggtaaaaacatgagataaagcacattagattgggctttaaattctctacaaaaaagctcttagacgatttttttataaaatcaactcctgacgagttattgagccagaactgaaattgaggcctagcaaccaaaattttctatttccaaaaaaattttgaaaattttttctgaaaatgacaccaatcgatagagcatcaaaaacggttgcttgaaagtggtctccgttttccccggaaaaatctgtaaaaaatactaaaattcaaaaacctcaaaagtgatgagggggcctagctcgaaaatttctgaaaatttcagaaaactaaaaacatggttggatagagctcgtcgagctgtacaataagtacgctggcgccgcacagctcagcgcaatgcccagcgagttattcccgaaaaacacaaaaaccggaaaattggaaaaaaatttttacaattttttgcaggccagggctttggtgctaggggctaggtcaagaagaaaaaaatttcccaaacattccaacttagtcgcctcccagcagaagttttttgctccaggttcccagaaaaaagttatggccccaaaactgcatgcatttttcctcaaaaagccgtttcagcgccgctggcgctgaactggcccccagatcaaaaagtctatagttttcccagatgcgccgtcaaaagttggttaagcaatgtcacacttaaaacccaccctcggcgcccgttcccgagattttggttttagcaacgaaacacgatttgattttatagtatataaactagcgtgttgcacagtgggggatgttgtgggcagtatgctttttgtatgtatggacgggcgctgacatgagcgcttcgcgcaaaggacttcgttgctagtgcatgcgcggcttccataatcgatgcgtgtaccacaacatgcgtggctccccacccttacccccacgcttcccccc

SEQ ID NO: 8967 - DNA, 2497 bp, Heterodera glycines
taaaatccagcaaaatttggatttagataaaccaataaaggcatatgtggggggtgccttggatcattctgcattcaaataattttctcgattttaaattcgccccaattgaaaaaatttaaattaaaaacgaattctaccgttcagtattaggtattgaaaatattttgagccaatgagataaagattaagcaacaagcttattgattgggattaattcatttaaaaaagaaactcacgcggtggcgggatgaagaacagcgaaggttaagcccatggtggttaactgctgttgttcaatttttttttcatataatataatttccaatttatcgtttgcttctcccccctccccccccacacgcctctccctcacgccttccccgccccacgcccgacctcaagacgggcgcttcgcgcccgttttttaattttgttgaggacattgggccgcttcgcggcctcaggacgggcgcttcgcgcccgtttttaattttgtgggaagcattcggccgcttcgcggcctcaagacgcgcgcttcgcgcccgtcttttaattttgttgagaacaatcggccgcttcgcggcctcaggacgggcgcttcgcgcccgttttttaattttgttgagaatttctttaaattaatttttttcatattttattagaagaggtacaatgtgaattttaaaatttaaaacaattattgataaaaaaatgtaaattaaaaatttatttattattaaatattaaatcaaaactattttaataaattaaaaacatctaaaaataagtaaaaaaatacttagaaaaataatgtgttaccgcccggattcgaacttgccccccgccccctcaaaatgatgcctcagaatccccaatcacacagggattctgaggtcttatcgatgtcaaaagtaaaatctgatcacgtattcgtgatcagcgtcataaaatacccctaaagacatgtttttggaagatttttggtgaaaaaatttttcaactcaaaaatcctatactcccctttggtcccgaatgccaaaatcacttttatttttgtatctttattttaaaagatgataaaaaggtcaaataaaatttatataatagagcaaaaacttgcggttttttgtattattttactcttctctaatgacttttcagaaccgagatataaatttttttctgaaaaatagaaaatttccagaatttctggaataactttttttgtttttgtggtataaatttcaaataaatctcataaaattctcccgattttttgctattttttatgctttaaatgagctgaattggaccattttgaggcgagttatgaatttttaaaatttaggttgaattttcaagggccaaaaattattgaattttcaaaatttttttaccaccctctgaaaaatccaaaacgcaatagaaagtgcatattcgtgttcagcacctcaaaataccccaaaaaaatattttttttgcaattttaggagcaaaaaaatttctcaagaaatgcaaatccatggggtcccccctatggttttgagtttcaaaatcacaattaattttataactttttttaaactcatggtaaaaacatgagataaagcacattagatagagcttaaaattctctacaaaaatgctctaagacaaatttccgctaagatcaacgcctgacgagttataagcctcaaacggaaatggggagctcaattccggaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagtcccgaaaaacggaaaatgccgaaattgggtgccaaattttgccattttctgcagcattggcatttacagatagccccgccaaataagcgccaagttttcccaaacagtccaacttaaaatcctacctccaagcattttccgctcccgcttcttcccgcaaagttacaggcctccaaagacggacaaaaaaaatttcacgccgtttcagcgccgccggcgctgaaccgtccaccggagacttttctctatggtaatataaactagggtgcccagttggctatggtgtgcatgcgtggcttggtaatatattgctctcatttgttattttaaaacatacaaaacattaattgcattagtgtgctgttttaaagcgctatcgcgctatgggacgcggcttcgccgcgtcgctagaaattgatgtaatttagcaattcatcgcagcctcaggacgggcgcttcgcgcccgtttttaatttttcgggggacattcggccgcttcgcg

SEQ ID NO: 8968 - DNA, 5094 bp, Heterodera glycines
  misc_feature (2564)..(2564): n is a, c, g, or t
  misc_feature (2598)..(2598): n is a, c, g, or t
  misc_feature (2600)..(2600): n is a, c, g, or t
  misc_feature (2619)..(2619): n is a, c, g, or t
  misc_feature (2640)..(2640): n is a, c, g, or t
  misc_feature (2642)..(2642): n is a, c, g, or t
  misc_feature (2651)..(2651): n is a, c, g, or t
  misc_feature (2653)..(2653): n is a, c, g, or t
  misc_feature (2665)..(2665): n is a, c, g, or t
  misc_feature (2669)..(2669): n is a, c, g, or t
  misc_feature (2679)..(2679): n is a, c, g, or t
  misc_feature (2688)..(2690): n is a, c, g, or t
  misc_feature (2695)..(2696): n is a, c, g, or t
  misc_feature (2711)..(2712): n is a, c, g, or t
  misc_feature (2715)..(2715): n is a, c, g, or t
  misc_feature (2719)..(2719): n is a, c, g, or t
  misc_feature (2728)..(2728): n is a, c, g, or t
  misc_feature (2735)..(2735): n is a, c, g, or t
  misc_feature (2750)..(2750): n is a, c, g, or t
  misc_feature (2752)..(2752): n is a, c, g, or t
  misc_feature (2760)..(2760): n is a, c, g, or t
  misc_feature (2766)..(2766): n is a, c, g, or t
  misc_feature (2772)..(2772): n is a, c, g, or t
  misc_feature (2785)..(2785): n is a, c, g, or t
  misc_feature (2788)..(2788): n is a, c, g, or t
  misc_feature (2798)..(2798): n is a, c, g, or t
  misc_feature (2803)..(2803): n is a, c, g, or t
  misc_feature (2812)..(2812): n is a, c, g, or t
  misc_feature (2815)..(2815): n is a, c, g, or t
  misc_feature (2822)..(2822): n is a, c, g, or t
  misc_feature (2828)..(2828): n is a, c, g, or t
  misc_feature (2832)..(2832): n is a, c, g, or t
  misc_feature (2836)..(2836): n is a, c, g, or t
  misc_feature (2841)..(2841): n is a, c, g, or t
  misc_feature (2846)..(2846): n is a, c, g, or t
  misc_feature (2850)..(2850): n is a, c, g, or t
  misc_feature (2858)..(2858): n is a, c, g, or t
  misc_feature (2861)..(2862): n is a, c, g, or t
  misc_feature (2865)..(2867): n is a, c, g, or t
  misc_feature (2876)..(2878): n is a, c, g, or t
  misc_feature (2883)..(2883): n is a, c, g, or t
  misc_feature (2887)..(2889): n is a, c, g, or t
  misc_feature (2892)..(2893): n is a, c, g, or t
  misc_feature (2895)..(2895): n is a, c, g, or t
atggcagaaccataaacagaaaaatttcgggaggggcatccccctagctttttttttttttgctattcgcgtcaatttctcctacttaattttaaatttgtcgacgccggagagcaaaaaaaaaaagcaggaatttgtggccgctttttgcccaaaaaaagacggctccctatcatttcgtcactgttcagttcgtcaccgagaaaacttttttaaaagtttgtctggcagattgaaacaaaatctgtcgtacatatgtataaagttcgaaaagaaatggatacagcacaaaaattgcaattattggagcaaaaaatttttttaaagttacctatgtatatcttctacaaaattggtttatacccaaaatccatcgtaagaccattcgcaaaacattcataaaagataaaaggtcgtcgtaaatatcagccctgactccccgccccctcccccctcggccactcgtacgttctacggggaacctgctggccgaccccttatacacttgtgatcataatcagggtccgaactgaaaaaatcagcatttgaccgacaaaaaacagatatgacccctttaaatcagcaaaatgctgataaatcagcagagttgggagccctctgatcataatgaattatggcataaaaattttttttagaaataagttcatttggaagttaaaattaaaaatgaaaagctaaaattaatgtcttttatttcagagaagatatccctttcaaatctcacattcaaggcaatttaaaacttttatcaaattcctttcttacttttttgctagcacttttgtttattaaagaatttttttgtttttttaagcaatgtgccaaacttttaaaaaaaaatttctcagtgacgaactgaacagtgacggaacgatcagtgacgaaatgatcggccaccaaaagaatattttttacaatttttggggttaaaattaaaaaattgataaaaatggggtccggtagtgccgacagtcgccgcctaaatttcaaaattgattttttccttatgagttaatatgtttttgattttaaattgtgtaagaagctttacaaaaaagttgcttttttggggggtattgttctcaattctcattaaaaaaccatttgctgataaatgtcgcttacaaattagtaaaattctgattttcattattctagcagattttggtatcgattatgagtatttaaaaaggtatttatgtgtgaatttctaaaggttgaagatcggcagttttttccaaaagatttgttatgtaattctgataaatctaccaaaaaatatttgtttttgtgccaattaaaaaaggcctgtatctcttacttatgttaatttttacaaatttaactacatatttgaaattgtgtaaacaaaaattatttcatttccccgcagtgacctcctccgtcctgacaatggaagaactgctcgccgtcttccaattccattgccacccgaatctccgcggtgcgcccggacagtacccaatggcatttccgtgccatggacgcatttctgatcagaaagaaggcacactttcgatgcaaattgagaaattgtcggaatttgcgcgagaggaagtgaacagcaggcgattaagcaaacacttttacacaaagggattgccatggaaaatattagccaaaataaaaaccaaagaaaatagtactgagaaatggctgggcttttaccttttgtgcaccgctccaaaacaaggtggagagataaataaatttaacaatttcttattcaattaagatggaaattggagctgcaaatggagctgcaaatgttcggcaacccttcgaattgcctctcaagacagcgtaacggaggatttgataagaaaatatgaccatgtatttaacaacgaagtggacaagtggggtttctcaaatttcattgcttttacggtgagtggcagcaaaacttcatttagtggcttaataaataggatgaggattctaagaattttacttattttttctgcggctttaactcaacaagaatacacgaaaaacattttatttcgacaattttgcgttttagcgcccttatttgaccttagaaatccttattttgggtgttagccattaaaataagttctgcccttaaaaatcctcgccctattaataaacagtaaaaattaagcaattgatggatccgagcaaaggattttacgacaaaaatgaggacaaagtgacgctggcgattgatttaactgttgaagaagaaaaaggcgaattggctgatgaataagcgctcaccaatcactcattttcaattgataatgatcgtttggaaatattatgcaataaaatagaagcaatacttacaattagcctattttattcatatcatttttaattttataaaatttggtccttttcgccgccataattaaaaatctcgaaaaattttgaaattatgttaaaaaacccgctagtctaaattttcgttttctttttttgaattttttgcaaatttaaatgatttattttaaattgtgaaataagtatagttttgttccaaattaaactcaaancttaaaatttttcacataaaaaaaatacaaaacnanaaataaataccaaaattanaaatacacctttaaaaaattnanatccctaantnttcctctattancctncaaaattttnaaaaatttnnnttaannttcaaaaaaattatnnctnttcnaacaaatanttttttnaattttatttatttncnctcttacnaaaacnactccnacccctccatttnatntcattttctnttttnaaaaccaanctntatcatnaaaaancatntaanaattnccccnatanattattcnaannttnnnaatttcatnnnctttntttnnnttnnanttaatcgagtggcgggaaaggtcagtgattatttaaattaattgaacacattaattaattatgacaaaaaaggaaacagcagccaccagcagttgaattgccaacgattaaattggatatacatatttatatgttgtttaaaacaaactatttcaacagctttctaacccatagaaatctttaatttttccattgaattgtttaagaaacgaaggcaaaaaaaataaagaaagtataaaagaatttttggccaaaaagcagccatcaacatttttaaattgcgtataaatctcgcaaaaatgaacaaattgtttataaattagagtccggaggaactctcgactcaaattttaatttagaaaataaaaaatccacaataaataaccaagtttgtcaggttttttgtaaaaataagtacagagttaaatcatagaatagaaatttctgcctggataaatatttttgggtggaagagacgcacctgataatcttgtacaaaattctctatctgttgcacattttgatattatttttttattatatataaaatggagattaaattattattttttgggtcatcgttttgccgttaattattattttatgccctcgccaccccatcataaatataagtgaaccatgccatctttcttcatttaactcttctgcaattacttttttgttcaataagttcccttttaaatatatatttgttaaagaattgttatttaaaaaagagaattcacaatttggcaatttgtgattttagtccctcaaaataacccggcaattcaaatgttattttggcttgttccaatttcataattcgaatattatttttactggggtttgttgctcatcagtaaaataaattcattttaaaggtttgttacaaattttgaacatgggggaaagtttattttctgatgatctgatgggcttcaatctcgatttccattttcaaatttccacaaaaaatgaactaaaccggaattttaaataatttatctcatttagtttccaattattttattgcataaaatagataaattacgaatttcacaattgtttataatgtcacaatcagtggtttatcggatgaagcatttgttgagcacgggagaagacgcggatgtttattttttggtgggggacggagacggaaaagaggcgagtcttcttcaaatttgaaatttttttattattttttaaattaattttagtgaattgtcctttttttgtttgatttttacttaaattttaatcctcttcagcttttgtcagcacatagactgattttgaagcacacttctgaagtatttgcggcaatgttccgttttgatgctaaaaatgaaaaagcggaattcggtaaaaaatattaataattataataaaattaaataattaattggtaaaattgcaatgtttctggatccaggcctaagaacaacgggaaaatggtcacataaatcaataataaaaaaaatcaatcagattctactaattatattaattagttttcaattaaccttgctcattgccataattatttctcaattagcctctgctaattgccccgtggaggtcactgatgttgaagtggcagcgttcaaagtgatgttgagcttcatttatacaggcgatttggccaaattgaacggatacaatgcaatggcagtgctttacgccggtggattatttttttatttgatttattaattatttttttaattagccaaaaagtacaacatccctggcttggtcgacgcatctttgcaagttccaatttcatcattgcgaaatgttttcttggcttatgcccaggccggtcttttcgaattggaggtgggaagaacaaattgaaaaaggccgaaagaatcaaaaatttattggtgtttaaccggctgggccagttactttatataactattttttattttcacatttcgaatttagaattttgccaatgattgtttggcttacattgacagaaatgcggatgatttgttcaaatctgatgcatttttgcaaattgaccaaaaattgttgtgtgaaattttgggacatgacgaattgcaatcgatggagaaattttcatttggaaagcagtaattttagaaaacagaaattaataaatattaatgaatccttttatttattttcattatttttttttttttttgcactccgttgggctga

SEQ ID NO: 8969 - DNA, 1522 bp, Heterodera glycines
gaataatgattttatgataaagcaaagacaaagtgacatgcccatgatgtcataatgatgagaaccaaagtcgaaaattcactttgatcaacgcaaatcgactgggacaatttcgatggaaattgaaaaagtgtcggaattttctcgagaaatctttttgagtgaacgtaaaagcaaaactgtgcacatcaacggattgccatggaaaatatggacaaaaatagaaaagaaaaatgaaagcactggcaatgagaaatgctttggcttttacctttggtgtgatgctccaaaagaaggtgcaattaaatataaattaacataaatgattaatttgaattgagcagaaaattggagttgcaaatgttcggcaatttttcgaattgtctctcaaaagagcgatgtggcggatttcagaagagtattcgatgcccatgtttttgacagtaaaaagaacagctggggatattgtttcatttcgtttgcggtgagttcaattagctattttcttaatcgatccaattatggacaattaaggaattgatggatccgagcaaagtattgtacaacaaagaagaggacaaagtgacattggccattgatgttacagtgaaagaagcaaaaacggaggacaaataaatgataatcaatttgcaattttttgatttaaacatccttaattgacttattatttttcgtgttaacttttccaactgttgtattcctttactgttccaaaaatgtaaaactattaattaattttcggtttgagtgtgtgtccaaattgaaatttgtttaacttaacggaaacttttgaaaatttgcaggctaatagaataaacttgacttataaaatctggtgccaaaattaggtacttggcgataatttgaaaaggaatagaaaagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaatgagatagccaattttccaaatttttcccaaacaaccgcaccgagaaacaaaatcctagaacaattagtatcggcgtaattattatgagaattcggttggaattcgtattactgtagagcagaaaaagagataggcaattttccaaatttttagctagcaaacgcgcagagaaacaaattccagaacagattagtatcggctgtaattattatgagtaatgcggttggaattcgtgttgccggtgagcagaaaatgagatagccaattttgcaaacttttcgcaatcaagcgcgcagagaaacaaattccagaacaattagtatcggcgtaattattctgaggaatgcggttggaattcctattactgttgagcagaaaatgagataatcacattttccaaatttttcccaatcaaacgcgcagagaaacacattccagacacaattagtatcggcg

SEQ ID NO: 8970 - DNA, 6057 bp, Heterodera glycines
atccaattcaatgtccggaaacattgatttctaaaacattgaaataaaatcttttggtgtaaaattttgacttacaatttcgtcgagattgtccttaacaagagccattctaaaggaaaaattaatacgaaaaacgaaaacctaaaacgtgtatagagtaactttttttaatttttaaactgcctacaaacgaaattcgaaaaactttaattttcgattttctgttcgaattcgggtccaggacccggagttggtcgaaatgagtgctggatttcgtgatcagccccgaaaatcctcgtaaacatattttcatgacttttgaaaacaaaaaaaaaatttcgaaaaaagggagggatcaccatcgatagaattttacccaaaacaatgttaatttctaaagctcattgtgtcaattaatttctaaagctcaaattgtgtcataaatggatatgataagcaatctaaaagttttagacaaaaacttctgaatgatttcctaaatacaaaatttatgagattttaatttaaatctcaaaagatcgggaaaataacgccaaatttaaaaaaaaattgggagaattcagtttggtcgaccaaaaaaagtggctcaaaatgcaaaatttagttaggtatataaaattcttttttactgatttttttagatgtcaagacctttgcctaacgtaacacagactgcaaatattttgcgtagtaatgcgccatcgccgcataatcaacagcaggttaaaaagagactcaaaatttgagttgccataatggatttattaaggctctctatcaacaacagcaaatgttaccccacccgcaacagcaggttaaatagattttggaaaaagttcttatattaattgcttaaaaattttaactatttttaaatttagaatgatataattattataaatcattttgaaacttgaaacagtcattagtcacttgcaacagcgaatgctattatgtattattatccaggaaatccaatttttgggtgcctacccttgacatgagtctttcaaattaatctggatttagatttggatttcctgggaaaaattgttttaacaaagctcgtaaactgttcttaaaaataattaaaataggcatcgatgcatataatccgtcatttgctatcagttacaccctccgccacggctcaattcgcaaccgccgtacacaattgtctaccaaaatcaacaacgcacggctcaaccgacagtttttggtaccaaaaaattgttgttttccaattttccaacctttcccttttgttggcactgccaattcgccgctccaatcgcagtccatcagttcgtcatgcgcctcttcaccccaattgtccatgaccagcagcagcggtggcggcgccggcgatggaggcacggcagcgccggtggcatcggcaaatccgcacgacccaaagcgggtgagaaaagggcaatggtagggaattgccacaagccaaatttaatgaacacattcactgaagagaaccgataaaagcctttgttgcaataaaaaaaatggcatttgatatttttaaaattaaaattgacaacatttttaatatagtgcagtattttcagttgcttctcaaatgtgcgcacttcttcaaatcgctgtcacgttttaaaccaaactcttctcaggaacaacaccaacaagtgctgcaactgttgagagtgagataatttagccttaacactgaagttattgaatcgagaaataatttgaaatattttaatttgattacttttgtcaggagggcgtcacaagtgaaatgagtgcagaggaattcagtgccaaactgcgcgaagtcactggctcacaggtgacccaaaaaatacggcaaaatttttgtgcaaactcttttctatttaatttcgttgttaaattgatcatatgaaaatcccagcaaaaatttgattaatttaaatttgttttatgatgccatttgatagagaaatgtttgctgatcattttaaaataagtttaattactctacctttattttaattttttttatgaacttttaaaaattttgtcatttttatcgatttttcggaactttgatcaaatttttctgatcatttttggcgccggagccaaaaaagccgaaaattggcaatagtaaatcgactatgctctacacgataaaagtggtttaaaagtgatttgaacacatacagttcgtaatgttcccttgtaaatgtacaataaacaactttttcgcttcattccatttatttgctctgtttaaggacaaaggcactctgttgccctttttgaaattgtcacttccgttgctgcgcgtctcccttcgcaaaggcgaacagaatgaattacagcaaatgcttcgtttggacggtgccggaagcgcctcgcccgaagaaactgcggttaatctgatgacagaacatttgagtggggtgggagacgaaaggcgttactttcaagaacaaggcaacaaaatgccactgatttttaatttacgatagttttcttagattatgattcaatcaaaagaaaatcatttttattcttgacataatttttaattttttggcagttgctttctccgcaacaacaacaactgtcagacaacggcgtcgatgaggcggtcacggcacagcgacaacttcaagtgtcgcgcagtgtgccgccgccatcgcttcagcaacagcaaattcaaccggcacaaattgtcaacgtggtccgtccgctttctgtacaaagtaatttttaaaaagaaactacgaatcagtaaaaatttttttactcctttagattctctcaacgcgctgtacccggcgacgaccgcttcgaccactttcgttgtcgagcgaaagccgccaacaccacagcagcaaccattgcagaaacagacgcccattgcttccgcctcaccggcacaacaagttcaagcagtagcgcaacagccgcaacaactgcaaacgaatcggcccccttctacgagttcatcaatggcaacaacaaatgtgcatgagagcagcggtattatgtttattcagatattagttaataaattaaattcattaagccaaaatcatcgcaaatttttaaaatttttagcatcaacgacaacattagcccaagcgcaaatggcacccgaaagtttgcaggtgggcacttaattttttgaaaaacagggactttttccccttcgttgcgaacccccctatttaatgtattgtaggaaaaaactaaaaatattacactaaagataaaagtatttaattcctaagccaaaaaacggtcatttgcatgaaatttttggaaaagcacactctgtttaggtagattcttataaattattatagattactattttcattcaatattagaatttgccaccgatgttgctgaatccacaagcactcgccgatcgcattttggcacatatgccggacgcgcaaggcgttgatgccgaagtgctttccatcatttcaatggtattttcatgatttatcgaatccattttgcccccccccccctcttaattttttcaggctgctgaggctcgtctgcgcaatgttttggctcaattggcctcgttggccgatcatcgtcaacggccgttgcgcatcgacccgaactatgcattggtggacgaaccgcgaaaacaaatgcgtttcatggaggacattgagaggagggctcacgaaagtcgcgagacggcagaaaaagaggcgatgatgcgaacggcgaaaagcaaagggggcaaagacagagacgtggtggagaaagcgaaaatggtgggacattgggcaggcggaaattgacccaaattaccaaataaatagaatattttatgaaattttaaaagcccaattcatcacagaatggctcggtgtattattgctaaagtcagcattggttcgagtcctcctccccgtgcttgtaatagcgaattgaatgcaagaacgctagagtcaccagaagaagcctcaaaatgagttaacttttggtgctaaagtagttcgtaaataaatgttccgttataacacctcttggcacattgttggatgattgctgggaaaataactatggcaaacaattttcattttaaacatttttgttaatttttactttttttatttattgcaaaagtttatctttgtcattccatcagattcaaaaggctgaccgtgaagcgatggtcaaccacgaggccaatttggccgcttttgctgcgcttggcgttaacaaaactggcataccggcgaagcgacagttcggagcgcccaatgggccgggcggcggcgcggattggaaaaacggaatgcaaaatcagggaacatctggaggccttgttaaagtgaacgtttttagtcttttcctagagaacaaataaactttttagaatcgtccaccgttggtgcgcctaaaacgcgtcacaatgcgcgacttgcaatattttctgtgcaacgatccgttggtgcccaacagctcgcggctgcgctaccgaattgcgctttcgacgcttagtgttgaagagaacaatccgacaaatatttaaatctgctttgtttaacaacgattatcaaacggaatttattagatcaaatgaacattttttgtttttattaccaatttattatttgcaatgagcttttgattaaaaatgactttattaacaaagtgaattatggggttctcaactggtatttaaatgatgccatttttattataatttaacacacattggcattttctatttttatatacacactaattaattaaaacttgttagcatcctcaccaatggctagcgccctcattttggctgggcttggaattgcagccgctggatttacgggccgatatatgatcaggtaatctgccaccattcactgcatcagttcctcatttttggtgtttattataaattaaggaataagcatctggtgaaacaggcgatgactttgcttcccacttattccatttacgagcgtggcggatttgctgttcgtttgccagaaaagaatatgcaaaaaaccgaaagttttaggcaaaaatgacacggcatgaagcggccaaaattttaggcgtttcgatgaacgcgcggactgaacggatacgcgaagcacacaaaagagtgatggtcgccaaccatccaggcactcaaattggcacagaataatcattctgattaacaaaaacaccattttagatcgcggtggttctccttatatggcagcaaaaatcaatgaagccaaagatttattggagcgataaaataattcgaaatgcagaaatttctttttgataaaaatttgtttaataattagtctctgttattcttatttgttagttttgggtagagttgagcgggaccgggacctggtagcggacaactgagtaccaaggtcccggttttgaccgggaccgggactagtcccggttttcccagccaaaaagtcccggtttttcaacccgattaggtcccggtcccggttttgctcaaaattcccggtcccgctcaactctagttttgggcaataaattatttaataaaatgcgtattttctgtttgttcgtggctcagtggttaatgcgtctgtttttgactttcgtttggattctctccatttgtttgttctgcctatgatgatagtaacacgacggtcttcttagactttgtttcgtgctgaaaatgttgttactgaggcatttcatccaatgtttgggcgaagaaataattttctctgactttgaatttaatttttttttttaatttaagcaacaatttattattccgaattacaaaaatggtattaaacattgatttattccgcgaagaaaagggaggcgatcctgaacaaattcgcaaatctcaagtgggccgtttcgcagatgtttcattagtggacaaagtgatttcggcggactccgaatggcgaaaaggtaaaaaaactcgtgggttttatttgtttgcttttattgaatgtcatcttttcttaaaaatcgcttttcagagcgtttctttttggacggtttgaatcgtgcgataaaagtgtg

SEQ ID NO: 8971 - DNA, 1432 bp, Heterodera glycines
tgttgaaagattattctcgaaagtggtcgttttcccccccggcgcccggcaacaattactcgaaaaaatggcacccaccccccttagttagtcttttgtccgccaagaaatttcagacttttctgaaatcggaaacttgacttttgtcagtcccccaatggttggtattctttgaaaatgcgaatgtgtcggtacatttaacgaaccgaaagtgacgaagagaatgtagggagatgccttccatagaaatgccaccaattcgtcccacgcgctttttcgtgccgcggccatttcggcaccatttgcgcccggcggcgcattttcggtcaaacgctgcaaattttgtgagcattcaatacatctttgatcaaaacaatgtttacattggaaatgaaccccgtcccaaagtgttccttccattcacccattaaaatattgcgtttaattaatttaaaaaagacacttcaaaaatgtccgccgttttctccaattcgccgtccttcgcttccgcacattggcggagacccggcaaacgttggaggatcacatcgatcacttcgcgtacatttttggcatctttctgtgcacaaatttataaattcgttagaaaattcggcttttgccatttgcgtttttctgtgccgacaattacttttaaaaaatgttttaaatagccttagggtggggagggggtataaattagaaatggccaattaaatttggtaattaaatcaatttaattaataaattaatggatttccccgtttctcaaaagaatgccaaaccaggccagcaaaattgttggattgttttccctcggtgtgcgtaatgagcaacacttcgtcctccgtcgtcggcattgcgcaattgaaaaatgggcaaaagccatgcttgctgacatgggcagaaagacacgggccatggccaatgtgttggcactttgccaacttggccaagcccgccgcaagcgacgtatcacacagcggacagatgcaagcggacatttcaaaattattagccgatgttactgaattgagaccaaaacattaaaaaatcttcggcgagggcgacggattatgccaataatcagaggttcgcagaagaaaattttcaaaagcttcgtttggcaggccaaacataatgccaatttatcaaaattcaaaagattctgacgaattttccccaaaaaccacaataagcctcaaaatttctcaaaaaaccacaaaaagcctcgaagcctcatttggagaatttagcctcattgacctatcaaaaaaccacaaaatgaggctaaagcctcagatctgcgaaccctgccaataatttactcagattatgtaggtattttgatttgatgagaaagtactttcggtcccatatgatcttctgctgctgcgcaatttgatattgattctgtgacttcgcttttctt

SEQ ID NO: 8972 - DNA, 4254 bp, Heterodera glycines
  misc_feature (3029)..(3029): n is a, c, g, or t
tttagtagttttttaatttcaatgattttagtctattttttttaatgaaaatatttttcaatttttttccacgggttttcattttttgaaaatttcaattttcattttatgtttgtatgttttaccgccttctcccccattaattagcacgtcattagcaagtgatcagatttcagaggaggatagctttgatgaaatcctccacaaacaccgggcctttcgtcatcatggccttgccgaagtcggcgtcaagctgcttgaaattgttcggcttcggcttcttcttcttcttggccacctttgtcttgtccaagcgttcatacacttttagcttggccaagcgttcgtgcaattcacaacattctgtctttccccccccccaatcatgccagtaaataaaaatattcgtgtttcgtgtcagaatacgaaacacgaacacaaaatgccctaaaacacgaaaatacgaaacacgaaacgatcaacatctctgtggggacaacttactctgacgaattgtcgaataatggacaaaattaaattttaataatctcatcgttttaaaaattagctgttcataatttcaaaaaagatgccgaggtgcgcgagcgaaggtcggagcgaagcgtagcgacttgccaaaaggttagagacagccgatagcaatgcttgaacgaaaccgcctattttctattattttaaaaacataattttggattaaagttttctcatgccatttttctgtgtttcaaattttcaattatttctggtttttgagcctcaaaacaccattagaattcattttcgagttctaattcgaaattcatccgtgtctgaattgccgaaattgtaaaaatgtcagaatttttgcaaatttagcgattttaatttgctgctgactccccttgccacctgtcttctccttctccttatgcttacgtcaggcttctttcgtttcaaaatgccaataatattaattatcaattttccatttcgcattctctcggcgattctttccatccaaaaataatatttattcattcatttacaatttcctatcataatgaatctatttctgcgcctattaatttttagtcaaattttgaaatttaatttttcgaaaggggcaaaggtggagaaactccgaattcgcgttgaatgcaaaagtgagaactcaaatcgggaagtcagaattgatttgcgcgtgatttacgggatcaatggcaaagtgtctggaaaaacacaaatgaacataaattgtgccgaggaatttggcatttatttgaacaaaaaagttgacaaagacagattcaagttcaattttgacatttttacgaaaccatttgacaacgaaattgtgccgtcgaatgaaagcagcgaaaatccccaaacagagggagaagaacagcaaattgtggacgacatcctccgctaagcgatacacagagtcgtcaaagtcgagctgttcaggccgaacttctcgcggctgtacgtggtcaatttgggcagtgccgaccccccggggcggctcaattggaaccgaagggtttttgtagaagcggaaaacgatacgggcaattaccacgcttttgtgtatgctgctgtggacaaaaatgagcgaattctcctgggatttgcgccatttgtgaaaattgagaatggcaatgagtcaaacgcaccgcaggcaaaaaaaacaaaaaaaaacggatgaaaaaaaattataaaataaaataaatttcagttctccgaatatcaattatcccttcctgtgaatttgaatcccttctttaaacgcaatatttggtttctttccatggacatttaccagtttgaggaggtatggcaaaagaaaataaaatgtgtaaatttttaattgaattaatcagaaatattatttagacaatttattcgatcgagacaaaaaatgagtcaaaatcaccgatatcaaatagtggtaattattagagaaccggaaatttaagtttacgggtcccgctgcatgattgggactcaaaattttagcgggaggtatcccgtagtctcgcattaaaatgtgcgagaacccgcggggtttgcgggatttttggaatttcgaaaaattaagataaatttaagaaaaactcaaaaaactaaatcaaattgcggatcccgctgcgggattggactaaaatttttgcgggaagggttcccttgggattaatcccgcaaaatcccgtgcggtttcttataagttcaatgaaggtgatggtactgatgatgtaactgcaagctgttcaatttgtttggaggaattaacgaacggccaacaaattattaaattacacgcagaaaaaggcgaaaattacttggttaatttggcattgaatttaaaattcatttcaaatcattttagcatttatttcacgaaaattgtatcaaaaattggtgaggaacgaaacagaaaaatgttttattacaaggcacatttaggtttaaacaggtccaatttccgatatgtccgttgtgcaaacaaacggccaaatatgaaacggtaaagaaaacaagccaaaccattcataatagcacattttaaaatgtaaaatttcagagttattaaatggcaatttatttctaaatttaagtccggcacattcccaccgatttttgagagttctgccgaaacattttcaaattttcatatgaattcaattggagaattatttcgaattgggagagaagatgaaaatgagtttttaaggacacaagcaaaacatcagattcaagcaatcgttgaccagttaaataattcggcaaaaaattacaaaaattttctgagcaacacaaatttgaaacatttggtgccctttttggaacaaaagttttttgaaattggaaccgatggatttgtggagacagaaattgtcagacaaattcgaaatttgttggaaaattttattaatgaacagcagcagaagggtggaaaggaggacattgcaattgcacgatatttgttaaaattggcttcagcctcaaaaattgccccaaaattcgcnaggcgaataacgcaattgaaaagctgaaaattataagggaagagcaatgaaaacgaaagaaagaacaaatgagcattttttgttgttaatttttaagtttctgttgagaaagaaaattttcaacaatttcattttccatattttatgataaattaaattcattcaagcgaatgattaatttaaaaatggaaaaatatttaaaaatttatttaattaaaaatggtagataaatttagggttgggcccgggcagacgacacctttgtcgggggcaaaattttcataaagtcggaaaaaaataaaagaaaaagttccagaacaaaaaagtcttaaaaactcatttaaggacatttacatcttatttgaagtgcaattgacgactttcataaaaccccgacatttcgggagcccaacccgagataaattcataatgaaacttcaataatacaatataattggattttactttttacatttatttcgaattagaattccctttgtttattttgtttaaatatttttttccttttgacattaaaccttctttaaacatctttactaagcattctccgtcatccaattgatcagcgaacctaaaattcggaataatcctcccttattgtgcccccccccattttaccgccaaaaagcgtcagcaaagcgatgccaataattgccgtgacagccacgccctcagcgtggcccccactgttgtccttcttcttattgcctcctccgttatcacccggctgtcggggcaacgatttgtttgcatagtgcagttcgatgctcttcatgttgcactgctcggggacgcagggttcgcatttgccaacgaacggtgccaaacacgacggcatcaccgaacattggccgctgctgtccgacgcgcacgaattcaccacgtaatggtcggcatgagtttcaactaacaaataaaacttcaattcccttattaatgcattaaatggcaatgtttttagagctgtcatcaatttattttctaagatttcgtcttttggggggacggaaatcatcgaaaataaaaatgcattagttagacttttgctttttccagcagcgtttcttggcactgaatttataaacgaattgcctaaaccccaaagaatgtccgtccgtccattcatcgctattattttaattaggtattattttttaaaatttatttttccattttcgcttgccatcgaaacaacggtaagtgt

SEQ ID NO: 8973 - DNA, 2934 bp, Heterodera glycines
aaaaaatatataccagtcacttgaatttatgtaaaaaataatctacatgatacacaatatgaagaataacaaaaaagcgaattctaaaaataaaaccacaacaatcaaatagcaaaatatggtcgtaagtgatggatgagtaataaatataattaatgccaccaatccccggggcattgccgcttttttcgcccctttcattgcgcaccattctccgcttcttccccgccgctgcgcttctgctgctctccctccctctcctcttcgtccgtcgttttgccttcgttttcgatttcgctaccggcgatcaaacggacagtgagctgatcgaacaaacttcccttgcacctaagggcacaaacaattcaaaattaaatgacgacatttgggctcagtcagcacaatcatttaggatcacaacttttttatagccaaagaaattttccgaagtcttttatatcactttgatcagatcactctctcaagatgacctggacatcctaaaatacactggaaatcgggaaaattcccaaaaactaggttttttttttggaaaatttccctgagtgtatttggggtatccagatcaccatgaataaatgctttgatcaagtagagttgtgtaattttttatcagtgtccaaagttatgttatagctggaatatttcagattcttcgtccgcaaaagttttcggaaattagacaaaaaaaaaaaaaatcagaattccgcgtctaaatgaaaaaaatattcccttttgctttttgtttttgtaaaatttccactttgaatttttcccccggttttacccgcatttggagcaccgccttcgctgcgctttccctccccccggcccttctccgtcgtcgttcttcaatttgagcacatagccccgctcgatgagttggaaacggcgcgacaaattcaacttcaaaacggtattaatttagaaattaaattttgaaaaaaattcggtacttctaggttttgtcaccctcccacttgaattttttttccaataattttttctaggctaatttttaattctgatcactagggatgggatttttaagcgcgaaaaagtccaaaataaggccttaaataagtacgaaaaaatcgcgaaataagtgcgaaaataagctcgaaaaaattccaaatttaggggtataattttttaaattgatatgaaaataatttcaaattaaggcaaacaattttattcattgattacagttgcaaataattaaatatattcgaaatttttgaatacacttttctagaattaataaaatttgaaaaaccaaaacttggttaaaaaaaaattacaaaaatttcggccgagataaaaacaaaatttagtggaaattttttgaaaatttttaaccaagttgccaagaaatgtgatcgcgtcaaaaaatttttttattgtatttttgttaaaaaatttgtgaattttcatgaaaaatttaaaatcgcgaaataagaacgaaaataagcataaaacgctaaaacaagtgcaaaacttattttaagggcgaacatccaaaataagcaaaacacgttatggctaaaaataaaggtcagattcgtgatcaaaattagcctagaaaaaatattagaaaaaaaatttcaggggatgacaaaacctagaagtaccaaaaattcttttaaatttagttttcccaaaaaatatttaggaataatttcatgttaaactaaatttgtttactgggaggaggcgaattgcctgctccttcattaactacaccaccttcttttcctccaggaaccgttttgccgacaaatccgcgtcaacgccgtacgatgggtggcactgctgcagccactggaaagcagaaaattcaaatagataaacagctgattcaaggggcccgttaattggagagtccaggtaaacaaattagtgaaatataaggggtaaaaattaaagctgggcgaaaaacccgggctttcaataaatgccctccgccacctccatgccgtcgatgggcgaaatggtaaaggaacaatgccgacggcgacagtctaaacagaagcagcaccgtcgcccattgttgtggcggtcgcatgcttcggtgccgttttcgtcattgatttggtgccaaagtttttgtgggccatcgaccggcgccgccgactttgccgattgttgagacaaaagctccatcaaatttgtactgttgtgcctttgcataaaaaatgttcaaaaagaatcgagtaaaatggaaaaataaatatttgaaagcaattaactgtccataaaaataacataattaaattaattattttaggaggaatgaaatcgaaaggaaaaatgaagtgaacaaaatggacaggaaagaattacaagaaaaacaaatattttggctcatctgagactgatcgacagaataaaataaaaaagacagtgcaattatatcacggaaaagaaatgataggtaattagaattagtgatcattaggcttggtgtgaactaaaaacattttcaggtaattaagggacggtgaacaaaatgcttttgtcattttgtgccataaacgaaaatttaaggtgttttggcacaaaatacaacttttgttggacattgaaacgaaaaatgggttaattagggaagaaaaaagttggaaaatgattgatgctactgctttttctgctgatctgattagagtgtggtcgatcatcagccaagtccgttgtcttcaaacaatccttgcgttgtctcctcctgaaaattgagccaatcattaaaaaggttcaaaaatttagccttaatattttttaaagaattaaattggaaaacttaataaaatccataacaaaagtaagaaatgagaatcgtgagacaaaatgctaatcgatgcaatttaatttgagaacgatagagtcaactggaccacacattccttcactgtt

SEQ ID NO: 8974 - DNA, 3225 bp, Heterodera glycines
aatggatgagagcattcctttttccatcttttcacatttgtccatccaatccccaattccttggcaattatttcgtcaataatttttggatttgcttcttttattttaaaatattgcttcatctttttcagtttgtccgcattggtatattgctcttaaataaaaattagatttaactttactaaaattatattctactttgacttttatggtattttggtgccaattcttttttccactttcgaaatgtgtcttcagaaatgcccaattccttcgcaaattctttctgtttgccttggccatataattctttaaattcatcaaatctttcaatgaattctctctttttctcatcatataattgtttttttattttgtttttatttaaatttaattcatttttccatttttgtattaattgcagatttgctcctaataattttgcaatttttctctcaattttgccttggtctttccttttgtattttcctttttgcttcagcttttctttaattgcttcaaatttcaaaattatttgtcttttttgttgatcatttgggtccgttccattttctccaccaatttgatcaatgcccgtagtttcattttgctccttttggtcgttttgttcaatttttattatcacaatttcttcactttcatttttgtcccatctttggccaaatatttcttcaaaatttggttggattttgccggatttaattacaaaaataaagaaaaatataataaataataaatgccacaaattcatttttacttttggaaattgaatttattgcattaaatgaatttatttaatgttttattcgcattaaatgttattacgcaattatttttcttttcaacaatattttaaaaattaatatgtgattcacgacgtaattcatacataatatggaaatcaattttttactcaaattttttaagaaataattattgcaaaaaataataatttataaaataatttattttatggaaaaaataaattaaaaggaaagtgtagcaatttactcaaaatgatttattttttttgggcacataattcaaaaaaaataattaattgaccataattggcttcatatccaacaaattttgtaaattgcttttttaattaattaaacaaataaaattaaaattttcctttaatttcaaaatattgcttcatctttttttaatttgtcataatttgaaggtttaattagcgctgaaaataataaataattttaaaaagttagaaattcgcttacttttattgtatttaggcaacaattcttttttccattttatcaatgtcagaaatgcccaattccttcacaaattctttctgtttgccttttccatagaattctttaaattcatcaaatcgttcaatgaattcactctttttcatctcataaaattccttttttattttatttttatttaaattcaattcatttttccatttttgtattaattgccgatttgttcctaataattttgcaattttcctctcaattttgctttgatcttttcttttgtatttacctttttcacgtaatttttctttaattgcatcaaattttttgacaatttctctcttttgctgatcatttatattctgatcacttttaaaaaggttctgtccgtgtaatttctcgtttgatcatttgggtcatttcccatttcttcacccatttgatcaactgctgattgtgagttctcatttcgttcatttagttcaatttttatcactttttcttctcttcttttttgtcccatccatcgccaaatatttcttcaaaattcggacggattttgccggattcaatacaaaaatattaaaaaatataataaataccacaaattcatttttacatataatgcaaaatatttagaataattactttcatcgaatattgcccatttttttctaatgttactggtattaataaaaatcgttaaatgtactgatttttctgatatgttctgatgaataggcgaacaatttcagcaaacaaatttaaaaatattattaatttaatgataataaattaaaaatacattttaaatatatttaaaaatatattttttaaattctactttgaaacacactgcttggggaataataggctaacattggcttttttccaggattttcatttttatagtgaatgagtggcgagtgtaatttgtaatgtaatgcaatgtttttgccgcccgcaggcggggcaaatgaccgctaattagattatttcacaacaccgcccccctcccgcacgcaccgccgaatcgcatcaatccgtcaccgcctccccccccccccccagaaaatatccatctctatcccaccccaaaaaatcccaattgtatgccacaaatctcacactttaaacaccacaaaatccgtcaccagcgttcgttctttggtccccaactgtttaaatattttttgagtgcctaatgtttaaattgttttcgttttaaatttttttaatgtttttaaaaaatgtccattttttctattggttttcattttttttgtgttcgattttccaaacaaaatctttttttttcaattttctcttttgtaatctttggtcccaattttccggaacttccaaattttccatctcctctcatccttcttctgcacaaaatcatcctacaaaaatgaattcatccatcccatcccatccctttcatccccaccggaccaacccccgaggggcccacttgacgagaagacaataattggggggggggaaggggggaagtggatgatgacacaaaatcgcacaaaattcattttccattttttgtttgtttgattttccgcacaatgtaagaagacttaaaaatagaaaagctttttcttctctaatggatcaatgtttctttcattttttagaaagtgaaatttttaagttatcgtatttcggttttttgaatttttatttaaagaatttgtcattaaacgttttcttaagctaatttaattagcatattagcttgtcattaaatattttcttaagctaatttaattagcataattagcatattttcattaaattttaatgtaattatctaataaatttttaattccttctttcttccaatgttaaatatgtgtgtacttttttcttctttttcattcatttttaaatatgaatattttaaaagtttcaaaaataattgttacaattaaacggttttatattttaa

SEQ ID NO: 8975 - DNA, 1142 bp, Heterodera glycines
  misc_feature (54)..(54): n is a, c, g, or t
  misc_feature (112)..(112): n is a, c, g, or t
tttttttaaaaaaataatttttttttaaataattaaacatcaattatcttcaancaaatccaacaaataattacatccaacaacaattttttattatatatacatatttttnacatccaacatcttttcttcttttttttttcgtttataaatatatattaatccatataggatggatgacccaaacaaagtttcgcaattctgtgccaatttggggcttgttttcaaggacgcccttggccccccatgggggacgggacaaaatttcgccgccgaaatttcgccgcaaaaaaaaatttaaaaaaaattaaacttagaaattttttaagaaaaaatcttagaattttttataagaaaatttcaaaaaaaaatttagaaaaaattttcagcgatttttatgataaaaattttccccaatttattttttatcttttcctaaataaaattaattaatcaacaaatgaggccgcctttcccgaaaaatgtttaacacacaaattcatttgttttctttggactgtcaaaatagctagagagaatttggccctaattgcattaaatgggttaacattttctttgttccattctattttttcagatgaaattcctttttaaaagaattttaattaattaaatttgtctttatatgattttcttattcgaatttggctcttaattcgtaagaaaatttaattttgttgaatttttttttaaaagatgagcccgaccttagaaaatcttattttcttctaaaaaaattaatatagaaattttttaattttctctttattttctttcgatattttattctggagatttatggaaatttgtgctcgtgatgaagatataacacacaattgagaagagagagagaggaaaagaaacgaaaggattgaggagagaacacagaatttttgttgttttctttcactcattactccccatagcataattgaaatacaatttttatttctaaatttaaaaacacaatttgtttgacgataaccgtggggttaactactactggaatttttggaacggggtcagtccggaatgacccttaaattaaattttgtttaacaaatccaagagtttttttccatagatttgtttacccaaataagaatttttttaattaaaac

SEQ ID NO: 8976 - DNA, 1504 bp, Heterodera glycines
  misc_feature (488)..(488): n is a, c, g, or t
  misc_feature (1408)..(1408): n is a, c, g, or t
tggtggtcaattcgatgttgagacgggttcgcaaaaatttagggttaaaccccacccttttccacttatttttaaaccagggcttccgtcgaaaaattttcaaaatataaacaccaagcccaaaataagattttagtgtcaaaaatatgaacatttagcaacatttttctatcagttatttttccaatttattcgatcaaattttatatttttagtcttctattatcaattttgatattttggggagatatttaagaaatcagaataattttagtcgctaccccaaaatcagaacattcttataaataataacaaatggaagcccaggtttaaaggccagcttggactcattcttactggcgctaacgaaatcagaagattaaagtgaaaaaggaagatttacgagcatttaaaaagaaaaaatggtttttttgggttaaaataaaatttggtcattccccgatcggggtccccgacccctgacattntgagctcctccccgccccgacccccgacatgtcgccccccgaggtccccggtccccgacattttgccccccgaggggtcggggagcaaccctaattaatataattaagggagccttaaaattttatttggttttcatttgcagaaaaagcacccgaagaccttcaacatttgttcagttcgccaacaaaaaacaattcaccttcaacgaaaacaggcccattaattaatttgttcttgacactgactagcatcaattagtatgtttgattatcaattaactttcggtttttttttgggttgggtcagattcatttatagaaattttctttcattcattctaagcttctttctgactgctgtcgtgtttgatccgcttatgactgacgcctgatggaaaaaactgaaaactcgaaaagctcattccccgcctttcccatagacataaaaatgaaaaaaaatgtctgaagaaatatatttttgtttgggtaattttgtaaaaatcattcttttaaattttctatttcatctaaattcaacgaaatgagtttaattcgtataaacaaataaatcccgattttgtatcaatgttattcaaattaaaaaccataaaaagtcaaattttatttaatttgcattttatttatttctttcatttttatttattatttgcatagaattgtcagcaaagcaactgttattttagtttattttaatttttttaatttgtgtttttgaatttatgtcgtgccatccatcccattttgtataaaataaaataaaaattatctgccatacgaaatatttaatttttgcgaacgtttaagttctattagcataaagcatccatccccccttcatcagcataaggagaagtttgtcatcgcgttaaggaaataaaaaatgatgattaatcatgtancaaacaacgggaaatatgtgcacaaaaattggctcttccttttacggagcgttttttcatttcacaaaacaagagaaataaatgcatatttttatt

SEQ ID NO: 8977 - DNA, 3820 bp, Heterodera glycines
tttcgggtcgctttttgagttcaattaattgactatcattgattaaaactctctctctctcgctctctctctcgctctctctctctctctctctctcttctctcgctcgttctttctctctctcgctcctcgctctctctcttattctgtctctctcattctgtctctctctctctctcttctatctttaaatcgtattcctatttaccacagaatttttgtacttttattttttatttatcccttttcttcttaaaaacaatcgcgataaaaagattaaaattttaaggatgcttgcaccttccgttttaatcattcttttatttggacttagtttttccatcaaagtagaaaagaagaaagagggcataattgtgactggccagtaagttaatgttatttttttacataataaatttagtccaaaaaattatgaaacactaaaacacgggctgacaaatctagaaattatatcaataaaaggcttaagcataggaccttctctcgctttaaacgtgctataacattttcgaaatagatgctaattatcagtctcggatgccattcgaactttattgtcattaatcaattcacagcccgtcacaatcgccaaaaatgagccctacaaatgttttggtggcaccggcttcaacacagccattgactccatcattggtaacaatcgcttcgccaacaacagtctcttccgggttcgatgttggcatcattatcttgctcttttgcattttgataatcgttgtcattgtgatgtgcctactgtgccgtctcttctaccgtactcgacaacaacagttcgtgccatcaaacattgtgccatcgccaactgtttcttcgccgcggatgccttctgctagtgtgctattgccaataacaagttccgtgccaatgccaatcctcatcggctgctgaccattcagcacagtctcaaattccaattcaaactttaacagcctctcttcagcatcaggttagcaatagggctccaatttttaggttttttaatgaaaatttcatcaaaaatccttttaaatatatttttctattttttgacaagaattttggattttaaaactttttatctaatattgatctagcctaattttgttacttttttgaataaattttgttattttacagcccgccagagaaaattttttagtaaattttgcgattaaaactttcattcagtgtgtggccattcccatgccaaaatgctgctcttcatcatcggactactcaccgtgcccaattccaactcaaatttttgccccatctcggcataacgaacaacagtttttgccaccaccttcaatgccatatgcttttgaccaccatcgtccgcaaatgattgctccaagttgttccgcttcgcctttccgtgaccaccgggcaccatcgccaattggccgtgccgtgccatttccatcaatttccggcaaccagccaacattttagccctcttttggtgcccattcgatgccttctgaatcttacgaatacatgtatgaatatcatttttcggaagaatatttcaagaggaaatagtctgttatgggaattaattgtgagaagcgtcgccgcgttccatttgcatatttttaatgtgttggaatggatttaaactcgtctttgataatcttaaaatatttaaatcattttgtcaaccaatttatttatttgtcccatctgtgttctatttttattactttgttctttaattttatttgatactagagtaaatgtcggtagtttaattttttgaaaaacaaaattgctttattatagcaaaaccattttttatttgatcaattaaaactgatttatttcctaatccttaatcttaaaaatatgtatcataaaaaccgacaccatgtgcgttaaacggtgatatagaaaaatgacagaaaggttcagcacgatttaaaatatttgtatgagtgaacaatgaaattaatatcatttttaaaaaatggcagtcgacataaatttttaataataaaatatcaatgaaaaaaaggcgtatctatagacatttggacagttggcaatctgccaataaactcactaacagtttccaattggcaaaatgtcggtaattaatttttcgaaatgaaaaatttcttaaccatagtaaaaaaaatttatatttaaattaaaattgctttaacatgataaaaccatgtattactcagcaaagcatggtcatatgaggaacagttcctcataaaaatatgaaagattcaaaataattttacataggttgactgacattcaatctttaaaacaggtgactgttgtgactggtgattactgacaagcacatttcttcacaacaattcacaaaaatattactttaaaatggcagcaaaaataattattaatttcagcattcaagaataatttcataaaaatttcctttttgataaaacttatttatttaaaattttcaaatcatttccaaaatattttagaaaatgcttctaaaaatttatattgcaatatttttgcaaattgtctttaacaatttgtttttgtcatgccatccaaactcagattattcagaatgtggcatttcggactttgagcctctgttggccaatgtgccaaaaatggaaatcggaacttataatgtaaagacaaagaatttaattagtttaattgaaataatttattctatttctttttgaatgaattaattaacaggtatacttgggacaagcggttgagaatgacaattctttgccgtggatggcctcgcttataaaaggaggaagtattaattttattataattaatatatctccattatgaaaaaataatagctaaaaattgaccgtttttaaaatttaatcaaatttttaagaatttaaatgctccgcaacaattatcgggccaaatcacattttgacggcgatgcattgtgttaagggcagagattttgatattggtgagaatttcagaaacattattattaaatggaaagtattttataaatttttaaaaatttattcaattttagggttttaaaatagtttaaaaaatgccgaattaaatttttaacagaaaaactccgaatttcatacgggaatgaatatgtttcaagccaaccgtataaatctgcagttgtttccatacaattgtatccaaatgcgaaatattatcgaatttatgataattttggcgatgaaacatcaagggcagatttaattttgcatgacattgcaataattaaagtaattgattaattaaatatttatgaataaattaatcattcaaatttatttagattaaaaacccaattaaatttacatcaaatgttcgaccaatttgtttatttggtattggtggtaatttttaataagtttaattcaattaaattaatattttttacccaataagtcttaacacaataaactcccaaaataattttatatttaaaaaaaaattattttgttagttttttgtaaaaaaaaatgtttaattgatgttaatatattttttgtaatatttttacaaaatgatttttaataatatttggttttcaatgaaaaaacaaaactttaagattcaacgcgcgcaaaatttctggtgagaaattcaaaatcagaaactaccaaatttattattgccggttggggaatgactcggccacagtgcgcgaaggaccaaaataagactcgaaatgatcaattgaattatggcaaaatgcgaatgatttcgacacaaaaatgccgagaaatggccaatgaacaaaaaaataggagttgttagatttacttcatttttaattttaaattat

SEQ ID NO: 8978 - DNA, 1055 bp, Heterodera glycines
atgtttcaagccaaccgcataaatatgcagttgattccatacaattgcaaccaaaagcgagatattatcaaatttacgataattttggcgatgaaatgccaaaggcaactttgcttttgcatgacattgcaataattaaagtaattaatttaaagtataattatcattataatttctgttaatttaagcttaaaaagacgattgaatttgcaccaaatgtccgaccaatttgtttgtttggttttggtggtgattttgaaagtatgtataataaataaaaaatcttattttattaaatatatttaatttaatataaatacttttaataagatttggattaaaacccaattttatttatttaaaaaaatcaaaatctaaaacacaaattttttttttatataaaataatttgaaaaatatgtggacctttgcatctatgtaaattttaaggttcatccgacgaaaaatttctcgaggataattcaaaaataaaaaattcacaatttattattgccggttggggactgacttggccacagtgcgcgaaggaccaaaataagactcgaaatgatcaattgaattatggcaaaacgcgaatgatttcgactcaaaaatgccgagaaatggccaatgaacaaaaaaattgtaaattattttagttttattttaaatttttaataatttaatttagcatttgaatggtctgctggcgatgacgatgcaattgaatcgattgaatcgctgttaaatgaatttgaaacatatgggttggacgacaaaatttgtgtggtgcccgagccgagcattggcgaaccggtacggtagaattaatactgtacaaacttactgtatacaattagtaggggaaatgtatagaatgtgtaaatctttaattgcgattaattgtttactctagggtgacagcggtagtccattgatgctgaaaattggcacaaacaattggatccaattgggcgtcgcaaccaaaacgagctgcaattccaaagacccaacaagtaccgaaggactctttggtaaatgcatttaaaaataatt

SEQ ID NO: 8979 - DNA, 1733 bp, Heterodera glycines
  misc_feature (1576)..(1576): n is a, c, g, or t
gcacattttgcattggttgttccgatttttaaaggtttcttttttcataatagtttcgatctgccctttatgtcctttaatccaataaaattgcattgtattatatagccaatcaataatcattcttgatatttggaatccctctcattaattgttgacaaaagtacaaaagtaattcaaatattgttgtttaaaacattaattatatttttgagacaggaattctggaaaactgttggttttattcacatacagaaaattaaagcggaggataaagcccaacgcttaaatataactcgaattatttataataggacaaaaaacaaattcggtgtctacagtattgtatgcctgtttgatcattaaaaaatagattttctatcattctgtttgcatcggtttccctctgatagatgtctaacagtatcatctgccatgcttgtttttatatcaatttttgtgtcccatcatttacccgtcaatcatcatacattcctctttctccccccccccccaattttacatatattatgctttccaccgtttgctgatcaaaatcgaccaattttggctgactgatcggagaatgtgaccctcattcaccacccaattcccacaaattatgcattattattattacacacatcaccaattggcacgttacgcttttaagaaaaatgtttatataattaaggaaaagtgcttttcgatatgttttttcatttaatcaaatcaatttgagaggatttttctctttgttttttctttttgaattcgcataaacatattacgatctttcaaaatataagaaaattggggtccgaaacttcaccaagttattaaatttgtattttttgggatcattttgaccggatttttaaacacacagcaaccaattattattgtgcaagaaaaagcacgaaaccatttttgccgtgaatgattttacgccagtccgacatgtgccaacgtggtaaacatttttggcacattcttaatacggcgttgctgtttacggaattcgggcttctgattgctctgggccaacagtgcaaaaatagagggttaaactgcggttgctgataatgggggtgatgatgcatcggatgctgttgcattttcatatatttaaacaagaaacagtcagttagacaaatgactatggcataataaccgaaagtccaaaattttaaattcgcatgcttcaaaatcggtttaaactagagtagagcggaccgggaccttttcgggttgaaaacccgggaatttttggctgggaaaaccgggaaaaacccgggactggtcccggtcaaaaccgggactggtcccggtcaaaaccgggactggtcccggtcaaaaccgggacctcggtactcagttcccgtgttttggacccggtcccgctctactctagtttaaacacatggaaataaactgaaagccatcactctttcaataaacgataggtaatttaataataagccctttttagacaaaaaaaatgcgaaaattcgaaaatttgatcgggtcagaggttcgaaattagtcgtgtcatattcgtggtcagcgacaccanaaacccatggctacattttttttgtcttttaacaacaaaaaatccaacccgcaaaagtcttaaatctcgcgcttacgattaacaataaacaccgatatgccattttattatatgtcaagtatctatatatgaatacaatgacgatgaatatgaatga

SEQ ID NO: 8980 - DNA, 3139 bp, Heterodera glycines
aaggggctggggggggggggggggaacgggcgactccttcttgtccttcgtcttgcccttcttgtccttcttcctgcgcgtgctgcgcccgtccttcttccagtgcttgtccttcttgctgccgccgccgccgctcctccccgtcctcttgcgctcctttttgcccgccgctgctgcctggtgctgctgctgctgctgctagtgctgctgctgcagctacttgtggtggtggtggtgctgctgcagccgccagcagccgttggccggccagctgaaaatattgatctgctaaaacttttctcattatcaactaaattaaacattaaaacgatttttttcaataaatgtaaatttttgtgaaaaatgaattctcgacttttggttcaaatatggtgcaaaatttcaatatattttctgtttacaaaaaagttttgaccaaaaatcaaatttaggaaaataaaggatctttaaaaaagcgcagcttaccgtggcggctccaccaagcagagcaccaccagcagcagcgatgaataggtaagtggccatagcgttgcgttgcacactgaagcggttcgttggttggagggaaaaatgaagcgaacctgggagaaacacattccttttatacacatctgatgccgcttgaaggcaaaggcaaaaaaattgaaaaatgggtataaaagggcggaaattgggaaaaatgagtgtccaaatttttgtgcctatttcgccatttttggcgcctttttcagaattctcggaaaaatccttaacatgcaataaaaatgaaaaatacaccccctaagaaccgacaagaaaaatctcaaaaaatacacccctaaaaaatgaaaaaatttttcaaagaaattgatccccacaatttaattattttttcatgataaaaatttttaattaaaaattaaaaaaaaaatttaatagtagagaccgagtcagaccggacccggtgccgggttttactggatccgggaaccggtccgacggttttttggaaaaatagggattggccggattttgaggaccgggtccggaaaccgctctgatcgatagttttcattcatttccctctgtctttgtacattggaaatgtgtgctcatgtgcagcagctgcaggaccaggtggaccagctgaacaccgaacgggccaccttccagcggcgccttcgtgcattggctaaccaatttgggcgcgattgatttggtcgcagaatgtgcgcgagtttttcatgtttttgcgcgtttgactgaacacaccacaaaaaatgctaacgaattaatttaagatcagattattccattccatattcatttttattgtttattttctttgttcggctcaatgattgatgtctcttgtgtctcgctgctgtccctgatcgatagggatgaaaaatatgggtataaattgcaaaatgtggccataaaattgcaaatattgagtgaaatgtcttgaaatccgtcaaattcagttaaaaaatcgcgaaatggctgacatgaaattttcgatgtgatttaaaaaaacgccgaattatgtttccatcttgcctagcagattcaaatcaagttaaaagttcggataaattccatgattttcatccctacttaataatatcctcgtcgtccattatttatccatccaattttctgcacatactataaaatgccaatgaaaattgtttgtgcgttttgtttttctattgtttttttccgattttcatcaacacaacatatccaaccacagacactgactgtcccttctgtgtccgacattctccgctttctctcgcaatttcactttttattattattattaatgaaaaattgaaaaataattcccctttttatttttgaacatttccttcctcccgcacacattctcttggcactcctctctttctgctcatttttaaattatatatatatatatatttaaaactcgaaaaatgaaattgtgtaattttttttggctatgacgtcatggaacaataaaatttaattattacacaatttaaattgaattaattatttttcaaatcctccgccaaactcctcccgacttccatcatcatcatcatctgttgtaacgatgagtttcgtctttatctctttctctcaaattctattttattcttgccttccgttccgaccaccgccgccggacccacaaaaacaaatcgccccgttcgtttccatcatcaatttttgtgtcccatcatttacccatcaatcatcatacattcctctttccccccccccccaattttacatatattatgctttccaccgtttgctgatcagaatcgaccaattttggctgactgatcggagaatgtgaccctcattcaccacccaattcccacaaattatgcattattattattacacacaccaccaattggcactttacgcttttaagaaaaatgtttatataaattaaggaaaagtgcttttcgatatgttttttcatttaatcaaatcaatttgagaggatttttctctttgttttttctttttgaattcgcataaacatattacgatctttcaaaatataaggagaaaatttgggttattttaaagtagggttgcgtccccgaccccgaaccccgacaaaagcaaccaattagttacactcttcggtactaattcagtttgggtcctatattttggccaaaattttttaaaagcgtaaccagacactagaaatcactattttggagcttcgtcactaaaatagtgaaaattcactattttggcgttttgtcactattttttcactatttcgacattttttggaaaattccttaacaaaaatgcaataaaaccaaaaaatacacccctaagaatcaagctaaaatttttcaaactatgaaattaaaaaaattttctcaaaaatttactttcttagcaaaatttttaattttaaaattttttaggtaacttttgggttttttggtcttaaaaatcccagtcctactcatttgcaatgcaatcagtgaataaaaattatttttgctcaatttttggctgaaaatttgtcactattcgtcactatttcggactttttttcactattttggcatttttactcactattttagttaactatttcgggatttttcgt

SEQ ID NO: 8981 - DNA, 428 bp, Heterodera glycines
ttaaaatattttaattattggcattctgttttttccctttaaaaataattttctcatcgtgatattgtgttttctcactttaaaaaaatattttcacatgttgttatgctgtctctctcaaatttaaaaattattttttattaattttccgctcttttcttccaaatattaattattttggcttccccctttaaatatgtttcatatccactctttttttcctttgttattcattttccccttgtttttttcatttttcattgatcgaaagtactttgtactgacctttctcacctcattttgttatgttgttgctttactcgaaactataaccctttatgatatttgtgtaatctttacaaatatcctgtgggacatccttaaaccgaggagtcccgccccggtactggattacttcccataggggt

SEQ ID NO: 8982 - DNA, 5505 bp, Heterodera glycines
tcttttcccgtcctaattggtgactgtgtctcttcactctttgtttcttttcccgtcctaattggtgaatgtgtctcttctgtctctgtttcttttcctgtcctgttttcctccgtcgttttttcgttatttcttttcccctttttctttttcacccttttcttccagtaggggtcaactgcgtcttggggccaactgcgtctcagttaaaaaatcaaataacaaaaagacattagaaaattctaattcaattttgaaccggaagttgatgaaatacatgcattttgcttagcaccctttttaaatttcttttagcgttccaatgaatatttctgaaattaaatctcaacgaaaaaataaaaaactcgaacatgaaggctgcctgtatgtcttccattcgttgaatgccgatcatgacgtgaaattttggcccgaccgaccgaccaacgggaacattcccgaacatcaatggtaccatgcttcttcttcttcgggcccgtggctcttggggggggggggctgtaaaccatgcgccttgggtggcccatcggttctcctcctcctcatcgattttacgggcattgtagtgcccgcccgagccccgggtgaaggacaattggccggacccttcaccccaactctcgtcgcggtttcgcgacagtcattgtggtaccggtaaattgtacacggccgatgggcaacaaagaaaaattgtgtgtggtaaatgtattaattaattaattaagacacttagaataaatagtgcatcaggcatttcaagtccaattttatggtggccaatttaccgggacccctcgctgtgggatttgagtagttacccacgaccttttcaccggattacggtagccccccataggtgtgggaggggtgcatggccaactgagcgccagccatttgagcgccgccaagtgagcgcgggccatctgagcgccagacttttcagtactgaagccaaaacctattgcgcgacttttttttgaaacccaaacctattgcgcgacttttttcttgcaaacccaaacctattgcagggggggtgcgcgacttttttgactgcgcgactttatgcaaattttttattaatttaaattaattttaaattaaattttaaacaccttaaaggtcaaaacatcttaagaacatgaatttaaattcatttaaaattcatcaaaaattccccgcaccaagcggatccgaaccccaggggggcggccagactgacgcactaaccactcggccacattggcaatggacaataaacattaatttgctctcataaagggaaaaattgacgtcaccagcgggggcaggggggcgagagcgggcggcgagaaggcgggaggaggggtcaaataaacaaatcaattatgaagggggcggggttgttggaacggtgccaaataaacaaatcaaattttttaattggtcgcgtactttgtagtgccgcccaaactcccgcacgcttattatgtaatctgacaccttcagacaataaacaattgtttaattgatttttttccatttggtcattttcatttcatttaattcactttacggatgaaaaagccaatcaataatccattatcatttatttatgccttaatttttccttctttggcacttgtttacccattactttttgccatttatttatgtgccagattggcattattatgccaccgtttttttgtgccattttgcctcaattttttggcattgttctgccccctttttttcattttcatttgccaattgtcgcaccttttcgtgccaaaactcctcaattatttcttgccagtttttggcattgttctgccccctttttttcattttcatttgccaattgtcgcaccttttcgtgccaaaactcctcaattatttcttgccagtttttggcattgttttgcccccttttttcacattttcatttgccaattgtcgcaccttttcgtgccaaaactcctcaattatttcttgccagtttttggcattctcttttttaaattttaataaattattcaatccttggcattctgttttttcaaatttaaaaattatttttcttttatttcaattcttggcattctgttttctcaaatttaaaaattattttaattcttggcattctgttttttcaaatttaaaaattattttcacatcttggtattctgttttctcaaattaaaaaattattttcacatcttggcattctgtttttctcaaatttaaaaattattttttattaattttccgcttttttcttccaaattttaattatttttgcttccccctttaaaatatgtttcgtttccactctttttttccttttttattcattttccccttgtttttttcatttttcattgatcgaaagtactttgtactgtcctttctcacctcattttgttattttgttggtttactcggtactaaaccctttaggatatttgttaagccttttcaaatatcctgggggccatccttaaaccgaggagtcctgccccggtactgggttacttcccagaggggtgggcacgggcgttcactgtccacggggcttattccgctggtatccagggctgcggcagtgactgaccgaaacccagtttccgtcatagcccgccgggtgtcacagcgatgtttaagcccagccagatagtcggtctggtgtggacgggggcccttcactcgctggccttgagggtgaaggtgtgcctgttcctagcagcgggggtggcggttcctagccctaatgtgccctgcctacgggctgcattggtacagcgagagaataaccgggactggctggcccggaggaccgtgagtcactgagcagtgtcgaacgcgcagctgctcaaactcaacaccccggattaaaatccgcgttgccggaactcatatgtgctgtgggcgttggcgcaagtgccttatggagggagtaattaaccaacatagggaggcctacaccaaaccttgcactttgggatggtagtgccacacactttgagttccatgagcggttccataatcgcttgctatgatagtcatagttggtgggcatgccctccaatgtgatggcttgggccggaaggttaacaacacgtgtagggggtgacctatgcgcgtttttagccctccaaaaatggcctaaatcatcgctcaggagaggggtcatgcccgatttttttttggcagccattttctttgtcattttagctaaataacgggtttaattttccttttaatttaagaaagaaaataaaatgagccaattatctgacgattccctcccccctacccttgatggaccgtactcccctgttcgggacggtgcggatttgtttgatgatgcaccgccgctcgaatccgtcctcagccaactgccggcttcagttagttataaaaaaagggttataaattcttctttgctaattttgtgagaatatttcaggcaccatcgccgccaccggaacgaggaaatcgcactgctcgcaaagagcccagcatcagcaaggagctcgatcccgagcaatttgagggcgaaggctttagctgtttggcagcagcccaagcggaagctggccgttttaaaggtgttttaaactgcttcaaaatattttatagccttacaacattttaattgttcttttaattttatttaattataattattatttttcgttttctctaatcgttttgagtgttttctttagcatttcgttttatcggacaatttttgctgagcctctcactcactggtgtttttccggaggaaattttgcgcaacatttttaccatgtgccttgcctatgctgccgaaggggcggaatcaatgaaacttgcggcggatcacttcattttcctcctcacttcaaagcacatggactacgaaatcgccattcacttaaaaaagctggaccacactgcaaccgacaagattctgtcgcgctttgagatggtggatcaaagcaacaaatccaaggaacgaccgtcgatccgcgatgaaccattcgtcatcgacataacagccatcgaaagcaaaggagcaaaaccgaagaaggccggcaaaggccggcgggacctcaatgtgatttaccgtatcgctgacggagcgacgtatgggttgcacaacgcggacaacctctgcctcttccgagcctttgaatttttgcggatgaaattcgtattgcctcgacagcgtttcgcggaatacaagaaggacgaaagaagacaactcgaaaatgtgcaagccctctgccgagcatgcaatattgacatgaacttgcctttttattgcgtcgtggaatacggcgataggatccaggcaaaattaaaaaaataataataataatttaaaaaattaacaaaaaaattaaggcttattatcagcgtcttcatcccgggttgttttggctttactgcttcgaaacgtccggtcggatgaagccatcatggaagtcatgtgccggcgaccgcgagcatgaactttgtgttctttttactgaggatgtgaatggtgaaaatgggcattatgacgctgtgaaatcggttggaaagctgttcggcacacaaaattattgctttggggtaacaaacaaacaaaaaatttttttaaatattaataaaaagtttaagtgtgagatgccgtactttcaacacactcaacattcggccaaatgcaaatggaaatgtcacaattgccagcgcgtgggctgggcgttcagaggaaactgtgacgatcatcaaaacttctttgagtcttgtttgggatgcaataagatcgtcttatcgattaatatttagtacctttgtttttaagactttcaaaagtctcgattgctacaaacaccatgccaaagtcacacattgtaaaatcaaacgtggcacagaaaatacaacaattgtgaaatcaatatgcaacagctcaaaaaaatgtgttgactgtggtattatttaccaaactcgggtaaaaattattttcaacaaacaattattattattattattatgcaaaagctacacaagaacaaagcacatgtatgcgggcacaaattctgcaaaacctgccttgggtttcacgcaccgcgggactgctacatcacctatcagcgaaaagcgaagaaggataagcggatcatcttcttcgactttgaatgcaccacggacttcaagccggacccgcaactcgctcggttcaagcaccaagtattttttttattttattttttttgtcaaaataaatagaaatttaatgaaatcgaaggtaaatttctgctttgcacacgtgacgtgcacccggtgcatcgaaaaaggcgtctgggaccaggagttggaacgggcttgcgccctttgcggccgcttccgcacctactcatgggcgccgttcgaattctggcgcacggacgtggaatgcgcgaatgtcgtcgatgacccgttggccgcttttaccaaatggctgctgaacttcgaggcggaagtcctcgg

SEQ ID NO: 8983 - DNA, 3713 bp, Heterodera glycines
  misc_feature (3530)..(3530): n is a, c, g, or t
tggtgctaggtcacttcgcgaaaattgcaaaaatgatgacgtcaaaaatggggcgtttcgcgaaaagtgcaaaatgggcgtttcgtgaaaattgcaaaaattaataaaaagagactgggcctcttcagttcggtgtctctttttattaaaacttaataaaataattattccgtgtgtttcggcccttatccgtagacacacaagccacagcaataaagcaaagcaaaagcaattttattaagcaaaatacatataattaatagtatttattaaaaattttattaaattgaaattataattaaatttaaaaaatttaaaaatataagcaaaataaatattaaaaattcaaaaaattagtacaccataaatttttgtaaatttattctaagcttgcaaggctccaacatcagcattttggtgtaaaattagttacacaaatacaaatccaaatgcttgttatttgctaatgaatacagcaaaatgagtgggagattttgccggcgcgctgtcaaaaaatgtcgttctgtcataatgtcgctgcgtcgaaatgtcgccgcgtcataatgtcgccgcgtcgaaatgtcgccgcgtcataatgtcgccgcgtcgaaatgtcgcccaagctaaaaagagtcaaaatgtcgccaagctaaaaaattagtgaaaaagtcggaaaattacattttaaggcttcataacacataattcattaacgatttatcagaatagcataaacaaataacaaaaataataaattttgcaggaaaaaggaatagttcaaaaaatgaatgaataaaaaagggtaaaaattgggatcgaacaagtctaagcgaaattcatgattgaatcttccgtgttttcgtagtccttcaattttcctgcatatccttcgacctgcagaccaagagccgtcataacatcgtgaatttcggcatcgtcgttgtatgttgcatccgccaaaattctcatgatgactgcgtcctgcagcacgtagcgtttgtgtcgtttgtgtatgaagttccttgctgacctcgctgcgtcaacttgtctgtcgatgcttccgctgacttcagaaatgaaatcggaaagggctgggtgatgacaaagacccttctaaaattattttatttggggttttataagtaataaatacagagaaatgaagatgggttgcttcgaggccattgttggtccgcgcgagggcagaagccgcatgcgagtgcacgttccaatatggaattggaaatagtgcgcgacggacgacgggttcttcccaaggacggacttaaaattgtttaaatcaacaattttgtgaattttgctgtgcctggctgcaatgtcgtcgttgacgatgaactcaatgagtactgcaccaacggcgagttttgctccactgttgacggccatgatagtgttgagggggcgggcgagtcgatgccaaattgtaagggctgccgtgagtatgtgtggtcggattcaacagaagaaaatgatgtccccgtgaatgcttaaatgcaaataaaagaaaataaaaagagtaaatgtaaaaacaaacacgaaaaaagtggagaaatgccaccaggacgaactccaaacgcattgtcaccgtcaagcagctgttgctgcgtcattccgatgtacgtcctcgcaaagtagaggagaaactgctccatctccataggggcggtgccgacaatgacgctgaatgctcgtctgacgtaagttggtggcaacaatggcaaagataggacatttctaaaaaaattatgaagtcaggtcaatttttgaattgttttacctgaaagagtgtcggaccgcttcaccacgcacagactgttccccatacatttgcaccagtttaagccccttcatttttcggaagaggttttgcccgtagtggaacatgcaacagaggatgtttgttgcagggaaaacagcagatacggcgttcatttcggctttctcaaaatcgcaaatgactaaaagaaaactagattttcacataaatttatgtgttagttttcaccttttctcggtgcgaccggtgaaattcggttacatagaaagttcagcacttcctcgtagtagcgtcgatgtttcccgggcagaagaccccagactccaatgcacattcggtggttgacagacgcgcccacaacaaagcactgctcccacatgtttggtgctgccttgaatgtcccgtccaaatgccaagttgcactgtttttgctcaaaatgtccaaagtctaaaaaatttaaatttaaattctgttttcgcccctgatgattacccgttcgctcccaaacacaagcaccacgtccttttctccaattctgacagtgcgactgtcgtagagcacaatgtcctctccgtttttcagccgcaatttgtcggggatcacgaatgccaaagggtctgtgcagtcgacgttccccaaaattttcctcttctgtcgtctcatcatgcagctgagtgcgttgtccgagcccatcgccacataggtctcgtcagcagttgaacgcctcacctccgccaaaagccgtgtcggtttgattcggggttcagctttcacgcactcgagtattttctgtcgccgaatttctgcctaaattttattagtttacttaattagcaatgattgtccgaaacccgttgtttttgtggctctgggaggtgattatggactttttgtccgaaatatccggccattccattgtcgcttttgtcggtgattgtcacgcgtgcgaggcaatctcgcacattgcacctccacaaatcattttgtttgtgcgtaaaacggaatccttgaaatttagaaaaaaaaattcaataacgattaaaatttttaccttctgaccaaagacaaatgcctcccttttgagtttttccgagttcgaagtttacgatggcttgttcttcttcaatttcatcgtcgcagtcgttgttttcgtcgttttgttcacggtgctcagaatttgcttcgttttcattgtcgttgttgtccaagaacttacgcttacgacttttttggagaatttcaatttttttacgatccatatgagtctaaatgagtagatttttcaaaataaataataagaagccttagaattatgtaattttaggatttttcgcaaatttttattgggggacattttgactgattttagcttgggggacatttcgacgcttggacattatgacgcttggacattatgatgcttggacattatgatgcttggacatttcgacgcttggacattatgacgcttggacattatgatgctaggacatttcaacgcatggacattatgacgcttggacattttgacgggcagcggggtacgcgctagtgtcggacaaaattgctcataacgccaaatagcgcatttggcgtaaatttttgcgcgttaattcaaaatttacactggtaaatgccttttttgtattttttatttcgatctgccataactcgcttcattcccaactaaactgaacaattttggtatctaaaaaaagattttgaaaaggngaatctttttctaagcgaatgttaagtaatttgtcatctcagaaaaaagttgtcggaatttcaaattttcattacgttagaaactcagtcctaaactgctgttttcaccaaaaatgctaaaatttattctttttttatttattctatatgtccaaagtgattttgtacccttataaccaaaat

SEQ ID NO: 8984 - DNA, 1640 bp, Heterodera glycines
ttcacgcactcgagtattttctgtcgccgaatttctgcctaaattttattagtttacttaattagcaatgattgtccgaaacccgttgtttttgtggctctgggaggtgattatggactttttgtccgaaatatccggccattccattgtcgcttttgtcggtgattgtcacgcgtgcagggcagtcacgcacactgcacctccatcggtcgtttttttcgtgtgtgtaccgaaagcctttgacaaattttcatccttttctagcaaatttcccaccttcagaccaaagacaaacgcctcccttttgagttttcccgagttcgaagttcacgatggcgtgttcttcttcaaaatcgtcgtcgcggtcattgttttcgtcgtttggttcatgatgctcagaagtcgtttcgttctcattgtcgttggtgtccaaaaacttacgcttacgacttttttggagaatttcaattttgttacggtccatattgatgctaaagcataaattttaaaagcagatcgtatgaaggcatataattatataattttcagttttttcactaatttttagcttggcgacattttgactctttttagcttgggcgacatttcgacgcggcgacatttcgacgcggcgacattatgacgcggcgacatttcgacgcggcgacattatgacgcggcgacattttgacgcggcgacattatgacgcggcgacattttgacgggcagcgatttgaaaaaagaaatgtttgttttgctttttttcatttttgttttgtcagtttttgcaaaaagcacaattttaaataaatgtctacttttttgtttttcttttttaatgacaaaatagtttttatattaataataatgtaatagaaatgattgctttctattgcatttgttaagagaaaagtattttgttatattagcaaagtgcatatggaaatgaatgctcttaatttttgtaaaaaagaaagaaaaagaattgtttttgtatatgcaaagtcaatggaaatgatcttacaattagttttggtattgtattgaaaaagttttggtttgagaaattgttttgactttgaaatggagtttttttgtttttgtaattaaagcggatgtcaattatgcctcttttactggatacggtttaattggatggatttatcgcattattaaaatgaaagagaacaagtatttataatgaaaaggattttctacgcaaattgtatttcataattgaaatacgtttttaaaattccaaaattatgcttaacaggtctgaattaagtcccgtgattgaaatgccgatgaatccgtaaaattgagttcattgtttggaatagtgaaggattgagtcccggtgattggaatgccggataattgagtcccagtgattggaatgtcggagaactgagtctcggtgattgcgatgccgaagaatccgtgaaaagtgaaggattgagtcccagtgattggaatgctggtgagattgagtcccgggaattggaatgatggagaattgaatagaattaagttccagtgattggaatgctggtgagattgagtcccagtgattggaatgtcggagaactgagtcccaatgattgcgatgccgaaggatcaggtgaggttaggtccc

SEQ ID NO: 8985 - DNA, 1450 bp, Heterodera glycines
gctgtctgtgtctgtctcacccaccccaccaaatttcatttggaaattccacggtcacttgacgacccctcccctcctttgttaggtattcatacaaaaataaactttgcttacgctatcccaaacttgcccatgtttttatctgtaatacttagggttctgtcaatccgattcgctctctttcttatcccttagtttgccaataatttctcgcttcccgattttctctaaggaaatgcaaaaagccaagatacatttcgttttttgtacattaagccgaattgcggcggcttccttccgcgtccgggactaattaaaattcgatggttaatattttaaaaacgtatgtggtggataaattgcgctttacaacaaaaatatcgcactttcactatcaaagaatcaaaatcggaacgaaaggatctttttcctaaaatgctcgtcaattcgtcctcctcaggccaacaatttctttgccgtttcgtcaatttgtgcctcaattttcgcttccatttctgcgcacaatcgcaccgccgcttttcgcattgcgtcctttccgttgggttcggccaaactcaaaaagctttgcgactttaagagttccttttccacagatgcccaacaatttttgttgtttcgaaactgttgaaacactttcagtgccaaaatcatttcttctgtcgccgccgtcactttgggccgggtatctttctgtaaatccggcacattttgaggaggcaacgatttgttggcggtccacagcttcacatagcctttctacaaaatgtttaaacaactatattcattaatgacgtttaaacgatttccaactttcacctgaatcattttgttggcgtccatttggtcctggaagaatttttctccataattgtccccaatgccggctttttgtccctgcgccgaaacactttccaacacttgcttttcccgttcaaaatcatcgattgagatgttttgatgaaatttgtaattgaccacgtccttggccaacatcagccgtttgttggccacgccgacgatgaaaagtgttgcggttcctttgtgaaggaatttaaattatttttgtttatttaaatcaatataaaattcaattactcatataaataaatgtctccgtgcttttattcaccttgggttgccttacagcacaaaaatgccccattggcattggccccgggcgccgttttgtcctccgtttggccattcattccgaccacaaattcgaatgccgtttccgttttcttcatgaaggcatagtcggagctgcgcagaatcacttcttccgcctcattgcattggccttccccagccattggtttacctactcaaatctgtttttttaaactatcagatccctcgtgatccaacaactcctcgctccccccccccaaggaaaagaaaagtcagttggctttttccaaatttataa

SEQ ID NO: 8986 - DNA, 1192 bp, Heterodera glycines
  misc_feature (1110)..(1110): n is a, c, g, or t
ccctactaatgactcacttcattcattgtcagttgggtcgcatccatttaatagcatctttcagtgacctacctattcgtcattccttcatttttacttttgtttatccatgtattccactctccctgaatcaataactccgcttttctcctcccaatttcttttttggttggtcgttttcgtttaagtcgcaatattatggacattgtacccgtttttattccaaaaattcattgttattttgctcaaaacaaataaatagtacaatttatttgtatattcgaagagttcaaatgttctgagcattcaaaattctaaaaaatcgttttgtttacaaaaaaaaaaacacaaataaaaaatatttttaatcttttttttgttatagcttttttaaaactattaatttttttaattttaatttataaaaagttgaaattcccattatattaattgaatttaatatctcatgacccctaacactcttctgactctaaattttgaatttacttgcgcttataaataatttaactaaatttaaatgtttagaaaagcgatggaaatttttgatgaatatattattgttgatgaaaaatcactttcaattaacattggctcaaagttcaatgaagtgactcaattcgctgcaatgtaatttattatatatttaagttttctcattatttttttgggaccaaccgagacgggtaattttggcacagccattttggtgtcaaacgcataactttctaattaaccactaaaataattaaataatgtgggacactttgaattagcggcaaaaaatgccgcgcaccaaagtaactctgacacgaccaaaacgaggtgccattatctagctgactggggaattttaaacgctaaattaaataggcagttggagtttgattcaattgtgttccaaaacctttggaaaaacaaatttttaaattgaactttcataataataattaataaatcaatgattaaattataaaattttctttgtggaaaaggaacgaaatttacagtaaattttttattgcaaatttttccgaagtagcttaatctgcctcatttcctcaaaaaaataattttttttatttagggatntttcatttgcatacaacccttgtcgcttgatagttaaagacattggcaatgcaactttgccggatgtgccattggcacaaat

SEQ ID NO: 8987 - DNA, 3690 bp, Heterodera glycines
ggatcagaaagtggaagaggaatagaaaaggaaacagaaagtggaagagaaagtggaagaggaccagaaagtggaagagaaagtggaagaggaacagaaagtggaagagaaagtggaagaggaacagaaagtggaagagaaagtggaagaggaacagaaagtggaagagaaagtggaagaggatcagaaagtggaagagaaacagaaagtggaagagaaactggaagaggaacagaaagtggaagaagaagtggaagaggaacagaaagtggaagaggaatagaaagtggaagagaaagtggatgaggaagataaagttaaatagcgaagctatttcaattaaaaaaataaattaaaatcaatttaaataaaaatatcgcatttaaattaaatttaaaacaatatcgtttttaaattaattatttgttcatttccaaattctcatattcctaaactatgaggatcgcttagcggccaatagatgctttttgcacgccccaaattatatctcccactagagccagcgttgaaagcgcccccggcgctttcacagggcccgcagggccctggttatgaaaaggaataaaatttaccagtaaatttttttattgccaaattcttcaaaccctatttaattctgcctcatttactcaaaaaatatcaaattattattttttatttagggatttttcatttgcatacaacccttgccgcttgatagttaaagacattggcaatgcaactttgccggatgtgccattggcacaaattattgtgtgggcatgggacgcgcaaggggcacaagtgatcaaagaagtgacaattcaatcaatgcctatgcctaccaatgatttttatcggaaaaatgaattctagacaaaaatattgaacacgggcggcacactaacatttatggcacagtcaagtgccaacaacactgtgggcggaacgccaaagcttcaagcccaaccgaatgccaacactatgggcggaacgccaacacttcaagcccaaccgaataccaacactatgggcggaattccaacacttcaagcccaaccgaatgccatgggcggaatgccaacgtattatgccgtacagcaacagcagccatatgcccaactgcagtttgtttcccagcaggcatgttagagggatggggagtactttggtggtatgactgttagtgctgttcgagagtctcgacttgagaaaagtctcgggttttcggtctctgtgtcaggtctcggtcttgaatcggaaaattttcgttctcgaacagcactaatgactgtggctcggttttttagttttttttttttttttgacaattttttatgcgagagatctcccagggcccatccaactacggggcccaaaatttccagcagccggcgacggtaagacttggcactccatcggcgtcagtaaagcctggcactaatcaacccatgatgcccatctcacccacacaatcagtgctggtacggattctcaaaaaacgcgaaaacatggacgaaaagtgaaaatttccattaaaaatatattattatttcttttttaatttttctccagtccatgccctccgctgagttcgccggccgacgatttgaccgtgcatattggtaacagaaaggtgaagcgacaattagcattaatcaatcactaatagggattcgtttttaggcaaatgcctaaaatttttcgcatttaatacatgtagctaaccacgaaaaacgcgttttccgctcttgtttggggtgtctacgatgaattttataatgcccaattttgcctattttgggctttttgtgcttaatgcctaaacgcctatttttgtgcctatttcgccacttttggtgcctttctcagaattttctgaaaatcctataataaaaacgaaaatacacacctatgaatcggcccaaaaattttctgaaaatacgcccctaagaattggaaaaaattttcccaaaaattaattacaaaaataaaaatttattttggtaatctttttaatttaaaattttgttcttattccaaaaaaaaactttaagatatttaattattcatttacaatttaaatttaaccagatttactttatttttatcaagttttacgttttgctaccttaaaagcgttaaagaaatttctatttgcttattttagtgaatatttgaggatttctgtgcctatttagtgcctattttgcaattttgcgtttttaggtgcctatttcgcgatttttagtgcccaaaaaacgaagccataataattcaaaaaaattgcttaatggatactgtatcaattttcaggttactgtgtctgctgcttggcttatgtgccaatcgccgatggtccgtcaaatgctcagcgtggaaatgaaggaaaagcagcagcgatcgctcacattgaacgaattgggcatcgacatggagcagttcatggattttttggaggcaatttcgaccaatgctcttctgttcccgattttgccaaatcgtaaaatgagattaacaattaattaataattaaatgacattaatttttaaatttaagcaaaaaatgttcttccgttactcatattggccgactatttccaagtggattgggtgaagacacgctgtgctaatcatctgatcaattgcgttgaaattccgctgatcgaccgtttctttctggccattcgctatcaacttgattgttttaaggtgtcatcccaaaaactagaaaaaataggatttttggggtccaaagaattttaaagaaaaaataggatttttgggttcgaagaaattttaagagaaaaaaataggatttttggggtcctgagaaatttaaggctaattgaaattttttcccattttaggatttctttttcaatttgagtgttaatgtgttgcgcgcctttttcaaggcgaatcgtgaccaattttcattgttggcaactgatccgaattccggcaaattgttcttcgaattcgccaatcgacttagtgcggatactgattctggagaaaaaccaatgccagcaaattttctttcatattaacttttaatgctaatttatgtatttaatgagacgcgctcatacataaatttatatttttacacacaagaaatgcatctgttaattatataattaaatgaggtagggagagattagaactctgaaaagcatcctaaataagcttatgggagcaaattaagtcactgaatcactgaacgcaaaaaccggcgaaattatcgatgagtaaataatagacgataccgggaattttttggaatttatgatcaagtccccgcaacaattctactacagtacactccatttacggtctgctgctttgtccgctgatcaacatcataaaaacacaaatatgaaagttaaataaatttcgatgataggaattgtttaagaaataatttatataaaatatttttttaaatgtaaataaaacatattttaccgcatttaggagagagagaaagctagagatgagaacatagtgagagaggagagagtgcgataaggaaagagagtgtgggagaaagcgagagtaagagaaagatttatataaagaataaaaaattaattaagttatgcaatgatttttattaatattatacagagaaaaaataaatcgttaattttaataaagtgagaagagagtgaggagagatggaaa

SEQ ID NO: 8988 - DNA, 1265 bp, Heterodera glycines
  misc_feature (40)..(40): n is a, c, g, or t
cttcgaattcgccaatcgacttagtgcggatactgattcntggagaaaaaccaatgccagcaaattttctttcataaattttcattcatttaagatttaatgctaatttatgtatttaatgagaagctctcatacataaatttatatttttacacacaagaaatacatctgttaattatataattaaatgagatagggagagaaataagcttatgggagcaaattaagtcactgaacgcaaaaaccggtgaaattatcggcgagtaaataatagacgatgtgataccgggaatttttttggaatttatgatcaagtccccacaacaattctactacagtacacttcatttaccgtctgatgctttgtccgctgatcaacatcataaaaacacaaatttgaaagttaaataaatttcaatgataggaattgtttaagaaataatttatataaatatttttttaaatgtaaatataacatattttaccgcatttaggagagaaagctagagatgagaacatagtgagagaggagagagtgcgataaggaaagaaagtgtgggagaaagcgagagtaagagaaagatttatataaagaataaaaaattaattaagttatgcaatgattttttattaatattatacagagaaaaaaataaatcgttaattttaataaagtgagaagagagtgaggagagatggaaaactaattgatttttttagttgtttaaaaggcaaagcaaaatgataaaaaatccattttaatattttttttacaaaaaactacaactaattgctagggatatttgtaggaatttacatttatttgttgctccaaggctatgtatatgtaggaagaaaggaggccaaaaatagtatctctgtgaacaaatttttggaatatgtgaaagtttttggtgcttttgtggatttttgagaataattcatatttagttatttttaaaaatatagaaaaaatgaaaatgccaaatgtctcacaattattttgtattttaattgttttttcaacatttattgaaaagacaattggtgtcaccaaaaaaggaactgcttctccactagaaaaagcagagcaaaaagacgacgaaccaaaattgggaaaagaagacaaaaaattggtgaacaacaaaaaagaattgctaaaaaaagaggtgaattttaaaaatatattttaattgaaattgaaatttaattttaatatttttgagggaaaaattgcaaatgcaaatggaccaaccagttgaaca

SEQ ID NO: 8989 - DNA, 1677 bp, Heterodera glycines
  misc_feature (129)..(129): n is a, c, g, or t
  misc_feature (152)..(152): n is a, c, g, or t
ttgtattatcacagtgaatcccgttaaaataatttatatgtgtgatttttgtttttgtgaaaaaggatttaattttgtataggatgagtgattggatttgggaaagtaattaatggaatatgattgaanattggtgggggattgaatggaantattttatattttagaggggaaattataataaaatggttgttaattattttatttttattttagcatggaaaatcgacaagcatttcgggatgaatttccattaatatttaaacgaaatgtaaatgtaattcaagtttctccacaacaaaatgtaagcacattcgctggaagctcaggacaacaacacgaatctttgataaaaaaatttttttattcattttaaaaatataacctttcattcttttcaccgtattttttttaattgtcccctaatcgcaaaaattggtcattttggacaaaatctatcaacaagttgcactcaaattttccaaattttcctggcggcgccgcctattctccataaattttttataaaaacgcgccgcaaaaaaaccggctttgaaaaagtagagttgctttaaaataaaattttggtcattacccgattcgcgagggtgactgagagagagggggaagaaaacagagagaatgggagaggaaagtgcgagagagagaaagaaagggagggagggaaactgaaagagaaagagaggagggagggaaagagagagagacaaatccaattcatgaagtcaatcttcctcctttcttggctttttcccatttttgtctttgactgaaattctcttaattatcaaccatatgggaatatcggtaagtatccgccagttgccggctctccccacaacacatcgcttcccggcacattggccacaaaccaatggacgaatgtccttaaatgaaaaaaaaaattaaataatttgtatgaaattctatcaataagtgccagagatcatgaaacaattaaatggctatttatacatgataaattagtaaataaaacaataattaaaattatgaaaaatattgtagtaatatatgtattattataacatgaattttaagaagatcaatcgagttctagcgatttggaagcgtctctcgagcgtttaaacggtttattttaagttaaaaaaatgaaaattaatttaccaatttaaaaccatcaaattctgcaaatctgcaaatgaatctgatgattaacgttagtaagataattttttgtgtaaaataaataatactgaatatattacaatatctaattaaagatgaaatgaatcgtagagcagcagcagatcagcatatgaatgtgattctttttctgatcggccattattgtcaagattatgccaaaataattttcacacttttgtccaattctaattcttaaaaataataaattacacacaaggttcttaatttcccattcaatgaaaaatgcgaaatttagtattttataaatactaataaaagataattttggtgatctcagagttttaaatgccaagaaaaacaattaatgattaattactatctctgccacaaaaaaaacaataaatgattaaaaaaaaatttatcttattgtttttgtcatgataatgccaaaaaactttaaggactgggagaaaataattccagaggaatcgatgtccaattccctgc

SEQ ID NO: 8990 - DNA, 4945 bp, Heterodera glycines
  misc_feature (3471)..(3471): n is a, c, g, or t
  misc_feature (3504)..(3504): n is a, c, g, or t
aatacatgaagtatagaattttgattattgaggccctatttattctttactaaaaaactgaacttatttagaaaaaaaagttttaggggtgccttttcggttttttgtgaaaatgccgaaatatggatgtaaaaatggaaatgtggaaataaaaattcatcctagaagcatcaaaccaagctaaaaatactatttacgtcgtttttaggccgaaatgagtttgcaaaaaaaatatggaaatccatacaaatccggtccctagtgatcacttgtgccttatttagctttgttttcttgtttattaatatttctttattgttttatgcgttcagttaataataaaaaaataattaaatagaaatattatatatttttttcccaaattcctaaaaatcatatgaattttaataagatccggcaatagattaagctgtataatcaatctgatattacaaaaatgaataaataaaattttcattcatagtaaaattgattaatgcatattttcctttattttttttattcataaaaatgtataattcatataattttttcgttatttaatttaatatcactaataagcatattaggatattttttcaaaaatttttttgttttatttttaagattatgatgaacgtgtttcaaattgtttggtgtttcgctgcaattttatcaatgtccaataccgctccaagtgcgaaaaatatatttaaacgtttaaaaaataaaaaatatgtttctttagacataaaagcaaaagatttaattactaaaaatgaatcaaattcacaacatgctgaaaccagtgacaaaactgcatcaagctcacaaaaaaataaatctgatgagaattgctcaatttgcttggacagcattgctaatgatgataattcttcactgaaaaccttacttaattgcaaagttagcaaaagccatataaagtttaatatttaaaaattcatttataatttttaaattcaattattaatatttttattcaaattattgaaaaaaatatattaataatataatcttgttttatagcacagctttcaccacagttgcattgatcaatggtaattcttatttataaaaaatattaaaatttttatttttcaacaatatataattagcaaattagcataaaatttcataagcccaacaaaaataaataaataaatattttcaggagttctagcccttctctaatatggaatttaaaaaagctaaattcgatgattagtccattggttttcattttgcaattttttcaaaattccgataaccttatttttttcgcttaattttattgggttaaggttacaaatcaaaaaacgatgtcctgtatgtagaggagaagttaataaacaggaccaagtaggaactgatgacagtcagcacaacaatggggaggaggacatggtaataaataatgccattttagccatggttattttgttttattatctttgattatcattttcaaaagcatttaatattaaaggaagacgaaaatataaataatgatgatgctacttcacttaatgagattgcagaggaatccgatgaaacaggtccattttttgtatattcaattagctatattaaatactttaatatacatttattttgttttttaaaaatttcggaaattgcattgaatctttcaaacatgttttaaaaaaaaatttcttatttattgaggtatttatataataaaagaatttcattcagattcgagttttcgtgaattggttgagtctattgaacaattttttaatggttatttatataattcataaatgagtaaataacaaaataattaaaaatgcaaaaatattgtagtattttatataataaaagaatttcattaagcagaattaagtcttggtgaattggatcagtcacttgatcagttattaaatggttatttatacttgataaattagtaaataaaacaataattaaaattatgaaaaatattgttgtattatatgtattattaaaatgagaattttaagaagatcaatcgagttctagcgatttggaagcgtctctcgagcgttttttaaatggtttaatttaagttaaagaatcaaaattaatttactaatttagaatctttaaattcttcaaatgaacccgatgattaaagacatgtatcattgataataatcattctttttcctgatgtagattttcctaattgaattattgtcagttgttttaccggatgccctttggcattcgtacttcatcagcccatcccccaataattagacgattgggagggtagaaacgagttaaagagggcggatgaaacagcaagtgaggtcctaaggtatactttattagagagggtgtaccgacttttgcggtgtcagcccaaaagttcccttccctaacgttaccacccaaaacagtagtgctgctcgagaccaaaaatttcccgagaccgagacttgaccccgagaccgagaccgagactcgaccagagaccgagactcgaccccgagaccgaaaaacccgagacccaaaaaacctgagactcgagacttatttcaaaaaattttcctattcgcttaaaaattgtttaaaaaattttttttgactctattcttaactaatttttatttttttaattttgattcaatttggtacaacatttatcatttcaaaaacgcacaaaacaaaaattcgttagttttttcgcggtttttgagtcaatttaaaaaaagaaagggtattttggagctccggcggtgccgataggcgccgccgggtaaaattttgaaatttatcagtgcgctttcttaatagatttagtccaaaaatgacaagattttatggttttaattgttaaaattgtgattaaattccctgaaaaaggaataatttttacaaattataagaaaaagtaattacttggagggatggtagtgatcaacgctaaaatgaagacaataaccaagaacacaacaacccacttaaccatgcacattactaaggaaataaagcaaaaaagttactaaaagtatatttattttttaactttacaaaaagccaatcattatgtgtgtaaaaaagtctcggtctcgaagaccgagaccgagactgaaaagccgagaccgagattcgagaccgagaccaaaaaaacccgagacttttctggagtcgagactcgagaccgagactctcgagcagcactacaaaacagcaccacccaaaatgccaccaacccaaaatgccactaacccaaaaggtcatcaacacaaaacggcaccaaatttgccttagacgattagagtggaacaataatagcctttattctgaaggttgatccgtacaaaaaaataaataaactggagatgatgaacagcttcgataatttaaaaaagactgggatttcggcgccaatagtgcaataaaaatgtgaacgattaaatacacaagaaaattgtagactanattttatgttgttttcatattacttaacattgngaatttttcatttgaatataaagacacatcttcgaattagtgcgatctatgaattgtacatttagaatcagtagagaatgaactatgttatgtgaagcggaatgtgcgagaaagcgggataatgacaatttaaattttcaaaccattttaaggcggcaagttttttgaaaatttttaaaattttcttcaaatcacattaagactattctttaaaaaaaatcaacgagttttgtagtataactcttttcatagttgaccaaattgaaattttgatatcatccaatagccctaagtgttctatatttgtgcaacaaaatttcgaacaatttatttaatttctaaaaaggtgcgaccaaaaaggtttggtttcatacgcttattacctttaaataaatttttttaaaaatctgttttagttatctaatttcaaatttagaaaccccccaaattttacaaggaaatgcgtcatcatatatatatgcaataaattaaaatttcataaacaaaaaaaaaacgagaaaaattaatcaatttttgtacatttataatcattagataaagaactaggtatcttatttttgagaactcctaataaataaaaacgaaaaggccaaaattgaaatggtgtataaaacaaatggactccaatcaactaggctccagcccgatttttggattataattcttttcataattgaccaaattgaatttttgatgttagccaatagccgccctaagtattctattatatttgttcaacaaaatttcgaaaaatttatttaatacaaaaaaaggacgacctaaaaggtttggaacgccagttttttttttttgtttttttttgatcataacttttttgtaacttaaggcatgtattcaattctcgccagtggctttaaggttcgataactgtcaaaagcttattgagttaaacttcaaaagtgttataattaaaacacagataaaatataaattggatttgttttcatacgcttattactttcaaagaaattaaaaaaaaattttattttagttatctcatttcaaacttaggaaacccccaaattttatagcaggaaatgcgtcatcttatatattaaaaataagaaaaatatttatatatgcaataaattaaaatttcataaacaaaaaaaacgagaaaatttaaattattttggcataagcatttcacgagaatttataatgttcagtggttttgtcacattgtaaacaacattgtaaacaggaaatcagatataagattaggtaatattttcatttttcattcatatttttataatataattatattattcattttaaaaatgaattcaaaaaatatttttactgcttctttgctatttttaatctcttttttaattgaatcaatgccatcgccgaaaaatgagaataataatgccaaagacgatatatcagaaat

SEQ ID NO: 8991 - DNA, 1361 bp, Heterodera glycines
  misc_feature (1283)..(1284): n is a, c, g, or t
  misc_feature (1323)..(1323): n is a, c, g, or t
  misc_feature (1331)..(1331): n is a, c, g, or t
agtgccaggcggacagcgaaagggacggcacgggcgacgaaagggtggagaacggcacgggggtctgaatgggcatagaaaaggtgatagcaacgcccaaacatttccaactctctttgtgccgttctctgatcactcccccctccaaattcagtccgatcagtgattaaacctagccgccatccccatccggcggatcagtgattaaactcagtccccccgccccctccggcgaatcagtgattccatgttaactcacaatctgtctgatcattgcttataagccatgttccccccatttgtctttcccttaccttcgccgtctcctcctcataatcgtcgttgtgaagggatgccggccgtggcagcaccatcacgcgttgggatgggttggcatggtcaaagttggagatgagccattcctccttggccgagtcgagcgaggaggacaccgacgaggactgagcggagaaggaatgcatgttggaggagggaggggcgcggaagacattgcgcgagggaatccgaggcaaagcaacggaatggtgtccatggacgagctgagaaagggaccgaatgaggaggaccaacttggacacaactgttgctgggattaatgggaatgtcacagttttggcatggatggctttgttaaagagccaaaagttcccgagactctcgagcagcacccgaagaacaattatgaaaaagcgaccacagaaaaatgggcggcgttttaagtttcaattttggctatcagcatgggtttgtctgaatggcccaattggctccacttggccattcaatttgcctgaggcggtgccggcggaatggcgccgctctgtgcgcctccggcgccactgatcggcccggggcctttgcccacggagagagtgtcgctcattccgctgctaatcgttgttatgctgtcctcgcgcttcttcagaaacacctgtttaaagaaagcaacaaatatccatcaaattaagtgaccggaattaaaataacggatggaattgtgatccaattgactttctttctgagtctctcattaatccttcgtgaaatgtgtgaatgaatgtgtttgatcacttcgctcgctgatcaatcttttctggtcaccttaatttgccgcgtgtcgaccaccgacgcggcgccatcgaagtcatacgcagccgaattcaccgtcagtcgtcgactgctaatttcgccaatggacgaattgttgttcagaatggtcgagcccgaaggggacaacgaatgggaggaaatgcttcgcctgnngagaaataattagcttcccaattaattaatactccctcngcccccantcattaacgggtcaatcaaacgtaattgct

SEQ ID NO: 8992 - DNA, 2395 bp, Heterodera glycines
  misc_feature (1788)..(1788): n is a, c, g, or t
  misc_feature (1841)..(1841): n is a, c, g, or t
ttggcatggatggctttgttaaagagccaaaagttccccatacatctcgagcagcacccgaagaacaattatgaaaaagcgaccacagaaaaacgggcggcgttttaagtttcaattttggctatcagcatgggtttgtctgaatggcccaattggctccacttggccattcaatttgcctgaggcggtgccggcggaatggcgccgctctgtgcgcctccggcgccactgatcggcccggggcctttgcccacggagagagtgtcgctcatttcgctgctaatcgttgttatgctgtcctcgcgcttcttcagaaacacctgtttaaagaaagcaacaaatatccatcaaattaagtgaccggaattaaaataacggatggaattgtgatccaattgactttctttctcattaatccccggaatttagcgattttacaaaatttgtttcttcgtgaaatgtgtgaatgaatgtgtttgatcacttcgctcgctgatcaatcttttctggtcaccttaatttgccgcgtgtcgaccaccgacgcggcgccatcgaagtcatacgcagccgaattcaccgtcagtcgtcgactgctaattttgccaatggacgaattgttgttcagaatggtcgagcccgaaggggacaacgaatgggaggaaatgcttcgcctgggagaaaataattagcttccaaattaattaattactccctccgccccaattcattaacgggtcaatcaacgttaattgctcgcactttgtttcggagtcggcaatgccaactgaattttgttgcttctctttttggcacatggcggcgccatcctccgtggagaagctgctatgccgggcggtgcccacccgctggacgaggtgttcggcaccggcaccggtgccatcggcggacgaattcactgatggcattgagcgacgcaaacttgacgacaaattacccattgggtaagtgatggacagccaatctaaaggtcgagagagaataattagccaatgtgatattcttggcataaaccgagtcaataaataaataaatgacccatggggaagggaaaatttaccgaaataaaactcgaaaagccgagatttttctcgaattggcaccgaaattctctgaagagccctgaggcggtgtcggtacgaagttggagaaaggacagcacaaaaaacgaacacttataccaacaacaaaatttgttgactaattgaagccaatttgttgaaaaatacggcacttattcgaatgaataatcaccgctttgccaatgagaaaagtgagcaattaacccacgggggatgggatgaagcggacggcacaaactgactaattggcccctttggcacccacacacggccgaagcgacgacaaagcacaaaaatggggggagcggaagccgaggtgaaaagttaatgaggaattagtaattggtgcaacaatattggcccatgcctcggggcatcaaaaaaccaaaataataaaaatgcaatgatcgtcccacaaaatgtttgtttttgaatgagtgccatccgcccgggcgttttaccggtcgaagtgccggcgttcggccgattggcggtgccctcgctggccaaatgtctgctcagcaccatcctctgctgctggtcatcgcctttgctaccatttgtcggcatttgtgaagaagtaaatgttcgttggatgggctaattcgggcaaagaaaatggtgccaatgccaaattctgtaaattgtcagtcattagttacggtaatgatgccatttgggaatgatntagtggcgccattggcaacccaaccgaacggacgttccgtccccataaattgncgcctagggtaaaatcggtgccgaatttccgtggcatttgggccaacaaaaggcaaagtccacaagcgaaaagcgcactcacatcgctctccctttgaaagtgatagcttatgaactaatatttcaattgggcaattgtctgccattttcccacccctccgccggcgacgacaattaaagcggacaattggccaatgtcttggcggggggccgagggaatggcaggagcaaattgaatttgttttgcatgacgtaaagccattcattcattccacgccctccgccgccccacggccatttgatacgccggcacagtccgtcggtcggtagcatttggcggttactgtgccaaatgaaaattcagccgtcgcccccgggcgatgctcccccctctccacacaaccgaacttcgtcttccgataatgtgacgtcaatttcagagaaatggcacgcgattgtgccgtgataatcaaattaaaataacagccgtcctttcgctgtattaattattcgcaaagtaaaacaccaaagcgcggaattacagaacccattga

SEQ ID NO: 8993 - DNA, 926 bp, Heterodera glycines
gtatttggtcatcacagcatcctcttgttgacttcccgggcagcacgggaaatctgtggtatttaaatatcataattttgtaaacaatagcagcttagaaacctaaactgtccattgaatcggaaaagtaccaaaaaaaaataataacaaaaacttaacaacagtcaaagcattggtttgtaatcgctgagtttttccaatggccgagcgatcagtgacaaaaaagggtcaattaattaacaataattggcacacattaatcaaatcattggccgatgaaatcgacgatttgctcaatctgacggcccatctgacgaatgctcaccgcgtggtatttgcgcaggtggcgaaggaattcggcacgggtgacaaaattgcgagtgcagtgatcgcagctgaacggacaattgcctgagggggggagggaggggtataattttcggcacaaaaaacaatgcctcccccattccaaatccaagccgtcccaccggtgtgtccgttcacgtggtcctccaatttgccgcgagtggtgaaactcttcccgcacccctcccagtcgcagtggtgccgcttctcccgcttcggctccatgtagcgcttctcgtgcacccgggcgatgtgccgtcgcagtgcctcccgggtcggctttcgttggccacaattggcacattcgtgttggccaagtgccaattgggcggtgggcacaacgccaaccgacagcgacaacgccatttgagaaacggaggccgaagaagagaaggaagagaggacgctgggagggccattctgaaaatgggaaggaatggggcaaaatgtcaaatggaacaattaagtacttaattaccatacaaattttatggacgggggatgcaataattaatttagaagaaaataagtccctctatttgcttaactgatatccaaat

SEQ ID NO: 8994 - DNA, 2453 bp, Heterodera glycines
  misc_feature (1762)..(1764): n is a, c, g, or t
  misc_feature (1768)..(1769): n is a, c, g, or t
  misc_feature (1773)..(1773): n is a, c, g, or t
  misc_feature (1784)..(1784): n is a, c, g, or t
  misc_feature (1791)..(1791): n is a, c, g, or t
  misc_feature (1797)..(1797): n is a, c, g, or t
  misc_feature (1801)..(1803): n is a, c, g, or t
  misc_feature (1814)..(1814): n is a, c, g, or t
  misc_feature (1818)..(1818): n is a, c, g, or t
  misc_feature (1832)..(1833): n is a, c, g, or t
  misc_feature (1842)..(1842): n is a, c, g, or t
  misc_feature (1845)..(1846): n is a, c, g, or t
  misc_feature (1857)..(1857): n is a, c, g, or t
  misc_feature (1875)..(1875): n is a, c, g, or t
  misc_feature (1881)..(1881): n is a, c, g, or t
  misc_feature (1883)..(1883): n is a, c, g, or t
  misc_feature (1888)..(1888): n is a, c, g, or t
  misc_feature (1890)..(1890): n is a, c, g, or t
  misc_feature (1906)..(1906): n is a, c, g, or t
  misc_feature (1922)..(1922): n is a, c, g, or t
  misc_feature (1924)..(1924): n is a, c, g, or t
  misc_feature (1926)..(1927): n is a, c, g, or t
  misc_feature (1930)..(1930): n is a, c, g, or t
  misc_feature (1941)..(1941): n is a, c, g, or t
  misc_feature (1943)..(1943): n is a, c, g, or t
  misc_feature (1947)..(1948): n is a, c, g, or t
  misc_feature (1953)..(1953): n is a, c, g, or t
  misc_feature (1956)..(1956): n is a, c, g, or t
  misc_feature (1965)..(1966): n is a, c, g, or t
  misc_feature (1968)..(1968): n is a, c, g, or t
  misc_feature (1971)..(1974): n is a, c, g, or t
  misc_feature (1976)..(1976): n is a, c, g, or t
  misc_feature (1978)..(1982): n is a, c, g, or t
  misc_feature (1984)..(1984): n is a, c, g, or t
  misc_feature (1987)..(1987): n is a, c, g, or t
  misc_feature (1990)..(1992): n is a, c, g, or t
  misc_feature (2003)..(2003): n is a, c, g, or t
  misc_feature (2006)..(2006): n is a, c, g, or t
  misc_feature (2010)..(2012): n is a, c, g, or t
  misc_feature (2015)..(2015): n is a, c, g, or t
  misc_feature (2017)..(2019): n is a, c, g, or t
  misc_feature (2032)..(2032): n is a, c, g, or t
  misc_feature (2037)..(2037): n is a, c, g, or t
  misc_feature (2039)..(2039): n is a, c, g, or t
  misc_feature (2048)..(2049): n is a, c, g, or t
  misc_feature (2063)..(2063): n is a, c, g, or t
  misc_feature (2066)..(2066): n is a, c, g, or t
  misc_feature (2081)..(2081): n is a, c, g, or t
  misc_feature (2089)..(2089): n is a, c, g, or t
  misc_feature (2094)..(2095): n is a, c, g, or t
  misc_feature (2105)..(2108): n is a, c, g, or t
  misc_feature (2111)..(2111): n is a, c, g, or t
  misc_feature (2114)..(2114): n is a, c, g, or t
  misc_feature (2117)..(2117): n is a, c, g, or t
  misc_feature (2120)..(2121): n is a, c, g, or t
  misc_feature (2125)..(2125): n is a, c, g, or t
  misc_feature (2136)..(2136): n is a, c, g, or t
  misc_feature (2144)..(2144): n is a, c, g, or t
  misc_feature (2147)..(2148): n is a, c, g, or t
  misc_feature (2151)..(2151): n is a, c, g, or t
  misc_feature (2153)..(2153): n is a, c, g, or t
  misc_feature (2155)..(2155): n is a, c, g, or t
  misc_feature (2159)..(2159): n is a, c, g, or t
  misc_feature (2164)..(2165): n is a, c, g, or t
  misc_feature (2172)..(2174): n is a, c, g, or t
  misc_feature (2176)..(2176): n is a, c, g, or t
  misc_feature (2178)..(2179): n is a, c, g, or t
  misc_feature (2181)..(2182): n is a, c, g, or t
  misc_feature (2184)..(2184): n is a, c, g, or t
  misc_feature (2186)..(2192): n is a, c, g, or t
  misc_feature (2195)..(2199): n is a, c, g, or t
  misc_feature (2206)..(2206): n is a, c, g, or t
  misc_feature (2214)..(2214): n is a, c, g, or t
  misc_feature (2218)..(2218): n is a, c, g, or t
  misc_feature (2231)..(2231): n is a, c, g, or t
  misc_feature (2234)..(2235): n is a, c, g, or t
  misc_feature (2240)..(2241): n is a, c, g, or t
  misc_feature (2252)..(2253): n is a, c, g, or t
  misc_feature (2289)..(2289): n is a, c, g, or t
  misc_feature (2291)..(2291): n is a, c, g, or t
  misc_feature (2293)..(2293): n is a, c, g, or t
  misc_feature (2300)..(2300): n is a, c, g, or t
  misc_feature (2308)..(2308): n is a, c, g, or t
  misc_feature (2334)..(2334): n is a, c, g, or t
  misc_feature (2336)..(2336): n is a, c, g, or t
  misc_feature (2343)..(2344): n is a, c, g, or t
  misc_feature (2353)..(2353): n is a, c, g, or t
  misc_feature (2366)..(2367): n is a, c, g, or t
  misc_feature (2380)..(2380): n is a, c, g, or t
  misc_feature (2388)..(2389): n is a, c, g, or t
  misc_feature (2392)..(2392): n is a, c, g, or t
  misc_feature (2396)..(2398): n is a, c, g, or t
  misc_feature (2402)..(2403): n is a, c, g, or t
caattcgtccgtttgcgcctcctccgccagcggagcccttttgactgcgaagtgtcaatggccctcagcgcaacggaatgttattcgcgaatgtgccgtgccaaccgattgtatggcacgcgctgcccgcagccgaaaacggtgcattggcgtgctaaagctctccaacaaatttaatttttacaagaaattattcgttatgtacccacccccccccccccattttaaggggaaaagccttttactcaaaatcctgggacccctccccccaaatgaaattcagtggaaaaagctcgacaaatgacccaggataacagcccgactgtgaaggcggcccttgctgaacaccgcaccgttctcgccgtgtgcctgtctctcgtgccgtcgcacttgagcactgagtttgttggaatagtcacagaatgaacaccgcttcagccccttaaagccgcccatccgcaccagcagaaccaagccaaagaaaacaataaaatacaaaaatgccaaacaattattagttaaacaatttaaattgctggatggaacaacagagtgacactaaaattggaagaaagcgtatttgaaaaaggtaatctttttggaggttaaaaataataaagcaaaacaaatagaaatgtgcgttgaacattaagcaataatgatcattggtttttgtaaatgtctgatcagaaatcaactgtgtcttccaggcttttcctctcttcgtcaccaatttcttcttcttcttcgtcctcctcctcttcgaccattagcaaatgatagcgttttccgtttgcaccatttgtctcttccattgactgctaaaaatttaaaatggaaaaccctaaaattgaaaaactttcgctttttaaaaaccaattaatttttgaattattatagtaggagaaacactgttttgttttacattactaatttgtccaaatttcctttttaatgttccataattcttcgaattcccacgcaaaataatttttgccgcacctttttctgtccgtcgttgtcctcctcgtcctcatcctcgacagtcaaaaggccgtattgtgccgcaatttgtgtctgttcgtcaattgttggcaccccaattggccgggatgttccattgtttgtcccatcgaccgaatattgcacatacgtcgacgaaaagttggccgttgcgctgagtgttccttccttttccacttaaatgatgcatttatttactatttttatgtgaaatatataaaacggttacaattttggatttggacattagcctggctggtcatgagtgtgtcttattttggacaatcgatgccatttgtgccccaatgtctcacgtataaaattcggctgtttacctttggtttctccgtccttttctccgtgttcctccccctcttctttgctgctgatgaaccgctgttccatccaatttgggttcatttcgacgaattggcgcagtctttccaacgcttcgttcagttgactcaaatcggcctcatgcaaaaaccgctggtggtgcgcttttcctcccttcggctcaaaagggatggacacgtcgacggcggtgctgacgacgccgtggagacgggcgataagcaacccaacctaagtgaaagcactggttgaaaagggtggcgcagatggaaacagcagacttggtccggcaaaacaatgggtccaccagcgcgatcaatgccaaactgagaagaggcgaagaacggagggatcactgacggatcggcacaggcaaagcgcgcgnnnatgnnccgnttgagcagtgntttgtcntttgcncggnnnccttttggcgncggnctatgcccctggcnntgcttcgcnggnnccttttttggnccgccagttttcgtctgnttgttngngcgcncntgtcccttttgctggngttgttggtgctgcgncngnntgnccccttccgtngntgcnntttcncgngttcgcttnntncgnnnntncnnnnncntgnccnnnttctcctcctnttnccgnnnccntnnntccgctccccgtnttgcncnggtcggggnngtggcgtcgttggncgngctgttccccggccntctctcgntccgnnccgggcgtgnnnntgnccntcncgnngtcnccctcggcccntttttccnccnnccncngngcgngtcgnngtgctgnnntntnntnntngnnnnnnnggnnnnntgttgtncggtttgnctcncttgggttgtccncgnntgccnnttggtccccgnngcctttggcgttggcgctttcctcgtgcgtccggcncngngccgggncggcttcnctgtgctcctgtctgtcgtccgtgtncngctccgnngcggtgggncttcgcccgtccnnctcgaaaggctgnggcggcgnncgngccnnngctnngctccctcaaaagataaataaatgattggccaaatacaaaaatattacca

SEQ ID NO: 8995 - DNA, 1640 bp, Heterodera glycines
ttgctccgaaagaggggatggaaaaactgctaatttttttaaataagatcaagtcccacatcaggcccgtttctcgactaaaaattccaaaaattttaatcggcaccgcctgaccccaatttatcaagttttttgaaaacttgactctaaagtgtcaaaaatctgtcatttttttggcgcaaaaccgctacaaaattcctattttttttgcccttgctgaaaaattcgaaaaataaacggaagaaaaatttctgaatttttaatgattttgttaagaaaaaattgattaatttttaaaaaaatgctattactcctagaaaatttttaaatttcggggggggggggaatctccatcccttctccctggctgcttttttaggtgcttaaagctcaatagagtaaaaattgcaattgaacaccttcaaaaccttgggccattgcaattaaatttcgcctccatttttattttcccccaaaggaaatatatttaaatttgaaaaaatttcattagaatctttctgatgaaaaaaatcaaacttttacaaacacgtttaaaaaattcaatattttgaaaattatgatgcaaatataaatctttaaataaatattttctgatttggtcattgttagtcatgactagggttataaattatatggactaaaaaacgccaaatatggacataaaatatggactaaaaaagcccgaaatatggactaaaaacctcaaaaatggcaaaatatggaccaaaatatagactaaaaactgccaaaatatatcttttaacccctataaaattccgaaaatgtattttatattcaatatttgttaaaacagacttaaaaatacactaaaaactgccaaaaatggatttaacatttaaaaaatgccgatttttattaaattctagcttcacaattgcgaatcaaatacaacccaaaatttttgtaataatctcattcggttttcagcgaaaattttcggtagtggacaaaataactaaaaaagtttccgaaatttcgaaaaaattctcttttttaggggtgttttttttaaaaatttccaaaaaattcgatctttagggggtgtatttttcgcttttttgcatttttcttatgaaaatttgccaaaaatggccaaaatatggactaaaaacgcaaaattggcaaatgctatttttgagcccctttcttcatagcatatgcgcagaaaaatatgttaatccatataatttataaccctaatcatgactcatgaatctagtacctgactcgaatataattactaggatgatattttagaccctaaaaactgccaaaatccacggggagctcaggaaaaaatatgcttttgcataaaaatatcatccctaataattacttccggcattttggttaaatttttttcaagcgaaaacgatcaaaatgctatttcctataaaaatcaacctaaaaatttttgaaaacaactcctaaaagaatatttctccaccaaacctatttcatgataacctttaattttaatttatattattaaaattatttttttcatcaaaccgaaaaattattttgtttttatgtctattgtatagtaaatgatgaacaaaaaataccaaagaaatggtatataattgacaagtgaa

SEQ ID NO: 8996 - DNA, 3804 bp, Heterodera glycines
gaagaggtacaaccacgtaccacgggtggaagaggtgcaacaatgattcgaaaaggtacaaccttggctgaaaaaggtaacacttggatctgcagaggaacaacatgattataagaggtacaaccacgagtggaaggttcgaaagatacaaccttggctagaaaaagtaacactttggtctgcaaatgcacaaccataaggaggaattacaaccatggctggaagagatacaacaatggtaagaagaggtacaacctcgggttgaagaggtgctaccgtggtacaaagaggcacaaccatggttagaagaggtacaaccacgggtggaacaggtgcaacatgattagaagaggcagaacaatggctgtaagaagtacaacaatggttcgaaaaggtacaacattgggtggaaaaggtaacactttggtctgcagagacaccaccatgattatagaggtacaaccacggaaggttcgaaaaggacaacattgactggaaagataacacattggtctgcaaatgcacaaccatggctagaagaggtacaatcgcgggcggaacaagtataaccatgtctgtaacaggtacaacaattgtaaggtggaagagttgctaccgtggtataaagaggcacaaccatggttagaagagctaaaaccatggatggatgaggtgcaacatggttcgagaaggtaacaccttggatgtgaagagtcacaaatatgattagaagagtacaacaatggttagaagaaatacaaccacgggtggaagaggagcaacaatggttcaaaaaggtacaatcatggttagagaggtacagccatggttggaagaggtaccatgtctgtaagtggtacaaccacgtatcacaagtgtaagaggtgcaacaatgattcgaaaaggtacaatctgtgctggaaaaggtaacactttggtcttcagaggcacaccagttttttgctgttccatttcagcttaaatatctcaaacatttattgataaaattttacataattgtatgctaacagggcagattttgggttataaaaattttttagaacaaatttaattggccaattattttttgcaaaaattatcaacgaataaatttttaatgtttggaacgagattttttgggtgagtgtagaacattggttataagtacagctatggtcgagaataggtaaacccatggttagaaaaggtacaaccgtattctcaagaggcgcaatcatggtgagaagataaacaaaacaatgtaattagaatcggtacaactatggttaaaaacctcctctcggccgcctcagacgcgcgcttctccccccccccccacccaaatagtgttttctttttaaaaataactcgccttttaatttttttgataatattatttatttttataacattaaaagaatttatattaattttatttttatcgaaaattatttaaaaattaaaaaaactaaataatttaaactgaaacattttcacctccaccattgcttgggagcattgtgtaaacagcagttgcgagtaatttgcattttgtgtcatctccctcagttggacaatcacagcttcaacagcataagctaataaagaaaacgtatcgcttgaaaattcaccaatggccattgtttacatattaaagaacattataaaaattcattgcaaaatttactaattataaacaagttatatgagttttataaaaataatccggcaaaatcatgaaagtctgctagatgacctaatcaaaataaaggatttttaggaaaagtcaaaaattaaataaatttatattctcacaaaatatggctaaatattttgttttgcatatttattaactccgtcatttaattttatgaaaaaacttttgtccgtaattgggaagattgattttgaaaacttgttcttccaacattcacattttttcaacttcaaacttcgaaaaagattgggctttaattggagcttcgacagtgcctggcactgcccagacaaactatcgttttaatcatttttaagggtccaaaaaactcttcaaaattatttagaaaaaattacaaatgtcctcctggttgtcttctcgaaacaggctcgtgccatcatttttacttgcatggcatttagtagaagtctctcctaaaataattaaagtgagaaattttagtgccaaaaaaattaaaattaattaaatagtgaccaaaaattgtgaaaacatttaaattgcattgcatcggcattcgaagacccaaccataccataaagaaaattttaaaataaggaataatggcataggcgccgccagggaaatttgtaatttgaataatttaattaatttttatttaatttctctttaaacataataaaaatatttaattttttctttaaacataatcaaaatatttttcaaaaaataaaaatgtcaatgttccactcatttacggaatagagattggaaattacggcgtttttgacgatttccggtcccgtaattatgggttacataattctgtagagcgaggattcaaattgctaccgcgccctaataagaaaaatgaatccgttaaatacccgttgaagcatcatcctccagtgtagcttcggcaattatgaagatggtggctaacaaaaaatttttagtgattaaatttgccatttgtaggtctgtcttcctttttaggcacaaaaaatcgcgaaataggcacctaaaaagaaaaaatcgaaaaataggcaataaatagcacaaagatatgcaaataaaacttttaaataatgctttttaggtagtaaaatacctaagacttaaaatttaattttgattatatttcaattgtaaaacaaattattaaaatttttataacaaggacaatttttaaaccaaaatttctaattttaaggatttttccgagcgccaaaaatgggaaatatgcaaaaaaagaagcataaaaccttaaaataggaaaaaatatacattaaaaaagtcatcgtagatactccaaaccaaaggaaaacgcgtttttcgtatttaattgtgcctatcaagcacatcggaattttcggcatttacctaaataagaaacacctagtcattggcgccctggcggttagggcctcatttttgaacacgtagagaaccttataaaataacaatccctcattttatcattttagcctcacatctctcgctcttttgattctgtcatattttcatttcactgtttccctctcgtctagcgtctggtctactcgccattactcttctctctctttctctccctcactttctttttgtcttttggcctatctctcgctcccactctttcaccctttaatttatcagtttttaatgggaatcccatatgaatttttcggcagtgagtcataccgcgggaatccgttcccgccggtctctagcaattgccgcaaataaaatgccaagaaaaatttaatttgttgatgccgatctgacccgaaatgccaccacgaacgcgcccacacagtttatcatgcggagagaaattttcaaaaaaatgagacaggagggaaggcgctcaagcggctgccttttgcacttttctccatttccgtatgcatcagcagcagtcgaaatatttccattcacccaattcattcatttgtgtacgccgctttggcggaccggcggcgccgccaaaaaacaattgcttgaaaatagagaatgggtagcaaaaaatactctaaaaaactaaaagcggatttcggcagccgagcgggggcggggtgagggcagtggacgggagtcgagaaaagcat

SEQ ID NO: 8997 - DNA, 1358 bp, Heterodera glycines
ccggaacccgtcaaacattctctgacctaaatttttgttggaattttcaaaaaaaaaacaaatttttttcccgcctctttcaaaatgttttctttgccctcgcggctcttcttcttcacttttgtgagagaaactgaaggaaaaaacaaattgaagaaaattatggacaaatttggctgaagaataataaattactgaccaactctgtcgcgcttcgattttggcatttgcgaaagtgagggaaattggaataaaaagaattgaaattgaaatacaatagctgtgaataaagtaaaaagtatacctatactaaattaataaatttataattttacaataatccttttgaaggcaaaatccaaaaaaaaagttaaaaaattccgacatttttcaaatttggaaatcggaattccgaccccaaaatgtctgtaagtcggaattctgtgcaatccctgttttagaacatgaaaaaaaccatcaaaattgtttaaggataaatttttgaagtaagtcatggatggtaaaaaaaacggagaaaattgttggcgtaaaaaacaaaatgccaaagatttaaaaagaaaacaaagtgtctttattagggcttatatttatagttgataaaaactgccaaaataattagtttttagtttctaaaaaccccatgaaatagttgctaaaaatgggtaaatagttgctaaaaactttcatatttaggggtgtaatggctagggctgccaaaaatatgtacaaaaagtggtccaaatatgtacataaatatgtaagaaaaatcccaaaatatgtacaaaaaactccaaatatgtaaataaaatttttttaatggtattttttgggaaagaagacccctgtaaagtatgaaatagccacaaaatgacataaaaattactttttttggtatttttaggcaacattttcaaacttattttggcgcgcggacaaaatcccgtcccgacaaaatcccgtccgacaaaatcccgtcccgacaaaatcccgtcacagccaaaaaacgacaaaatcccgtcttcatcaaaaaacgacaaaatcctgtcccaacaaaatcccgtcacagccaaaaaacgacaaaatcccgtcttcatcaaaaaacgacaaaatcccatcccaacaaaatcccgtcccgacaaaaacgacaaatcccgtcttcacctaaaaacgacaaaatcccgtcttcttaagaacaccgaacatttagaattttttattctaacataatgaattgacaaaaagtgagttgaaaaagataatttgacaagagaaaatgcgatcaacaaaaaagaaatggtggataaataaagcaaattttcaatcatcttccgaatcga

SEQ ID NO: 8998 - DNA, 1033 bp, Heterodera glycines
  misc_feature (6)..(6): n is a, c, g, or t
  misc_feature (1000)..(1000): n is a, c, g, or t
taatantgaaaaaaataataataattttaataattttattatttaaattaaaattaaattaaataaaaaacctttttaattatataaataatacacttaaaaaattttgtttcacctttacttcacgctgaaatgagaacaggtccacctccatccaattgctgccgtccatggccaatttgttccatgttcgacaaacttgcgcacaacggccaagcgatgtgatgtccaagtaggaaaagacccttgcaaaaattggcacttaaatttaggcatttgaaatagtaaattcaatggcatttaggaagttaaaataacaaatgtacaatatttagaatgcataaaaatgtttttgagaaatcgaaaaaatataattgatttacttttttgcatgctttccatgaaactgtagtaaatttttattatacggtgttttaccataaacaaaaacagttttcttaaaaatccatgtaaagcttactgtaagaattttttaatagtattttttaatataattcaaaaagtatgtttatatttgcccatattgaatgtaaaatgtagccaaggacgacagtatgcaaaactatcgtactaccagtcaagtaatacatacggtaatggtcgctaattgtcctatactgctaccgagaatatgtagtcttcttttattagttccgtattcgaatgcaaaataaaacacagtaaaagaaggtatatgccaaatgtctaccgtagtatgagttcggttggcagaatacggttgatcaacgcggcggatggcatatgctgtaatgatgtgttgcgccgatgcccgtttgattggctgtgattgttgttgtggtggtggtggacaccgttctgttgttgttgctgggcattcccattttgtggcactgatccatgggttggcaaaagggtggtgatcagatacatcttggaaaaatgatcaaaaaatttaaaaaatataataatttaatttttaattttttaatgtcacaanaagaaaaagctagataaataaaaaaatcgctaa

SEQ ID NO: 8999 - DNA, 1425 bp, Heterodera glycines
  misc_feature (1417)..(1417): n is a, c, g, or t
tttgtaaaatgtcaaggaattgaagaaaaataaaaaaaaattagaaataatcaagtaataaacctactttatttttgcttatttaaaaccaaaataaaaatgtttttttcatttattaaattaaataaattaaatttatagtttttgaaaaattaaaataaaagactgtaaaattaattaaacaatttatgataattatattaaatagataaacaaaattttgaaaacaacatccgatcaaacggaaggggtggtgagaataaatatgcatcgagaattggaaccaaaaacaaaattttgtttcaaatgataattgacacaaatgaaaactgataaggtggggaacaattgataaaagggattaaattaaatattgtattattaaattaatataataatttaagaaatacaaattaatggaatttatttaaattataaaattatttttaaatattaattaaaaattattaaaaatgtacaataataaaaatgttattaaattaattttaatatttaagaaataaaagaattaatgaaaaattaaaaataaatcttttttaattaaaaaaagttttaaaatattaatttaaatgcaatataatataattataaagattttaaattaaaaaaggaatatgaaatattttaaacaatttttttcattaaattatttttttataaaattaaaaataaattaataaaattaaagaatttatttaataataaatttaaaaaaaagaaaaaatttgcttttcccaattttaccccttggctacggcggcgccagcgccaaaatttttgacgctggcattttgagtcctcgattggcgcaatggtggcggcgccaaaccttggcgcacgatagcgcccaagcggctgctccgaaattggccgctcgggcggatggtccgggttcgcgaaacgcaaatcccacagtatgccatcatggcgtacggtatgatcaaaatgcgcggtacggtccattgcgtaaacggcacgcaaacacaccatggcaccattgtcatcagcaacatacgcagcaatgttttgcacagcaacagatgaaatggttgaagtggagggcaaaggcatggcgataggtaattaattcataatatgatggcttgcttaattgactagtcgcatgcataattggggtcattagagggggaacagctcattccctcccgccgtcctccaccccaaaaaattaaaaaataaataattcaaatttacgtaatttgaaaaaatcttagtctaacgattctttcataatttaatgatgaattacttactatgttttttgaaaaacacttttccaaaaaatcgctgaaaattttttctaagtctttgtcttgaaattttcttataaaaatttcgaagattttttttaataatttctaagttcgactattgntgctgaaa

SEQ ID NO: 9000 - DNA, 2346 bp, Heterodera glycines
ttgggacaaaacttaattactttggcaaagtgccctcctccaacccaaaaaaaattcaagtaatagtttcaagtttttaaaaagaattgttaggaagtgctgaattaaattttgatttcacaaatccaacatctgccactttctgggtcatttttcagaccgattgcctttgggaagtttcaaaatttaaattatttctggcgaaatgccctcatccaacccaaccaagtaattagtctcaagtttttaagaaagaatttatcagaagtgcggatttaaattttttttttaagcagattttacaaatttaacatctgccaccttcagcagggggtggtcatttatcacaccagccttatagagatttttaaaattgaaattttgtttggcgaaatgcactcctcccataaaaaacattccaactgtgcgcaacaaatgctcaacaatggaaaaaggagacatcaccatagcagatgaatgggaatgaataaatgaatgaatttgtgtgtcgaaagcatatgtttgtgccccgcattttatgggtctgttgtgtgttatgtttacttttgtatttggcgcgtgaataaatttttttttcgggacggggacaaaaattgcgggggaaaaataaatttttgcgggggtggaaagcaatgtgaaaagtcaagaatttatttcctctttttttttgcgagaataatgaatcagactgatgaatggaatgcatatatgaatgaacaaaaaatacgtggcatggattgtgcaaaaaagtgtaaaattattgtctccatgatacagtatgacacaaaatgatacggtgtcacaatcgaatttgagagcattttgaatgttccaccggaaaattttttttattttttgaaattatgcaaaataatcattatgccaatctataataaaaaattatttcctgaaaatactaaactccatttaaaagagcacaaaagttaaattttaaccttggcattacaatcccataaaattcttgataattttcataattttagacccatccccccccccaaaaaaaaatctatggaaaacccagatttcagcgaaagccggccggtggtccaagctctagcgataaaatcggaaaattattttgacacaaatccaaacaatcccacgggttgatctgactgatcccattggtcatccgtaaaggatcatcagcagcagaagcaaaataaatcctgatcagcaataaaaaaaaattgggagggattgatgggagaggggataaagaagcatttgctaatgctgcaaaaagtcattgagccgtaatcgaagcgaataaaaaatgggcacttctatagcgatttgggggctttgtatgaaaaaccataggggtgacccctttggttttctacagaaaatattctgtattaaaaattcatgaaaacatgcatccctgggtttttcgatggcaataaatttggaagatctcaaaaaaatccacaaattttttttagtttcataataactttctttaaatggattcggatattaaccaaattcggctaacattaatgtgaacatgagagaaatctttgagaattttttcaaaattttacattgagaatttttttcagtaagagaaaaaagcgcccgtctcggtacttccgggttttgacttcccccctgaaacttttttttgacaatcttatataagctacgttttgctcgagctaaaaatgtatgtaatgtacttatggtgcgtaaattccccactcgtgaaaactatggtatgggatttcgtttttcggcgttcgctgccgtttttgtgccgcaatttccgctcatccattagaaaaattttttgctccgtcccatttttcttttttgagcttccatccgtccgcccaccaaatttttcgtcctttgggcgtggacagacggacgaccatttattttctttggtcgcatttatttttatcagccatggaaaaatgaaatgacttttctttctccgccccttccaattttcttctttcccttcgttttcttttgctgtttctccttccttattttctcctccctcgttgcctttttaattgtttgttgaaaagccaattttggtgtttctcagccaatgattaatatgtacaaaggcaaaaaattgtggaaacgattgaagaatttgctaatcacacggcacaattatttaattacccaaattaaaattctgagatttttttatgacgcttttttctgtttttattaatagaaattcccttttgattttccccaccaacggaaagacatttttatacaaaaccattccaataaatattttggcacagatggaggggactctgtccaaat

SEQ ID NO: 9001 - DNA, 1830 bp, Heterodera glycines
tttttttgggggggggagtaaatttatggtttttagtttatttattttttccaaaaaactttttatttctaaggcaaatgggaaggaattttttgggttctaagaaaacgaaatacctattttgatgaaaaaattttgtaataaataagttatatactttaaaatctttaaaaatttcaaaattcactgatttttcaattaaaaaaattcctacttatttttgtgccaaagctaccaccaacataaagcagataaatttaaccaagaaaatttcatttttcacatgtgatttaaaattatttaaacgcaataatttagccaaatttttcagataattatgagggacaggcccaataacctaaacacccatacagggtgaattttcaaagaaaatttaaacgaaaagaattttttcgccaaaattttcccgcttttacaacattttgtttttcatgggaaggaattgtcagaaaatgtgtgcaggcagaaacaagtcgtggagaaaatgcattagtgaagtgaatggcgggagaatcctggaaagtgaagcgaagcagacattttgcttcacaaaagtccgaaagtatccaattatagcggcggcgcagtttttatcaaaaaaaagacaaaaaaaaaaaaggaagaaaatttgtgcgcgaaaaattccctccaaaatgaaaggcacaaaacgaagaagaagaaagccaactaattagataattaaggaattaatattattattaatatttgaaccagaggatgatgataggttggaatcggattatttatttttggtttagggaatttttgcagattaaattttttaacgggaaggtatttgccaatttttcaaacagattttgattaaaaaaaaaatgtaaacggtaaaagcttcaattaaatgtaacggtaaaagtttcaattcgggaagaacaatatttgggtaaatttcaaagttaatctagattgtgtatcataataataataataattacaaaaaattagatcaataataaaaaatttttaattactggatcttcaaagggaagcacttgaattgatatcatcttgggacgaattcagtcaacttcaattaattacccaattttggatgataataaaaatattttttgttattatttaaagagaattttccaagagatagattttgaggatttgagtgacataataatgatcgaatttgtggaggctcgaaaattttacaaaatttggtcatccaaattttaaaatttaattcccattttctccatgcattaattaattggtagaattttggggaaaattaattttgtattttaattgcaatcatccaaactgaattcggggaacctccgcaacatttttcacattttataaaattaggtgctaattaattttcaattttcttttcaatgctttagactccttattacattagcacatttctgatcactgatcagagacattctcagagaatggtgaagagctttcctttctttctgcctgctgctgttggaaggctatacctatgcattatttgcgatcggttggggctgtgtcattttcattgtccgatcgctcggctcgctggtctttggtccgctgccctccaaaattattgtcgcgcgggcggaggcggggggggggggggagacaaataaaaattttggaagacaaagtcgggaaaatgggaaatggatgaatgaggaagaaaatggacggatgaatggaagaattaatgggagagtcaaataaggaagaaaattgggtgaaataatggatgaataattgggaaaaaaaagttgaaaatgaatataaattaatcaagga

SEQ ID NO: 9002 - DNA, 2752 bp, Heterodera glycines
  misc_feature (90)..(90): n is a, c, g, or t
aacaacatatagtacaccccgaatattaatcagagctcagcgcagcattcccaccacttgccccattccttcaaaaacgaacataaactntgacgattttccaaagcttgaaaaactgattgatggtcaaccaccggtgtccgacattctaccaccgctaattcaattgtgtaaggatcaaccagatgaaaacaatttgtatcagcaagcaatttgtggggcacttattgtgctttatttgatgctgatcgtcagtcttgtgttacaacaattttgctcgtttttgtggctgaagactaaacctcaaaaggatgaacaccattcaaattatggccatcatgagggaaaatcatcacacagcgcgagtttttcggggatgctttgccagtgatcaattaccaccacccagcgctctacactatcctgctgcgttaatagtgaaccgagaccctcacaacaaagaaggctcccattggtgtgccatttacgccaagggtttggatgtgccagttatttattttgatagcctatttcatcgtcttttttaattaaatttccaaacgggacaaaaaagaatgctcatccttatcaatcacctctgacctctacatgtgcccaccactgcattgtgtttctataccacatgtcgattggagatacatttgatcaatatttacgcattcttgactctaacgcatcaccagatttatttgtgactgtaatgatgaataaaattgtcggaaattacaaattgtaggcggagcttgggtgaccgagtataaaagccttcccgttcatcagatgatttcattctgtcaaaaatggtgttgctgagtgtcttctgcgctgagctgctcaattgccgtgttcagcaactccgcgaccgcctcaatcaccctgaagaccgcacatacattttcaattcactgaaaggtcgtaaggtgaccacaacttataaggatcgaaacggcatgaccaagactttcttcattggcggtttgtctgaaaagggagcagcactcactatggcctatggtcgcctctcgtctcccttcaatgtcaacatagcggcccacttctatgcgcggcaccgcataaagctccatcacccttacatgcattgtgttgttgaacggttcacagctggaaaagaggaccgattttatccaatggagttgcttgagttggccgatgacaatccaatgtggaggcggtgggcaggcccaatgtttaccgagaggatgtccacaccacctacacgccccgatgttcaattcaatcttggatattgtgatgatgatgatgatgacgatgatgaactaattggagacggacgcgaccaatgtacacaacaatcatctcccgacatgtaccgctggtgacacacacacacacacatgcgcatgcatatatgcgcacatatacgcatgcgcatgtaaaattctctaatttacagcatttttatgccttttttacaattgcttcttctaatccttaattatgcattttttctacccaaaactgaccactcccaaacattaattatgcttagcttttaaaattgtgtcttccaatcgttaattttttcaaaattgtgtcttccaatcgttaattatgcactttttctacctaaaagtgacaacttccatcgcttaattattttcaaattttatcttccgttgcttattctgcatgcttttaacgtccttaaatatgcacttttctacctaaaaacgacaacttcgctcacataaaaatagtatcttccattccttaattttttcaaaattgtaacttctttctcttaattatgcactttttctacctaaaagtgacaactcccacgcttaattattttcaaatttcatcttccattcgtttattatacatacatttttatgaaaaacatgaataacacacaaaaaaaaagataaaattacagaaattgttataaaataaagggaaattggggtatataacatttatcggttgtggttcaccagtctcagcatattttaacaccttgtccttgaacgtgtcgtagcgcaacccctggttctggggcaattcaaattgtaaatagccccgcgtcttctgccgtcctttgttaaaaatcccatttctgccagttgagtttgcccctttgtcccattttgtaccatcccttcacaaaaattcaaattcctttcttcgcccggctcaactccggccaattttgtgcaaaaaatttttttctcacaaaatttttcttttgttcaattcgttggctaatttgcatttttttttgttcgtccattttttgtgcaaatttttttcccatcttgccagatgcgcttatttgtgcccgcccctcgcaaaaaattttcctatttaagcgcctccggccaagggatcgctcattttcacttttctgctgctccctctctctcctctctctttctctctgaatccaataaattttacaaaatttgcccccccccctctttgtttgtcatctatcatttttatgaggcgaccaatttttaaatttttcatttttcagtttcaatggctttttcaaaaatcgcagctaatgcaattgccatcgacctcggtacgacgtattcgtgtgttggagagttccagcgcggaaaggtggagatcatcgcgaacgaccaaggtggagcaaaaaggcgcaagttcgacgacccggcggtgcagtcggacatgaagcgctggccgttcaaattggtgcaggagggtgctcgtccga

SEQ ID NO: 9003 - DNA, 2312 bp, Heterodera glycines
  misc_feature (42)..(42): n is a, c, g, or t
  misc_feature (50)..(50): n is a, c, g, or t
  misc_feature (84)..(84): n is a, c, g, or t
tgatcaaattgatttgtatttgtgagatcaaatttgatgtanttgtgacnccaatcaaatttttgtgttaaaaaaatccttttnacgcatcaaagtactgtaggaaaagacaaatatccatccaaatagaataattagtgaccaacttttgaggttgagctttttgtgcacattagttccgatatatcgagcacaaaacaataagggagtaagaaattaattggatttttgaaatttaaatttggctctaattccacaaattaaataaaaataataaaaagcatttttaaattgaaattaattttaaaattataataaataattattatagtagaaggaatatccatttttagacataaatattgacaaatgacaatataaaaaagtgttaaaaattgggggaaaattgttgcatttttttcttcgtccattttcatcatcatcaaattccgttgttgttcattttcttgacaccagcatggcgtactgcacacatttgtcccagtggcgctcatcggaagggtcgtaaatgcgcaaaaagagacccaacggcagcgcactggggtccaaccggccgagcacgaacatctgattgtgagatgacaaaaatggcatttggatttgctaattgggataattagagtttgatctgtactaattattaatgttgtctattctgtacagtgtttaaaggctgagaatttgtaaagttgcttattttagagtttgtgccttattctaaggaccggaaaatctaaaattttctgggaaatttttaaattaattttagatagtttttaaaaagtttaaaattagaaaagttaagttgaaattttttgaataaggttgtaaaagaaagaaatgaaaacaatataaaatttttataaagcggaaattatgcaaaatttatttttatttttttcttgatttctcttggaaatgttccggaacaattcaatttttaaattattttcgctggctgactgaccagctcgatgggcatcatgtcgaccaactgtcgccagtacggagtgcggggcgcttgggcaagttcgtgcaagaagaaaatgatgaaagtgaccggcgggcgcaacgtgcagtcgcgcacaatgcgattgaagcatggcaacggacggattatgattatttaattggtggccaagtaagcgttattagcgaacatgtctaattgagggtgattagctaatatgtttaattaaaagtaattactaattagggaacaaaagtatgtatttaaaggaattaaaatggcattttatagatggaggatcccagccgcagaagttaaagggaggaggattttatttattataccattcattcgaaaataaaaattatttttaaagtattctaaagatgtttgcactacgtttctcgcgccagcccgccaaaaattttctctactaaaattgaaaaaatttcaagctattttttgaaattttatgaaaattaacttttttcaaaatttcccagaaaatcgctagaaaatttctcactatttttagaattttctgaaaaagtttttcaaaattttttttctaaaaaattcgaattttgaaaattaagaaaaaaatttgggggtggggtgacgagcggctgaacaccctaaagatgaagggggggggggcaatacaataagccaacaattccaacaatgatgagtaggtaatggtaaattgagagacagcgataccgttaggcgccgccgtcgggaaaattttgagaattttaatgcaatgtgttaagaaaattgctttgaatttcaaataatttataaaaatttaattatcatttaccggctgatgactgcacggattggtgccgtctcttccggcatgtgccatcaccttttagattaaaaaacaaattaaaaaatgccaaaattgtttggcccacccgtcgtgccgtaaatttgctgcaatcgcttctcccgctcgcgcttgcccagcacactgcgctcgccggcccagaggagcagctgaagaaacggtggacttggaattgtacagtattcaaccaccaccaccgtattttgattgaatggtggaaatggttttgtaagtacctgcaaggcgcggatgagcattcgtgccattacggtggccttgggggacagttcgccgacaattggatggcgctgaaaatgaaaactttttttgaataaaattaaaaattatctgatagcgctggactattttttaaaatttgacaaaatttcttttataattgggccgaaaatcttttaaaatatgctgctatttgcatcttccataaaaaagacaatttttttt

SEQ ID NO: 9004 - DNA, 1068 bp, Heterodera glycines
acaaacgcccaatatttggggggcgctcaacaccgcccctcaaatttgtcgtctgagaattgtcccaaaatgccactattaatttttgatccaaaaatttcaatttaatataaaaacatctttctaggggtaaatgagttcgctgatcaggaatccgatctcagattttcatttctatatttttatccatgatttttcatccatttattcgggttttttgaatttaagtttatgttagaattagagcaaaataactgttagattcggaatctacgtaccaaaaaacccctagaatgactcttttgccatttttcatttttttttgcattttccattttcctgagaaatgttgattaatccttaaggaaaagtgacgacaaacgacaaatttacggtagattttgtcaattgtgattggacgacaattcacacgacagagacaaacgacaaacggaaaatcggcttattcaaacgacaaacgacataattttttgtcgttatgacaaattcggagacaaatgccaaatttgtcgtttgtcgtccgttttgccgttttttgaatttatcattttgcaataaaaattaatttttaaattgacaaactaaaaaattaattttgttttaccttcttattttaaaatatttaaaatcttgtttttttcttattttttaaatcataatttaaaatagttcccaactattttcgctatttaaattcaattttccaaaattttaaagactgccatttaaattaaattctatttttatttgtttttttttactattcatttccactacggaattccaatttgctgatgaagaagccttactcagatgagcctctcttttctgctcctcatctcattcccgcccacattcatccacaatttaccacttaaatttgattatcttttcttcaatttgtttacattttcacaaaatttccacccctttccgcctctggtggcgctgagttggccatttccgacctgcccattttgcctcaggcatttttgcgtgggtgggccggaccggccgagcgctggccagcccggcctcagaacaaaa

SEQ ID NO: 9005 - DNA, 4331 bp, Heterodera glycines
ttgcttcttcatcaatgcgtcgtttttgttcagtagccttgctgtgtccttgggggtggacagtgatccttgaaaaaaaaattttcttgaaattttgataaaaattcaaaaagttcttacgcatccccctccactgccggcgcttcccgcttggccaggtccccccggggcgcccgggtttccgggagatccgggtggtcccgcatcgccagggggcccaggcggaccaggctgtgcgttgccctagaaaaatgacagtttgaatgatacaacaaatcttgataaaaaaaaatacaggtgatccaagttggccagcttgtccgggctgtccaggtggtccaggagggccaggtgggcctggcggagcaccccctgaaaaacaaaaagaacaggggtaaatttgttaaaaaaaattcagttttaccgccagtgatttgtccagggggtccgggagggcctggcgtgcccgagcctccgggtggcccaggcgggcctgagggtccaggcggtccgggaggagaagcaccgctgaacattccaattcattaatgtataatttgcaataaaattacaataatggcaaataaaattctttaaaacatttagagcactaaaaacaagacttactatccgccctccggcgtgctccctggtgctcctgggtttccaggcggaccttttggcccaccgggtccaggcggtcctgaaatggttttatgagtgcgttgtttaaatcagcagcccaagggtatggattcaagagtgatttgagctgaagcttatatcagcaaacgaaattgattggccaatatgattaagagcctatgatcaggtttatctaatcagtgattaaggttttttagaatttccttccccacacggttataattttagtggccatatttgccgatagattttgctgatcagttccgatcagagacatttcgttttgtcttttataatacgatttttttcctccaggtgccatcattggccttcctctccacgttttcccctcacctggcggccctggagggcattccggagtgcagctgccaccatactcctgaggcggcgcttgtccgtccgcaccgggctgccccggtccgcccggctgtccgtcattgcccggctgtccgtccgtgccaggctgtccaggtggaccgggtgggccggtagtgcacgtacattgttggccgccaccggaagtcgcactgctggaggaagcatagccaccaaatttggaatagccagcgcttccgccgccgcttcctccactgcttccgccaccgccaccgctggacgcgtaaccgcctccgctgcttccgcctgcgcgcgcgtagccgccactcccaccgccgctgctgcctccggcctgggcatacccgccgccaccaccgccggttccgccagcgcgagcgtaggaagaccgtttggcccgttcgtttccggtcagatgctggacctaaaagggaaaaagtaattaattagagcacacaaggaaaattattaaatatcgaaaaactataggacgcatttttatataaaatatcactgatcatgaaaggtagttctgcccaaagtaatattatcggatcatttagacgaagttaaggaataaaaatacaataacagtttttatgagggccgaatttgtaccattatacttacgctttgcaattctaaatctggtcaacattaaaaactgattaaaattgatccattcttccacccaccttggcatattcatcccacaagccctgggttcggtgatggcaaaatgccagctcttcctgcaacgatgactgcacatactgcatgtaattgtacagcattggcactgcaatcactgcagtaagcatcgcggcggtgccaatggcaacgccaatgaatgccgaccgtcggagctgtgctgactcgcgcaacgcgcttttcgggtcgtcctgttgcagctcattgtcatcattgccgagcggcctgcggtccaattttgtcattttgacctgaaaattggcaaatattcttaaaaataggcacaaaactggcatacacaaagtcaaattttgatgtaaattgaagtaaccaggccaaactatgaaactttaaaactaaaactgagtaactcaaattttaaaaattaataatctttaaaaaatttttgagcatcactctcatagctttattaaacgttccgataaaggtgggggaaagctaatttgctggcagaagcagtaattattgttcaattgagcggcaagatgaaggtaattggctatgcgcttgtctttgcgcaactcgtcagcaaaattggccatatttggcctttgaaagtggcttatatacattgcgaggaggggagtcagtcgtcgcgcaacagcgacagtgagcggtcgcgaaaaagcaacaaaaaaatgatcacccgcacccttcccacccccttccccagccattcgccacactttccgctcggtgtctgttgcattccctcccctttctctctctctcgctttgatcacttaatcattataggcagaagcagtgatcagaggctttcaattggggtgggacaaagtgatcaattggtgctgctgatgatcggcctgctgccggtgaaagttcgcagagtcacccttccatcgctgcttctcctctcctctccctttgtcacccataaatcaaaatgaagtaaaacgcaatggaatgaattacccattgttttgctaccttttttaaagagaagcattgctttttccgcttcttggtgaatggaattgctcgacccgcgcggggaacggaagaaaagcaaaaaggagcgaaaggtgatgcaagcgcacggcgcaaggccatcaccaatgctgttgttgccactggcccagccaatcaaattaaattaattggctgttaattagtgatgggacagacacaacagagaagtcagacagacagaagcgcctgagggaatttaatggccgaaggaggtgaaaggagaagaagcagttccaccctggccaaaacataggaataactcgcgccagcaacacacccacacccatccaatacacacatgacaaatccgaggcggcgcctttctttgttcattcggtgggacaaaatgagtaattaacggacaattgggaagagaagtgaaaattggtagacgtatgggtgtataaaagcagaaaaaccattaaataatgattaattaatgaaagcattttgtcaataatgcacaaattgtgttattgttgtcccaattggtattatacagcgcaaatggagtggaaatggtagtgacaataaaaatgcctaattacacaattaattcattaaggaggcaaattgatgacactcaattaaacttgaacaataagcaaatattataaattgaataaatgaataacaatggaaattttcgtaatttctattgctattaatatgtttgaatggcaagtgaaagggaatctcgattaaaactgttcattttttctcggtcagctgatttttgtcgcagtgagttttgtctaatgattcgctcccatgaattttgactaatttactgacaaaatcaacaaccgaattatggcaaaaagtaatttatattcaaaatataaaaaaataattggccaatttttaaattttgcacttttgcagtttaggtggcccatatgaaaaaccaataggagaactttttgataataacatgtcattgattagtgactcaaaatgtataatttaataaaaagggtccttttcatcaggccacctaaactgcaaaaagtgccgaatttgtagaaaatcatctaatttgctttagtacctcgcctcctctaatggaaaaaatgaataaggggcattattttatatcggaaaattaaatttaaacgattgagaaagctaagaattaaaaattaaaaaagttccaaatatttaaatttttctttttatttattttttattattaatacaatttaatgctttttcatcatgcaaaatggagacgtattatcatttcaccttcggttccacttttggccatttgtcgccgtcggtccgccgcgggcgaaaaagcaactcatttgtcagtagaaaaagaaagcattcagcaatcagctaataatgaatggaactgtgtgcagaaaaagaatcaaaaagtaattaaagaaaagccaaaattaaagaatttgaaataagaaaaagcgaaagttataaaaacagtataaccaatgaacactgtacaggaaactgattatgccttttgcaacaaaagtatttttgcgccatgaaaaacctcgaaaatagcaaatcgttttttttttataaatttgtatatg

SEQ ID NO: 9006 - DNA, 1637 bp, Heterodera glycines
  misc_feature (1327)..(1327): n is a, c, g, or t
gcatcacttttgcacggggttcaggttcacatattaactaaaatagtatcacttcaatttttggaatataaacttttcctttattttaatatactaacttcttcaaatatatattttgaataatatgctattttacaattattcagccaaatattctctattttcatcataattattaaaatatgaacttttccacatttttgcttattttttacacaaaattaacattaaagaaacatttaaataaaaaaaacatttttgagaaattttgtaaaaaaaatttttttctgttagttttctaatgaggttaaacaggccatttagctgaggggacgttctacttagtaatagcggttttttgaaaaatccaaaaaattgacataaaacatgtaaataatgccaacatatggacataaatcctgaaacatagaaaaatacgaaaatatggttatcgaaagaaaaatacgaaaatatggaatatcgaactcataacaaaaactccaaacaagctaatacatgtttttcgttcatttcagggcacccacagatcagacaggaaaaaaatatggattccatatattattgtacaaagagttgagcaggaagcaggaccgggaatttttcgggaccggtacttgccggacctgaaacgccgggaccgggacctggattttcgatcgggactgggacaaagtggggcttatccttgagaaaatttttttccagatccatgaatattttcatgcttggttgtataactaataccttttgaattttaaatttgggcacgaaaagagagtgttcgatgaagaaaattgaccaaagtcccgaaaatggaaaatctgtaatggaaacaatcaaataaattggtcatcctagatcaattcgccatttgtgagcttaatccgtgccaaaaatttcatcgtggcgctttttaagttcatctaccgcctcgtggtccgatttgtcgtgtcctccaaaaaagcgctaaaatattttctcccacaatggcaaagtcattctttgtcatttggctaagaatttttctctgaaactaattttaaatgtattaattttctaattttaatttgaccttcatgccaataacaccgtactgatgggccaaacggaatttgaaaatggccaattttttacttttggtcatcaaaaagtcaacacaacgattttcaacagattccaacagataacgattggccaacgcaagaacattttccacacaatcatctgaatattttttgtgtgtaataattatataataattaaatagtgcggtgattttgtccttataaaaactaaagtaggccgngcccgggtgctggctcggacggcaaaggggggcaatttggaaagggcaaaaggggagagagtgcgggaggaataaagggggaaaataaattccgaataaataaaagaagtttatttaataaatataaaagatgtgtgtgtgtgtgaaaacgcaaatgcttataaggagagaaaatgcgggggtggagcaatttgtagagacagaaaaacgtaggaggagcaattttagacagagaattgtgcacaaaatgtagtgactaatgctaaaaatgtacaaatgttcaatggagggacaaaatcacaatttcaaa

SEQ ID NO: 9007 - DNA, 4390 bp, Heterodera glycines
cgccgaaacggcggcgccgaaacggcgtcgccgaaacggcgtcgccgaaacggcggtgccgaaacgatacagactcgtaaatagaaagaagtaaaaatgaatttaagatgaaaaataaaatttgttctgcttcacataattgaacattcttcttcggccttttgcagtaaattgtttcgaagactgattgtgtgtttggtatttgtgtctttgagcaatttgtcaacaacaatctggagaagaatgtattaaacattttagtgaaaatgttttttaacaaccaagtccaatctgtgtaaaagaaacgcccacccgtattaagtaagaggaagtagagggggcggaagggtcgtcgtcgattgcgtagaaaggcgtcatgttcacgcggtctttgaccctccgctcttcacagaacatgttgaatgcttgtgacaaaagctggaatgggaagcgtacaatcggtgatcaggggaattacttaaaacgactgaccaagtcacagtccaacgcaccggcgaaataaatttccttaattcagcgtctttgcatcgttaaaaatgtcgcttattatttactgggtttctctccattattgtagctacaatacaaaacaattcgacaatcagctgacgattttcagggtttgcgatgtcgctcatcatcgactctaaaaagggtgggtaaggaatccaattcaaggaagtcgaaaacaacaccaattttgtatgaaaaattgagctcatgctgcgtcataacatgcagagttgggtactgagaatggatttggacaactttattggtttcaatttgtagaacattctttgattcggattccaacctgaggaaggacatggcctgaaatgacgatgccttgctccactctttcgagtatcttaaacagcaatgccagccattttctctgcgaatattttgaccgaccttccaaactctgtcgtacaaatttgtcggtactcggttcagtgccccgttcaattttttcatttgcaaaggcgaactgaaataagaaaaaataaataaatccaaatgcacaatccaaacttacagcaatctccagacatcttgctttgtcaacagttcagcaagcagatttttgacaactgtcggaggcaaatcgaaggcacaaacgctcttcccactttctattaaaaaacccaaattaaaaaatttttatgcaaaaaaccaaattctctgcgaatggaaccctgccaaatgcgttcaaaaaatgtcaccaaatcattggttttaatcggagaagcggcagttccgttgttcaatttttgacggttctttaggtcttccataacaaagcacagaagcatatcaatcgcatcagtgtacctttaaaacggcatagttaggtaagcattatgatttgcaatgaaatttaatgtttacctaatgaatttttttccaaaaaatagttaaatattggaaaatgcatataagtcaccatgccaaacgaatggtgagaacgccgtcaaaggaggcacttttctgagttatctgtgccaaaaaggaatttagaatgagatatttcccacgttaccaaatctgaacatgcgattatcagctcttgctgaaacaccgcagcgtacgggtctatgcaactgtcgaacaaggccttctgcaattctacgggcgttgacggcgaattgacggtgatttcttttgatgctttttggccgatgataacccaaaagtgcattttcgaatttaattcaaatctataggcaatttttttacctgttttccacggaccaaaagattagtgaccgatctgttgaaagaaaattaacgtgaaaacagagaatgaacaggtgtattacggcgccaaactgatcatagttttgcgtaatttagccgcgcaatagcgcaccaaccaccaatatcggaattggcacgcttggctgtacacacgttccattcgggcgagaagagtttcttaacccaatcgatgtcattattttggatgtgcttgcctttggacaacctccttgtacaacaaaagtaccagggtaacgcatttgcaacacagcgatctaaaaagaagcattttggagggaaagaggaaaataacccacggcaaaagcgactctgcgaaggttttcgatattatttcgggcgattatttgatactaaattaagtgtaaaattgggaggggtgaccaaagcacgccgatttccatcattgtttccgtcctttggctatttacaataataaaggctccaccgaccaattcgtggtctcccattccgctcaattgctgctccgatagtaatccttctaacttttctggcggcactttcctcagtttggtccgtgctcggagcaatgcttcttttgcgtcaatttcttcaaggacatcgacatcaaactcgacatcgtctgggttgaccatgtcaatctgaaaatggggaagaattggcattttgtatagaatggagttttcatttggagtacaaacatgttctatacagccggtgttgatcaattgcttaataaatataaacatttcaataggttatgaagaatgacaccactgacatggattcttcccagccgaactcggacaccatttacgaagccgtttttaagactgaccaaaaggtccagcatatttgaaaagtacctgaaatagttttaaggaggttccatttaaaactattttactcactctccggcgacattttcttcacgcaaaatcatacaaaaagttggcctaaaaggagtattttcgtaaaagaaaactaaattcatgcataattgtaagtgctaaaatgaacctgccactcaatttccaccttctcgaaatgaattccaaatcaccctaaaagcacttcttgtccaaaactcgttttcccaattcaattgcctttatgtcctcaattaaagtcgaagagtccgcgtttgtgtagaaatctttcagctcaaaaatgagcgggtaaatgaccacggtattcccacaaattcgaaatattttcgacgtgttcaatggccccaagggtcgcaacggtcggccgccaaggcccaacttttcgtctcggcccaaacgctcgtacaatttcaccattcgccatgaaggccaaatctgagagaggagacaaacaattagtcaatgttttgttagtttttccaatttgtacttttccaaattcttcggtcagacctgaacgggctcaacttcgtggggagtttgtgtggtgatgccataagtggagagcatcatctgcagctgagccgactcggagataagcgccacttgcaccacgggaaagcctttcatgcgaccctcaaaaaacaaaagtaatccgaatgaacgaagaaaaaggaagagacggacgtgaaaggccgatgaaggcatcaccggcatattccgaggccgttgactggccggcaaatgccgataaatcgggtcaatgtcactgggatggattagccgttcccctgaaaaaaattgcaaaaataggatgagaattaaaccaactggtgcattagccacacccactcaacaataagccgatgacaagcacagcgttggaccaaaggtggtggccaaattcgtcgtgagggaccggataaaactgctgactgttcaattcgtctcgctcgtttttcatgtgttcctcactgatgcaaaagcattcaggacaaatgagcatacaatcgccgttactttcatcatctgaaagaacaatttgcaaattttgagaatgcttcgactgattaagcaactgttgttattgctgccgcagttaaagttttttcggaccaaaagttgttagtatttattccaatatttgtcagccaaaacgttgtcgaccttgaaatagagctgaaatcgataaatgaaaacataggtattttcatgtttttcacctgtgattgaaatgcagaccaagatgtgaaatttgcttattttgtatatcatgtaataagtcattaaagacaacaacagtgtatgatttggcatataacgtaagaagttgtattcagaaaacatgtgttcgtacgaaatcggcctggcccggctaaaatgtacaaatttttgaattccctttttgggcactaaaatgctcattaatctatttaaaattattagttggcattctgtcgtcgtcgtcatcatctccattgtcgccaaacccagaaattgaacctcatcaacaccgtcggcgttggcgccgtggaaaaagtgaaaaaaaactaagtaaaagtgcaaaaaaacaatcagcgagtaaaagtgaaaaaaaagaatttgtgaggagtcttagcagcaaatcgatgaagagcagctcgtatcggaccaagtcaggccgacgtgtgatggaggaattgttgccaaaagaagtgcttaagaagaaatcattt

SEQ ID NO: 9008 - DNA, 1315 bp, Heterodera glycines
  misc_feature (137)..(137): n is a, c, g, or t
cggcgcgtcgaatcctccatttccgtgcgaaatccgtccctaaggaagcgtcgcaggccgaaccgtccctcgaggtggcgcaggcatttgctaagtgtcgtctcaaacttttggtcgtcatgggtcgcaaaggaagnccatccgatggtcaaaatcaatgacgcgtcggtgtttttggagttggactcgcgaggcaacaaagtctcaaaggtcgttctgttgcggttgtgtccgtcaatgtctgtgattttataaaaaagaaaatatgcatcgcaattcgcaatgacacagtaaatgaatgactgaccaacgtaaatgaccgagtcactggtccctttgtgtccatatgcgttaaaaccattgaccgactcgagcgcggcctgtaattggaaaagggaaacaaagtgactaaaaccaataaactgcactaaccttcacaaatcccaggctggatgagtgcagttccgggttgccccggttgtatcgggtccctctctcccaaatgccaaagtccggcgtgcgataagtacgctcaatgtaaaatacgaggttctgcagaaaggccacctcgtggggcgtgtaaatgatttgagcaccggccacagtcatttcgaccaaaacgagaatgaagagggcgatcaggtccatttgcaagtgcggaaagagcgcattttccaacccggcgcccgtctgaaggtcaaagcgcgaatgcaacgcgaattcgggcgagttgttcagtttgaaggcatttaactaaacgaccattgaattgtctaacaatgacaatttgtttctttctccacccattcgtcccctaattgaagttttggtccgatcaatggcataaattgcaataaatgcccaccttgtccaccagttgcatccagcaaaacagcaccccgcgcatcccttttatggcggtctgacacagttccgtctctctgccacggtcatcgtccaatctcctgttattaagtgtaaattttatgcccacgattggcaatcccatcaattacttctccagcagaccagcctttatcttacttgtaagcgagagaacaagcccaacaagcgaacgagcagtaaattgtatcccgaacatagccaaaatcggaatccttagaatagcgcgggaacagaccagtagtgacactttggtggtcaattataaggcgcctgactgttccattatttagcaacattaagcccattaattgtccattacccaaatcaaagacgcggtcaacatcaactcgtatgtgctccaatgttttgggttcattgtgtggaaatgtttaagagtcactcataatac

SEQ ID NO: 9009 - DNA, 2186 bp, Heterodera glycines
cagcagtcgctgagaacgaccctccaaatttccacagtttccgcagacagaacgtcaacctccgaagttgtcgcaattgatggcgttaacggcggtgattccacaaagtcttcggcagatgttgatggtcgcaattcgactgattgtagtgcttcttcttcgatgttcggcgtttgaatagctgaaattttatggagattttttttttgtgttaaaccattggaaaactcactttttctaccccatcgggctccaattgcacgttggacaataggatacctctcttcttgcttaaaagtagtaaatgttttgcggcataaattctttcttgccatcaaataagcaggaaaaatgaataatccctgaaacacaatggaaatgtttattagtgatgccaaacggatgaagacagagggaggcaattataaagtttatccccacactttttcgaaatttctaattgtataaaaagtcatgaaaacatgctttcaaattggtttatgtatattatgtgaattaaattacgatatcaaaaatgtttcttcgattctttaaatctttactcataacacaaaaacaacaacaatgcaaataaggaaatcgctttgtttcccctctgtaaccgctcagaaacgaagttttgtgaataaccatttgctctttccggctttgtagctggtctcaaattcttttttgacgctaatgatggcattcttcttctttcgcggctctttgatccactctttgttcaccaaactcttgtccaaatcggcctcgaatatgcaacgagttggcaacaaatgctggaggctggtgaccttgaggaatggtttgatgcgaattcgcttctccacttgcttcttccccatcttcttggtcactttcagaggatacctttagggattttgataaaaccaagaatcatatcatgaaaatacttgtcgattcccgcaatcaatgcatgtccatacggcctctctgatgagccctcgtcatagctcttaacgacgacagccttacgccccgcatagcgtccactgagcacaatcaccacacgtcccggcttcatgattttgaccatttttgcaaaagcgccaaaaaaaacaaattaatgtgaaatgaaaatcgtcagtataagaatcaaacaaaatgatgaattttaattcttattatttgtgaaaaaatatttttatttggctggcatatcatcacgcaaaagcaaaattcaccagagatttctttgtcatacaaaatacaggatcaacagcctccaaccctttatgtcccaaaagactaaggccgtaaaggccaaaaacagtatggaaagggtcagattcatctccaggccgatcggcgatccctcccttttcatcatcttgactggcgattatgaagtgggtgagagattcgccatcaatccaatgtaatcgttttatgatggccaatgatgcaagcacccaccaagaataacacacatcaggcagtttctcgggccgtccgcaaagtccgccggaagggcattgtctattgaagcaaaagataataaacaaaacatgtatttgaatggaaccgttcagccagccatgttgcggttcgttccacatcaataagctccaagcaaccacaaacagagagtgttccaaggcaacagtaaacctaagcaagttggtagcgatttactcaagatttaaaaataattcaaccccacctgtccagcatgactttcagagccaggccttgttccaaagccgccatcaaaattgtaacagttaataacaaattcaactgctttatgaacgtcaattgaaccaagacgattaagaaaatacagagatgcagcagcacagaaagaaaacctcgtgtcaatctctcccccgtgatcaccggcaaaactcccatcattttgttgtaacgatttaatgaattcgacggtcgcatccaaatttatctgaagatcgtttttttggtgaaaataaaatttgtcacctacaatatcgagtctgccaatgataacagccacttgaatcgcacttagtgtatgcaaaatgtgtgagtcatggccatcagccgcagcaaaaccaccatcttcattttgattttcttttgatgaggtcagctaatttttcttcgtcgtttatattttctcccaatactttgagtgcagctaaacaccagtaaatgccact

SEQ ID NO: 9010 - DNA, 1944 bp, Heterodera glycines
ccaaaaatttttttgaaaaaaactcccccgaaaaagtgttgagaaaaagatcagcagaaataaaaaaaaattttggaaaaaatctgcgggcgcaaaatacaaaccattagaataaaattacccattttcatttcatatgataaatttttacgcgtccttggatttggagaaaattttcccgttatgtccctagaaatcattatactcgtccttgggaggcgagtttttccaatgggaaactctgtataaaatgcttagataatacggtttttggcaagaatattttttgtaaacagaaaaggttgccaaaaacaaacacattttgcctaaatttgcatgttgctggacaaaaaacaaactgttaacaaaaaaagctcttcataatttgctgggcacctgttttgcgtgaagaagaagcatacaaaagcaaattgatggtttgtcaaaaatttgattgttgaaatgaagaaatgcgatgactgagtgatcaatatgatcatgtgtctgaaacagtgatgccaacccgaacccgaaccccgaggtttttctcaacccgaaacccgaagttttttgagtgcccgacccgaaacccgaaaatttttctcaacccgcggcatcactggtctgaaacgcgggggaagtttgggcactaaattaaggatttaaaaaatgaaaatatttttaattgtctataattgcagccatctaatttaaaagcaaagaaattttaatcaagttaggaaccgaacatttttccacgaatatacgctcaattaaccattcttattttgctaaacttattattagggcccgcatttctaagtttttgcttattttttctgcggctttaactcgacgagaaatgcactaaaaacacattttttgttcgaaaattttgcggtttatcgccttattcgaccttagaaatccatattttggatgttcgcccttaaaaatgcatatcttagatgttcgaccttaaaataagtttttgcccttattttggcgttttgtccaaaatttattaacaaaaatgcaataaaaacgaaaaatgcatccctaagaatcgaccccaaaattttttcggaccccaaaaaccggaaaatttccaaaaaaatcattttctaacaaaatttcacgagaatattgaataaatttcaattttcttaaaaattgataaatttatgtcaaaaataagcaaaacagcgaaaatttcgcttttctggttgatttaatcagaaattactttttcatttaaatcacaaaataattttatattttcctttcctcgacccattaattatgtttttacaatttctgtcaataaattgcactgaaattttcaaaaatttcccggcggcgcctatcggcaccgcttgaccctgaaaatccttatttttcttgagaaatttgcctcaaaatcgctaaagtggtcattttttggagaaaatttgttaacaaatctcataaaaattccaaaattttcccggcggcgcctatcggcaccgctggaccctcctccatgttaccaaaaagtttttgaaaaaagcgcgccgttaaaacgtgtaaatagtcactccttttcccaaaaattttctaaaataatgaaaaatgacataaaaaaattttttaaataaaatcatcgaatactttttcaagaaaaatattcaaaaaaccaaaaacatttttgagatcacctaattaaaaaatttagcctattaaaatatttagaaatttttttatgatatttttatatattttgaaaaatttccgatttccgtcttccgatgtttttggggtcggaattccgattttcgacttccgaaaatttttggggcctcggaatgccatccctgtttcccacccaccctttcgcgacggtcatttgcacttccttttttgtctttccctttttctcatcctttgctatactctctcgtttct

SEQ ID NO: 9011 - DNA, 1232 bp, Heterodera glycines
  misc_feature (1182)..(1182): n is a, c, g, or t
  misc_feature (1216)..(1216): n is a, c, g, or t
tagggcactggttcccctatagaaaaatttttaagatttttgaaaaattgatgtttatcattggatatatcatttattgacgcctgaagtgaaatagagcagaaatttaacacttgcccatttttggccaattatgttatgatttatttccaaaaaataagccttctccctaattaaaccaatttttattatttttatgcattttttaatttttaataatgttttcatctcaagttttttttgcccttttcccaaatctttcccccgcagttttgcccatttttgggtcaccgtttgcccaacactaaaaggcaacaatttgaataaataaaagagaaaaacggaagaaaattatgagttattcaaatatttattattcttatcttttgcccatcgcatttttctccaattttgggtcatcgttttgcccataaatttatttactttttggcctataaatatgtgcacaattacagcggctatagcagaatttagccttcatttgctcatgttttttctgaatgcattaaacaaattaaaattttaaatttagattttaaaattaaaatgtcatcattcacgacttcttcatcagcggacgaattttctcctctccaacgtaaaaaatttgttaaaattcataattaaaatacaataataaaaacatttttcaataattaaatttgctaaaattaattttttttttttttaattaatttttcatttttagcaatttttccaaatctgagcacatcggaggaaatgagtgttctgattgccagaattgctgagctgaatcgagcgaaaacaatggagccatcaatcgcaagttctgaagtgtttggacaagacggatacggtagagaatttaagcataattgaggggttacagtatgaaattttataatcaaagaaatggttttgaaatttattaataaaagaaagcgaaaaatttggccctattgctgcagttcacacgacaataataaaagaaatggcctaaaattatttgaaaacttgaaactatagcaatttatagaagcaccacccaaattaacattctttgtatcatttatagctccaagagtccttttattctgtaaaatttcataaaatttgttttgtttcaaaaaaagtaatggccaaaaatatttagaaaataactttttttaaatagaccanaattatttatttttaattttattttcattaattntattttgaggaatgaa

SEQ ID NO: 9012 - DNA, 2205 bp, Heterodera glycines
aaaaattttgtaatttttaatgcgatttgctaacagttttttgtcaaaaaataaccaaattttgcacaaaccttatattttcttgataaaacagtgacattctgccataaaatttcaaaattttgaatatatttaagaaataagaacaaaataagaacaatagcccgaaatcagaacatttcttacaaataagaacagatcacatccctggtgtaatgatttttcacgaaaaatttttaccagctccataggaattttttttctgaaaatttcccgatttcaagccattttaggattttcagatcaccatgaaggagtgatcttatcaatttggtgcaattaagttttttgttcaataccaaaagataagttcaaatttattttttcacattttttaatgctcaactcaaaaagttacagccttctgaccccaattttggttagaaatttttttaaattttcgagtgataaattccaaaatttacttaattaagaaagcattaaatattgttaaagagctctgcacaagaaaatatcatcatataatataaaaacaatacataaatctaaaagatgaatttaaaatataaataattaattaattaaatttaagaatatgaaatataaatgaaaatgggtttttttggttttgtattgcagaagaggcgcaaaaagtgaatgaatgtttttggagacgctaaacaacagcacacacatacagctaattttgtatagcaaaaagtttttgtttggtcattaggaaagtggggggcttttgagtcgttgtaaaaaaataaaaaagttgggatggcgttaattagtgatgaaatcattggaaaggtcagtcatcctccgatcagtgtttccatgctaaacactgctattgattgatcgaagtattgattggcattgattggagtcgatcaatcgatttgatcacagcaccgaatgtgtttgtgtggcattgtgttgtcgtcgtcatattgcaaaaacgcagttggcccccttttgcgcgtagcagtcccggcaaatccattccaggcgcgggtccttgcagaattcttggaacgcttccggcgtcagatcggcacattcctgcaagggaagcaaaagggatggcattttttgaaaaactttggatttttcaaaatttcatttttttactttctatgaaatttaaattttgtttgtttttttttaattttcggggcggggatgacgtaatcgattcatgttgatcaggtcgcttaaattgcataagggaaggagaccaacaacaaggcccccctcctcttcaaagtccattccgaaatttgcttttgtgtagaaattttttgcaaatttttaaaaatttgccatccctcaacaaacaaaatcgggtcaaattgaaaaaaaaaattggaataaaatgcctgatcagtgatcacttcaacatataataatgacctttgggtaaagtgggggggagggggggttctaaatttttccggtcagtaaatttgaaagaaaaccagcaaagcaaattcttgaaatatgtttttgtgtgaaaatttttaaaaatttaccaccccccaacaaacaaaatcgggtcagaatgaaaaatgttggaataaaatgactgatcatttcaacaaatgacctttaggtaggggaggaagggaatgatgggacaaaaattttctgatcagatagatttgaagaaagcctacccagtggaacactctgttgcagccctggctgatcgctgtgcattggatgcccttgtgttggtcctgaaattcattttttttaaaagtcatggaaaaatcttggcgttttgttggatttttttttaaatcagaaaacatacactaagttccaagcggcacgcttggcactgcccgctgagttggattcgctgctccggcatcggcatcagcgtggacggcggcgtgaacatggcggaggcgggcggcaacgaggcacgcttcagtgacgagggcgaacggccaggcactggaaaacacaaaaagatttttaaaaaattttaaaaacttcaatcgccaatttccctatgaaaatagtgtgtcaaaaatgtattagaggctaaatgtcattttgatcaggccgatgcctacaactagttgcagatgaattatgccacggcatgatcggtagaactggtcagctcatgggccggaagccaggtcccgaacaatttatccg

SEQ ID NO: 9013 - DNA, 931 bp, Heterodera glycines
tttttcacgcagccacaatttttatatatttaaataaatatcgtctactttattatttatctggtttaccaagaaattaagtgagctgtgaccgctcattctttctcatcagatgggctgagtgatagtgtaaacgtactttacacatacttttttattataattattttttattgtttagagttttatgtttaatttgcaattttataaattttttgatattttcagttttcactactaataagttccactttctttgagaccaagagttcttacaattagcacttttttttagtataacttttggtttatttcacgatattttagaaatattgttgaataagataattggaatatcagttcggttcaatttaaaattaattatatttttaaggtaaatataataatttttgaccgaaagtttccagaatcttggaaaacttggtaatcatttttttataattttgaaattgtttttctttatgattcttgtggtatcttttattttacaaaagaattttattaaaattttatccctttttttaattttttagccatttcctttatccgcgaattagaaatattaaaaataaatatactaatttcttctaaaataaaatttagagaatgttttttacatagatggtaagcttaaatatttatttttattgataattgtttatatttacatttattctcatcttgttcttcttcacaagctattgtattttcttaaggatatttaaattatgaatatctgcattggaaaaatatggttgataaggcctagactcaaattaaacaagcaaaagtggccaaatgccttcggtactgaatgattcgtttttctgcgttgaaatttttcatttgaacatcattgcaataaaacggaaaatactccactaagaatcgaccaaaatttaaaaaaaaa

SEQ ID NO: 9014 - DNA, 4174 bp, Heterodera glycines
tggctccccttcggtcatttctgagtgattttcctccttttttgccctttgactcgtccgacacttttccggcaaaatgtttattgatgatgataaaaaatggtcagaaattggtcggtgattaaaaggcaagatgtcgttggatatatggtaaaagaaattggaggagaaaaaagcgataaggattatgatgggggggtcaaaaagtgggaataattcagagggaagaagattacgatgatgataaattggacgagtgaaaaagtgaagccaaaattagacgccgaagggcacaaattggcggggaaaaaggctaaacaaaggaaaaataatgaatgcaaatggccaaatggaaatgtccgatctgagaaagtgtaaacaaaggaatagaaatcggagtcagatgtgaataggcagaaaatttggaaagaaaaggcaagtggtgaagttgaagaaaacattatgtaaatggcaaaaatgaaaagaagtgaaatttaaagcaaaagaaagaaatgaaaatttttgtaaggagaaaaaataggaggggtgaaaatgtcgacaaatttaagaaatggtcttcatccgggaatgtcccctccggattcctgattagcatcgtcctccccggcgcttcttccctcctttgttcgggtgaagcggttgggcgggggagggtgacagaaaattccccagcccactcattttcctcatcctctgacaattccctcgccatgccgtcggcgttgaagaccaagttgccgcttcttcctcctccggccctctcgttggcaacaaaattgccgacattcccgccggacggcgcagcaatggcaccgcctcctcctccaatgataaggtgtcgtcgacgtcctgtccgccctctttcgggttgtccgagcggggagtttccacgtttcctcccccactttgccctccccggtgaatctcccttcccggggtttttgccggttttgccaccgttttccacctcagccagcatgactcgcagttctaccgcctgtttctccagctctttaagtttcttctccttctgcttcttggcttcttctgctttcttcggctcttcctcctccttcttctcaagctcacttttcaccaaggcttcagctgccatcctggccttcttcgccttgacaaccttttcggcgcactcccgcaattccgcctcttttttttcgcttgaaggaaacaaaaatttaattaacaggtatttatttgtaagataaacaaaacgaaagtcctcagattacttgactgttttcgctaaattaataatgttaagtgtggttttgaaattttttatttaattttttaggtataaaaaatagtttaaaaattattgttaattttttccgttttggggaacgaattcgaggaaaattttttaaaattttatttcaggggggattcttggaattttctaagcccaaaattctgggtttaaaataaattttcaatctttttaaatttttttgctttttaaatagctgtttttaaaaatataaaaaaaaatttctccttcttgaccaattccctctctttctcacccagacttgaaattttgaattaataatatggtatttttctttaatacatcattcagaaactaattgcgattttcttcgagtatttgttaaagaaaatatcagtgacaaaaaaattatatttttcgaattaacttaaatcccagacaaacaatatttttactgctaattgtaagaattcaaaatgattcataattattttgtgcctcaaatttttttgcttggtgaatgttcaccccctaaggatcgattttttgtaattttaaaaatacacccttaaaaactgaaatttttgagccttttgtaagaatacttggaaaaaatttgtttataagaaatgtaatattcttttagctgtaaattttgaaatcaaaatttatccaattgtctaaatctattagatggttgtgatgtttttcaatcacatctgaattttgtaaaaatttttggcatttttttagtactaaaaggcatttttggtagtttttaaggcatattttaatgcaggtttctaaatttttatttctttcatcataaaaaataattgtttatattagtaaatttcaaataagaatatagcatccattatcctcatacaacaagttgaagagttgtttttaaactttgttcaagtattccttttgaattttaaagttttaaatatataattttctgtgcgtgtaatattattatttttagagattctttttatcccagcgaattagcgaaaatttatcaactatttttttataactttcaattctatcattttttttaatatcaaggttaattcctttatgaataatttataatcttctacaaaattctttcccatggtgatgttactccatgtgttgggtaataagagctttcgtttttggttcctttcacataaaaagtggtaaatcaacatttaattatttattcttaatatttatcgcttaatttttaattcgatatttcttatattaatatctcttttatttttatttttgcaaaattcggcttttcacgtcatcattgacccctctccacgacctaaaattactattatcatttgccttgaatatctttggtagaaatttgaaggtgttcatttatttttttatgccaattctgggtaaaacaaatagtttaatgcgtttcatttaataaaaatgtttcaaaattttcgatcattttatatagaaatgaacgtgatattaatacgctgtttttcaatattatttgaataattttgtaatttaattttaattttcattgagtaaataaatttaaatgaaaattaggattggttatatatatttttatttgcttcaaaagcgttttgtcggctcgtcacaatcgcggcaattctgtacctgttaaggattttaaaaattttagttaaaccaattatttaataatgaagattagttttggtaattatttgctattttaattgtgtttgtattaatttacttggacaaagtgcgaatgtattactgtattaataccgtaggccaatctttgaaatgctttggaattgatttttagttgcccttttttgttttgccaatatttagggctgaattttgccattgaatttgggccaatgataaatttgttttgcatctttaataatgggctttttggtttgccgttatttgccaattgtgctttgaggattgggcttttattttgccatattttagggctcaatacgtcatagatgtttgggccttgtgaaagtatttatttgccttatttttagtttttggcttatatttgagtttggcattccttttacagaattgttatattatgctgtcgcccgcgcgcggttcaatttttctttggaattggtcctttacattgccttttgcctttgttttctgcccatttttggcttaaaattcagtttggcgacgcacttaatgattttcatttcttttcatgttcaaaatttgagcggtaggtatagttttatcagcggccaggatttttatgttgggctatcgcccttgcgcataaaattgtacaatgaggggaaaaatggtcgaccttctcccgaatgcatcccgaggtcggtggaaaggttgtcattcgacaaccatccggtactagcagttaagccgtgccgggtttcgggatccggtcctgcttcgttccaaccccggagattgatctccactaggccgtagcccccgcggaatggctcggtcggcttagggggagggccagtagtggtagtgatgactggagaactggctaattgacctcgatggctgggaaagccatcgcttaagggaaaatcccggtgggcgttccaatgaggaggagcctctccctcctctcaaataaccatcctagtcgggactcggaaccgctcagttgggcgccggcacgtttgggcgccagcatgtttttagctataacttttttctttgtcaaccaaatacaacattgttgatatcattgtaaagcgtgctgggacgtttcgtaaaatccgccaccttgggcgtttcgtaaaatccgccattttagcgattttttcgacaaaacatggtataactttgcttaaaaccaaccaaattttacattcttggtaccattcgatagccaagctt

SEQ ID NO: 9015 - DNA, 1486 bp, Heterodera glycines
cattggaaagctctaagtgtcctctattagcctgcaaaaattttaggttcaaaaaagttatggccagaagaattcaaaaaaccaaattttccaagttttttggccataaatttgttcaaaattaacaaaaaattttgaaattttgcagactattagagcatctgaagagctctcgaatgataccaagattgttggatttggatgacaaagaaaaaaagttatagtcgaaaaacatgtgctggcgcccaaccgtgcgcgcccaaaaattttgaaattttgcagactattagagcatctgaagagttgggactttttgcttgtcaataaatgattatcaaccgtgaatatgacctagaatacagttgcttaaaatacaaaataaaagcagaaatccctttatttttcacaaaatcccataaaattttttatttgtttatttgtaacaaaatttaattatattatttgtcatattaaatttctttgccggtgatcatatatacttataatatcgctatggcgagaatttgagttgaacaaaatatatcaaatttattgcattgtgtgatttttattgtttatctttaatgccttctttatcttaatttattttcattaacatttaaacagcagacagcagtttattgttttatttcagtttatttttaaatttttcatggatagaagagcaaccaaacacggtactttgcaggaaacgtgaagtgaaagagttacgctcactttttgtttcatattttctaatatttttaacagatttttaatatcattcatttaataaaaaaagatgcctacaattgctaaaggcaaattcacatagcttaatcagtcaattttaaattttaattgaattttttttgaaatcgaatttaaccatagaccaaaacacaaagtcaaattcattttaatgaattaatttagaggataagaaaacgtttgtaataattttcttcgtaatactttaactcatttttaatacaattagtattaaatacattaattaaattttttatgtaaaattttaatccaataataagctttttatttttgatttaaaagacagttttttaaaattaattacattgaaaattttgatattttaaatatttatcaaattaattttattttaatattattataaaactgcgaaggatttcattatgcagatccttttcacattttcttttatcgttctgtggactacttaatttttttcatttttgccgattttaaattttttatatttaaaattgttaattcattagattttttaaatttagatctttccattactcgaagataaattttttatatttaaaattgttaattcattagatttttaaatttagatctttccattactcgaagatatatatcttatattttatttgattgtcagggataaaaatattcaccagattttggctgctttagcgcacaatgctgtcattattacatgtttctaactttt

SEQ ID NO: 9016 - DNA, 6423 bp, Heterodera glycines
gaaattcaaaaattttccaaaatattctggaagaaattcgataccaatatccactataattgtggctttacttttgtatttgcaattttaggctgacagtttgaaaaataaagttggactcaaaactttattaaaaaaaattagagaccggcgggatcgggactggatgccgaattcgcgatcagcgactccgaaaacccatggaagcatgtttttatgacttttaaaacaaaaaaatttttttcaaaaaaggaaggcaaccatcgtaactattacaccaaaaaattcattgtcaaattatccactgcccgtcccactgtaatagatgcctgatatcccgaaataaatgcatcaacaccgaaatctccggagtgcccgtcagtttttgctgctgtaacactgaagatttgtgcaatggacagtgaaaggagaaacaataataaaactggacgactctcaatacatatattgtcatattttatattaaaacaattttcaagacaaaaacatttaaatatttgggcccgtaacgagaggcaaactctgaaaaaaattaaagcgaagtttacggagtcttttttcgaactcgttacaagccatcggacatccgtccgccttttctcttcacatccgtatcatccatcccttacaaaacatcggcagatcagtcgtcaaatgcgtccatgctttgtcttcctccgttattcaaaagttgggtttgcgccaccgattgagtcgtctgctggggggtgacggcctcaaattcaaaacaaacagtcattcattgacaataagtcaacaaaatcagaagattgacctgctgctgtgaagtgccctggacaccgctaactggcgattgactttggtaatactgaaagattcgcaaatggcaaaaagtgttttaaacgaccacctgcaattggtaggccatgggactgatcttaaacccatataatctgaaaacattgcaattagtcgattgtttgccgatgtgtccgagggaggacttgccttggcacgtactgtttgttcggacgtttgggtctcagtcccgggtggacaaagaaaaacatgtgaggaaagccagtgccttaaagggatgggatgctttaagtaaagcgaaaagaataccgctgaccgaaataggcaccatcggtgtgctgatgcttggaagagcgcggcacgtacacatcgcagcaacgcggacaatacacacggaccatgcactcaccgacaacgtcagaaagacctgaaccatggaacagtgagaggccaacagataaaacaccaaccgatgggaagaactgcctgattttcgcagtgtacccgagggcatgtgccaaactcctcattcttccacttctccatcatttgctggatgccacgattagttagaacataacgtgcatgtatcagtccgtatagcatctaagaatggctggcaatgagtagagctggggaaaatgtgtatcatacggcccagagccaaaacacccaacgacatctgacaatgagtctttaaagcggttcaattttttaaccgggcttgacgtcttaaaagattaagcatgcttctttccccatttttaagttttaaacaaatttaaagattgaaacagtatttttgagtttgtttttggtaataaggtagttttttttttcgttttggctctgggccaatgatacacatttaccagagttagagtgcttttttacctccgccgcctgctccaccaaatccgactgtccctcctcatagtcatcatctggttctaaatccaaaatcatgtcgagagcctgtcgaaagtgcggcacttgttcagaaagtccagtcaaattgaagcggtcttggatgtactcctcgtcaacctacaataaaatgtcaagatttatattatatgtcataaaacttcgcaaaagaagtcattgccacgcaaaccacaaaaccaagagatccaagaaacttcttcggaactgctcattctaagtcacaaccaatctaaagaacaaatatgctatgtattaagccaaaaatcatcgagtattttagattaaaaaaaaacacaataggatttataaataggcgctatttgcaaagcaaccttttgaaattttttttcactttttttggtcaatttttttttttttgtttttttgacacataatgatgaatattaagtattaacagcataattatggcgaataaaaaatatattcacgattttttatctcaaaaaaattttgcaaaacaatagggtcccccctttggtttttgataaaactcaaaatttgtcaatttttaactagcgctaaattttcttttaaaatgtttttttcagtttattaaatagtatgcaatacgttccatgttaaaaaaacaaattctgcattaaaaataaacaaaaaaaaaattgaccaaaaaaaagtgaaaaaaaatttcaaaaggttgctctttgcaaatagcgccaaatcgggcaaatttactagagtgccacgagaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaattttcaaacaaatttctttaattatttcaaacaattaatatttttttggactaaatgattgatattattataaattaatatttgcttttcacataacattttttcggcgcgctttttcaaaaaatttttgggaaattttgaaatttgggtgtaatttgttacagattttcaacaaaaaaaagttggtttttgtgattattaagctcaattggtaggattttcatttaaaaaatgataaaatatgtatcaatttaaaaaaaaactatgaggaatcatattttctctataggaaacccacgagtatacaaaaagaaaattcaaaataatttaattactgtagaggaattaaactatgggaaagaaaaagggaaagacagggagactagccactaggccatccgcacaatcgtcgactttacttttaaagaatatattaattattattttttatttttccctttgactccaattttcttcactaatttttcactcagacccccattcttaccagtgcttgtttttcccggttcccggttcccggttgccctaccgggaccgggacctgagcttttcaaaacccgggaccgggacctcggatgaccgggaattcccggcccggtcccggtcccggtcccgtggcactctaaaatttactatttgtcctaattttctgatttgtacttattcggaggggttcttagaaatttgcgaaatccttaattcgaagattctaccaccttattttcattttttcctttttttctcgattttggtataaaatttaaaaaaatagttattttttagtccaatttttatgtataatatttagagctgggatttttatgtgctaaaaatcctgaaatatgtaataaaatatgttctaaaaaatgctgaaatatgtgctaaaaataggaaaaatattaattttcgcccgcacaatcgcaaatcaaatacgtgtcaaggcgtcctagggtaaaattgttttttgttttttgataaattattttttaaattgaaagtttcagcagagaacttcgaaatccaatgactcaattaagaactcgatttggctatttttgcattcgaaataaataaaaaaacattttgaaaatttgttagaagtgcttgatttttacaggccaggacgttttcgtacgagttgatttgcaaaaaaaattgcatttaaataattttgttaatctttaagtaattacttttaatgttttgacaatctaagcttttattaactacaaaataaaccagcaacaagtatgtcgattggagaaaatgctatttttgggcttatctcgtcgtaactaagccgcaaagaaatatatgtaaaaacataaaaatcccagctctaataatattcaatggcgcaaaatctgtgaaaaatgaataaattttaaaaatttcccggcggtatcctggccttacagaagcaggcgagtggataagaattttttctctattaaaaagcaaaaaaaaaaagttttatcttctatttgttggcacatttaaaaaaacaattaccgtaatatcaccgtatataaacattgtaattgtttgtttcgctggtgaatttattattttttgttccccttaattaatttgtgatttttgctggccgaagttctgcgaaaaattttttcaaacgaaactgtgtcaaaaatttccaaaaaatttagattttctttttcaaaaaggtggcttcgtttgatgcacgacttggcccataaagaaattttttttatggattattatgctattttttgtaattttctcttttatttcaaccgcaaaaaatatatacagtaaaacaattcaaaagcaatgaaattcgtgccgaaattgagggccagtgccaaaaaacacaacaacacaacattgctccatttttcttgtcattgtgaaaactggaaataaaatttgccaagagacttgagactgacaagaggggcccgcccatcaatggtcgagattcccgagaattattagacaatttcttgacattgtgacaaaaaacaaacaaaaaactttggcaaaatgcctcctgcgacttggcactactgtcgagattctcgatgagtcccatttatggccgagattctcgagagagaattctcacaactgatggtgggttttcctcctctctagcgtccatggcgaaaatttgtccggcaccgtgatcaccaccaacttttcctcgtccgccttgtcctcctcctcctcccccgtcttggccacattctttggcaatctgtcctggccgataccgtattcgtccgcccacttggcgttgtattccttcacttctgtaaccgctccatttccaccatcattcttccgacgactgtccatcgctgaataagttggcatactgtatggcagctaccgtcccctacagtgtgcccatgtaagtttatgaacaggggctatacagtaccatctcaggcttatacggtaccccaaattccttaaaactaaattgtgcgtactctgcagggccgttctttgcgctaagcgccttataatgggcttacgctacgattttgggtggaatggcgctccgagtggctgtaaacgggctatacggtctctgcccgaccgtacggtaccctaagtcccgtgaattattcgccttattgtacaccaatatctagccatttcccgatgaattattaacaagcatttgccttccagtttgtgccgcttctcgtcaaacacataggagacggtaaaaccaccgtactcgtcctggaactgttcaagatacggattacggtggtcgtttcgccgacgccgcttcagcccgatgattgtgcatgtgtagccgggcattggaagaggcgagtaaaagttggccggaaatggtggggccaaaaagggagaagccgctgggaacgggggaggaagtggaggcggcaacactgaaatggtgtcaaagttgggttaaatcatgccatgccatacaacgggcggcctgtgacaatgccatttttggaaaacattttaaaagtgccagcgacccgggcaccgaagaaatgcttgagaaaaacagaaaggcccctgaatcaaaaattttttgtgggggggggggtgtggcgtgaaaattggagttgccgtcagattagtagaatttttgtgtcattgatctcgaatattaatctcggcataattcttcttgcttttgagtctctgggtcaaatctgagtcttgagaaaaatcgcggggtttttttaaacgcgcttctcttcaatatattagtgaaccgagaaaaatttctaattagagtttcaatctcgggtattgggttgaagtcccggtcgcaaggcttggtctcgtctcggttttttagtcgctttcttgaatctcggtatcaagtagagattggacaatgggttccatcgatttttacaatgaaaattgaaaaaatcgaaaaaatcggccatgcaggtcactagcctcatgccttgggctctattctcggccttgagtcttgattattcgtttttcaagcacatgctacgaaaaagtccaccggtaccgtcaagactccctaccgtacctggtggtggtgggggcggtagaggaggcactgctggcccaaatgggggcataatgagcggtggcgtttctcgaagaattggcggcgggggcagtgccggcggcgaaag

SEQ ID NO: 9017 - DNA, 3676 bp, Heterodera glycines
aaatgcttcattaaaattaatgaaaattctttcgttttagcattcaatcataaaaactgtctataaaacacttctatgtttttcgttcaacaaagtgaatgatttaaaaaacataaatattcatcacccgtaagtgatttgtcattttatttaacttttaatttggctgtgccaacaaacgacgaaatgtaaccgcataaagattttacgaaaaaagggtgggacaattaacatttttactttaaattgaattttatatttataaaataaaaatgaaagaataacatagataaatgtttgacataaaatatatgaggtcatcagctcatgaaaataataaacgaacacggaaataaagtttttaatattattaaataaagagaatcaaaacttaacattgcgcatacttaataaacaacataagcaataaaaaaatttctaaggaataaaacacagacagaaaatcacatatcgccataaatttgaaagattggtagtttttggtagcagttttacataaaaatggccgatttttgaggattttttccaaaaatcagagtaaatcagtaaactttctcaactcgtaaattttcggtctcaagctacactactaattagggggtccaattttaccaaatcccccccccctccctttaccacccatcaattaaaaaatgccgcaaatattttgacacaacattctgttataccaccaccatctccgttctcttctcccgcatcgacagcaaaacaacaaaattgtcacccctacgtcatgactcccccggcgttgtcattgaagcggacgcaattttcggtgttggcgaagtgatttgattttgtgatcgatggggttggcgaaatgcgcaacccccgccggggcgaagcgaccaaaaatataaaaataatcacatttttcgcgtcgttatcgacgtacgagcagctttgactgcttctatttattcccgaaattagcatagctccctgttagtcgttcattggatcaattataattagagcttggcacggtaaaataatcgcgataaatgtcgactttaggaaaaccctctaaaagatagataataataattgcggcatttattaccgcttactaatttatggaaaatcgcgcttaccaaaggaaattatatagtgttggaatttggcaatttgatactattttcaccgaaatttttagcattgttttggcattttgaattaattttacatttactatacatttactgttgttacagtaaaaattgaaatgggcttaacactgttggccaccatacccgcttcatcatgtttacagtccgagcagcgcgagctgtacattgacaactttacattgatgttcttcgacagcttaatggtacagttcaatggtgtttagaatgaacttttctacgatagtaatggaattaattggtgcctaaaatttggaaattaaaataataataatttcattaaggttgctttgaactctgcttttccggaacatcaagttcaatacgacttctttgaatgtaattttattttaaattaattacctttataaaaaatattttaattttttataaaatgtctttcgaattcaatctttctgaatttcatcaaataatttttttacacaaaatgtgaatttaatatatgcaaaaataaaaatttaattcgatagcattatttattgattaatgatgacaaacttaatatcactactaattatcataattatgagtaattcaagctgattttaagatgaggatgaggacggtgaaattatgcgagtgcgtacggacgaagagttggccacctttttgtccgatttagcaccaaattgtgggcggcaacggcaaccgctcaaaatttgtttgagtaaattgataaaattaatacactaattaagtgtgattaatttgaaggaacgtcgaccaattgccatcggcaacaaagcattgattttgaggacgatgaacatgaacaacaacaacaaaaccaacagcaccaatttgagccggaagagctgcagtttgttgaacgactgtcagatggccaatttggcagtgtgtataagtgagaaaattaattgaatgaatcagtccttgaaaaatccttatttcgaggatttttccgaggttggccacttccacaaaaagtgcaaaaatcaaatatctgattttttaatatgttttttatcaatgtttttaataataaacatgttataatttaataaatgatgctgaaatttcaatttttgtgaagtgactccttatatcaggtaaaacatttcttttttgtcaatttaaatatacttttcatcaatttctagcaaattcggaggaatttccgaatcccacacaatttattctctcctcccttggaacaaacaaaattgttctggggaaaagttcctcgtgttttagagatttattcttaaatttttaggtataaaaaatttctgacaaaaaattattggaaaacgggattctttgaatggcgcaatttattaaaataaaaaggacatttatcctatattttttaattttctcccccttggaacaacaaaatgaggcctacaaaattcctggctagcggttttcgagtcgagaaatctctcgggtttttggtggcctcgactctcggacttacttttttcatctctcaactaacatacagagcattggacacccgaaatgatcggatgatggcggtgaaatgtatcgcggtggatggcacaagcggcacacggcaaagtctgctcaacgaaattgccattcttaaggtgctcctgtgatctgatgcaggacagcagcagatctataatccaagcaatttaaagaaaattaaacaattattatttaattggagcccattaattaatttattaaaatttcgcattttagattggataaaaaaaccaacaaatataggaaactgaagctatcaaaatgcttgaaatttgtccaattaattttatttcacttttcatacttctcagtagaggtgtgcccatgcgaacattgtccaattccatgcggcactttttgtggacaatcaactgctcatttgcatggtcaagcaaatactaattacttttcaatctcctacttaggaactaatggatgccctgtcgttagaccgttatggccaaataactccgcatgttctgggtaaaatttaaaaaattcaaatgtgtactacgccaaaatgaaaattactaatacaatataagtgtgtagaaagagggggcgggggctgagggggctaatgcccccccccttcagcaagatttttgaaattttaagcaattttcttaccaaaaattctcaaagaatttcccggcggcgcctcgctaccgccggaacccatgttaccttatttttgaaaaatggagaccaaaatggcaaaaaaataataacttcttttggcgaataacggctaaaaatttgtaaaatacacccccctaattcgggatttcaaaaaaaacgaaaaatgcacgcctaaaaatcgaatgaaaaatacaccccctaaaaatcgaatttttgacttcggccctcccccccccccgaagccaagggtctggctaggcccttgataccatatttgcttgaaaaaacgctctctatgttgatgggtacaggctttattaagggggtcagagggttatgctttt

SEQ ID NO: 9018 - DNA, 1673 bp, Heterodera glycines
  misc_feature (1663)..(1663): n is a, c, g, or t
gttataatagcaaataattatttttaaatcatacagaaaaatttgttttataattttttatttttgccaaaagcatcatggaaatttaatgaataatgtgtaatttatcataaatcacatttttatttaaattgatttatttatttaaattttaaattattttgacgaaagctcaggcaaaaataaagttacttaaatgactttttgtttagttttttttaaatttaatattttatttatatttacataagtgtggccagtgatgtgtggagtttgggcatttcattggctgaaatggcattgggccgtttcccatttgggcctggatcagcagttatggtgccaaatctgttcacaatcgaatcactgatcagcaggccggaaacgatcgccaccgtaatccgtcagccggaactgagtgccgttgggtacggtttcgaccgtctgatcgctggatggtaatcgggaaatattcaaaaatgatttgaaatgatgagcagtaacattaataataagctggaacataaattgattgaaggaaaatcccatttttgggtattcaattgtccgaagaaagaaaacggtatgccaaaattttgtaaaattaacgcattaaattggaatgtgcgctaaatgggcgtaattttgggaatttcgatcacaaaccttccttgatttttataattttctaattttatttcacctgaaagccgacaatttttagggttgatgaaaattttaaagagtttcaaagggaattgccatttaaattgaaaaattattaaaaaattgcatctcaaatggatttttattcactaagtttggaatttccagtctcaatttaaattttataattaattagtttttttgctttagagagatatatttaaaagaataattaaaataaaaatttaataatattttttaaaatatttttaaaaatttctttcagtctttcactaaatccgaaagaacgtctcagacccgaacaaatttatcaacacgactttttggcagctcatagaccaatggaccaaagtttggtggccaaatttattgctgaaaagaggcaaaattcacaattttgcggaaataacggaataatttgagaaaattcacaccgtgtcaatgtttaaatttgaatctatgtaaaggaaactatttaattgaatataagaaaatgcataacttggtagtagaattttcattaaaaaacaatttttttttaatgaatgttttatgtaagtaatcattgtgattgtccaaaatgatcacataaaaaattctcgagggggtggaacgagacgggaggggggaggggatgacaaatggacaaatggacagtgtgaacaatcggacagtaaaataacaaaaagataagaaaatctcgtcgctgaaagggatcgattgtagaaaaaagaaaaaataggcaaataagttgatgattttttggggataaccctaaaatgaaaagatgtgaatcgaaggtgtggggcagctcattcaacgccaatttcgttttcttcgttcaccattaagctatttagttaaacaaaaaaaatgtagccgggggcgggggaaaccatcggcagaaaaacggcgacgactgaacacttaggactatcgaatgatgagaaggaaaatcttgttggcttttgagcanaaattataaa

SEQ ID NO: 9019 - DNA, 3577 bp, Heterodera glycines
tatttaaaaagtggcaattaaaaaaattcaaataatttatttttgtatttatttactaatctaatcatacatttggatttttgctcaaattccgatatggcaccagcacaaaattccattcccacagtaacaacgcccatttcccaattactgtcatttttgtgtgaattgcccattatccccttgagcagttcgatttcgctgctgctttttgtggacttaactcgtcccgaattgttccaatcggtcgccgattctctgctgaccgtttgtcgcaagagaattgagcgattaaaatcgggcgacgaaatggcgaaattaattgggcaaattgagtcgcaagtaaaggcaaaaagcatttttgggaaacgttcaaatacatatttaggacaaaaaggcaattcgccccctcggaattcaattggccattgtttgtgcacgatacgacgaatttcaggcaaaggaaaaaacaaaaaagagagaaatggacaaatggacacaaataaatggacaaatgggcaaaaacaaaataatataaataataattttgaatttcctttttcatttcacagaatgcgaacagtgagcaaaagcgtcaaatgtatcgtttaattcgccaattcgcgcatataaacggcgctgcgataattgtgggaatttgaattttaattgcataattaaattaagtttatctcagactttgagcattcgcatggacactttgctgaccaaagcgcgcaactttctgtccgatctgatcagtggagttcctctccaccagtttcaaaagtcattgtcaactgatccgcaacagccccttttcgttgtcccccatgggatcgattcgtttgaggtgaatcattttttgaactccctccatctctatcgtgatgctccttccgttcactctgtctcccctcgtttctctcatttctttgttgtctctctagctttttatatttctcagcctccttctctgttcatcattctctcttccttcctgttcattctttcaacgtatctctctcccctctctctcccccctctttctctctctctctctgctaatcattcctcttccttcctctacccctctttatctgctctttcctctctccctcctgtctctctctgctggtcattctctctccctcccactctttctctctctctctgtctctctctgctggtcattctctctccctcccactctttctctctctctgtttctctctgctggtcattctctctccctcccactctttctctctctctgtttctctctgctggtcattctctctccctcccactctttctctctctctgtttctctctgctggtcattctctctctccccctcccccaaggtcattaatccgtcgttgcgctctttgggctctttcagcgaggcgatgcttaactttttgcaatcgcttaaccaaacatttgctcaacagcaacaaaaggcgccggacgatgaagcggaggaaggagaggaaatgaaagagcaattggcagagccaacaatcgacgcattggtggaggaacggatgaaagtcaattgaggggagggggggggggaggggaatgatcaaatttaaaaaaaattaaaaaaaaaagtcgaaaaatgattgggcttaattaatccctgaccaaaagtggtcgtctacattttcacggattgccgatgcatttctcattttcatttttttcttgtaaattttagcaattggagcgttttacgcgtgaaaaacgcgaccgaaaagaagcggagaaaagagcagcggacagaagaaactaatgggaaatgaattgaagaattaattaattaattaataattaacaaaggataattaattaatttttcagaattattttttaatgagaaataaaaataattaattttttaaattaatgtcgtcattagcccatttaaccttttagattaattatttgcctatatttatttgtaattctttctccttcttttattaatcttttcttatcaattattttttgcttatttgtcgatttttacaatttttgataataataataataaatttttatttttatcatcagggattaattttgaaaccaattttttagtgcaagagttttaataaactttctgccattttgcacaaattatttttgctttttggcaccattttcaaatgccattccaattaattatgttaatgttcgccttaattagcccctttcactttgtctcctcccgtttctttgacctcgatggaatttggcacttttcttctcaaaattggtctaaattttcgggaaatgcgaaaggttccggggggagtggcggcataagtgccgtttttaaataatcatcgtttttaagtgcccggcgatatttacgccgatttattcaccaacggatttattgaagtagattgattcatttaaattaattttttattttaattttttctaattttggaggaccctttgtttgggaacggcgacggcttttgccgatgggtgccacggcaccgatggatttacgaaaagaaattcgaacttccggacgaagcgcacaaggcgagaagagagttttactggtcaaaggcaatgcgcagtaaattgctcatttcgtgcgcagaaattcaactttggatatttcgaaattgaccaattattgtgattaataattgccatttaaattcccatttaatttaattattttccccattttttggctaattttttgcttctccatttgtccggcatcgattcacccgcctctgttctgctgaacaatcggacaattgcccaattggacaaccaatttgtgtccaattccgttgacgtttggtccgatgttttgccccgtgaaaatattcttcgaattgaattcgaatcgcccgttgaggaggccaatttcagggcggaaaaatacgaagtgagagagaaaaagcacagattgaaaagcgaatttcatttatgctcacattaaacaataattaaatcaaaattttataaattcattaaattttattttttattttttaattttaggcttttcatggccacaaattgccccccgtaaaatttgtttaaataactaaaaatgctttcgagtgttttgcagcagtgcaccccgcccatttacaacggggagtgccatgtgcaatttttgcgcaaaatgcaggccaattttggctgggattggggcccgaggtctgtccatttggcatccaattaaagcaaatggcactaattagttgctcaattgccttttgagttttcccaccgttggcatttggcgtccaattcgcttagaatttttcgatttgctttccattcgacgcttttccccggtgatcagtctgggcaacggttaaaaaattccccaaaatttttattgtgaaattagtttagctgaatgttttgtgatttccgtccgcctttctttgatttgtgccgtcgaccatcaaatttccatcaaattgagcttaatcgaactcggaatggacaaagtccctaattatttgtccttcaattcattagctaattaacaccgctttaaggaatttatttttcaacggga

SEQ ID NO: 9020 - DNA, 4336 bp, Heterodera glycines
  misc_feature (2637)..(2637): n is a, c, g, or t
ttcaccctcttttctgcactaaaagcaaatgcaaatgttttgaggatttggggcggcggattttacgaattggacgaattttatgagcaggcggacgaattgggtaaaaggcaattaattaattgctgctaattatttattaattaatgagttaatacgcatttatttgtaatccttcgataatttctgatggttaattttcaattttcgggcttctcatttggcaagattttatgttcgcctgctcattgtatcccatcgatcctcattttttgcgttcggtggaagccgaaattgaggaacaagtaaataaaaaatagggaaaagggacgagtgaatggcacggattggcattttgtggaaatgccattgtttaaccgaaaaaacatgatctctcccaacagcattctgatgaatgatagttacgtcaagataaacaatcacaaatcatctctgttttccgattgcgatcggatcattttttctggctcaatgccaacatttgtccgtgccctttgtgtatgatcggcttcacttgtccagactgatcagtgtgatcagtgatcagtctgtccttcccccctcttttggcactatccacattctctgtccttttcatgtgcttcgccttcggcaccatccgtcggtgctctgttgggcggggaacaatgaaaacgaattggccgtgcgttcgcaatggtatccttcgtgggattaccccgaggaggcccaagcgcgggactatgtgaaactgtacaaaaaacacattcaaacattggccgtcaagttggacccgaccagaccatttctgctgtccagcccatcgaatggaatcgaaacggaaaggcaaattaattaaaataaaataaattaaattaaaaaagtaacgaatttcagggagggcggagtgtctaaaaacccgggcgacccggcgtacggcgacgtgcacttttactcggagtcggtcaatctttggaagccgtccaatttccccgtgccgcgctgctcctccgaattcggtgttcagtcaatgcctttgcggtgattgggcacccgccgaagtgttgaatgaattcgcttttccatcagtgggacaatggcacgttggattggtccgtccgattggaattacaaaagcggcactttggtcagtcggcaacatcaccccggcggcgttttgaatttgccggcaatcgtttcgcaacatttcaatgtcttcgtttggtccccccattttcaattcctttttcattttaagctcctctcctccaacttttcttctctctctttgtccgccccttttttcatcgacaaattcgcttttctctcccaaattcatcaggcaattgcacttcaagcgcaaattgagcattaccgaaggtgaaaatagcaaaactgaacaaacccagcgaagggatggaatggcatttccatttcatcattttgcattttgattttgggtcgttttggcaaagtgccagttcagtgttccttggctgttacagtcactttttgcccttctgcttggaatttatctttgattactccaaaatgctctctctctttttctgaaggttccgttctcatttggacgaggccgggcttggccacacaatgtgcgcgatgtattggcaattgaacggtctgtctgtccattgcgtaattacaagcaactaattaacaaatttttcaattcaattaacagatgtttgggcagcgcccacttggtcaaccgttgactttgacttgcgttggaaagttggccaccatttcgtgcgccgttcgttctctccgctaatcgtttcaatggtccgtttggaaatgaaaggacaatcactcgattcaattttcatttattttttagtttttggactcaaatggcattttccgcctttggactgtctccgatttgtctctgtccgtccaaaatgccattgtgcgactgtcacttttcccccttcgcaacggactttccccccttttcactgccaatgtttccgtcccaaatatttctccgctttcctcccaagagattcctctcccgtaaggcattaattaattaataattaagggtaattaatgatcaaagcatttctctttgttttcctaattgttcagtgattggcctcccattgcctttgttcgtcctttctcttcttatgacgagggtgacttccttctcatcgccgatctgatcagttcccgtggtgatttgctaagtccccgtgccgttttgtaccccgacaaaatgttccacgcggggctctacggaagtgccgcggtgtcctccctcagagacaacaaaaacggcactttctccgtgaaggtcactctcaccaacaatgttttgccattgctttggctcgacctcagtgacgcgtttaaaaagtgccaaacatttgccaattttcttttatttttacgtttttttcagtgccaaccctgaagtgcttttcttttttgaggtcatccacgggcatatttcactaactgccatttttccatttacatttttaggaaaatgcatttccccgcagttttcgtcccaccattttttcacgctttcaaatttgtagaaaacccaaaagagttcgaatttggcaaagatgacatttgctttgatggcattgtgacganacaaatgtaaaaaggggataaattttatcatttttttactaatatttattttcattttcacttatttttgcacaaaatgtcattgaagtgataaaacagcaaaaacaaacaaattaaaaggaataaaagtaatataaacacacacaagaaagatgcacattatttaaatagccaagtgaaataaaccggtaaaaatatgaaaagtgaaaaaaagggaaaagctttggcattggcacataaaattgagaaagacatggaatttccgccgtttgatcagatcctaaatgatcggcccaagtgatcagaagccctccgggtgcatattcgtcctccgccggtagtcgccgttgacgtggacaaatccgtcttcgccgacgacaatcccttggacaattccctcaaagccggtggtcggcttgaacttttgtccaaatttcacctccaagtctttgagcaacggctgaaaagcaataatttacataatatactttatccatttaccgtatttgctctttttatatgccagtctccattaatctgccggtctccaattatataccccctttgaactaggttgaaaaataatctcccagtctccatttatgtgccgggggggggggggggataaatagaattttttaataatttatttggccggcttcttcgtgatcgtttcgtccatctttaaccgtttcagttgccctaaactcgcgcaaaaaagcccagaaggctgtttctatgcctcaaaacataaaaaattacaaaaaaaaacttcattttgatcacgttaaaaatttcgacattttgaccgacttgtcgacactttgtcccactactcccaaacattgttagacctgtcaaaacattgtttaacccatttaaaaacaaatatcaagctctacgcactcaattacccccaaaatctcccactcactgcgaaagccgacttttttgaccaaatttttagacaaatgaccaactcaactttgggctagggactcaaattttttaaaagaaccgcctcaaaatgctctaaccaaaaaccacctcgcccattacccacggcaacttaaaagccgctacgggcgcaaaaaaaacatgcaactctaaaaaaattcggaaaaattccctttttgaccagtttttcggacaaatgacctacttaactttgagctaggggtccaaaatttttttttaaatgtgactaggtgagctctacaataatatacaatagcgcctgagctaatatttcgctaaagcacacccgcccgagtctaactttttgagaccccttcctggccaggggctaaaggggggtcaccccttcaacttagtgctggcgcacaatttttttttttttttttaaagatcaaaacgattccatattttcttaacttttcattaaaaattccaattttttatgcataccggaagcaagaaaattacatatttttgccattttggggtcattttcagaagttctttaacaaaaaattcaatagaaaaaattttttttttgacgagatgacattttttggcgacatgttcaacatattcaaaaaattttccactaaataaatcaaccgaaaaataatctcccagtctccattagtctgccagtctccaattatatacccccttctgagaaggttgaaaaataatataccatggtatataaaaagagcaaatacggtatata

SEQ ID NO: 9021 - DNA, 4793 bp, Heterodera glycines
ggtttattgttttttttgggaaaagataaaaaaattaaaaaaacccgaaaccgaaacggtataccgaaaatttttttcggtttttttcggttttttaaccgaaaccgaccgaccgacaaatttttgagtttttcggtttttttcggtttttttttcggtttttaaccgaaaccgaccgaccgaccccctcttgtccggtctctaattttcagtgtcaatttccgtcggacggtggtcatcgtatggcggcatattgtgtgcgcgcgatggtccgatgcgaaagacatgcaacaacagttgcacgaccaccgctgcaacaccagcacgctcgcctaccaagcgtcgaccaagcgcttgttgcccaacgtgccgtgcagcggcagtaacctgaacctgcaccacgctcaacacgcagcggcggggacgacagtggcaccaccggcggtggtgctgtcacggccgggcagcggacagcgcatttcgctcgaagtggaagagggcacgccgatggtggccaaacgaatgccatgacgacgtggggagagggagaagcatcgcctggccaattcgagagtctcgaccaaattccgtccagggacacagaaattttaatcaaattgaatttaaaattcaaacccaatgaaatttatttgttattattgttcgtgttttcattcttcaaatatcaaaaatatttttgacatatcgcccgccaccttcatttgagaaaaaacaactgtgagtccctaattttatcatttaaattaataattcatatttatatttttgtttgtccattagttcgttcattttttctcaattaaatgattaattaattttgtataatcatttgccattatttccaatgattgtaaatatttgtacgataaaacatatgaataaattaataaataaccatatttaaaaaaacttttttccgcttatttttgtatggaattaaatttatgcatatttgaacatgtcctttttgcatttgttgattgccgttttgtttgactgttaattggtccattaattaattaatcggtcttcggttcgtcctttccttccctttcctcggcttcgttcggtcttttccgttcagtaagatggatttttgaacttcccaaattcatcgattttatcgatgttctccatcggcttcaacatcagctgatccttctttgtgtattgataattccccgaatcgtcagtccattgtttggcagtgccgtcgctcattctcagctcgagtccgcgcatttcctgcacacggccctacaaaaaatttttattggcacaattaggaacaaaaaataacttttattaaaccaatcacaaataaatggattaatgcgtcttataattaatgattttgaatttgaaaaaagaaattgaatgctgcctgaacatttgctgctaaaactcatcatgtgagtgtgtccgaccgattccattcgaccgatcccctctttttgcttttccctcactttgcttgcgtccacgtccttgagtttgaagctttgcgactcgcaactgaacaaatatttagtgggaaagtgattggatgtaattggtgttcaatgcttactcgccgccgctgattgtgagagtgatgtccttgaacgtgttgtccatggtggcactgccgagtccgctgcacttgcgatgctgcaacagcacgggcaacgtgaacacggtgctgtcgtctgcttgttctaatgaattaaggaattaatttaaaaaataaataaatttccaccggtgatagtgccattctcgtctttttcagaaaaaccagaaaggtcattccctttgctgagttcgaaactgcaaaaattataatgtacagccaaaccagctaagtgctgacaagtttccaaatcgtccttattttccaacctttgccaaagtctggccactaattcagcaatgatagatagtgttttgggcccggacactcactcgttctcgagcgcagttttggcttcttcgtaacaatttccggagaagaagccggtgcccggctcggtgaactcgactttcactttgcctttgcatgcggttttcactccgctcacgcacccgtccaacagcaaaagagtcccttaaaagcccgtggaatgaatggccatgttttttttaaagtttacgcttaaactcggcgccttcgggttcgcttgccggatcgttcttgtagaagtgaacctttgagataaaatgattaaattaaaaagtaaataaataaaatataaaatgttggtacaatggcacagtgacggatatggtcgtagttttcatttccgcattttggcatctaagcaacaaagaaataattttaaatgtagttgatttaattggtttgctctgaattcaattcgtacagtatcaatccgaaccctacagtaccaaagaaactgacatacagtaccaaatcttcaccaaaaatttaggcgaaagggcaacggccaattaaatgcctaccaaagcaactttgtagaagttatccacgcaactgtcgagtttatcgctcaattggatggagccaaataagtttccaaatttaatgtccggggctttgttttcatactgaagaagttttaaaaattaatgaccgatcataaaactaaagaaagtgagccaaaacaaatcccaaaccaaagattggccaaaagtctgctggtttttttatttaacaaaaaacccaagaaaagtaaaatcagagagaattttgtcagggtcttatttttttgcaaaaacaaaaagtttttgaaaagcaaaaatttgaaaaacaaatgtttgatttttctaaaatgtcaattgtgcagttttaaccctcaaaaacaaacatggcatgcgcagtattcctcctcatcgaattttccaccgctcgccatgctgcccttgtagcaggcgtagcaattgctgtccaccttttccgctctgttgtccccgaatatgtcaagggccaaccacggagggcgcaaatgcttcgggatgaatcccttttgtttgaccacctccgacttcaagcattcatcgtaaaagcccttgtccttgtccttcaatggagcgcacaccttttcagaatgtccggtctctgaatttgtaagttaagtgcaaagaacaaaaaaaagaaaaagaaaaaaagggactgtcggcggcatttgccacgaggacggcaaatgcaagcagttcagccgcgagaaggacgacggcactgacggaggagcacattttggggagagggcacacgaaatcggtgaacaaagaatgaagggagaagagggtaaagtgctgggtacggtaagtgtgtgggtgggttcctgtaaataacgaccattcaaaattttcactcaaggactgacattctcgacaacactctcacacggtatttgagttgttggttaggatgtaattacaactttacaacttaatgacccccctcccctctccttccataaatgaagctattatttacaaaaccctcagatcaattggttttggctattaaataaatatttttatcaattagatggaaaatattttttggaaaaattatatttaatggaacgaatgaatgaatgaaaaatgtaagcgaaaagaatggacagcaaaagtgatgacaaaaaaaaactgatgctgacgaatcattttcactgattcgctgctgctgatcgctttttcattcactgcttcggacggacaaatccaatggcagttttttgatttacatatcaaatgaatgcataattaactattttatgagtattcattatgaaaattgttggtgtacaatgaatgatttgtgcaaattagaaggactgaaaatatttccgatcaaccccagttttttgctaaaaagtcgtgaaaaagtgaagggtttttggggttgttgatcacgaatatggcatccattttggcctacttcaaatcccggacccgaattcaaacaaaaagtcgaaaattcgaatttttcagaaactcacatttatgttcgagcctgtgcacaatgattattttttgatgttgtaatgatttgagtttatttttgcttgttttaatttattttagaacaaaaagtgaattttaaaaattttatttcagactttttgttcgaatttgggtccggggttcgtaatatgtccaaatacatgtcagattcgagaccaatgttacaaactagcctagaacagggggggggggtgacaaaacccggaagtaccaaaagttgtgggtttatatattttttaggtttttgaccatttcgaggatttctaaaatgcgccagcacgagctgagataagttatgacgatttatttgcaaaaaataaataaagcagatagtctaatttttaaaaaagtttctttaaaatgacccattatttgaattttcataaattttattttttcctcgaacactttcatgaaattagtgcattttttcttagtccggtgatggtttgtcgtttgatcatttgtctgtccgtctttccttcccctctttccgtcctcgcccaattcaaatgtttggcacaatttggcccggtttcacccatccaccgaatccgcgttccaattctttggcggcagcgatcagaagcgcctcgttgaacggtgcggcgatcagctgcacgcccaacggcatgccagtgacccaacttttgctggtcggagcggtcaaagcggggaagccgagcacattgaccatgtgaagggcacggctttattgcttagttgcaattgaataaaggaactcgtattggactttcttatatccgctaccttcgtta

SEQ ID NO: 9022 - DNA, 1635 bp, Heterodera glycines
gttgcgcatcattaatgcgctttttcttcccttgcgctgttaatgatgctttcgttttgggagtgcgccaaaattggctgggtgccaacaaacaccgacacaaagcataataatatttagaattgattgcctaaggccaataaaattttttcaaaatgccgatttttgggtggcatcgaaatttcccaatggctaatgtcatcaactaattagtcgctaaaccatttaacggttaaacatctggtgggggactatctttgtgtgtgcaccgcgcgccgccacttagttctttgtcactgggtctcttctggtcggacatctttttttagtttaattaacactaattgatgcatttgtccttctctctctcctttccgtcgaccaccccgcgggggggggggggttcctataatttatgacaaattgatataaaattctcaaattaggaaaactcattaaaatagggagcgcgatcgctgtgttgcctttggcccattaacttttggtttttgcgcataacgctttctttttcttttcccttcattctctcgactcctttctctctctcaccgtccctctctctcttttgccctctttctttccctctcgttctctatctctctttctccctttatttgctcctctttctctcttaccgcctctctctctttctctctctctctcctctctctcctattttcgccttgtttctttctccctctcccccctctctgtttctctctccacgtcccatccgccgctctctttttttacatctttcgttctctgttcaaagggatgtcatctactgctttgtctgctgctgctcctcctgtgatcactaataccctttctgcctgtctgctcaccctcctcctgttgcccactctctgcgcctgctctgccggcgatgcgtctcccattttccggcactgtcttgccgcctgtgttcttccatcgtcccccgagcaacaggcgcttcatccgcttcaccaccactgtcccatcaaagagccaaccgcttttgcgtggtgggcccgcgaacattgctttaggtgacaattagttgaatgaccaacaaaatgccaaaagaaatgagtgccaagtttggcgacgggcgttattggcaaaacgttgtattcaattagacattattgggttcgaattcctgttttcgaaatttttttgagccgtcgggatgctgatttccgattgtcgaaatttagaattttcttgaaatttcaatttttcttattttcctttttcccatttgaaaaagatgtcgccaaagttgcatttggcataccgtcgacgaattcgcgcgccgttcgctgcccccgtcgtccggcaccaaaccgatcccaccccaattcttcggcaaatggccattcattccgctgattttgcgcattggcccactgtttgttccggtccaagtgcgtgtgggccattaattaaatttaattgtttattaaattaattaattgcaattttccaccatttaaaggagcccgcctcggtgttcttctcggtgttgaatttgtgctcggtggtcgcaatgcaaaagcgcattcgccgctgtgtgcccgcgaattttcattgccgcaatgaatgggtgaattttgggtggccggc

SEQ ID NO: 9023 - DNA, 2987 bp, Heterodera glycines
tacagagtcttgccaatattttgaataccgtcattttgccgcaaaaaacaaaaatttttgtccaaatttttttttaagtttacactacagccgatttaaacattattatttattgcatttaattttaatttataaatttttatttatttatcctataaaatcccttttcattaatttattgattttaaattttaataaattaaataattatttttaaattaaataaaagattatctgtttttcatttcttcttctttatctcacaaaaacaaaaaggttggcctccgctattttccatctgtgcgaccaccgtatcacggaggcgatggattacggtgcggcccttggcctcatactgtacacattttatgccagcacttgcttcattttgtccccgccggtgctccaattttgctgccctattcaaatgtcataaaaaacaaataaaaatatatttaaattaatttttgtattttttaagtgtccctcaaaggctcaaaaatggcattggcattgcactttctgttttttatatgcgctatttgctgtacatttttggcacggttagagagacaaaactaaatttgaattaaaaaattaaactaattacttaattagcttaaatgtactatatgatgttaatgggaaattagtgtaatttttctaagacgtcattttttcttttaaattgtaaaaaatcaaaaaaaaattaaccataaagttaaatcatttttggtaaaaaaaaaaaaaaaatttcatcatttttgatctgtaaacattataagaaattcatcgacggcaattaaagtatttattaggaacatggcctgatcacggattaaaaattatgaatttttgagtcattttttacctaaaaaaatttgcctcatggatggaaaagcgtaaccattttcactatcaaagtagcaaaaatcttcgttatggctaccaaaatgccaaccattgtgacttaatttgtgtcgaattaagccccgctttgactacggttggcacatccgttgctgtgtcattttgtccatggccaccgttttgctctttttggcatgggcattcgcattgacttggcttggccgtgcccatctccattcactgcgcattttggccacaactgtcagtttattactgtagtaaatttttgttttactgtaatttggctcggtttttttttgtgtatacggtgttcgggcgaatattacatcgtgatgatgtagcttgaggctaaaaccttgaccaaacccgggacccaaaatataaacatttctcgagaccggtaattgatggattccgagccccaaaattttcaaacctttctcagaccgagacttgttgactccaagacccaaaacctttctcaagaccatgaattgaccgaacaattgacctaatcccgggaaccaaaacatttcaaacatttctcgagaccaaaacttgacaaaacccaccggggcgggcccaaagcatttcacgaccccgagactcttgaacaaaaaagtttgctaatcgcataaattttaatgttttttaaattctttgttttatcagtgatttgttttgtttttgttttaagttccttctcggctggttctccgcttcgttcgatgtgttcttcgattttccgcctctcttttggcttgtcgacgcccacgcgcttttccatctcttttcaattccggtgctaattaattagttgcctaattatgcacttttgttggcatttccacacactttttcaggtgccattgctttgggccaatttcatttgtgccgaggcggcgattgggcaaaaaaagcgaaaagaaaaaaaaattgattggacttcataaaatgtagtgaaagttttctgcttacaattaacacttttgtacattccttttggtgtgatgctcgagacccaaatttcccgagactcgacaccaaaaaccgaggcgcttttctcgagtcaaaaccaaaaaactgagaatttgaatccaaaacagtgacttttctcgagtcgggaccgagactccgagcatcactaatatcctcatgtcagcttttgcggccgagcttaattatttttttaaagccttgaattttatgttgtttgacgatttcttgtttatgtaattagactcagactgaatgccgggccggtctacctcagttgggcacgcacggttgggcgccagcatgtttttcgactataacttttttctttgcatccaaatccattatattcgcatcattcgaaagcttaacatgtttaaagctttttctatgctattgcttcgcgattagcgcgaccaaccgtaagcgcccaactgagcggttccgtgcccgggcaccccgaaaagcggacaatttggcaatgtgaaattccaaaaaattcaaattcacaattcttttttgatcaaatttgtttaaattatccaatttggcacttaaacatagaaatttaaagtaattttcacaattcatttttcttcgtcttctgtttcctctctttttgagattctttctgtcattttccatcaattatttctttttcatcttctccttttgctcagttttctgagtgcaaattgagcggcgctcaattggggcgaagaaaacagtggcccattgagcgcgggcgagtcagtatggcgatggactggcgaggcctaaaatggaaattctgtcccgtctatttatgtactgtattattgtaacgaaacccgggtgtacggtatgcccgtgattatttgcacattgtcggtcacccttttttggtgcaggaaaatttggtgccaagtttaatcacacattacccctgataactgttattgatcatagagcccggaaccgggatttcggtactgaatcgggattttcgctcaaaaattctcaatgaaaactcatggaaattttctcaaaatattctttttgcctattttcgaattaggtaactaaatgtttttctagaacattgtttatatagaaaatgc

SEQ ID NO: 9024 - DNA, 2127 bp, Heterodera glycines
  misc_feature (10)..(10): n is a, c, g, or t
atagagaaanatgccggctcaataaagttttcttagctctaattgatcctacaacccctgacactcttttgtcggttaattgctgctaattgattactcccgctattttttctccaattttctcactgaccaacaaaactggtgtcatcatgtcccattgctgttgttgttgcctgttaatcagcagttgctgttgttgttgctgctgctgtacagccgcggctaatggcaccgccgctaattgtgccgtttgtgcgcctccaacgccgagcgggaccagtccaaggccggcggcggcactgcccgccgcagttggcacttggccaattggtggcagcggttgtggcggaaagcgcaacgcgttggccagcaacaattgttgttgtacttaattttatttttttgactttcagtacgccgtaaaaattttgagaaatttcggaaattttaccagtaatcaaaccatgtctgatcaaatgtgatcagggaactcttaaatggagctcactgatcagtccaaaaaatctcatcatgtttaatcaccgataggttgtgtgtgaactgtttcgatttttagcaaatcataggctaattccaggaccaaagcctttgtttcggattcaataaaactgattgggttaaattaaaaacatttgatcaaactgctgatcagacttatcattaaattaaaaacatttgatcaaactgctgatcagacttatcattaaattaaaaacatttgatcaaactgctgatcaggcttatccaaattaaaaacatttgatcaaactgctgatcaggcttatcattaaattaaaaacatttgatcaaactgctgatcaggcttatcatctcaaattatgcgccaaaaaatgcggctaaattcataataaatataagcattaaaaatttatacattcagcagttgctgcccggggcaacgccgtgccggcatttgcgcccccgggcgcctccagcagagggggcccaagctggccaagtgttggcaataacggaaacattggccaaaccacgggcggcggcactacaaatgagcgagtgagaagcatgtatgaaatgccaaagcagttttttggattagaggctgaacatttcccgaggaatgtctttcacattattaattatgaagcagatgatcatcggaccaactctttctggtttttcgagagtctcgcttcaaaatgtgtatcccgattccgtttatgttataaaatatggtaaaaaacaacttttactttgccaattcgtactggtatcccttactcgtattagttttccctactcgatttcgttatttaaaaccatcagaatgggcgttatttaaaaaacaatgaacggtctcgagtctcgactcgagaaaagtcttggttctcgcgttttttgggtctcgggatttgtggtctcgagtctcagcattagaaaactcaaatatctgtctagattctcaagtaatggggttttcactctcgaacggcactaccgctcacccgccgccgccgacgttccagcgccgtttgtcgctgattggttggcggtcagtgccgcgtttgcgcgagcggcagccgccgccgagcccaggaagctggcggtctgcacgtacagtccggtaaccgcggtgcagcgacagttgtgcacaaagggcggcacaccaaagtcggcacaactttcgcaccaaccgacgcggaacaaatcccttgaggggcgggaaagggaggagaagcgtcgtcggcttttatttgaagtgccgtttttttccaaagcgaagggaccaacgggaaaattttgctttttttttatttgccaaaaaatgactaatttttaattacgtcaaaattccgtttccgatttccaaaattttttgagccgtcggaattccgattcggcgaaatttcggcggcgaaattatgtcccgtcccccctattttgtgtacttgcaggacagcgtgatcaggtcccagttgcagccgagctgctcaaactgttcagcacgtggtggtgggctgtgccgtcgttgttgttgttgttgttgttgctgtgattgttggtgttggtgctgatgtgcccgagaggactgagatgaacgggggactctagagatccccggtc

SEQ ID NO: 9025 - DNA, 3584 bp, Heterodera glycines
aaaaatgccattgtttaaaatgccttcagaattgagtgttctcctctttcttaccacgctgcctttctttggtgcgagcacttcgtttctccaatgctgaaaatgccaaattaagtacaaaaaaaagcacacaatttggcattacgtcgattgcattgcgccaaatttggtcgtcacgttgatcagcactaccacccgcgccgtcatttctgtacatgtcacagctgacgccttgcgtaacaccgcgcagaatgcccttcatcgactcgtgcagcgcgtccacaaagaattggatgaactcctggctgtcatgttggaacgaatcagcgaacaaattggtacggctggagatgaattcctgaaaaaacggcgagtcatgaaacgcaacaccaccatcaccacggcacactgttcaccacaccttcagttcgaatggcgccgccggttgtcgcaacaccaaaatgcttttgatcatttgcacatattccatgacgagtttgttgttgggcagtcggttttcgctgaaaaagaggggtgaaaacataaattgatggcattggacattggcattattggcacccacttttccatcagaaaattgctgagtgccgtcacgttggccaatgcttggagtgcagcgcccatgtagcatgtgttgccgatgttcataattccgcccacttccttctttttgtcgtctgcttttggtggtgtgctcatttttgcttaaaaaagaaaagcaaattaatttaattttatttgaaaatttgtcaggaaaaaaggaaagggggaagttggtttgaagcagggttggcgagtccggtttttgtaacctctgccggatcaagaaacgctgagtcagtgggtccaaatttttcaaatggattttgccgggttttgaaaaacataaccaaaacattttttggtggaatgaaaaacaaaaatttagacatttttgagcaatgaaaaccataacgacgctttagcgtaagaattaaaaaatagaatggagcagcagctgaagagaattcaaaaatagagaaaggcgtttgttgggagaaattaaaatgagagaattttttaaaaaatggtcccttttatagagaattttggcaatcgtttgcttttcaatttttaacttttcgatcattttgcctgaatttacaggggtataaaggggactgggtcgttttggcgcccacgttttggcgccagcgcgagttttttgattaacttttttcattgttgaccaaatctaacaagcttggtatcattcgaaagcccttcataagctctattagccttacaaaaaaaaaaaaaatttttagcttgtaaaaaagttattaagaaaaaacttccaaaattttggtttttttgttatttcaggttataacttttttgataattgtctaatcacgaaacaattgcttagaaatagcttctaaacacgttaagctttcgaatgataccaagaatgttaaatttggttaacaataaaaaaagttataatcaaaaaacttgcgctggcgccaaaacgtcggcgccaaaacgaccccgacccaaataaatctgtcgaaaaataatccccccttctccatttatccccccgtgtctaattatccccccccctttctgaggaggttgaaaaataatccccccggggggataaaaagaaaatacggtaagttatagccccaccatttaaaaagcaaaccgtaacaaatttgtgctctttccctcaaaatttccaaagaattttaccaaccctctagggtttttttcgattttttcgaaaatccctatttcactatttggggtgtccaggtcaccataaagaagctttctgaccaggttgagagagagatacaatagaaaaacccacaaaaatgctacaaaaaatgccaaaacatttaaacgtcaaacctgtacttttttttggataaaacaagagctcatttttataatatgatctattaaaaaattctttttttcttcttcactcatttccattttaatttaaggaaaaagaaaaaataataatttttcgtatgaaagctaatttgttctatgaaaactaatggcgaaggtgaaggacaatttgcatcaatggaggttggaggcataacagtccttccgtcccgtctcttagcaaatttctcccatattctgtcagtggcgaaaacgaagcgccaacggaaaagaatggatcggatcaattaaatgcaatggaccaatgaccaacaataatttggcaaaacagcaacagcagcaattattgcctaacccttcgctgatacgccgtgctcgattcataagacgtaggacaaccaatgtttactgtgaaacactcaaacaactgaaggaacaggacgccgcattgatcagccaaatattattgatcggacttaagccgaggtgaaaacgaaaagtaaaactgaaattgaagggataggatggaaagagagtcttttcagaggctatcaataagaatgggtttctaaaatgtatttatatattcatattaatttggtaatactatagatggtaccccccattttttcgaaaaaattttttttttgttttttaaagtcatgaaatatgtttccactagttttcggggtcgctgatcacaaatctggtgtctatttcgaccaattacgaaacccagacccgaattcgaacaaaagttcgaacatacaaatttttcggactgtgtttttggttcaaaaccgggctaaatacgcggaaacaaatagaaaagaaactcattaatacttcacaataaaacattatttaagccattttgaaccaaaaatcaaagtaacaaaaagtttgaatgttcgaactttggttcgaattcaggtctggggttcggaattggtctaaatggacaccggatttgtgatcggtgaccctgaaaaccctcggaaacatactttcatgattttagaaaacaaaaatattttttgaaaaaaggggtatcatctatagtattaccttatatttgtaaaaattgataagtacaacaaagacatttagatcggaggcctcggaattcgaatgttcgtgttcgggttcttccagttcgtctgtgattccctccgttgaatttgcgtaacattttcttgctttacagttctctcaaagccttcacttttcctctcctttccatttcatcatcccttcagttgcccttctttgagttccaactttttgctttttccgcccacccttttctatccggactttatgaaggggacaatccaacgaagagaagaacgcgaggcattccaagtgattttgacgaacgaaaagggcgacaggtgagtacaaagaagcgttgatttgtttctttctattatttactgttgctcactgtcaggaagttcgccttttgcttcaaatttcccagaccgcaaattcacaggggtaaacgcgggtcgatgcattcggctgacagcggaatcgacactcttcgttcaattggtgttggatggaattacatggaataattaagaccatacaggcacaaggggtgtctcagcccaagggtcatacgacggacgattgggaagggggggggg

SEQ ID NO: 9026 - DNA, 1361 bp, Heterodera glycines
tagggttgcgtccccgaccccgaccccgaaccccgacatttttggccattttcggggaaaaccccgacccccgacgcttcataccccgacaaccccgaaccccgacccttaaccccgatcggggtcggggttaaatatacacccctaagaatggcattttcgtgggagaaaatgcaaaaaagttagacaaaatttgaatttttttaaccattcgccaaatttttattaaataaagaaaatttgctcgattttggacatttggaatgtgttgtagaggttagtgcatcacattgacattactttctgtcgtgagttcgataccgtttgacgttttcttctttaattattttctttgtgacaaattgttttttttaaattaaatactcatagaaatcgaccaatcttggaatattttgacaaaatacatatcgaagaaaaacaaaaatttaccgaaattcataaatttttttggtgaaaaatcttagaaaatagagcttaattccaaaatttagcgctgcctatcggcatcacagggcccaaaaagtcataaaccttattaaaaaaattggctcaaaatcgcaaaaatttagcatattttggacaaaatctgttaacagatctaaccaaattttcaaaattttcccggcggcgcctgtcggcaccgccggacgccgtaccctttctccttaagtctttagaaaagagcgacgtgaaaaaagatgttttggaaaacaaaaaggtaataaaaaattttaaaatttcaagaaaaaaaaattaattctatacaaaatttctgataaaaaataaataaaaaaatataaaaacaatacaaatattattatggaaattaataaatattatttccgaaaaaatattaaaaaatttttgactatttggcataaggcaaaaattgaaaaaccccgaccccgaaccccgaacgatttggcaaccccgaccccgaaccccgacacttccaaccccgacaaccccgaaccccgaattttccaaccccgacgtcggggacgcaaccctaatttgcactatgggtacgccccagtgtcagacaaaaatgctcataacgccaaatagcgcatttggcgtaaatttttgcccgctatttcaaaatttacactgaaaaatgccttttgtattttttattttgatctgccataactcgtttcattcccaactaaactgagcaaatttggtataaaaaaaaagtttgtgaaaaggagaatctttttataagcgaatgctaagcaatttgacatcccagaaaaaagttgtgatactttcaaatttttatctcgttatagctcaagtcttaaactgctgttttcagcaaaaatgataaaactatt

SEQ ID NO: 9027 - DNA, 1236 bp, Heterodera glycines
atggcccacccccggttaagaatagtttctgattatgagcgaatacctttccaatggccttcgcagccacaaatgggttatccgaagaagaaacaaagtcggccacaatcgtcgaaagggcgtcccattttgaaatcattccgtcaaagagatatttgcaaatgaccgctgacccgtcttcttgaatgaaggaatcaatcaacctgcaattcgtaattgtttctcgtcaattatgtatttacagtttttacttatgagttttcctccaaatggcgaataattcctgcaaaactgtccacaaagtgcgctcattcgattcgtcttcaatgaaacatttgattttgtttctcgcaaaattgccaaaattggactcgaaaactcaaaagagataaatttaaaagaaaatcaaaatttatttgtaataaaagagaaaaccttcgattcgatctaatgaataatacttctcctttatgctgtccaaatgcttcacgtcaccgatatcgatggcgtgaactgtggccggagaataccatgaaaggaattcgtcctttagcttttcaaatgtttgggccttttcatcgtccagtgaatactaaaaatgttgtttaattttattccaataaaagtgcaacttttcgcatgatttcaaagctttgctgaagtgcaaccaatttttggtaacgcatggccccgtcagaaacatccaacaattgtaattcctggtatgcattggaccatatcaatttggcctgagttgacaacacaataacagtctcaaaagaggccgtgccgttttactttaagcacttccgcaagtttgtccactttcctcttggccatgtcacactccaaaaccgcagtcggctgtttggttgagttctcattctgcctaagcattctcaggtgttcttgcaaccgtttgttcaacgcgtcaacacttgttccaagttgattcgtttttgcggcacttccaaacaatgtttagcgtgtggttgttttttttttaggggaacatttttccatatacattttttagatgccctataaatgtgttttcagatattaatgaaaatatgtgttaaggggttctcgaggtcgctgatcacgaatccgggctcggatcagcgctaccgttcactacatgagctgtacatggtcaagaaatgataggcttcctgtaccaatattaccctcattggcaagatgcccatgaggatatcattcgtacccattttt

SEQ ID NO: 9028 - DNA, 1102 bp, Heterodera glycines
ttaccactatgggtacgccccactgtgcagagaaaagcctagtactatctcgtcgtttctctttttctttgtattttctctcactttggcgtactatctcttcattttaattatgtaaaaagcaacatttacttcgctacgtttaactttttttctgtacgttaaatctataccaaattttgcatactgatagagaaaaaaattctgcataatgtaatacagccattttatgttttatacaatttttcaaaagatatatataaaacatgaaaatgcattactttttctctctttttggcgtactattttcacatctctaacacacaaaaaacatcaaattcgtaaatgctaacaattttggttatatggataaaaaatcactttggacatttagaatcaatagagaaattaatagttttagcatttttgctgaaaacagcagtttaggacttgagttataacgtgataaaaatttgaaagtatcacaacttttttctgggatgtcaaattgcttagcattcgcttagaaaaagattctcgttttcaaaaactttttttagataccaaatttgttcagtttagttgggaatgaaacgagttatggcagatcaaaataaaaaatacaaaaaaggcatttttcagtgtaaattttgaaatagcgggcaaaaatttacgccaaatgcgctatttagcgttatgagtagggctggtaaaaatatggatataaaatcgcgaaatatggccataaaatatggaccaaaaaacgcaaaatatggacataaaattgcgaaaatctcaaaatatggacataaatggcaaaaacgtcaaaatatggacataaatttttcaaaattgagtgtaaaatttcttcaaatttattggttgaaattgcatatgagatatatttccaaattttttgactcggtaaggcgctttgacaaagacggctttcgttttgcaattagtcggtcaacattcggaaattggtctcgaattttttcggcaattacgtgcaatcaagagaaaagaaaaaaaacataaaagctaaaatttattaataattggggcgcaaaatcaacaacaaaagcgaaattttcgcttt

SEQ ID NO: 9029 - DNA, 2261 bp, Heterodera glycines
  misc_feature (38)..(38): n is a, c, g, or t
  misc_feature (103)..(103): n is a, c, g, or t
  misc_feature (148)..(148): n is a, c, g, or t
cgagaaattttggcgaaaaaatgatttttgaaaaattntcggttttttgggctcaaaaaggctaatttagctgatgggggcgtttctaatagaggtttttttntgaaaaatgccaaaatatggacataaaatatggaccaaaatgccnaaaatatggaaaaatatggaaatatggacataaatcgcgaaatatggaaaaatatggaaaatatggatatagaaatccatcctagaagcttcaaaccaagctaaaaacatgtttttcgtgcgtttcaggccttccacagtccaggaaaaaaatatggatttccatataattcccagccctagtaatcactgatcagcgaccccgaaaacaattggaaacatattttcatggttcttgaaaataaaatttaaaaaatttacggggtgttcccttaagaaaaaaaaaattgattatgcctaaaattaaatccaaatctgaatgggtgcgcgagaggatcaacagtgagcttcactgctgaaaaccttgagaaatttttggttcgcaattgcaaaaacaaccgataaaatttatgatgaaaaaattttttaaattaatttccatccctaattttcaagttttttgtgcatatttttcgatttttgtgcatgttttttaatttccatccctaattttcaagttttttgtgcatatttttcgatttttgtgcatgttttttaatttccacccctaattttcaagttttttatgcatatttttcgatttttgtgcatgttttatgactttatttgcatttttggtcatttttcgtgcatactatttcttacagccctgtttataaaaatagaaatattcaaatttaagaaattgtaaacttataaaattgagcagtttttaaaaaaaaatttaaaacttcttatgaatagggctcagatttttaagcgcgaaaaagttcaaaataagtgcttaaataagggcgaaaaaagcgcgaagtaagtgcgaaaataagcatgaaaattttcaaatgtatggggtgaaatttgttaaaattgctgttttctcaatgtaaattagttaaaattaagtcaaacaattttatttactggttgcagttagaaatgaagtacatttagaattttcaggatttaagggtccattctcaggggtgtatttttttgaaaatttttaagtcaatttcttaggggtgtattttccccaaattttttttgtcgattcttatgggtgtattttttgtttttattgcatttttgttaataaatttctcaaaaatcgcgaaataagaacgaaaataaacataaaacgctaaaataagtacaaaaacatattttaagagcaaacctaattgaacccgagcagagggaaaaatccacgagggtagaagctaatgtcaatagaattcattgtttattatgcccataacaacaacaaaggacatttttgatgaaggaacagagatgccagaaaagtgtttgtcactccaactaatcatccgattgcggtgcctcaaccgacgggaggtcctcgagagaattggccgaattttttggcgacgattcggtaatgtacgccggcatgtcaccattctcgagctaaatgttaaataagactgattgattattttggaaaataaagaattgtacactttgcttatttgtccattataaaataatgccaattatttgctgtaaatgataggctcaccgaagtgatgacttcgtccaggtacgtaaaaagggggtcccaaatatttcccatggtttctgcgtagaacttcaacacggcaatgtcccaaggctgaaaagggaatatttcaatttaattcaacacaattattttgtttcattctgtgattctaaatcctgaagattttgtataaaattccgaagaccgggtccgaaatcgaacaaaaagtcgaaaatttaaatttttcaatttctgaaattagaaaaatttgaatttcgactttttgttcgagttcggatccggtgtccggaattggtcaaaatggacaaatgatgctttgcgaaaaacgccgaaatcccatttaccaattcattgatagcaaaaaattggagttcgcagaaataatattttttggtgaacccagcctcgttgtcgtgaaagaaagtgcggaccatctctctctgaatatcgaataagaaaaatgattcttaagtattgactacgatggtgcccatttgccaatttacaccacttcagcagaggggatggagatttcggggaacgctaacat

SEQ ID NO: 9030 - DNA, 4583 bp, Heterodera glycines
ggaattaatattaattctgtaataaaagtaatatttttttaagctgaattatttaagcaaaaattaaaattagattaaaaaaatattaaaatttttaaacttaaaacttttcatttgatcagagctcaaaaaaaacaaaaaatatttatttaaaaaatttcaattgctaccgattcagatgaagaaaaataatgttttatttgtacatattataaaattattaattttgtagcggcaatcgaattaagattgattaaatatttgtatacaaataaaatacaattagcaaagaaagaaaaaattaaacataatttgaaaaatccataattgaatccaactaaattactttaaattggaatgaagagcattatttgaaataatataataataaaatatttaataataaatgaatacaataattattacaatgtgaattataaaaatagcaaaaatatctgtagaactaaaaattaaaagaacgatattatacaatttcactcgtagataactgtgcaagtatttattcagataattcttgaataatttaagctaaccgattatgtcttattaataattaaaaataaaatttccatgtaaaatattttcatttaaatataataaaaatttcaagtttaaaaaatgttaaagatgtaaaaacaaaataactataaaaaatacaaaattgacgtattatttgctactaattcagttttacaatgtagcctttttcaatatttttagaaaaaactgtaaattttttgaaaattttgcaactaaatggttattttttgatgcaaacccattaaaaattcctttttttcgcccggcgctgaaatgtgatataacactgcccctaaatcgtcgtgaatttttaaaaatcccctagaaattaaaaaactttcactagatttaatcttaaattattttttcttaatacatttttactacattgatagaatccctgacagaggtgtgcaaaaaacaaaaaaattttcgaaaaacaaaaagaacgaaaactttttttgattcatcagtgcgaaaaaaaattgagaattttttttgttaatttaacaaaaaattttttgtcaaaagtgttaatttttatgactttttaaactttttgttcattttttattcatttttcacatttttcgttcctgttttaggtgcctatttatgaaattttcgtgccaaaaagtccgagcctattcataatttcaaatcgttcctaatttgtcaaatccacccgttgccgacgcaaacagtagaacggcgtgagttaaaaaaactttttaattttctaaaaagaataaaacgaaatagcaaaaaagataatagtaaaaaataattacaattaaaaacaattaaagaaggctaatggtaattatcaaactgaaggactataaaaattatacggaaaacgaaataattacctttaaaaaacagaaatgaccaaagaagattcagctggaagattaatcaaattttaaaaataatgaagaacactcaaaaattgaccaaatatgaaaaatataaaaaaaacacataaaaatatataattcaataaataagatacaattaaaactaaataaaaagttaaaataataattttgatttgataaaaaaattatcaaagaatttattttcatattttaatgagccaaagcaatttaaataaatataatctattaagaaaattaaaaacatcattatattctcattgtacattcatcattcgtgttcgtgttacataaaacggaaatttgtacgtgaatttggaaaaaaaagaataaagttaaaatatattacacaataaaattaatggcaattaaaataaaagaatagatgacaaaaaattaaatttaaaacattaaaaaatggcccaattaacacagagaaaccttacaaattttattaattttttttgcattaatcctgttgaaaatacaattaattaaataataattttaaaataaaccaaaatacttaattaacaaaaacaatttattattaaatattaaactaaatattgctcaaatatcattgataaagctaaaaaataaaaaatgaagctaatgttataaaacctggtttattgcgtacttttagtcatacctttgttaaaactagatagacgaaaaattttttgaattttgcaggctaatagagaaaaagatcagctgaatgttaccaagaatttaaaatttggttgctttaagcaaagttatgccatgttctgtcgaaaaaattgctaaaatagcggattttacgaaaagacccagcacgtgaaaaaaccatcaaatgaaaatttcaacaataaactacacataactttggagggaagaagggacaaacaaagggtcagagatcacaaaggtcaatggtcactatttctaacacctcccttcttaaattctgatcacttcctgatcagtggcggcggcgcttcttgatcgggctgggcgagtaaaattgccgcggcttgacgatccgttctgatctgcgcactgccaattggggaacatcatcagcgggctgctcgggttgttgctgttgctcatcattttgtccacgatcaatgtgaatcggttgatttccgatcactttttgttcatcttcgaagatgaaacgtcggcgcagctgatttgtgtgccggtggacaattcttcctcccaagatcggtacttcaactcgaaaagttggggaatttttaaccctttccaaaattgtgccctgcagccagtgggatttgttgttcctgtaattaaagagtaaaacggggtcacccggaccaaaatcagtgcgtttgctccgtgctcttgtcaaattgattagacatttttgaagcatattcctttttcgcctgtctgatcagtcatgatcaatattctcaattggctctcccctcgggtgaacaagcgacattttggtacggagcttccgtccaaagaataactgatcaggtgagtagccgttcgatgtcgcgttgggagtcgtccgataagaaaggagcgctttctcggcccaatctttgtcgtttttcgagcacttcttcattgcacgcttgaacgtgtcgacgaatctttctgcctgtccgttcgattgtggatggtatggcggggtgaaagtgtgtttgatgccgaattctgtgcaaaatttggcaaaatcagcggaacgaaattgtgttccattgtctgacacaatttcttccgggactcccagtctgtaaatgatcgatcggaggaaaccaaccgtggcctgagaatttatgctcttcatttggcagacttcgggccattttgagtaggaatccaccataatcaaatacacaaatccgtcgtcgcatgggcccgcaaaatcaatgtgaactctttcagagactttgcttgttggcgtccatggagcaagtgtgctttttgtcggatttttctgtgcgttttggcattcttcacaggatttgacggttttctcaatttccgaatccaatcctggccaataaatgtgacggcgtccgagcgctttcattcgcacaattcctggatgtgacaaatgtaaagccttcaatgctcgaccccgtagaattcctgggatgatgacgcgctgttggtacagcaaacaaccttccacttccacgatttcgtctcgtttcggaaagaatggagcgatgtttgggtcgttgcatttgtttggccaaccattctttggcagtctcaaaagttctgagagaatttcgtctttggctgttgcatccgcaatctcagccgctgtcaatggcaattgatcaatttggacttggaatacactgttgatgaagcattccgtttctgtgcaaatgtttgcaatcaaaatgtcttcttctggccttgggtaatttgcgatgagccgggaaaggacgtcggcttgtccaaatgctgctgtgttgacatatttgatgtcgaactcgtaatttgacaaaattaaggcccatctttgcagtcggctcgcggcataaattggtatgcccttcttggaaccaaagatggccagcagcggtttgtgatcggtgagcagagtgaattttctgccaaacaccattttgtgaaatttttgcactgcaaaaacgagtgccaaagcctctttctcgatttggctgtaattgcgttgtgcgctcgacagtgtgcacgatgcgtgttcgatcactttctctcttttgtcggggaaaatgtggctaattgtcgcgccgattccatcttttgaagcgtctgctgcgacgacaattggcaatgacgggtcgtaatgcgtcaatagcagttccgacgtcataatttcctttgccttttcgaaggcttgctgttgttctgcctcccatttccaattttcatcctttttgagcagttggtctaatggtgtgcggatttggcgcatttcctttatgaaacgaccataataatttaatgctccaaggaatgatcggagggtcgtcttttcatgcggtggcggcattttgcaaatagcctctgatcgttttgggtcagggcgaattccttctgcggaaatgatgtgaccgaggaaaagcaattctttttggagaaatttgcattttt

SEQ ID NO: 9031 - DNA, 1631 bp, Heterodera glycines
aaataatgcattttagttgctcctttgtgaggctcaaattcgcattttcacaggacgcattgatttgtgcgatcaatgaagtgatgtcctgatttggctgttgtctgattttgaagcactcatagcgtctgacaaatagcgatcgtgtttcggcgtacaaacttttcaatttgtcgagagtgtccgcccatgaaatttgatcgggttgggtcggacttacgctgtctcggtatttgttgtagtcctcgtccgataattttcccaatagaagacggacttttgtcgcttcaggtaagtcttttccatcgtcctcgattagtgtgccaaaacgtttgaaccattgttcaaatgtgtttgcgctctccgcgtcgtaataaaatttcgaaattcgggcgtcaattgaactcgccaaattggcattgctgaggttgttgttcgctggcactgcatttccaagcagttgctgcatccttgtttcggattgcgtaagcacagcgttcaaaatttgttccaattttgccgcgttcatgtcgaatttttgtcgaaaatttgttgaattttcaaaaccgcacccagcggaaacttacaccccccaggtgatcagtttttttgtcgatgaaaaccgcacccagcggaaacttacaccacccaggtgatcagttttttttgtcgatgaaaaccgcacccagcggaaacttacaccacccaggtgatcagttttttaaaatgtccaatgaaagccgcttaggcttttgttgctgactgcgccaaatttgttgtgtccttacccaaaggaacgacaacaaatataaacaataaagtttattgaagaaaataaaataataaattggtgacggagagaggcgaatatcgattggctttatgccacaataaaattggagaatgaatgaaggaagtccaaatgtggggaagggagccaacattaaatagacagaaatgggggagggaagaagggacaaacaaagggtcagagatcacaaatgtcaatggtcactatctctaacagaaacatattcaaaaaattggattgataaatattaaaatagtaaaatattctaaaatttagaaaatttatttttattatgtttatcattataaaaaatttcactataagataatacaaaacattaacgttcattaaattttcattcccactaaagataatttaaaaaataaaaaaaaaataataatacatttaaaggcttgaatgttaaataaaatattaattagattaagtgcaatttttgaaaacttcattattttatttcaattcatactcaaatttaaaaaatatattgaaataataacaattaaaaattgttaataatttatttattttttcaatgagttaaaaatactaatgaatttaaaaaattatttatcttcttactaaaatatcaaataataggactattaaacgcatttttataagaaataataaacagcttccttaaatatttattgaaatattaaaattgtaattatatatttttaattaaaattttatattatgttaccgaaaataaacattaattattataacacgcgacgtgagaatattaattataaaaatatacatataaaaaataaaaacataacatttatttctt

SEQ ID NO: 9032 - DNA, 3364 bp, Heterodera glycines
tccccaaatgtcgggatccccaaatgtcggaatgcctaagtgtcggatccccaaaagtcgggattgtcgggtccccaaatgtcgggatccccaaaagtcgggtccccaaatgtcgcgtccccaagctacaaatccccaaaagacgcaccacgcttccataaaggaataggaaaaagtgcaatgcgatttcttaaatgagagcactcaccattatttaccaattctatactacccttattcaatgaaatttacaataaatcacctaaattcaatgcctcgatacgatcccgtatccaggcatctgcgcgccctcccatgttttctccattttgatcaatgatcggctcttcttcttcaacaattcgtcggggccaatccaagtgtttacaaaatatatgacgagttctttaaagtttttcatataggacgcattaatttaatcccaaattcccagctttttcatattgatttaccttgcaattcagcagttggttccaaagttgacatcaatgcacaaaaataattgtacacatagtgatctggcacaaatggccttgatttaaaaaaaaaataaaaattatagtctcattaaaacggaaaagggccttttttccacaaaaatgcaaatgaccaaacgaagaactgcactttcaactccaaaacaaggtaagaaccataaaaaagataacgcgaagaacggcgaatgcaaatatagtaattattctcgagtttcgctattatcacaaatgtttggctattgcatatcaccaattttttgttaaggaaatgattggactttccgctcaaactgcttaacgaaagtatatcaaactttaaaaactgttgtgaattcttgtccccagttatataatgagaaaattatatgtacaaatatttgaagtttatttatatttcgtttttgaccaatcttcaaattttggcatgaatttttttcaaaaaactctttagtgtcgaaattactcagtgtccaaaatactcagtgtcgaaattacccagtgtcgggattacatggcaccatttttaattattccaaaatttaaacagggcggggactatatatttttagaatttttagtagaaaaaacctgtttaaaatactggggtcattttcgcgaggccgtttttgcgcgagtgcctgttttagcattagaattgttcagatgttattgtacgaggcattggcataataattgtggtaaaattcattttaaaaattgtaacagtctatatcaagtaggttagtgcacgaccggttattaataaaggcgaggatttttaggggcgaaaaatccaaaattgggacctaaataggggcaaaaaattcgcaaaataggggcgaaaataggggcaaaaagtttcaaatataggggtgaaatttattaaaattgctgttttttctatgtaaataagtaaaaattaaggcaaacaattttattcattgattacagttagaaatgaagtacatttcgaaattttcgggatttaagggtcgattcttaggggtgtatttttttgaaaatttttaggtcgattcttaggtgtgtatttttccgaaatttttttggcgattcttaagggtgtatttttcatttttattaataaattttggacaaaacaccaaaataatggcgaaaatagaggtgaagcgccaaaatagggacaaaaacttattttaggggcgaacattcaaaatagggatttctagggtcgaataggggcgttaaaacgaaagtttttcgaacaaaaagtgtgtttttcgttttggcgcccatttggctggcgccaatttgtttggcagcgcccatttgtttggcgcccatttggctggcgcccatttggcagcgcccatttgtttggcgcccatttggctggcgcccatttggcagcgcccatttgtttggcgcccattcgacagccaccgactttctctatgggtcctttgaaaggataccctacgttcgaccctaattaagaacgagaatctcatatatatttttaaattatttttaattatgcgtcgatttttatgagagcacattcaaaattttttttgactttttcataagaattttatataaatttataggcagaaaatttttttttatactaggcattcgtatgcaaaaatcaacctaaaagaacagctcaaagagcaaacaaataaatatccaaaacaaaaaggataaagctttcccaacaaataattaatcgtttcatttccttcctcaaattatcacttcttcttcttgcgcttatcattgctgggcccggcgggactcgaggacacttcttttgcatcgccacctaaatgaagaacaatttgaaaaacacacttattaataggaatatggaattacaaatacgggatagaaaaatagccaaatattgatgtaaattaaaatttttttttttgataaattatttgtttcgggaggcaaacgatggtgcacccgattttctcaatcccatgcgattgtgggggctttattagagggtgggggcactaatagagagcattatgaaatatttattacggtaattacccgtttccttcgcttggtcagcgcctgccccggctttcaccagtcgcttgacgatgtctttcagccccaacttcgttgcacacattaacgcggtatggccctttgggtcgctatgattcacattggcaccacttttgatcagaagatcaactgcaacagtcagaatgaaaataacagaatttatgatggcacgctgagataagcatcaccgactggcttagtcagggattttttttttaataaaatttaatttaaattttgggtatgtttagaaatgaaaaaaagaccagtgtccagccgggcattgatgttacatgcggccatcagtggtgacatggcaaattgcggcgcgcccaagtcgacgtcggccccgtgtttgaccaacgcttggcacacttcgaagtggccatccattgcgccaacccaaaggggcgtcacaactgaaaattgatggaaaaataaataaaaattcgaatttttccgccgttagaaatgaaaatttgatgggaaatcgatgtctttaagcaatcttttcaaacatttttctgccaaaaaggtgggtaccctcagcagtattacgaaaatctttttttttaatttgcggtaagttatgtcccggtgaagtttcgcccgtcgatgttttgaggtgtacccttcgttttgacccccccccccccggtgtgcgaaggggtcacccttttgaatcactgacccccaaaaagcaattttttaatgaatcttctcactcactggtcatggtggaggaacctcttgcgtcgatgagtttgcgaaggcacatt

SEQ ID NO: 9033 - DNA, 2170 bp, Heterodera glycines
atttgattaaaaatttttttgtcaaccatttgctgtttgaactcacttcttcgcgctccaattcaccgtccgatttcagtgcatccgcttcatattccttaattgtttacaatatcgtttcaagcactgtcacggcattttttttttaaattttcaactttttcatttctgccagcgccgttagcatcaacggttttttttctgaatttatgaataaatccaaaaaaaattgacgtttttgggtgtaaaaccgttccaaatcaacttctagatggtgggccaccttttttgaagaatttttgttcaaaaagtcatgaaaatatgttatgggtggttttcgggttgccgctgatcacaaatctgacattcattttgatcaatttcgaatatcgaacccgaaaatgtcagattcgttcgtgatcagtgagaaacccgccccataaatcacgattagggatcaaatttcaattttttgtgaattttaaccgcaccaaccttccatgagatggtttgcacatgaattttgtagttggttttgctaccgccaggcatggacaggaggaaattcattggaagagattggtaaataaatcagtttcaaatcactaaatttcggatttggggattgattatatattagcaaaaattaagaaaattgaacaacaaatggttttatgtatcggcaatggcgtgccccaacatttgcgcctttgtccaaaatcggattcaaaactaagttttttcaatacctgatcgcctaaacagctttatatgagtggtagaaagtgattgtgtctgataatttggtcgtcaattaatttcgaaaaaaacatcaattaatcaaaacaactgaattaatgctcttaataagctaaaagactttgctttcttaatttttgttgttgtttatgctatcagagcttgaaaaaacgcaactttgaatccgatttggacatagttcatgtagtatgtttggaagtgatcgataatgttgaaatgctgatcaaaacaaatcacgcaggggtggataggttagtcgtaaacaaaaattatgaaaatagtgcccaatttttgccaaatttttttgttggggagggatgacgcaaaaatggagggtgatgaaattcagtacaagtcatacaaaagtctattgacgaagaaaattagagaaaaaaccatttcagtagagattgttattgcagaatttcactggtccgctttttcactgattcttttggtcatagacgcagaattatccttgtgtttctctattctctctgtgtctttaaatctcttcacgttacactctctattgaaatagcttttctttattcttcttagtcaaaaaagcttttgtatgtatgacctgcactgaatttcaaaacccaattattaatgcgttatctctagggtcaaaattttaggtatttaacttcttttctttttttgctcgattgttttgaatattctgatgtcactatccgtcactagaaatcaactcttttggcgccgcttaatccagggtttggatcgaaaatttcaaaatcagaatatcgggtccaaaaatcagattttgaggtcgaaaatcagaacattttgcaaaaaattgctttaagtcggattgtgtaataatttaatcaattaatatacagtcaggtgcaaaagtattgcataaaatatatgtttgttttttgaaaaatccgattttctcaaaaaatgaatggcgtgaaaaagttttatttactccaaaagaaatgtcaattagggcactaataaaccccaaaaactgcactgataagtttcttagtcaacgagaaaatttgccgagtcccaaacaacggtatgggtcaactccgtccgccaactccgtcccagccaagtttaataagccattgttttttctcaattgacctaacatagcaacctttatatcattcaaaatctctgaatgttggaagatatttttaagctatttctaagtgattatacaactcacaaagaagttgtcgcttgaaaaccgcaaaaaaaccaaaaaaactcagaatttttgtatatttttatttataacttttttgtatcattgcgaactagtatgattttggttatctaatacttattaagagcttctgaatcataccaagtttgttgtacttggtaaacaaaggaaaaa

SEQ ID NO: 9034 - DNA, 3805 bp, Heterodera glycines
ccactggaaaatcggaacatggaagaatgggagagatccttccaagtggcggccaaacgatggaaaaacgacggacaaggtgtaccgcaacacaacagaagaccaatgggacgagtcgcgacacccgtcatgtcgtatttggacgggatttttcagcggcgtgccaaagtgccgtccgtcgccagcatgagagtgacgaacacagcgcgagaatggatcaatcgaaatcgagacgagatgggggcgttccccccagcaacagcccatcggccggcactgatgcaaccaaaaatcgaaaagcatcaggctcacgtgaacgacgactatcgggagcgtcagacataccccattcgacggcatgctcgagacgagggagaacatgatcggaagcacgggagggacgaaatcacgggaatgacaacattcgagactgttcggctgcaaccgccgataccgttctgcgtgtagtgctgatcggagtagtgggctcgctcccggggtacttcattcgtatgtcgtctgtctccgcattccattcgagtcccaagactttggccgtcgtcttgccgaggaattccgcatccgaaaagctgttgttgagtgtctcgtcattgctcaagaattcccgaaggttcatccgcgcgtccgcaaacattcgtttcgcttctcgtcctttaatggctgcttcttccgcagtgtccgccgggatgagcacattatccacgtatgtgtcccgaatgagttcctccgcgaagttggagtcgtatttgcgcaggtggtgtcgtacaacggcggcgagacaaaaggggcttggcgtgagcccaaatgcgaggcgtcgaaatcggtatgtcacctgctttctcgacatcggcgatcactggtactcggcatgctcggaaccgaatgagcatgtcggccaaatccggcagccaaactgggcctctgagtaggcagccgtcgagggaaggtgcccctcgtgtgtgtgcgctcgcatcgtagacgacccgcaactttttgggcgtgatcactgcttggtgagggatgaagtgttcgtgtttaccagctccgatcgtcgtttcctcgattattgctgcattgagctgatcggtgatcactgtggtgtactgcttgagcacctcgggagtcttctgcagtcgttgaagcattgtcgttagccgtcgataggccatgctgaaattggtgggcaaagcggggtggcactcccgccatggcaatcgaatggagtagcgcccgtcgttgagttggcgcactgatcgttcgaattgtatcactgcttgcgcatccgcgtcgtctgtcgggtcgtctcttatccagattgcttccaatgaccaaaattgttcaactgctctgatcggcggcatttgatcgcgttcatcttctccgcatggcaaggtcatgaacacggacggagcgggagttgccccgctactcacttggaaccgttcgccgcacacgattggcccaaaaaccgtgtcgacaatgtacgtgcccctttccgttttccgaaagccggtcacgaaatcccagaattttcgaatcccgatcaacagctgcggttgtgttgtctgtgtgatagtcctcatgtcgctgtcgggtactgctcccgactcgatgagctctgttctgatcggggtgcagatcagaggcacttccgccacttcaatgctctcccatccgccatcgatccgcttgagtcgcaagcgataagttgcggatcggatccgctgctttctccctccaaaaacttgaactgttagtggccgcttttcggtcggcttcggtccgagatgttgaattagctcagtctcggcgcagtcaaggtggcttcctggatcaaacagcaatgttgtttggcactcgttcttcgccttcttctgctgctgcggtcactcttcggatcatttgctgggccgggactcggcttccaaaagctgtgaaagcccgttgctccccggcattcgtctcggatatgtctcgactgttcggctcgtctcgtgctgtagtgacgtgagtgggttggtccatcccactgatcagcatcgcgtggttgttctccttccgttcaggttctccggagagccgggattggtttcccggttggttcttccagcacataagccaatgatgatcgtcctttcggcatgcgtcacatcggaccgttcgttggcactgttcgaatgtgtgatcagagcccaggcaacgcaggcatcgcttttgctcaattagtcgcttcctccgttcctgcggcgtcggataggcgcggcattcactcggccgatgtccgctctccagacaaaacgaacaattccccctcccgaagcttggagggagcccattttgcgcgaagcggggtccattcccgcccccgcccgtgtgtccgttctcgttgccgcgtgccactgttcgcccggtgaaacgggcactcgtcccgcactgctcttcttttcgtgttccgttgggctgcgcacgggttttgttggctgtcccgtaccataaatgctctttgaaaggttctcgacctgctttgcctcctcgtcccgtatgatcacgttcggttcggtgatcagtgcgtacttccgggtctttcattgccgccagtgctgactcagctgatcgcatgcaccgcacttgtgccgacaccgctctcctgaaatcgcgcactgaccatttcgagcccatcatgctttctctgatccgcaattccgtgagcagtcgcaccggcaattttgcctccagcaatgggccaaatgagtcgtcgtccacgttcgctccgagctgctcgagttggcacacgcaccgctcaaactcgtcgatcatcgtcgtcaggctgttcacattgtcctttgccggtgccaaatgaagaagccgggcccgaattgcccgctgtaaatcgtccgtgtcgccgaatcgctctttcaaaagttgcacgaccaccgggtagttgccgtcggagggagggtagacttcgacagcccgccgggctggcgatccctcctttaagcagcgcaggagatgaagctgcttctcgaacccgggaatgggtttgtcgtccacagctcgcttgaaataggcccaaaatgtcgtccaatcctcgggctttccggaaaaaatcgccggttgcagccgaacagtttcgaatgttgtcattcccgtgatttcgtccctcccgtgcttccgatcatgttctccctcgtctcgagcatgccgtcgaatggggtatgtctgacgctcccgatagtcgtcgttcacgtgagcctgatgcttttcgatttttggttgcatcagtgccagccgatgggctgttgctggggggaacgcccccatctcgtctcgatttcgattgatccattctcgcgctgtgttcgtcactctcatgctggcgacggacggcactttggcacgccgctgaaaaatcccgtccaaatacgacatgacgggtgtcgcgactcgtcccattggtcttctgttgtgttgcggtacaccttgtccgtcgtttttccatcgtttggccgccacttggaaggatctctcccattcttccatgttccgattttccagtggaggtgggtcgtcccccaccggatggctgttgttggtcccgaatgacccgctcaatcgagaccgcgcgattgcttcttcttcatcctcgagtgcccgtcgcatcgtccttaagtctccgatgtgctcgtccgcaatttgaagcagttcagctggtgttggatggtttcgcaactgcaactctttcgtcgccgccggcagtggcgctgtcagtatgtcgtagaag

SEQ ID NO: 9035 - DNA, 821 bp, Heterodera glycines
agcagaaatcgggcggccgcatgttgtcaatatttgctgttggatttgcttttttgtgtccgattcgcatggcttttgcttttgtgggatattcctcccccctaaaatgttgtgttgatatttcatctctcatttttcgttttccgttttttacacttccattaatttcgtcttacgacaaaggcttcgaattcttcaatttcgacatttttcactattgttttttacatatatatttatttattctgctaatatcttcatttaatcttcgttttttctattctaccaaatatttcttagtctgttttttcccactttttcaatgtgcgaccgtttaacacaaatccaagaccttgtcaatgatttggccaaccacatgtgcaattcggtcggtgttctgcaggcgagtgccgggccgtgcgaatttgggacagctccggaggtgtaataaattttttaaattgccataattctatttactcaaccagcaggaggcccgtagccaaaaaaaaaattatgtttggaatcagatttttgttcgtcgggccaaaaaagttcactagttttacgtcaaaatttgcacgccagagaggaaaagcatgaatttgtaccagttatgcgtcaaaaaagacaaatttttgccattttgggatcaaattttcaggaagtaatggtaaatgggatctgatgagggcccctgacaaaaatttttgaaaataaaaattgcctgttcttgaatttttttttaggaggggggggggggggttgtcttccgctcccattcactacgcgcttcttctacatcatcccactcttcatca

SEQ ID NO: 9036 - DNA, 3474 bp, Heterodera glycines
  misc_feature (35)..(35): n is a, c, g, or t
ccctgttcgggctcgaaacggaatcgaaaaagttntaaattggaaaccaaaaaacatttcattaccaaatgaaaaaaaccctaattttcgagtgttttttgattttcatccactgaatttcttctaattcccttgcacaggaactgaagaatgaacccaactgtcgcctcttcgctcagcaaattgcacggaccgccaaagacatcgaaattctgatcgattctttgcccgccgacgaacaatcggtgcgcaaattaagccatttaagcgtcaattaattaattgtcccttaattatccccagttgtccgtggaagagcatgagaaggcgttgttggagttggacgacgaacgcgcacgggcggccaaagtgcgtgaagcatttgcatttatgggaaaccgataaaaaaaattgaatcagagaagggattaatcggccacagttattcatgccatcgtaaatgtccggcaatatcagaaattttaattggaccaaatttaaaacccgcaaaaatataccaattttttccaaaaaacactttttacatttaatggacacttttggattttcgaattgaacctaactgttatctcaatcatctaaccgagctgtccagccgaaattcaaagttgtgccgtaaagctagagtgcagcgggacctaaacacggacaactgagtaccgaggtcccggttttgaccggggccgggactagtcccgggtttcccagccaaaaattcccggtttttcaacccgaaaaggtctcgtttaagcccaaaattcccggtcccgctgcactctacgtaaaactcataaacgatgggggaggggaaacaatttaatttggataatttatttggtctaatggatttaatttgtttatgcaggagcttgaacaagcagtggaaaaggcggagaaactgacggatcagttgggcgaacttttgtcacgcattgcgcgccttcaaatggaatcgcgcccgatggcattttccacctgaaaacaaccttttcaacccacattttttttgtcgaatttatttgaatattaatacgcataaattaattttattaatggtttacggtatattgccaatttgtatttagtgttaaatcggcaaaagggagtctgaaagcgtgctgatggtttaaaatttagaaaagtttcagatttaaccaattctgacttccaacctaaatttgaacaaaaaaaggaaatttaaaatgagcaattttaatttttgacaggttcaagtttggttagagattagggcaatattgccgttggtaccccacctttttctaaaaaaatattttgttttcaaaatccataaaaacatgtttctgggggttttcggggtcgctgatcaagaatataaaatctatttcaactaatttcgaacccggacccgaattcgaacaaaaagtcgaagcttcgaattttgcatttttggttcaaaaccggcttaagaacaaggaaagcaactaaaagtcaacaatggttcaataaaaataaagatcaaaccatttttagaccaaaaatccgaaattcgaaaatttgaagtttcgactttttgttcgaattcgggttcgaaattggtcgaaatggatactctattcgtgatcagcgaccccgttaccgagattagaaatcggtcaaaagatgtcagattcgtgatcatgcaacccaaaaacgctaaaataatttgtaaatcaaaagggtccctcccctcttttgtttttcataaaatccaaacttttatggacaaatgcaaaaagaataaagaaatacataaaaagtcaaaatttaacccaaacaaaagaaagagaaacacaaaatgaataaatttatgtatgtgttgaataataataaaattgtgctgccaataatgtgaacaattgtcatttttttcatttctcattttgccacccaattaaaaattgtccccaaaatgtaatatttaagaaattggaagggcttcattcaaccagtcaatcgatcaatacacatatttcggcaattttcaaaagggggctatgagggattggcgggcggagtgacggagcgagacgaataggtgcgagtggaagcgctgaaaatgagaaaagtgtgttgaacaagtacttaaaagcagaagtggcagtcagcaggtgatttgccttgagcttgaagaggaagaagcggaccgggttttgccacgattccttgaccgactacggtcccgcgaacgactactacggttgcgcgagcggctgtggtcgcgagagcggctgcgctcgcgcgagtggctgcgatcgcgtgaacgactacggtcgcgcgagcgactcctacggcgtctgtcgcgcgaacgacgccggcgactgtagcggtcacgagagcgggatctgccaagttgagaattgattagatgcaaccaaattggcaatgaacgggcacacctgctgcgcgagcgacgccgacgacgccgatcgggcggaggccgatagcgatgattgaagtacgaatcgccggccgaggaacggatgggcgaaatgtaacgcccggaagtgccacgacgccgagggcgactgaacgaaaaaagcgatcactcaaaagagttattttttgtcaagttgagagtgtgggatgaagccaaaaaagggggatggaaggacaaatgagacgaaataaagtggaaaacggattctgctggtcagtactgtttttaagcgtggcacaaatagttaatcgggaatttaaacaaattgtatatatattaatcaacctattttctgggcagtttaatagtgatgctcgagagtctcggtctcgactcgagaaaggtctcgggtttttggtctctgtctcgaggtcaagtttcggtctcgaaaaatttttggtctcgagcatcactatagttaagtcaaagcacgaaacatttgcatggggaaaatgcccgaattatctggcaatgggacgcatttaagtgaccagcagaaccggcaaaagtgattagaatcaaaaaaaaaaaaattatcgtcgagcaaagaaaacacacttttcgtccgggttttgctgttcggaattgcccgcttcgtctgactgcgatcggaagccgccgccacgaccgatgaacgccccgcgccctccgcgcgcagcgcccccacggacagtcagtcgcacgccgcgcattgcctataaagcaaatggggggaagcagttagaaaaagccaagttgattgaaaactgatcgatcgcaccatttggacgccataagtgaccgagtcttggtcatgggcgaatttgcaacggtcgccgaatttgcaggtgttgtgacgcttgaagaattggcacggaccggcccctggaaacggcgttaacatatacaatgatttatggaagtaattgcatcatcacaatggtttaatcgcaaaattgtctcggtttcccgtgtgaaattcgaaactgacgctccccccccccatgggtgatcaa

SEQ ID NO: 9037 - DNA, 2479 bp, Heterodera glycines
gaggagacaaaagcattttggccaaattgctaaagcttttctggcacagaattcgaataaaaccgagcagtgcgctgttgcgcgatggctttccacgggtgctccccagcggcagcgatgatgcggcacaagagcaaccgcagcagcaaaggcaccacgcgacacccacggcacgcggcacgcgtcgaaacggcacgcggaagggcagcaaccaaactcagcataaaaatgccataatcgcaccagcagagacgaacagctgcagcagcattgacgtggcgatgatggatatggacggagcggacgaagcggcgacacagcgccagcaacgcggacaaaggcaagtggtgaagccggagggggtgttatgggcgggagggagagataaagctgatgggagagggagaggcggcgggggagggcgacgtttccggcataattttgccgatgattcaacttccgcaattttttgagttttatgtcgcttaatgagccatgaatcggaccacttttgtgcctgtttagtgccgacttccctctgccagacgccttttcggcgtccgccggcgccgcccttccgcgcgtctctttgccgttggatgactctttggacgaggctttgttgccgcttgggttgacggtcggtgctgcgcgcttcctttgcctttgtttcatttcactttgcttcaggtgcaacatgcactcaaattccaaatggactacgaggcgcacaattcggtcccgtcccctttaatggcatttaattgactttaattgattgtacttttaatggcatttaattgcctttatttgcttgccatttcaggaagtgttggagtgtttgcgccacttgcgactcgaatcagtggagaatgtgtgggctcgtttttgggccggtgcctccgattcggacaacggccgaggcaccgccggcgcggaggaggaactgtcagtgttttgttgttgttttgttcgttcgctgattgttttgccaattcggcagattgcccgggggtcatcagatgcaattgtgccgtgatgttctgtttcggctttgttctgtgccgcaacttttggccttcgtccagaacgtcgacctgtgcttctaccaattgctgctcgaccaacttttgcccgatccgctccgtccatctccctcggctggtgcgtctcacagatttggccaaggataaattcaaaatcagtccgaccgatttggaatttatcaaatcttgagagattttggcttccatttttcactcaaatgccctccctcctctgctctcagctcacccaccaaatcggcttcaccttttgttaccccaaatgcgtccttttgccaaaaatctttgcgcttcaatggccaaagcgttgggcgccgctgctccgtccgcgctgcgtgagctcaaattggccggcgtgcggcttctgtccaatgcgatcactcggctcagttcggtcgcccatttggcggtcaccgcgcgcgaagtgctccaaagcgacgaacaaatggcacaaatgcacgccgacttcgccaggtaaaacgcacagaattccaacattttcaaatttattgcattttcaggttggactttgctgtgctgcacgaacaggtcgaggttcgtttattgccttgggaaatgttcgtttttttgtcctttctttcgagagtctcgacttcgtttcctcccctttctttcactcctttctttcctttctcaatttgcttcagtggtgttgcgattggtcttctggttggcttcgttcgttggaggaacagttcggtgccgggttgtctcagcgccggcgcttggaagaatgggccgattggctggactgtctcgccgcgcgagtgctgcaaacaccggcaccgcttacaccggcgcgttccccgcaggacactccgccgacggcgcccgaggcgcaattcgtccgtggcaaacagttgcttctcgcgtggaccttttggaggtgccaaaggaagcaaagagcggggcgaatcatcgttttttttgcagctctttggtgctgcgcgacttcactctccgctccgccgcctctttcggccaatttcacttggtaaatgccaaagtcggtttgtgtcaatggcatagccttgcagatccgtctgctgttcgacgactatttgtccatttcggttgaacgccgtctcgcgcagctcagcggacagccggcgatcgccttaatggcacccgaggcaaaaagtcgacaaagtacctttatataattaattttagtggctccaactgcgcccatcgcccctttcgctgcctcctcagccgcaacagtaccccgcgctgctctcctccgcccccctttttttccgttcccatccgcccccgccctcctctgtttcggtgtacgccccgccgaattttccttcacctccgccaacgacgacaatttctagcagtacagcggcagttgctgttcagcaacagcccttctttgctgggcg

SEQ ID NO: 9038 - DNA, 2565 bp, Heterodera glycines
caacggcacggacgaaggagtaaacgcttcagaagactgtcgaggcggcggaaacgccgacggcgccattcgttttttcggggtcggcgaaagggacggaggagaaagacgaaggatcaagcaggagcaggacgaagccgaagatgaacaaacggcggttgttaggtgaaaagatgcaaattgctgggagtacttcggttttcatttcccaaaacattccattcgatggcactcattcattttatattttttgataataaatttatgagatcactttcattcgctcccattgtcctttgttggtacggtatttttagccaacagtggcagtttggttacggtgcgtcttcgacttctccgtctgccaattaaaccaccgaatggccgtcggaagcgattttgaattagcgcgggtcgcatggacaaagccaaaagaaaaagagacaacgaaactgaagaagggaggaaaggaagagctctgctggtcgggtggaagggcgcacttccgattagcgaagcacagaaaagcaccgaaaaaaacacaggaccaaggcacagccgaaaaagcggcggcatttgatcatttggccaaagggacagaaacaccgcgatgggttggcccgtgaacagtgccgaacaatgggactgagacggcagcgaagtgtcggaactttccgcggaaaaagtcccgtaaatgagcaaaagccctaaagggaaagagaagcgatggacagagagcgaaagccgaaccacgaccattctccaagaagagcagagaacacagagccaagcaggcaaagcaactggagaagagcagcaaaagcgaggcacgatcatttggacgggacctttgacaattaggggaggcaaattagggcaattagacaaattaagggaaattaacttgttaaattaaaaattcattggaaattaatgcaaaatgatcaaaaccttgcaacgataaaggcaaaaactgcacaaaacaccgaagccaaagcggaagaaacggcgaaacgcgactcggtcaaaacattggacaacgcgtcgacgccaagcagtaacagggcgaacagcagatgaacaacgcccatccacaagaaaagggcacgagaaggaggcgaagatgggacaattttggagggaccaatgggaggagaaaagttattggggagggcgaggggaagagagtttggggaagagacaacggaagacaaacggaggggagaagagaggggacagatggaacggtctttgacactttggcccgaattgggaaggaaaagggacggatggtcagcagaagaagtagcagcagcaacagcagaagcggaggaagtgcggaaaatggaaaggtaatcgaaggacgaacgggcggaaggaagctcaaaggggacgtgggcagaagaacaggaagaaggaatcatctgacggaccaaatgaaaatgaaaatgaaaatgaaaatgaaacatttcattgtttgggggggaaacttcgaaattcgaatccgtccttgctgaacatatcaattgatccgccgatcagtgttcgttctttcgctgtgccttatcaattgcgttgtcgaacatttgtgaacaaatgaatccgcttatttccgccccccattttttcaatggcaaatgcttttgctttctttgccttctctcaaatgaacatttgtgccctttaactgatcaattagctcataaagttctttcttcagcagaaatccctttgtttttccgattgttaagtgatgaaagcttttggcaattgcccatggaaagcattgacaacggaaatcacttcgaatcccacaaatccaattaaccaattaattggtctgtccgggttgcccaacggaaattcacaataaggagaagcagcaatgagaaattgacgacaagcatattttaaaggtgacgagagaggaaaagaaaagggtaaaaggaccattcgaaaggggaggagagagagagagagagtgataaggggagagggaggagagaaagagagtgcgtggggagggggagggggtgtaggtaaagagagtgagaaaaacaattagaggggagagcgagacgagtgagaagcaggaagagggagagataaagcatagtgtggagggcggggggagggcaggaaaggggaaaaaagactttgtccatcgcctgaacctccaccggtggacggggcggtgtccctttgtcccatgtgccatttgtccatcatttcccttcccctccccctttgtccttttcgtcattcattcgcttcagtttttcccacgatgaatagacagacatatttatagaaaagaaaaagggttctgaaatggcgtggcaaagcgattttttttttgatgagtgatcctttaagggagaaagacaatggtggggagagagaaacagacagttagagagagagagagagagagagatgtgagagagagagatgagagagagagagagagagagagagagagatagagagaaagagaaagagagagagaaagaaagagagaaagagtgagaaagagaaagagagagagagagagagggagagaga

SEQ ID NO: 9039 - DNA, 1684 bp, Heterodera glycines
  misc_feature (781)..(781): n is a, c, g, or t
cataattgtacttggagcccaaaattgggccgctgtgcattattattattttttaattatgtaaaagttgcatcgccgtctttcatttttatttattggatatttagttcacccaattttcatgtgattgtcattgtttataagaaacgtctgcgtcaatacaattaatgaaaactgctcttcttcagcagatcttttgtttgtgttttgcagtgttacaaatacattttcaatttaaaccctttttaatttaatcattttaatttacataatttttagcgagtccgcaatttcatggacaacatttccccgcattaaaagagttggaaacaccgacaaaatagagcatatttttatttttataaataatcattaattaatccatcacattattcaatttccaattttcaacatttttttcggtgtcttcaaaaagaaaatattaaacaaaaatcacttttcgagcttccctcgtaaaaagttaacttcaaaaaagtaaaaatatataaagtcagccacacataaaaatattttagcgctttttcttgattatggcaaattataaatgttgttaataatacataaatttcgtttaaaatttttctaaaatggttaataatacataaatggcatttaaacatgtgttcatcattcattcattgtcaggtgggacattccaagcccgtgatcccctcaagccatttctggtcaattgggacgtaataatttattgagtctgtgaaaagcaaaaaacaattaatttagcagctttcataattanacagataatattttaaaattgaaatgtttttgtgtcatatttttgccaagttttacttttgttctctttcacatcgcatgagccggccgaaaggatggcaatttggacaaaatgagtgccattgctggccaaaagtgctccgccgctgtccccctcaaacagaaaagtgacaagagaaaaatgttggggtgggcaaatcatttttaaattataattataaatattaattatttctgtttttgtagaatagaaattattttttttttccaatttaaatttgttttcattttttattatttagaggcgttttcactttcattaattccctaatatttcggattatcccacaaattgcctgcatgacagtgttcgactcaacacaaatgttccctttgctgtcgctaattgattcacagccaacgatttgcactcggcgaccttttagcattttggcattcctcgtttcgcccttacaatcatctaaaaactcatcgactagtcaaccccccgaaaaaaatggcacaaatgatataccaatcgattcgtcttgacgagctatgcacgaaaaagtaggtctccagttgcggaaatgccagaaaaccggtttttgaaccggtttaaaactcgaaaaattgagtgaaaaaggtgggccctgaccatttaaaacggtcaaattcggacaaatttggtatcattcaaaagctcttgatcagctaagtctaaaaaacaaggtataaattcgaaccgatgacatctaggcactgggacaactgagtccagtgaaaatggacacttcagtacgaaagaaataaccatttaaaagcaaaaatttcgcaaaagggaacatgcgaagacggagcaagtagtggggcgagacggaagacgtctgacgagcgccacagg

SEQ ID NO: 9040 - DNA, 1079 bp, Heterodera glycines
tcgactgtgcgacggttttttagcgcaatactcgatattctaggataaacgattttcatgcattatataagaagaaaactttttttattttttggtactgaagtgtccattttcactggactcagttgtcccagtgcctagatggcatcggttcgaacttataccttgttttttagacttagctgatcaagagcttttgaatgataccaaatttgtccgaatttgaccgttttaaatggtcagggcccacctttttcactcaatttttcgagttttaaaccggttcaaaaaccggttttctggcatttccgcaactggagacctattttttcgtgcatagctcgtcaagacgaatcgattggtatatcatttgtgccattttttccggggggttgactatagtatatcccataatttgaatcaatttaaaccaaataataattcatggtatcttgcaatcgctctaggtgttctctatcagaatattaatttagaaattttattttacaaaatagtaaaaaaaaaagttatggccatacattttcaataagtcttgagtcaaatttgtttgaccaggacttttttgaaactcgatgaaattttcttgaaattttattatttaatagattttatagaggaattgaagttcttaaaagaaatttaatctaattgcttctgaaaaaagttataaagcattgaacaagctattttttgacatggtcatgcaaatataattataaacatttaaattttaaagtccttaaaatgacaattgagccaaacttaattaatatcattcgatagctataagaattctctattatctttaaaatttcaaaaaatttcattgggtttcaaaaaagttctggtcaaacaatttagactcaagactattgaaattttatgaccataacttttttataattttgtaaaattaatttcgaaattaaaattgttattgagaacacctagagccttgaaatattaatttagttgaaattgagccaagttattaatttatatattttacattttttattttcctacaccttggcggtttttaggaaatgacccagcac

SEQ ID NO: 9041 - DNA, 2669 bp, Heterodera glycines
cccctaagaatcgacccgaaaattttcaaaaatgcacccataagaaatggaaattatttcaaaaaatcatctccaaaattaatttaattattttattgacgataatttttgattttgaaaattatgtatctcattaatgatttggcataatatttttgctttttgaagaaattttcgattttactcccctaaatttgaaagtttttagcaaatatttacccatttttagcaactattttgggggttttttagaaactaaaaactaattatattggcagtttttagcaattataaattggagccctagttatgactagaggaactcaaaaaaccttggtttttgaggccataacttttttgaaagttaacaaatttttttgaaatttggcagactaatagaaaacatttagtctatcgtatgatatcgagaattaaaattggattgtttagagcaaagttataagcaaagcatttaaagagcatttaaattgtttttgttttttacccaaatgaaagtattttccctctttggttttgtcaaaacaatgcgcggctaacagcacaaattccggcgaaataaatgtgctagcgcaattttgaaatattttcattttattttgttcatttcttttcactaagccttgaaatagcactgtccacggcacagtttttatgtcaatttcgacaccgccaaccatctgaaaatatgagggagagagatttaaaatgaattctttaattgtagggccaattttgaaattggaaattgaatttcaaaatcaaaaaatagccaatttcataattttagaatttaaaaatatttattttaaaaattgaaagtcaaataataatttttttaaatcattttcaataaaatctcttaggtttttcttttgattttttatatgttttaaaatttatccattatttaattaatcttttacatattttttccatttttttaccatcggccgaattcctaaaaccccgtggagtttggcagaagaagagaatgtaacacacgcagaagaagcgtatttacaattttcacactaaattaaattcttttttttattttttactttcaaattttaatttatttttcacctccaattggcaatttttcggcttttccattgaaatttccgttgttttcggcccaaattttgggagtatgtccaacccgagcagccaaagtccggcgtaatcatccaaaaatgggccaaaattaaattggtcggaaaattctttgccaaaatcgagcaacggtttattggctaaattttcaattttttattttatatattttctttccatttattactttcatttaagttaatttgtgccgaacatttgttggcatcgaattgaatttcgattttcgaatgaggcgttatgctaaaaaatgtaatgaaattgatagtgaataatggtaattaaaacagatgataattagaacgagcagttttttttataaaaccaaatttattgaaaatgtttaaccgagtaaattaaaaaaaagaaatgaaaaaaagtatttcattcatttgaatttgaaatttgaagataagatattttcctaaattttaaatttaaaagtcactttttgttttattttttatttatttactgaatttggtaattccgttttaactttactttttatatgtaaaaataaattcaataagttttaagcatttggtcacccacttgaagcattctcttcccattgaaaattgcgtgccattcattgcaatacgaacttttttgccacattttccgcttttatccaacaaataggaaaagaagcgaaaccgacgcgacactttccacgggaaattctcttcgccggacaacacacttttgtagcacatggccaggcttaattaacaccccaattacttatttattggctttttaagccttaaaaccctttgcaattgccgcagtttttcagccgaatggtccgatcagtgccatttaaatccaaaaacaattttcttaaaataataataatttaaatgtgattaattttgcaaagaaacttcttttctccattttcagcaaaaactttttcattggagataatataataaatgagcagcaaaaaatatatggaaaaaggcattttatttttacaaaattggataaatggaaaatttcaaatgttttgtggtgtataaaaattattcctatgattcactaaacgacggaattttatgttggacaattttaaacaaatgggaaattgaatattttgatactaaagtaaaaaataaaaatgaataaattgcatgccttattgtttttgtcaatgatgtctaatcaaaattgaaagtcactaaatatttaaaaaacaatttattggttattgactgaaattataatccttaaacggattatatgactttgatcccatcgtttgtcgaggcatttgccatctgattgggagtagaaatagacgtaatttgacgatagatttttttctgcaaaaagtgtttgaaaatttaatggccgactgactgataaatagggatttatgaaaatccatattttttcctgactgtgcgaggcttgaaacgcacgaagaaacaataagaaaagcggctattacaataattaattagtaagatgaaataattaaatgataaattttcccactgtttcta

SEQ ID NO: 9042 - DNA, 852 bp, Heterodera glycines
cttcgctcgcgcacctcgcgctagccgagctttgaaaaaatttattatcttctctctctctctcacctctctttctttctccctctcctctttttctctctctctctcttcctcctcttttctatctctctcctcttctctccctcctctttctttctctctctctctctctcctcttttctctcccttctctcctctctttctttctccctcttctctttttctctctctctcttcctctctctccttttttctttctctctctcctcttctccctttctttctctttctccctcttctgtttctctctcctcgatttttccaataatgaagaaatatgtgctcgctcataacacaaaaaagacgtaaacaacaaacaaaaaagaaaagaaaaaaagactgaactattttccaaaaggaattcgtttcgataaattgtttacttttaaatgtattagttacagcgcaaaattaatatatagatagcccgaaataaggacaaatcttacaaataaggacatttttattttgtaagatttggaccctccaaataaggacaaatcttataaataaggacagatacgcgccctgggttaaatatgcacccctaagaatggcattttcgtgggagaaaatgcaaaaaagttagacgaaatttgaatttttttaaccatttgccaaatttttattaaataaagaagatttgctcaattttggacatttggaatgtgttgtagaggttagtgccattgacattactttctgtcgtgagttcgataccgtttgacgttttcttctttaattattttctttgtgacaaattgttttttttaaattaaatactcataaaaa

SEQ ID NO: 9043 - DNA, 2633 bp, Heterodera glycines
  misc_feature (42)..(42): n is a, c, g, or t
tgatgttggatttagtcgattttgtcacgaatgggttgcctnttcttcaccaaattgtcattcatttctgtccttctccccaatcgctctttttcagttaatgcccgcccttcgctgtgtggccgtcgaacgccgcgctctcagccgtccgtttggccgtcgaacggacgaaaacgttcacattggcaccatcgacgcactgcggctgtttcgctgtcccggcaccagcgaggacggccccattctctgcttgagcggcgcgcgcgaccgccaaattacgcttcggaaatgccaatgcggcgaaatgccagcgtcggtatcctcaccaaatgataacgtaagaagaactcacaataactcaaaaatgttgacagaaaaatggagtatggaattgtccaatggacaacccgacaaaaattgagtcaatttttagaaataaacggtcaatgcttacaaaaataacaaaattttggacctatcacatttgggtgcacaccaaaacgtcgccgcaaaaaaaataataaaaaattttcaaaatttcaagaaacttaaaagtattttagctttatgaaaatctaagattaataaaaactaaatttgctaaatttccggaaaaaaacaaaaaacttgaattttttaactttcctttaattttcttgataaaatttttttttgaatttttctagaattttttttgtttgtattaagctagctaactaaatttttgacaatttttctagatttttttctaaaattattttgtttattcataaaaaataaaaaagtcatcagaagggcgaaaccacttactctgacgactattccggtaaatgtgtcgtagagtaagtgacaaaatatatggatgatcacaggaattaaaaaaagacaaaaatatgtgaaaataaatgtgtgggtaaatatgagaatagacagcttctcccctccattaattagacaatatccaaatttaaatgggcaattaataaatatcaaatttagcagaatggtcccgtgaatgaaattgcgcgcattgacaacgcccacacgggatggatttggtgcatttcggtggcccccgacggacgccaattttattccgccggatgggacgcacaaattcagcaatggcacttggccgaaagcagaatcgaggcacaacaattattttttcctaattagctttaattaaacaattagcgtggccttgcgctcaatttcccctctttggccgcgctttggtgcgttttggaggatcaaaatgtgctgtacgccagcacgtacagacgtggcccaattctgttcgacttacgggccggcacccatccgcaacatgagctgaacgtgcacaacaatttcccagtgttcgaattggccacgggggtcaggcagccggggagggggcggcaaattttgaaatttaattttaaacgctggccgaattttcagccaaattgcaaccaattgttttctattggtgaggataatcggctcgtttcggtggacaaacgacgcttttcggttcgcatttctgttgatttattctttgtccaaccgattttccaattcattttaccattacccaaattccattgccattggtttctttccgctttttcggcattgctttctgaacatcgtgcgcccgtcagtcacgtggactatgcggacgggcatttgtgcctcagtctgaggaatgggcagctgcgcttcttcgaccccggcacattgcaaatggaaaatgtgcggtaaaatgcaaaaaaataaaaataaaattgcaaatttgaaaaatcaattcagcaattgactgtcaccaaaacggaccaaggcccatacaacatagtcaaactgacgcggggcgccacattctgtgccaacaagtggtcagtaaatggtggacgaactaattatgtgtgtcataaataccaattaacaggaaattatttttcatttttttaacaattttgtttcccatattaaacaaattcatatttgcaatgagatcgtcgggttggatctgtaaatacatcttttttgaacatgtccaaacgtaatttgaaaaaagccaaccacttccttttggtggctaagtggagcatggatggtttggagtgggcttttggcttgggttcgattccgcattatgtttaaataattagaatgaattgttgtcccaatgatgaaaaccccagctttccaaagtaaaacgatgtcgaaactaaaagtgttccctaatcattgttatctgagggacattttttcatttttttaaaattcaaatccctttattatctattttatttaacaaaatttatttattttcggttaatttgggaaaacaaatagccaattttcgcttaaattgtgccttccgtcctctcttgcttataaccggtttcttccccttctgtccagtgacaacatgctgcgtatgtacactcccggccttcgtcctcggctgatggccagcaccaaacttgacgcgaatgtgacccgcttggacgtgctcgacggcgcggtggtggccgcgctgagcaccggcgcactcgcttactttcttgaccgatgaaaaagcgagggaagaagagaacggcactgacgaagcgatgcctggaattgggccttttgcgggcgaa

SEQ ID NO: 9044 - DNA, 3404 bp, Heterodera glycines
  misc_feature (3183)..(3183): n is a, c, g, or t
aaaaacgattttaaagcgccggggacaaaaaaaataataaaatttaaaaccggaaaaaggaaaaattctcgcgagggatggcagtgaaagtgaacaattgccacaccattcatccgcacccattcaactgctgcaaattcaattaattaatattgtaatgagttggccaataaatggaccgtttttatcgcttccgccgtttccatccctccaaagggtcggcaaaataatcggcgccggccaattggacatcgtccagctaaaacattatttatacattccaactttgctaattgcctctctaattgatccgctaattaccctcccttccccttttacttggccgcctttctcttccttgccgcaggcgctttcgcaggtgcggaaccctctcagctcaattcggccgaccttaaacaatggacatacaaaaattagaacgataaacatatttcaactttaaaaaaaattaaaaatgtttatttctaagttcactaattgatcaattaattaattgtttaattaattgattgattgtccgtcccccacgacttctctcgtcgcgtgtcgcccgtgccgtcgccggcggtgccgcaattcttttgctctgtcggcgaatttgcgcggccttcggagtaagcgaaaatgaaaagagaaaggggcggaggaggacatccactgagaaggggtaattgagaagaaaatgggaaaataaaacttaaaatataataattttggggaaaattaaaattaaaataaatataaaaataaaattataaataaaatgcaaaattaaaaaatatattcggaaaaaagttaatttttaacaataaataaaaattttaaattttaattaaaaaagttataacaaaaaaataaatatttgaaaatttaaatagaaaatttaaattctaaaatatataatttataaatttaaattttttaaaaaatgaattaaatggtaacgcacgggctgaagcttatggcacgagtccagcggagaagggttggccgagtccaaaaactgtttcagcgttgtggtggccaaaaatttgtccaacacacaaatgccaccctcggccatgtgacaagtgtacattaaaagtctggcaaaattggaattgaaattggaaataaatttaaaaataattaatgagagaaaatattttaaacaaaatttaattttggagccaattaattttgactgataatctgatcaatttattcttcttcttttctgcccatttttagcattaaaacgaaaaaacttaaaataatttttacaaaaatttaatttttcttattcatttcaattttgtcatattttctgctttatgttttcacttttcgttttgttttgcctccatttgcaccactttcccatgcccacctcgtccgttttccctccactcggaagtgcgcctccatgcattggttgggccgcagcagccatgtcgccgtgcgcacgtgcatttgcgtttgattggcacggaatgccaattcggcacggggcccaacgacgggcagctgagaagggaaagggtgggcgaaggtcaaacagcaaaatgacaaggccaaaaacgtctcattatcagtcagaaaatgtgccaaaaaatattttgcaattcgaaaatgtgccgaaaagagtaatttaaaaaatatactaatcaatgggacagcaaaaaagcatttagccggcatgaatgactatcaaaattttgatccatcttaaaattttgggaaatgccgggaaatggcagataaaatttatttaaaaaaaccgcccataaaacccggaatgctaaaaattcttccattgcgtcaatcacttcttcaagtgggacagccttctcggcgcttggccatcgccaatcggcggacaattcgcccggcgcggcggtgccattccttccgccactcgtcgtccgcacgtcgtcgcttttgctggtgtcgccgtttcgctttcgcttcgctttcgcaatgcccttgtcgtgcactcgcttatgtctgattctgaaatggcactttgtccgctggtcatccttctaattatgtgcccgtccacctgaatggtcccagttcgtccccccatggattatgccattggatttgatgccgtcgccgctgtggcgaagcggcgttgtcaccaccagcggagggcactgctgaaagactgtcgatggaataatacaacgactgaggcggcggtgccgtcgccgcagtcagccaaaaaaggacaagaactgcgctggaggacttcattagcatgccaatggccggaagaccaactggcaaaccgccggcagcacccggagggcgcaatgagtgccaattccgacgatggcacattccctgcgggtgggaaatgggctaattagtcaggacgggttggaccctacggtgggaaaaactaaaagttaaattcattgaattttattggaatccgagacaattaattatacgccttggaaaagcaattcaggcaaagtaaaacgcgaatttcatttttaaacattttattttgttgcaaaatgctgcttccctccccccccccctctcccaccactccaatgtttccctccccccggggctttgtgttggattgtttcgcagtcgccccgcggcgtttttattatgaataagttgcccccccccaaggaagccaaaacaaaaatgaaataataaaatgaaataataataataatgatggtgatgatgatgatgatactaaagatgcctgttctgttgtttcatgaaaaattctgcattcatgcacactgacgccttttgaaaattattattctcccgaagaaatgattactgaatgaatttaattaaaattaattaatttaaacgaaactcattaaatgtttaataaaaatgaaaaaaataatatagaaaatcacttagttcgccgggatccgaacctgatgacccaactcaccctcagaatgatgcctcagaatcctcatttatgcagggattctgagtccttaacgttgtactaacaaccaaaatctaatttcaaattctgatcagagccctaaataagcaggaaaatttttccactcgaaaaccatatgaactcactttggtcccgaatcccaaaatgagttttattgttaaaactttcttcaaaaaaaagataaaaaaatcttaaaataaataccctcttataattangggcaaaggaattatatgcattatacattgaaaattgcgaaaagccgaaaatttttgaagtttttttcttaataaaaattttttcccaggcttgaaaatctttttcgcttttttgtaaagaataatagagaatgttaaaagttttcgattgatataaacaatgttggattggatgccaaagaaaaaaagctatcggtgaaaaaacgagcttggcgcctaaa

SEQ ID NO: 9045 - DNA, 3179 bp, Heterodera glycines
  misc_feature (3142)..(3142): n is a, c, g, or t
  misc_feature (3159)..(3159): n is a, c, g, or t
ttttgattgatcatctaaactttatttcgcctttcttgccactttttactctgacatttctatttattaattgaaaaatagccttacatcaattcagatctcctatgagaaaaatgaaattataaaacaatgccataaaaataatacaaatgacacaaactgttaggagtcaactttttgaaaatttaaaaagcgcaataaagaaactaatttactttagtattataatattatctcattttaattaaaattgactcgtttcttaaatacaatgaaataataaatagggactccatttttaggcacaaaaaatcgcgaaataagcacctaaaaaggcggggaaaaaaagtcacaaaaatcctcaaataggcaaataaaattttttgttaacactttttaggtagcaaaacacataaaaattttcaattgtaaatgaaattattattagagaccgcaaaaaaaggcaccaaaaatcgcgaaaaagacactataataggcacgaaaaaattgaaaaaaagcacgaaaatcccgaaaaaggcatttaaaaaattttttctaaggttttagggagcaaaacacgtaaaacttaaccaaaaacttaattttggtcatttaaatggttattaaatattttataatgtttttcgaataaggaaaatttttaaaccgagaattttttttatcaagaaaaaaatgaatttaggcgatcaatttttgagaaaatttttcaattcttaggggtgtattttctgaaaattttcaagtcatttcttaagggtgtattttcccgattttattctatttttaatggaattttcggtaaaaacgccaaaaaaggcatttaaggcacgaaaatcctgaaaaaggcaaaaaaaggcataataaaagtcaacatagaagcctcaaaccaagtggaaaatgtgttatttatgcttaatatatcgaaacaagtgcgcagaaaaaaaggcatatgcctcaaaatgcggtctctaattattatatattttagttttttttcagaaaagaacaaatttgaaaaccaaaattttttatgaaaaaatattaaattttgtgggtctagttttgggaaaaattttcaattcttaggagtgtattttctaaaaattttttcggaccatttcttaggggtgtgttttcgtttttattgcatttttgttaaggattttttcaaaaaccccaaaataggcattataaaagtcatcgtagacaccccaaaccaagcggaaaatgcgtttttcaagtgcgcaaaaattttggcatttgcctaaaaatggagtccctattaataaaagacaaaatgaaaattagaaatttttaaaaatttcaaataaaataataattaaaattattcccgttaaaattttttttcagaatttattaaaaaatgaacgcttttctgtctctgttcggcattttgctaggccttcaatttcacgcacaaatcgtttcggccaccgttacggcctcgctaaaaactgcgaccacttggaatggtggtggccaatacatggtgaacttcaagaacaatgatggctccaaaacagtgtgctctgtcaaattctctctgactccaaaatcaggggtacggtacctactgatactattgattaccaaagtttaataatacttcaataaatatattaggactggttaataacactaatcactagggtcataatttgtatgcattaaaaatgccaagtatgcgcataaaatatgcactaaaaattcgccaaatataccctaaaaacacgaaaaatgcccaaatatgcactaaaatatgccttaaaaaactgccaaaagtggtttttaaccttcaaaatgccaaaaattgtgtgtataaattaagaattgacttttaaaacaccaaaacatgagctaaggagcattttttagacaattgcaaaaatattgaatttccaaatttgtaaatttttattatatgtaaaacaaaattacattttatatacataaattttttttcaaaagttcttacaaaaattgaaaattttttcgatttttaagggtgtattttttaaaaaaatccaaaaagtcgatctttagggtgtatttttcgcttttttcgcatttttcttattgccaaaagtgaccgaattatgctctaaaaatggaaaaatgtcaaaatatgcatttattctcaaaaacctctcaaaatatgcttttatatgcactaaaaacctttaccaaatcaaaaaattttaacgtagaaatgctattttacagcctctttcttagcatatgcgcagaaaaaatatgcaaaatcatacaatttataaccctactaatcacaagtggggcaacaaattattatatctttgattaattacccccgccattccctaatagacgtccatctcgtccaagtggggctttgaagcggtcagtggcgcttccaaccagttcactctgtccaacaatgccgacatagcaccgggtgcgacaaatggaaatggtggactgaacattcaaggcaacggcgcaccgactctcaaactgattgaagcaaaatattacagcggcggtaatggtgcaaatattaaaaaaaaattcgaaattaattaattttataattaaaacgcggcatttttaatcttttaatttttctcgataaaaaaagaattaattttacattttctgcaggagtgtgcggtggatcatcttcttctggcggtagcagcagcgattcttcttcatgtaccattagcataataatccattaaggcttatccgatatcatgaagagtatcgcaaaatttaggcatgggctgtctgtcgaacaccaaaacggccgggcccatcgattcattcctgggcaagccagtcacgaacagcattttcactttctacggtgccggcggacgcggcgcatgcggtctcgacgccggagtggtaagtcgagaattaagtcatgataatgggatgtctgaggaatcacagtttcgaaaaagacccccccccccttcgatactatctttatgagcatgccattgttttagccaaaaatgtcagccgccggctccggccaattgttcaagtcggacgggcagtggaaagacgcatgccgagccgacaaacagtacatgttggacgacccgatttngcagaacatttgcatcnaagttgatttacatgggaaa

SEQ ID NO: 9046 - DNA, 3969 bp, Heterodera glycines
ttctttgcgaatttcttacttaaggtttataaaaaataagtaaaaaacggtactatacttttggtaacaatgtacttgtgcaaaagaaaattaaaaagaaatttaaatattttttattatatgattatataaataataaattttaaattgatcaccttagctccttgccctcctcggagacaaccagccatactgcttgccaccgtccgttggaccaattcattgggaatgtactgaaatggatgacggggaattggtcaaaattaataaaggacgaataaaaatagtcattaaagaagttaatttaaaaaatattcactcccaaattgagaccggaaaacccttggaatttcttaagccgggtctttgacggctcccgataaattggacaccgaaaattggacaccgaaaattggacactagaatactggacaccaatgaaaattagacaccggaaaattggacactatttgataaaaaataaatagttaaaaataaataaacaaaaattttaattgaaataaattatgtattattatttgtagcatcagcagcagaaagccatcatacattcataacgaaaaaagtttttatttttacggaattcccattttttctgcattttttggtacattgatcaatcatcgtctaattttgtacacttttttgccacatttgatcaatcattgtgcatattgaatatttaaattcctgggtttatattttaaaagaggaatttagtgtccaattttcctttggtgtccaaaattccgacagtgtccaattttccgcttggtgtccaattttttttaggcataatttcatagaaagataagaaaattagtctttttgggtggaaggacacagcaaagaaaaagcaactaatcttctgaagaaggacttagccatccatattctctagggcccggttaaaattgcggattcttctgtggaatgaagacccaaaagtttagctggacgcataccggtgggattaatcccgcaatttccaaaattataaaatttttcaaatataggacaattaactggagaaatttatgcccataaaagtccattcctgatggacaattttaaccgggcccgggccgccagataaaaaaagcctattttgccgggcgcgcaaatgcaagtcgggcccgtccgatctcgaaaatttattttttttcatcgccaaacgaaaattttggccattttggcatgggaaaatcaattagccaataaatcaattacaatgaatgtgccattatatgtagacattaataacaaacgttatatcacccttataatccatcgcaaattgccaaaataaaataaaaacattaaaatgaagcggcgatttgctgttgtggcaatggttgcctatttgctgatcggtgcgctcactacgacttgtgaagcgaccctttacgcaaaactgaaatttctttcacttctatgcctgtggccaaagatgatcaaaatgaatccggtgtcattcccgaacaaagccccgagaatcaatcatcattaaatcggatacactcattctccgattcatcttcctcctcatcatcgcccgcctcaccgccccatttacaagcaaaagtgccatttgagcgagttgactcattttcatccgcttcatcgtcaactttatcagcccatttccaaccaagcaagctgcacaatatcaatgccaattccgaacaaaaaaatgaaaacaaaatcaatccagcggataaagcagactcccaattatggtcgtcattaacggctgatttaaacccaaccgttgacaatcaaattgatacactgccacccaaaaagcgcttctcgaaattgcggatcacaaaaacaaaagaatgagagccggcaacagagaatttgattgctgttgctgaagtttcatgatttattgagatttactgatcagttgatccttagtttgtcattttttaaggattcaagaaaaatgttaacaatttatggaataaaattagataattaatcaaaaaattatttcgaccaaagaacccacaaaaataatcattattgctaaataaatttttgctttgagcagttatataaaatttttttttattatttggagtaacgtcatagcaccataacttttataatgcctattgttgcctatttcggggtttttcgcttaatgcctgcctatgcgctatttttgtgcatttttcaccatttttaacatctatttcagaattttaggaaatatcctttaaaaattcaatataacgaaaaaaacaactcctaagaaatgaaacattttcccagaaatttattacttaaaatatttttttttcttgctaaagtttttgctttaaaaatttgtcattattcgaaaataaagctttaaaatattcaataatttcattttgaaattgaaaaataatcgaattaagttttttgattaagtttataagtgtattcctacctaaatgtgataataaaattttttatttgccttttttcagccttttggttgcctatttctcggttttttgtgccttaaaaacgaagcctacctaccagggatgcattccgaggccccaaaaattttcggtaatcagaaccggaattccgggggtcaaaaatttttcggaaattggaattggaaatcggaattccgatcccaaaaacgtcgtaaattggaagctggaaatcggaattccgtgccatccctgctacctactgataacaatagataaaatgttttttttggatattttcaagagtattaattacttttcaaacaaagattaaaaacagtgaaccgaattccaaaatcggtcaaacatgtttttgggttttttgttttaatcgattaaagtaaagcaaattgcttttccatttgcaatggaagtgccatagatgtaaatattattaaattattacatatttccatatcctccattaccaagccatcataaaaaaagattaaaatctgatctaatgagtccggtgccattcaccaacaaagccccgaaaatcaatcgtcattcatcgttaaccacatcggccctttcaagccaaccaatactcacactgtcaatgccaattcccaatcaaaaatccaatacaaaaatatcccgaggataaagcataatatcccttatggtcgtcctcagcggatcattgaaatttttatcggtgtctatcgtttccggcggattattgtattttttaattttgtttttaattgtttatattagggttgttcacgagcttacccatggttttcagttatgcatgttttggaccccacggtttcggtttttcggctattgcggttaatgaaaaaatttcaataacaaatttttattccaaaaattttgatagtcaataatccaaccatttgaagcgcttttaatagcaaattaaaaagatttggccagatccggcagtgccgataggcaacgcagagaagatttttgaagaacttattttcgacttgtggcacatttgacaaaacatgtggacttttctccgcgccattttgctcgactctttttctccctttgtttgaatggtgctgggacgttagtcaaaaaccatcaaaatgggcggaaatagaataacagtgacatggaaattatgtgactaaaaattattcgctatctctcaccattatgagtcaaatatattaatatattaattatgcaaaaaacacttaaagatgaaagacacacagttacaaaaatttttttgagtcagctagctcggaactcatttcagtgaaagttaatcctttaccggggagtatccctgcaaagtttggtatgcttctgctcatttaacaaaatatatgagtgatcgaattttcactataaaagttaagactacattttttggcatatttaaaaagcaattaaaaaatttttaaaatttaataattttcctgcaccgaaggtactcactcggcctcttcgcggcctcgtg

SEQ ID NO: 9047 - DNA, 1736 bp, Heterodera glycines
cgctcattggggcccgactcattgctgacctcttcaatcatggacagggaattctccgcgttattgctgcatttcagccttttctctttgtccgcctttctttctgacagtaaaatggtgttatttctttgctcgctacaacaaatgctcacttttcttctccaatcttcggctgagtgctgaacgcgttcggaagtccaccttttccaccgcccccctcaaccatttgtccaagttctgtttttcttccgtcgtttttacagctgctgatgtatcgatgccatcttccgggccgaacagccaatcctcctcactcactgctccatcatgtcgcaaatttagtgaatcctccaactccacagccaaatccgaaagatccatccaattagctaacaatgatcaaaactattctttgagaatttttcacattcaataattatatcattacaaacataaaataaagttaaaccgaatggtttgatattacaacatgaaacaacaaaaaacaaaagaaacgtaattttatcaatttcatatgtatatttatatttttttcctttaatacaaaatggataaagcccaaaatacaaaagcaaaatcaaagtgtctaaaagataaatgatttgtcaggacataaccggggaagaaatgaccatttgaggcattttggtctcaaattcttaaaaaatagcacctataccgaaactctcgatttcacacttcagctatggccaaggtttatacaaattggaagtgaataaaaagaaatcaattcatccgcgttggattagagactccgtggaatcgctgttgtgcatacgtttaactaacggcaaaatggcaataaaaaggcacacattgagcacagatgacaaaatgaatctgaatgaggagacaataattcaaaaagaatttgaaaacagtcaatctcaatttgcttttttaaattcattctctagggatatatgcggcattgagtggctattaaaattaaatgatagggcggggggggggggaattcgagaccaagagacacattattatcactacaaaatttccgttttaattaataaaaatgcctacaaatttcgccaaacggtgtagcggtgttcacaagggatgggacattggaaatggggcatccatttgaccagggaatggttgctttgcaaggcggccaagtcgacgagtgcaccgaccacagtttcaatagttcggttgttcaccacatcatcgccaatatgcttttgggcaactgattttagaaaattagtgggatatatcgaaagttttgacttttccaaggtttgaaagcgaatgaacccactcattgtgtggattgaatgacgtttggcttcctcaaattcctctttgtatggccgcacattgcgacggcgccactgatcgacctaaaacatgtcaaattgacgaataaaatagccacttggacgaatcaaacagcacaaatcaacaaaacaaagggtcaatggcaactcgtacaaaaaaaaatttctaagaattttcaacttaaacttagaatttttagataaaagaaaatttaaatggattttttagcctagaaaaactttttaaaacacttaaattttcaaaaaattttaaaaaaccagctgaaaaattagtaaaaagctttaaaaaatttttgttaaatttttttaggctaaaaaaccattatttttttatctaaaaattctaagttttagttgaaaattcttaga

SEQ ID NO: 9048 - DNA, 1522 bp, Heterodera glycines
  misc_feature (450)..(450): n is a, c, g, or t
aattttaaatcaagaggcaaatttttacagtaaataaatagacgctgtctaagtagctaacatttataaagaaagtagaaattggattaaatgcatatacaatatgcaaaatattacttttttaaacttgtataaagttcctatttcgtcttagactttgcttatttatccacatatttcaatcggctagtgctttaaggttttgtctttgactttgcttttttttccatttatttcaatcggctagtgattcaaggttttgtctttgactttgcttttgtattcttttgtttcaatcggttagtactttaaggtttatatgtgaacttagttcgtgtatacaatgagaacattcggaaaaatgtctaagtatttttttgttcgaattcgggtttggggctcgaattgcgttaaaatagatgtcagaatcggttttcccggccctagaanaaactttaaaaaaattctctaagtttttttactaattcttttcagctgattttttagtttcttaaattttttgaaaatttaggtaagtgttttaaaaagtttttctaggctagaaaatccattaagattttttatctaaaaattctaagttttaattgaaaattcttagaaatttttttttgtacgagttgcctattgtacgagttgccatgacaccaaaacaaacattcatttgaacagcaacgtaatttctcatctgtccaaggagtattttctcaaagaacaacagactcctattccaacatcccaagtcgcggtcgccgtacgagcaatgatttctggcacagttaaatccataagaaaacaaaataaaaacgataaaactcacgagcagccgtgaacagtcgaattatcaccagtctcaaaattttgtgcaattgttacgcttaaaaaggcaaaaaattgcaataaaaaacgaaacatctaaaaaatagaattacaaggaaaaatacgaataaagaaggcaattaataatttgatcgtgtaacaaaaactaaacaattaaataaaacaagcaaaattattcaatttgtcgttgcgttggtgtgacactgttaaatgagttcagttaattgataaacagtaagatagcaacgaaataataggagataaataataaataagtcacaaaaatggatggtagtttttctttgaggttggacgaaaaggactcgcttcatcaaagaggcacgtgagagaaaagataactaaacgaatatgctgtcgatttattttaattttctgttaattcctctccccctttttgtaactgcaccaacctgacggactcgccattgtgtgttcgacggatggcttctgagaggatcatcgaaatatcgatgcacttaaaaaatgcggtaatactaccgatggtatcacaccttttttgaaaaaaatattttttgttttcaaaagccacgaaaacatgtttccttggcttttcggggtcgctgatcacggatacggcacccatttccaattctgaatcccggacccgaattcgaacaaaaat

SEQ ID NO: 9049 - DNA, 1214 bp, Heterodera glycines
  misc_feature (1195)..(1196): n is a, c, g, or t
ttcgacttcgggtccgggattcagaattggtcgaaatgggtgccggatccgtgatcagcgaccccaaaaagcccaggaaacatgttttcgtggcttttgaaaacaaaaaatatttttttcaaaaaaggtgtgataccatcggtaggtttgccaaaaatgctttttagcaacccatggcccgctaaaaatacttgaattttgttgcatcttttcatattttcttcttgtggaattgtgtttgtgactacaaccgcttcaaatctcgatttgttcaaacgatcgatggccggtcccgaaaaaatgccatggacacaaattgcgtaaattttacgagctcccgcttcgaaaagcctgaaaatataaaagtataaatagcaacattcgctagtatatttgaagtcagtgacttttcggcagccaaaacaatggtgccgcaagtgtccgccatgtcgtccactaaaatggccactttgtcttgcacattgcccaccagtgtcatcttctccacttcatttggattattgcgttctttgtggatgagtgcaaaagcagcattcaaacgatcagcaattgatgtcacactaaatgggcagaataaacctggaatattttatgccaataccgtttggcacctccggcatcaggcgacacaatgaccgattcctgccagtgcgggattgtctcccgtatgtacttcaggatggccggctcagcatacaaattgtccacaggaatatcgaaaaacccttggatctgcgaagcgtgtaggtccatggtgatgatgtggtcagcaccggagatggaaagcatattagccacctgacagaacagctccgcataaaaaggcaaataaccgaaccaattttgctgtgattggggcccgtgacttgtccttcttgtcctgcctggcatatggaaagcacggaatgacggcagtgacgcggcaagctgaagcaattttacatgcactgatcatgatcaacagctccatcaggtggtcgttgatttctccacacctgcaaaagttgtccaaagagtaaagcgaattgcgccgagaaaaacaaattacccgctctgaattatgtagacatcttcgcctctaacagattcgattatttcgacatttgtttccttaagaagcaattatttgtgtctgtaactttcggtctctaagcccaccttattgctgaatttnnctttaagcgcttttgcaa

SEQ ID NO: 9050 - DNA, 2237 bp, Heterodera glycines
atgctcagcaaattttgaccgacgtagctgaattgcgcgatttggtgttggacaaacgcaaggagtacattttgtgcagcaatgcattttcgctttacggtgtccagaaatttatgtccgatgaggacaggaggaaattcgaccaggaaacgggttagtcagaaaagaaatcgaaatatttctctattaaaaaaacaacgcaatttaatttttatttaattgggtttgatttttcgcctgaatggatttttaacaaaaaaaaaactttttttctgctcatcattttactctcaaaaaatgaccaattttgccttttaattaggagccgccgtgaaaatttttgaaaatttgaggcaattttttaatagattttgtcaaaattacctaatcacattaacgctttttggatgtgtttttaaaccaaattttccgccaagtttataaaatttcaaaaaattctagcagtttgcttgttttttttccaaatacatccttggaaaaaagaactttcaattccaattagcgaggctcaaatccaaggacgtcattggcaaccaataacgaatgacagccttgcgaaaagttaaaatcttaacggtaaaagcctcatttccagatttggcctttagacattgcaccaaattgatcaagagtcttgaggcacaaattgaatctgatcgcactttgcgtccatccgaccaattaaagcatctgcttgccgtgatgaatttgctcaatgtttatttgaaagaagtgctttctatcgttacgcaattaaggtaaccgaaagttttctgttcaaaatggcacatttaatatatttttctccataaagcaaaaactagttcaggaggtttttgattacttttttttacaagttcctaatccgaactcgaacaaaaggtggaaaaaaagttggctctatgctaaataattcctcgaatttttaagggcaattcatgtgcgaaaatcacgccaaattcgtcgtatttgccggttggccaatctcgttgaaatgtatggggcacgaattgaacagacgcaaaaggaggaggaagaaaaggcgctgaaattggtgcgaatgttagaagagctgaaagagaacgaaaaatgccagtggaggaaagaggaaacacgggaagaagacaaagagaatgttatgttaaagaaaggaccaaggaaaacggcggtggtcgacggatgggaggaggcgcaaattgaggaggaagaactgattgaaaagtcgactgaaaggaaagtgccatcggatgggtgggaagaggcacaattcgacgacgaacaaatgcacctcaagaggaatgaacaacattcaaattcagtggatgggtgggaagagacagaaatttggacggatgaagcgaacgaagaacggttcaaatcgaaggatgtttttgaagaggcgcaaacgaaggaagaaattgtaatcaaagttaaagaacgactcaaaccattggatgtgtgggaaaatggtaaaagtgaagagcgcgaacagtcaaaaggtgcattagtgctaataaaacaacgaattaaagccccactaattaacagctgaacaatcccaacttctcgaggagaatagaaaattatttgaacggtttactaccaccaacgcagagctttcgagaatagaaacgcaaatgagtgagatccagcggttgcagggcatatttgcggaaaaggtaaataccatttaaaaattacattgtaattttatttgattttttaaagataagtgaacaggaacaagaaatcgatgtgatccattctaggactgtatacacattggacaatttggagactgccaatgaatttatcagagaggcaattaaaaatcaggccaatcgtcgggtcatcctcatattctgtttgcttgtactcactttcacgctcatattccttgactggtacaatccgtgattcggagtttgtgatatatgattcgatattttatttatgataaaatcgccaaataaacctccctcaatcgccaaataaacctccctcaatcgccaaataaacctccctcaatcgccaaataaacctccctcttatttcatgccttaaacacgacagttcttcccttgtcaaatactttccagtgttaatgattttaagaaagtgaatcaaattgaattttatgcgtccgattaaatttctttccaagtatgtttgaatatttatttgtgtcatttgaaagtctccaaatcattgctatg

SEQ ID NO: 9051 - DNA, 2320 bp, Heterodera glycines
  misc_feature (67)..(68): n is a, c, g, or t
gaaaatgtggtaaaaaaaagaagaaatttatggaaatggtgaagagtaaaactcaatgtctctgacnnatcggaggagggatatgagatttcggtggcggaatcattgggccaggaaacgtaatgaatggaggcggatgagacatagaagcgggtgcgctgattatgggcgggggaacgtttaagtggtgcaagccgtgcgcaaaattggagggaggcggagcattaagggagggcggaggggcaaaagccaatttgaactcctccattttgcgaaggaaataccaacagggggtaattggggtgcccgaaggcgggggctgatagggcacacggaaattcgacggtgccgccctaacattccagcgccggaacatcgagtcctgaaatggtgagaatggttaacaagagaaatgacaaacaatggccaaatccgggagccacagcttaattcattttgaaaaaagcccgagtatcaaatccgaagccagaaacaatttcgaagggaggaacccgaagacctttttttttgttggtcgactgttttctccagtgttattttaaaaatcagcgccggagaggaaaaaacatgcatttatagctgttttcgccaaaagggtgcattttgcttaaaaaatccaggtccggcattggatgactaacccggtccggtcaatttaatggcctaccgaattggtaaaggtagtcccatcggtgccccaaagttgcggaggctgtgtctgctcgagttgcgtttgctgcagtttttgtgggctcgtcccctgcgctgctgccgcgttttcctccatttcggagctgttctcaaacactgtcttctcattggtcgatggtgccatgtttgttcccatcacaatgctgaacatttgttgcatcgcggaaagcatatctgaagtggaaagagatgacacaaattagtcactaataaaagaggacagtaacacactttcaacacaataaaaaatactgtcatccgaatggttctgtcattttctaatcgaaatttggcaccgcccctccatccaaatgtcgctgacctgcaccagaagtgtcttcgtccggcttcccattggttggtattgttttctgctgcggttgttgggtcggcgacgctttgcagtcactgacaggcgatgacaaaaggtccaactgtgtcgtggacagcgactgtttcatcggcgactggtgctgttgtgcgggtacgctttgttgctgccgcactcgctgcttctgcagctgttcgtcttgaagtgctcgttggtgcatcgccatgtattgcgcttgttcctcggcataagcgcgggcggcggcctctgaattttaggaacataaatgtgatatgaatccatctttaggcaccttcagctttcttcttttcctcagcttcgcgtttcaatttcgccgcttcgcgttcagccgttgccaatcgttcattttcagttttttgccgcaaagcggccctcctcttctccacgtctttctcccatagttcgaattgctttacgtaattgatgtacgcctcggtgccaacggaatcgctaatttcataaaatagaatatttaaattgcgacaagttaaattaccgatttttttccttccattcttcgaattgcgctttgtaatcgcggtattgtttttcaagttcttcggttggtgacaactaaagacaaattaaaacaactttaaaaaatatatgtttttaacctttttgctagacatcggtggctgatggaccataaaaacggagtttaagatgcagacaaataactaaaaattatataatatacaacataaaatacataaattaaaatcacaatgaccatattaaaataataaaaggactagaaaacaagaaaaagcgaagggactaacaataagattctttgtgcttcgtacacacataaaaaacaaaaatagttaaacatcaaaattaaaattctattttgattgcagttttataattgtcaattaaaaaagagacaaaatgaaattacgaaaaaatgcctcgtacaattctcaaattttcagccaaaataaaaataagtggataataaattaaaaaattatttgatttttatttacaaaaggttaaatgtcgcttgcccaagaattgctagccgatttggaggaggatggcgatgaggagatgcaagacttggaagtgaagaaggaggaggagcaggacgaagattatatagacgaagtcaccgaagagaaatcgttccccaatttgtcaaaatatgatcggataacggatgtggccaagttgaccagttcagcttagtaagttaattaacccaaa

SEQ ID NO: 9052 - DNA, 835 bp, Heterodera glycines
  misc_feature (92)..(92): n is a, c, g, or t
actgctcgccaatgacattgacacgaactcgcgaaaggaaatcatccatcaaatctgccggctgcaacttgcattgttcgctcctttttacnccttaaattctcctctctctttctgtcttaggttgtcagtgttaccgcctccacttcccagggaaagccattggagcaaaatgaggtaatttcaaatttttatcacaaaaaaatcaatgggtttttatagctggatgttatcatcgaagcttgttcaatggctgaggaactgtatgatttgcgcatgaaaatgcatcttttcgtcgaattgcgaatggctctcatcgccccaaatctctgccgaattgtcggtgccggcaccgctgccatgctaatttctcaggcgggcggactcgtaccgttggctaaaatgccggcgtgtaatgtgctaatccttggcatgttttccaccttttattcgtttttattgcaaattttaggaaaacagaagaggactttggccggcttcagctcctccgtgatccttcccaacaccggcttcatttaccaccacccaatcgtccaaactctgccgcccgaccttcgcagaaaagcggcgcgattggtcgctgcaaaatgcacattggcttcccgagtggattcaattcattcttcgttggacggacgaattggggagcgattgtcagtagaaatcaaagggaaattggaaaaaatgcaagagccaccgccggtcaaaaatgccaaggtaattaattgcacaggccccaaaggcgaaaagattcgaaagcctaaattcattgcacattaaaactttttgtggatttaatttgtttagcccctac

SEQ ID NO: 9053 - DNA, 6246 bp, Heterodera glycines
  misc_feature (66)..(66): n is a, c, g, or t
tgcttcatcacctgttgttcatcagcagtaaagcttcccccttatctgcctgtgctcttaccaggnccaagtcttttgctccttacaaacccaccagacggatcagaaaactaatgtttggcttccatctatccaaaaattcctcgcagattttctctttacgaatgtcaccggttaatgacgaatttgtcgcatccaccacaggagttaggcgtctcagaaattgcgccactgtctcatcctccctttgtttgcacagcgataaagttcgtttcgcaatttcccgacgctgaggggagtccaatttctgtcgaagttcactcaatgctgagtcaagagtgtccgtttgtgctggcaataactccttaaacagtgcccgaggagtgtccctcagagccaatttgagtcttgtgactttttcttgttcagtgtaagccttgcctgacacggacaggtaatccttgaaacgttcagcccaatcgtcaaatgcaaaaacagactcctcacaaaacatttccaaacctgaccccactgtgggtccgctcgagagcatgttcaggccaaaaagagtcggcccgtcatcttcgtcttcgcttaataattgatgaattggcacttggttcggtacaacttgattgggctgtgcattgcccattggtgtcacaaacggcgcacgcgacgctctattctgattagtaatactaacagtcccacctgaattcgtcccatcactgtcttgttccaacatctcgactctttcggttaaggtttcgtattggactttcagtgtctcaaaattggcatttgtattggccacgacatctttcacccaattgactttttggttcaaggaacgattcatgtagcgaaaagctctgttcactccatcttctaatttccctatatcattttgagctttctctaaatcagagatttttatcgtggtctttccttgccaaagtttcctatcaatagccgaaatcgaggactcatcatcctttccactcaaaaacatctttgtttcctgcccgaaggcttgggatgtaccaaaggggaactcatttgacgagccccctgatgtagacattcgaagtcgttcagttcgtagtaagattttgttttattttgctaaaaaaaattatttggtaatcccattatgcattaattgagagagaaaaaaattaatgaatgacagcgggtaatcaaatagatgcgaacgccttccagaaataggcttatctgctccatctccgtttaaactccgcctaacaagagcaattaacaattctcaggcgccgcaaaaatgtgtaaagtgaatgatctcgcccaatgaaaaatgcggaggcacgtgattacgtgaatattcttatggcgtgaaaaacgagagaaaacaacgagataaaatgaactttggaacttgtaaaaactgtaactcatactgtaagcaaaatgatagggcctaattttcattttttaattggtccctctttttaattagctaaaatagtgcccctttgattggttgtcagcccgggcctttttgctctcctcaaaaaaaattgttttattatttattttttttgtctcacttcttctctctctctctctcttttttttttgcttcacaatcgttcaagtatttttataaattagtccttattcatttgctaccaggactttttcttggttatttttggcttccttcactctcttttcctattctctctctctcctacaaataattgtcaaattttgtcaattttcgatgcagtaagcccctttagcatttggactagcccggggcaaatttcgttcttcttttttctgcatttttaaaatccctttagcttttcgctagcccggacaaatgttctcacctcttttctcttcgttttaatgtccctttagttttcgactagcccggacagaaatttaaaatgtcagacttctttacttgcgtgtacacgtctttgtttctagccctcaggccagggagatctcccacaaacttctgccggcttacccaattctcagcttcgtcgtcaatgatgtgtcgttgtttcccaaaatgggaaccatccggtgctaccagtgagggatgcgcactgtgcccccagaccaactatgcaccgtttatcccggatggagtttgggagggaatggggaaaagccaaggcgtctttgaccaagccccgaacccccaaacgactaattgactgttaaagatgtgtttattcattcgatgttggatttaaacgaagcgagaaatcggaataataattgaagtctgttccatcactactactgactaactgatcactggggaaagagaaatgcgaagagaatgggcggagaaacattacaatgagaaaaggaaaaacgtgtgaaaaggataaatgtgattgaattgataatggccaatgggaaataattaaatgagggaaatgcgtcgaataatccttacattattatattttttaccgattccgaaccatgaaataaagataatctttacggccaaacgatactcatcaatgaaattctgtccagaaaatgcgatgtaaacaaatagaaaatggctaggttggtgaatcaattcgaaaaaggagcaaagtgccaaaaggtaattaacggtgccacagaaagacctaattaaggcaaatttaacaatttaaatgcactaaattaatttctaatcactttgtcctaatggtcacataaattacagaagaatttaaaattattccaagtaaagcgattaatccaagtactgaagagcatccaatgagcgaccagcttgcattggcatctttgaaagtcaaataaaactaaaaaacaacaacaaattaattgacaaaattataattttattcacttactgtatcattgttcaaatcagccccttaccccacattgccatgaggtgaacctcgctcccatctctcttccgaaattcacggagagccatgggagtggccaatgttcaggaggctcttccgttcctcacaaaggaaggtccctaagtgtccgtggggtttccgaatgaaacttggcgggtgaatagagcaaagattttagtcacaggttggaatgctctgaagcaaatcaattttttaattttggcttcttttatgcaaagtcaattattaaaaaattgtttaaaaaagaaatttatattttttattttttaccaatccttgcttggcccattttccaggaccacttgtttgccgaatttggcaccgaaatgaagcgtccaggagtgcatggcacaaatgctcgactcgctgggcaaataaataattttgaattggccgacgtccaaaagttgcgtactttcaaaaagtgtcaaatagtttttttatgcaaatggaagtaacaaatagaaggtgaaagaaatgtatgtcagggcagggggcgcaaccgcggaaaattcggattaaatgaaatatttaattcctatagaattttttttaaactttttccttacaaatttcattcgattttcgtccccggcggcgcctttcggacaccaccagtctcaaaattgcccaaaattaaaaaaattctcgacaaaatcgctaaaattttcataggcgtcgccgaaaatttttgaattttttaatgctctgttccgtaccccggcctttttcagactgcgcgtccctccactgatcaatgtgttgacagttgaatggaattaaagtgtgaaccattgaaaataaagataggtagtcaaaaaaaatggaaagatttgctgtttgctagagcaaatgatcaaaagaaacgggaaatggataggtttgatgatttaggatgctcggttctcgaattaaaaattttctcgatcttttttgagttttggatgggtcattcacggggtaattttgtagaattgcggtccaccgaaaattaagttagaactttggaattcattatataatttttgcaaagaaaattgaacccaatttccagtggtgaccgcaaatttgcagtattacaccgttctcggtcttattttcgacaagattttgactcacgagcatccctaaccttcgcatcattctctctgatgttgtgcaattctgactaatggttcagttagcccagttcttcggcatccaatgattcaatggtgtctccctctttaatgccgtattcatccatcgttttcgcattgtccacaagttggtcaatgtcagctcgtgatgggtgttgtttgctcagggaaatgtcgccgaactttttgttccaatccgcctccatgaatggccgtactttatccttcaaatctttcacagtgtccgtgcccgtcacccaaacgattacccgccggctaccgtattcaacgtgaatatgaaaattagaaccatcttcgaaagcagcaaatgaccactgtcgtgagctttcgtcacaagtgacaacctccataaaaatggtgtttccttctctgatgccatattcgtccattgttttcccgcccctaagtgctttagcatatttacaatcgaaatcgcatttgcttagtttgatcactccgtttaacttggatttatgcctctgtttattgatcgccctgatcttccgcttcactgttgccacagtgtctgtgctgttcacattaatcacaaaaaattcccaatgatcttgccaccgcacggtaattccagatccatccgacattgttaaaaagggcatatcttctttcacgaaatctatcaccctagccttgtcattacattgtccgaatttgaaatggtataatgtttgtttttcggacggaattccagtgatttctgtcattttctccttcacttcttttaaggtggtcatggccttcaccttaatggagttcatcttctctttgtattccaccaaaaattgaaattcgtccgacgacagaaacagttctttgccttctccaatgccatatttatcgattgtctcatcatctgcaagttcaatccaaaatgtacaagtaattttttttgacaatgtttgtttttgaatcggaatattcccaagttcatcaatgtttgctattttcttctttaaatctttcacagtgtccgtgctcttcgccaaaacggagatccgatttctacggtagttcacgtgaatatgaaaattcgaaccagcgtaggcgacaacctccatataaatggtttcttcgccgatgccatattcgtccattgttttatcgtctgcaagcacattatcactaataccactgaacaatacttgattttgaatcggaatgttcccaaatttgtcaatttcttggatcttcgccttcaaagttgccacagtatccttcttgttcaccaaaacagggtaagtatatatatcatatagcacttcaataatcatgttatcagcggataaaggcatcatcagcgtaagcattgtgacaatgctgaactgtgataagccaaaatgattcattttgcgataaattggctggcaattgaaaataatggaagggtgcaattaggaatgaatgaatgtggtgaatatattacttcaccactatcaaggcagcccttttatggggagaatcctacttattgactactttaatttggcataattatagtgaattattgaattggcaattgagtgatcacttcatttggcagagttatagtgaattatttaattggaaattgcgtgatcactttaattgtgcataattatagtgaattattgaattgccaattgtgtgatccctttcatttggcagagttatagtgaattattgaattggcaattgagtgatcactttcatttggcagagttatagtgaattattgaatttgcaattgagtgatcactttaatttggcatttactttaaaaaaatttaattataattatattttcatccctccccactcccacggctgagactcaattagctgaaaatgacaacgcaatgcttctcacaggcttttctgcttccatatacaattaaatttcacaaaaatggcaaacatttccgagaccaatgagaataatagtaattagaattaaaattgttcttagcaagggcacaacgccgtggatttcctctaaggtcaggcatattcaaaccaatgtaaaagccgatttttaaggggtttttgtctcgaattttgatgaataattgctgggaactattttcacagaaaagccaaattttccgggggaagggtttacttttactgggtcccctaaaaaaaaaaaaaaaaggcgttttttatgatat

SEQ ID NO: 9054 - DNA, 1551 bp, Heterodera glycines
  misc_feature (1512)..(1512): n is a, c, g, or t
gaccaaaaaaaaacccaataaaatttccatcaatggcggacggtttttgtgccaaattttgttggcacccatttaaaataatcagcaccatcaaaggctatacgccccgtatgccatgccattttcatttgaaggggaaaagatcactcattatcattattgtttttattgtggaaatgtgtccttacaacatgtgaaaattcgagtgctgtaatataaaacggaaattgatagcctttgccagaaacaaaaaaataacgtattggaatatctctcagatcatttgccacagccaccgatcagtccgggacggcggcatattacccatttttaactactcgttcacgagacagacatgaaaagtaactaaatgattgtatacgatttgaaaaaagcagttgcttcacttttttatttatggtagcaattttgagaaagaaactcttattaaagtcgaaaattcatatgttgaaacgcgaaaatatttttcatatttatgtattgatgaaaaaattttatcaaaaatttaaaaaaatttcaggaagtattttaaaaaattgtaaaatcctctgtaaaaatttagtgaaaaatttgaacattaacatttcgacgatatgccatgtttctacgaattcagttaatgatgccaatgtggcaatttgcttatttacccttcgaaaatgcacctgccaattttgacgatgaaattttgcatttaagtttgttaattagaaatttttcaaacgaatggataatttgcagtgcgtgaacggtaattacaattttaattatggacaaaaagacaggtacaaaaaggcaatcccataaaaaattaattaaaattttttaaaatattttttgagatccatttcgcccaattccgatgccctgacccgaactcgaacaaaatccaattttacaaaaacgataatatttttggtggttttcgagaataaattgatatgctgaaacttcgtttatgtttttaatattatgttttgccactaaaaagaaaaaatgtattaaaaaaaagttcagaaaatgtttaaaaatggtaaaaaccaaacttattgtccgcacttttattaaaactctgtcaaaatctaattgaaaatgaatgcgttaactaaattcactaattacattttgacaaatgcaattaaataaaatacgcatgccaggtgttgagtggaatttgtaataatttctcaatatcaatttaacgttaaagatggcaaaaaaagtttttatttttatttttttaaactttgttaatttacatcattttttttaattctttagaatatttaccgatttattcaatgaaaaaattgttgccattttacaaattattaagtatgaatatgaatttcgggaatcaaaacctaatttaagtaacactaaaatcaaaattcttctccgttcaccagctgacattgaaacccgttgtcatacctaaaattattaataatttaaaacaaatttgatgagaaaatgaaaaaattcacaagngaaaatatcacaacaatcttttatgataaatttattttt

SEQ ID NO: 9055 - DNA, 1890 bp, Heterodera glycines
  misc_feature (1843)..(1843): n is a, c, g, or t
  misc_feature (1851)..(1851): n is a, c, g, or t
  misc_feature (1863)..(1863): n is a, c, g, or t
agaaaaacaccgagcagcgactgggcgtacttgccaatgcgcacataatggaccagcagaggggaggaagtggccagctgatcaaaaggacaaagtgatcatcaattgagaataaattaattgatttggattcatatcattagatagattattggttaattgatcagttagaaaaatctaaatgatcaagatcaattaaaggaatttggcttgatattattggctctgattgatccgttagaaaaatgaagttaaaatttcaaagtgatcaagatcagtaaaaggagttgagcttgatcagcaacagaaggcagagagtgcaaaaaaaaagtgataaaaaaaaagctgatcattaggcagatcagcagacagaaagtgatcagcagagcagaagtgtgcacctcgctgacgtgttggatgcgcggatggacgcggtcgcattggtcgacgcgaattgtcacgcgatagtccaaatggtggaacagggagaggccaaaagcgaggccgaagatggcgaggatcagcagcagcagacgctggtcacgaagctgaaaacgctaaaccaagcacagagagaaatgatttatgacaaggagaatttcaaaaagattttcaaaacggaaaatttcgaaaaaaatttacgaattttatagacgaaagattttaaacaaaaattcaaaaagaatttttaggcatttcttctctcactgtgtgcatcggatggcgaacgccgctgaagcgttctaatgacacggccaaaacgaagctaaaaacatttaattgaatttgaattaaattttgatatatggcacaatgtcgctgcggttgagaagcaattggccaatgccacccaatgaattttggtgaagctaaaattaaaatttaaaaaatggaaatttaatttcaaatttaatgaacatgtaaaagtaggcgaatcgaatgcttttgtagaagacggagaaggaggccaaagagtggggcaacatgcagaagaggaaggccaagtcggcgaatgccatggccgagaggagagtgttggccttggggaaacccgaaaaataaatgcgaccattggcacgatggaggaaacgagaacggcatttacggacaaaatgccaaatgccaacaaaaaccaacctgattcttcatgccggaggacaaaaggacgcacaaattgatggaattgccaacgacgcccaggcaaaattggacggggaaaacgtaatgctgaaaagtgacggaaaattaattggctaagaaatgccgaaatggaacacggaaaataggtgttacctgaatgtaatagtcgacctgataaggaatggtttaaattttggcataaaaatattcacttgccatgccaacggtcagtgccattccctggacggaagtgccgttgccgacggcgctgcaattcattttttaaatatttttccaaaaaaataaattgacttttttatttttttaacatttttagctgaaaatatttgctctttagattcattgaagcgttagaatttttctcaaagcctgggaatgaattgaaacggaacaaaaatagggccatttttttgagggggagacaaaaaaaaacaaaaattaaaattaaaatgagatttaaattttaaaattaaaaataaaagtttaaaaatgataaaacaaaaagaccaccataacattaatatatatatatacataaaattctttgaaatgcttctgcccatttgagtgtcactcaatgaagcgaaaataattgaagcccatgggacgacggacaccacaaattagcaaaatgaaagaaaatgagaaaaaaaaaacatgaaaaaaagaagaggaccacccnaataaccnattaaatgatcngagagagaaattggaattcatttttta

SEQ ID NO: 9056 - DNA, 1068 bp, Heterodera glycines
tcccggccattggcccatttgacatgctttatttgttcggtgaatgccatttggaacggtgtgtatcagatgatttgtcgtgggagagaaggggcagcagcgacatgtggagaagaagctgaagcagcagctgctgtgcttttttttactcattagcggagggaatttttccgaattcgaaactcgagacaaaaaaaggagggaaagtaagaaacattgtcggaaatggccgaattaaaattctcgaaagaattgttgaacagaaaagtgcctaattttgccaaatgatttggtcggtttttggtcccttttttgtattacaatttgctgtcgctgctgctgctgctgaatttcgtcgctccattcgtaaaattcggcagcataaagttacatagattgtgttgtgtttgttaagcggtggccaatctttggcgcaaatccctcgggcggcgcgggggggggggggtaattggtgaaaagcaaagcaaagcaaacggacggcaaaatgtgtgttcaaattgttttgagtgggaaaatgctcgatttaggccgaatgtttcgccgatggaaagggaccaaagttttccttttttgtcaactcttagtaatttaatgactttttaggcttcaattgtgagcatttttgctaaaaacggaaagcaaagaggagacaacaaagtttatgatagaaaaagataattttcgacggaaaatgccaaaatattttgtgccgaaattttgttgttgccaaaaatgcaaaaaaaaaaaaattaattgcacaccaaaaaaaagagaaatgtcgcggcacaaattgcgtgtttttcttgtgcattatttatgtgggtatttgttctgcgcggtaattgcctatttgtgattaattttttgatgcataaaaatgtgaggggaaaagaaaaacataaggcacaaaaatgtgaatgagatgattattatgaatggaagaagtgctgctgatggaggggaccacggctaatgaattaattagttgactatgaaaagggattttcctaaaaaattatttttttttggaacgaaaaagggttttaa

SEQ ID NO: 9057 - DNA, 2807 bp, Heterodera glycines
gaagcaggggacagttttttaattgggggttaattagcagttaattaggtaattagattagcatatctgcacaaagtttaatttgttttttctcgcacaaaagcaccagaagaaatggcaggtcgttttgagagccccgtttccccgcgctgtctcgcttcctttgcccacccatgtgctccacactctctcttatttacacttcactaggctttctcctctctgcttgcctggctttccttttgttgtctgtccgctttatctcgcctttctttgctgcctctcctacgcaatttcccactgttttatgcttcttctttgacgagagggatgaaactcaatttaaatgctttttattttatatttttaatttgtcgaacattttggccaaatttggaacaatgggcaagaaaaaaataagttcaaaaagggacaaatgaaatgccattggatacaaacaatacaaattaaagggaatggccaaaaaattgccaaatttttcattttcggctcaacgaaaaattgctcatcgcccgaaaaagcattggccgcgaaggcgcacgaatgcgaagcacaaattcggacagtttgtgctgctgttggccgcaacttttgccaatgttttgaaattcgtacagcacgcggtcgttgctgacgcggcgttggacagcggagggaaaaagggtgaccatgtcaggccaaggctcatccgcggccagccaaacgcaaatgcgacggaccaacgcgtcgggacgatgcgttgtgagagcgtactgtatagaaggcataattaagaattgctaattagggatacgtcaaagggcaaatgcaaaaagagggacttaaagctttaatggatttttattgaaacgtttatccaatcccatggggattttttgagatttcgaatttaaagtatttagcagagtacgatgtggtaaaaaaaatccggcatcatatagccaaaaaacttttcaaaatgggctctaaaaggggttgaaaatgcactcgcctcgaccaattcttcgaagaaagtgggtggatatccgctgaaaatgttgcagaacaccgagtcgacatggcctccgccggtgtagagaagttgagcaaattcgcacgagtatttgaacttgttcagcaccaattggcccatttcgtccacgggcgtaaggccggccaaaaaatgggccaattcgtcgccaattccgtccccgccgccgccctcgtcatttgcagggcaattgctgacattcgatggttgcggctgctgttggatattttgttcaagcggaacttcgtcggcaattgaaagttcgtcttaattttaatttttcaaagatgggattaacatgaaatagcaatttgaaacaattatgcccataatgacaaacattttgccaaaaaataaatttaaaagtttttgagcggtcacagattttttaaactgaggaagactttagtttagagaccagggacggtcccgtccgaaaatttcaaagaaataaaataaaattgcaccgaaagtcgaaatcctaatcctggtccgaccctctttcacaccaacccaaatgtatcgtttcaatggtttgctccgcttcattcctctgttcgttgttccctgaaaacaggaattattcgaattagacgtcctaacatttatttctccccaatttcccaccgtttttgtgcgtctgtcgccccatcgcctccaaatttgccctcatctgcgcatccaatcgttccaatcgtcgccccaattcgtcctccattcgccgcgtccgttcgcgcatggccaacgaagtgtccaaaaactggtcgagaaggtcgcccaacgcactcagctgtcgcttaagcaccttcagctctttttccaaattctttatgcgacaatcggcctaaaataacaatgattcatccttaaaatgtgtcaaaatgcgtctgaatttgtttgaaactctctctctctggccacctgattgttgccatttgtggcatttttcaaacgcgtttcgtacgccttccgagcatcctcaaaataggcaaaaagtgtgcggaatttggcttcaaaatcgtcgcctcccggcgcattttcgtctccgaattcgcccaataaatcattgtttctccggcaatggtgtggaattgtggtcccgacggaaaaaaatcgtagagttaataaaaccaatttttctggggtaaaaaaatgcgctgatcattaatctgaactcagattttgaaaaatcattgattttatctatgatttttcatcaagtacttgatttttttcaaaattttttaattttctttgagtgttttttccaatgattttagggtaaaaaatgcgctgatcattaatctgaactcagattttgctaaatccatcattttgtctatgatttttaaccaatgtggggtggtattcctttcaaatttgcttactgagttccaatggcggcagctcggtacttatacagtttgacccacataaaaaaaaatttttgtttctaatgataaaaacgtgtttctaggggttttcggggctgctgatcacgaatatgaactctattggacgaatttccgaatccctaacccgaaattcgaactttttttcgaaaattttttttttaatccgtttaaaatgtgtcaaaatgcgtgctccatgattctccggtgagctgctcgttcaacacatactcaaaaaataaataaaatttaacaaatttctaaaattcaacaaaatgccaaaatatgaagtgtaaaattggcgcgacaatcagttttcgcatggatacaaagctgccacttgg

SEQ ID NO: 9058 - DNA, 1167 bp, Heterodera glycines
tgcaggtctgatcaaaattttaaatctcatcgttaaaacttttttccttctaagctaatcgattaactctgtctgaccagctgatccttgtgtcgaaataattgatcacttttcatttctgtgcagaggtgcgatcatccgctgcttgtccaacattgtgtttgagcatcgtgtgctcggtgagcacaaggacttgagcaaggattgcaagaagcagctgcgggtcgcctatttgcaacaagaacaggtcgatgtgagtttcactgtcttttccttcgcttaagcgctttcaacaaaaaaaaacacaatcaaaaaaccgattggaggagatgggtgtggcgctgaatttttttgataaaagctgatcaggaagcgcaaaagccatttttggattaaagattactaaaagtcgataaggtcaaacccgagaattcccaagactcgagaatctaactaaaagacgcaccctcagcatacgagaccaagaccccaaaaaagtgagacttttcctcaaggccggcactctcgagaatctctagcagcaggcccgtaaccattggaccgaagagaaaaaaaagggcaattttccatgaaaaatctgcaaaattgaaaattccaattttttttaacaaatattacttttgaatacggtgttttagttttctgatcagaatttcattgaccaatcccactgaaagttattcgcatcggccttatcagtgatcagtgattatatatttttcctaagcaagaacagcgcacatccatctcattttttaaataatgtccatatttttttcaatttgttttgttttcctgcttccgctttcggtgtgctttctaccgtatacctcgttcataaattttttgattgtttactgtagtttgatgacaagcagcacatggacgacgcggacccacaactgatgaagaagtgtgcagctgatctgcaacgctacaactgtatggcccaacaacgatttgaggacgttgtggagtgtctacgggtcaactttgacaacctgggtcagtaaattttggaaaatatcaatgcaaaaaattgaaaaaataaaaaaaaagaaaaataacggggcaaaatttggagaactcttcacagcatccaacggggtccggacaatccgtcagtggataatccgacagtggaca

SEQ ID NO: 9059 - DNA, 888 bp, Heterodera glycines
  misc_feature (769)..(769): n is a, c, g, or t
gggaaaggattggcttgggattggatgaacagatggataagtttacgacgggattgggtcgggagaaagtagggcaatgtacattatgcacaaaatatgaaatttgaatgctacggatacagcaaaactcaatttcccaaacaattttagaactcatgcaaatacgacattggcaaatattgcgggaatcagaagggcgacaaagtgctcgactgtttaatggtgggaaaaaaattaattaaaattcataaaaaaattgtaattaatatttaatttatatgaaaattatataaaattcaaaatttaatatttttatttcccaatttcagaatacaaaaattgttcgactgcttcaaaagcgctgtcttaaagtgagttgtttttattcagtagcgcccaaaattaatattaatttatatataattttttttttggaagggttcgaaatttttcaatttttattaaattaaagtgcataatttttaaatttatcttttttggatcgtccccaaaaatgataacttatttttttacagtataattttaatttcattttaaattttcatttttttgccacaacctccactaaaaactgcatgttggtttcaggttgtgaaggagcgtatgcttgaacgggtgaaggacgaccggctgaacccgtcactgttggaaacgtgccaaaaagaagcggaacaatagtacggcactcatacattaaaaaggggggggggtcaaccaaaatttttgcgaaatggtctggagggggggnggggggggggtcagcggccaattttgcgaaatggttccggacatgtaaatagacgactcttttttttttttttgcttttcaaaaccccaatttttgctgcgcactttttcaaaaatttt

SEQ ID NO: 9060 - DNA, 4154 bp, Heterodera glycines
tatatatatatatattttttggaagggttcgaaatttttcaatttttattaaattaaagtgcataatttttaaatttatcttttttggatcgtccccaaaaatgataacttatttttttacagtataattttaatttcattttaaattttaatttttttttttgctacaacctccactaaaaactgcatgttggtttcaggttgtgaaggagcgtatgcttgaacgggtgaaggacgaccggctgaacccgtcactgttggaaacgtgccaaaaagaagcggaacaatagtacggcacttttgccaaatatatttatgaagaccggacatgattggccaaaaaccgattatttaacaaactttaataaaaatgatattaatatttataaatcaattacaatgctaattagtgaaaattgaattttgtcccaatttaagttgtgccgacgattacaagaagatcaacaacccgcagtattcacagcagcaacttggcccaatcattgccacttgcctgaggacacaatttgccaaattcggcagcggcgttcacttgtcaatgggatgcaaagatgaggtaaattaaatttgaaaatttatttgcttattttttctgatccattagtaaagaaactatattttggtcaagacataaacgagagaaattgactacattttgaggaagggcggtggatggattttgaacaaaaaattttcgatgggggatttaagtgaactactgagttcaaactggtaaaaatgcttaaaatggccaacagttattattcaaaaaatgctgaatgttttggtaatcctctaactcattattgacttattaatctcaaggcttaattatttgagtggtataacaaaaagaaaactgttcacttttaattattatgtgttgccgtattatactaatttaccgattaatgtataccaattactctaattttattaattgacatgccttaattgagtatttttaattagaaaattgcttgtcaaaattttacggtagtctgcttatctgtattctatctatacatgcttttcagttgtccaagctgatcctggagagtgagttcgacattcagctggaccccgcgctgtacaaggcatgccgtagtacaatcaacaagcattgtgccaacgcaatcattgcccggggcggcaactatgacaccgtgctggagtgcctgaaagccgatttctacgctaatcaaattccggacagagattgtgcacaacaggtgggtggtggcgatcagggatgtatcggaatgccgaattccgattgtcgattttcgacatttttgggcttggaatttcgttgccgaaatttttgtgggcctcgccacacatcctctgctgctgtgatatggccattagttaattactctgtctccaaaatgagtgttgcgattaaggatatgatttctggctagaaataaacatcttaggactctgtgttctttattagcctaccaagttttaaaaatttctttatctttcaaaaaatttatggccaaaagcactcaaaaagtttcctttggcacggtaaaaccgctaaaaattataaaaaacttaattttcattgtcaaattttgctgatcatttttggtcatggaccaaaaaagcaaaaaaatttacaatagcaaatgactatgttaattggcaacacattcagttggctcgtcgaacacaagaatcgctgatcgacatccatcttgacccgggtctccacgaggcgtgcagcgtggacatccaaagagtgtgcagagatgtgccaccggggcagagtagaagtgggcaaaatattaaaagattattttaaaaatttaatatctttttttattttaaaacaaatttaaatattacaatttaaataaacaaattttattgcgattttttaaaaatagaataattattcctaatcacttaatatatcgttttatttaattttgatgttgtctgcgaatttatcagatcttacaatttattgtttatctctaaattcattaaaaatcaatttccaatcaataaatcaatttcgcaatgcttttttccctttctcagttatcatgtgccttgtggacgcggcacggaacggccaagtgcatttgtccgccgcatgtcaaacaaaactgacggatcgaaacaaactttggcaaatggcacacgacgagtaccgaatggcattgccggagacatggtctgaggtaaagacgtaaagacaattgtggcaaaaaatgtcaaaaaaccatttggagtcattttactcataacattctatatagtttttttttctaaaaattatttagcctcaattaattcgttcaagcatttaaaacataaaaaattgttcaaaattataaatattttggtttttaattaaaaaaaaattcattagcttttaaatatgggtcaattatgataagctgtgattgaaaaaaaagattccgccattttaaatattttgcgtcgtttatttatttttttaaaataatataaaggaattttttgccgacaagcgcagctgggtttttttggcttttagtaatattttgctaaaattttaatcaataatttttgaaatataattaaaaaattgaaattaatttaggcatattccatcattgtgaaccacccgaaacggaccagcattctgtcataccttggcattggtctgctggtgcttttgctgttgggctgctgcttgggacgcctcagcaaacggacgtacaacgagctgaagaacagatgattgatttgtgattgatcactctgatcagaaaaaaaagaattttgttttaattatttaccatatttttatgagggttgacagaaccggcaattttttttttgaaattttaaacatgaaaaaaaatttcaaaaattcgatcagcagcaacatttgttgttacttgacaatagtgtacaaactatacatacagaaaaggcttttgcattgaaaaggaactgatcatgcaaatctgatcactcccaaaaactgatcatgacaataaattattccaatcaatttctgatcagtcccaaaagtttttaaacgaaatgtgatcagttccaataaattttggttgagcgtgtgttcgctcttaagcaaaatctgactgctgatcagtttattgtctgaccacttggcatttaattcgccggtcctgttcttatcatcgtatcacccatgttgattttatatctctcaaaaattgtgcagctgcaccaaaacattctccgtcgagtaaaactttgtgattttacgccacagtatggcaaactttaatcccgcccccttttttcattactgtaccatttttcacacccaaacacacttcctgccgatcactaaattgaagcctaaaaactattgaaaatgtaatttcaccaaacccataagcatcttttttatattttgtttaaaaatttatttttttatttaaaaaaaatcaatttctttttaaaaaaccttcattcaatttggcaacttttgcattttttaaactattttttctaaaagttttatcattttaaatatagcactcgcataatccatccgatacgatatttgtcaatcatacggtacaccaaatatttgttaaatccttctaattttgtctctgctgaacaagtccacccacattttttgttgatttaactgtactggttgataaaagatttattgcgttgtttgagataaataaagccaggaaatttcaaatttatgaatccccctgcgggagaattcaaaaatttttcgggaagaattccggcgggattttacctaaaaatcacatttaaagttcccgggatcccgcgcagaattatgggatttatgaaatctctaaaaataaatttaaaagaaaaaattttaaaaattataactaataatattgttttaattcttttatgtattaagcacccaaagatcaattttatgggttttttaggtgctaggtcgtttcgtaaaatccgccatttttgcgattttttcgacaaaacaggctataactttgcataaaatgaacgaaattttaattcttggtatcattcgatagcccagcttttctgtttcaaaaaattatcaaatatagactaagttatgataaaaatatgtcttattttcgcacaaatct

SEQ ID NO: 9061 - DNA, 1803 bp, Heterodera glycines
  misc_feature (6)..(7): n is a, c, g, or t
  misc_feature (39)..(39): n is a, c, g, or t
ctctanngagtcggccaaaacaattcaatagtgctaacntcgcccaaaaatctctttttgtcactgcccgcagaaagaacttcaaaattgcaaaagtttaattatttttgttttagtggataattcaccaattggttccttagggtgaaaatctgttgcattaactgagccatgatggccgggcaacttgtaagcaatgtttctggaaccaacgtcccaaatgtacacgaaacggtcactcgatccttgaaaattagtaaatgaacaaatgattttacgataaacaaaagcaatgaaattcttgatactactcaccacatgaaactcggtgtccgtctggtgaccaaagaacaacggagaaggtctcttaaatttgaaggtaatttcttgaaaaacgtattttgaactcgcgtcgtatatgatcatctatgaaccattttgactgtcaattggaccttttcaaagttgtgctgatgtccagtcaatgtcttcacacatcgttgtgagcttgcataaggtcgaatgtcccaaatgcgagcagtacaatccatggaattggacaacacgtggttaccatccggactcagactgagaccggtgactgtgtcagtgtgaccgggcaaaatatgaagcaaaccaagccgacggatatcccaaatctaaacaaatgtttatattaggtcatggccccaacatttaacactgaataatattccattctcgcggttgttaactctacaaaaaataacggaattgataaatcaaacaaacatttggttgattgtaagaaagtgaatagcccttttaaattttgttggctttatgtaatccgacagaaaacacataaaatttacgccccttaagatccaacgcatcaccttaagcacattgtcaatgcccccactgataatttgttcggctgtgtcgttgaatgtcacagaggtcacttggtaattgttcacactttcaaaagtggccacagggccccgacgacgaacatcgtgcacctgaacaaacgcataagtaatggatgcccagggcaaaggcacaataattttgccgccgtcacagccggagacgacaagcgatggaccacgccgggcggggtgacagccgttgacgaaatcggtgtgtgtacggaaacggcgtacgcatttcccactttccatgtcccacacgcgcactgttttgtcggttgaacaggtgaaaaggaaacttgaaatcgaagtgggacgcgataaacacacaaagtattaatgtcttgggaccatctcactatcagcaaaggttaactgtcaatgaaatggggttttgacttggaaacaacaccaagcgtgggactaacgggaaaagctgacaatatgaccggtcccaaagcgagtgacaaaataaacccaaaagaagtgaccttccatcggtgctgaaatgtacgtccataatggcgcctttgtgaccggagagagtggagaagttctcacactcgccataaacattccaaaagactaaacaattaaaggtaagtaacaaaaaatatataatcggacaaattcgctggtcgtagccgacagaagcgagacatgtgccatcgggactgaattgggcggcgtagatttcgccctcatggccagtcaaaagcataatcggacattgtagaccggacgctcgttgctcccccgtgcgcgtagaatccccgagcgaaaccaaagagacgtcctcggaagaaagacgctgccgtttgccacctgaacggattgaccatttcaaatgagcattcaatcattaagcaataataagaaccaaaag

SEQ ID NO: 9062 - DNA, 2520 bp, Heterodera glycines
tttaagcattcaatcattaagcaataattaagaaccaaaaggataacaagaaaaccttttcaaatgttttgtgagttaaaagaatacgatttttcagatgctcaacctatttggcagcgcattttaatcttttcgttaattacccgtatcgcatcaaacatttcgagtgtatttcaaattcacttactcgcaggaacgagtgggagtgcaggtcgtttgaatacttcagtcatctgagaaatccagcttaaaaacatgtaacaagacaaagcataaagtcacaagtataaatatcggttaaacaaatgattaaacaaaagtaagttaaagacaattaattctgtacagttttaagataattaacaaaaaaacaaaatcaagtggaaaaagagacaaaatgacacagtccgttgctcgtccttcgttcattccgcttggctatgacacaatgtcacgttgtgtttgccattgttttgattgaccggcaatttcttgcgccctcgcggcgatgtgcgcggtttaaactcagtgacagtgaacgaaacaccgctcacattgaccaccattttcttggctgcactccgaacgacgagggcatctcggaaagggacgggccgacgacggatggtcagtttggactggaaaattaattgaattgtcaagatgtgtgcaaaatgcccaaatcacaaaacataagcaaagttacattagaaaatcaacaagcaataactaaaaaacaacagcaacaacaacctgttgtttgttggacagtccaccattggccgatggggcacgtgagggcttcggcgaattggccattgccgaagtacacggactaaaagagtcgggcgaattgcgcactgccatttcagcactgttgcgctgttttctttgagtttaatctttcatttcttttttaagcaattattttaattctgttaagtccaaaaaaaacaaacttttggtgtgccttttcaacttcaaccgctaatttttgcaccaaagtttgctgctgaacaacagagggatttagtcgcggctttcgagttgaagtcccttttcgagtgtcgcacatcaaacatttgaatgcttcgtaacggttgcgaaatgtgcaaaccgaaattaaagataaattttagattcaataaacaaaataatgaccaaaaaagtgctaaatgaataaggtttattaaaataaaacaaatcaaatgagttaaaaccttcgccaacagtgcccttgatttattacctgtacattcccaactgcccggttcaaatgccccgtcttcttctccacgaccggcgcctccgctttcccctctcctctcattttcggcgttgttttcgctgtcttgcatttccgcggaattacaactgccgtcgctgtcattccgcgtggtttttcttgtgcctctttttccaacactcgacataatcaagaattacataatgcagaaatctttgctccaaatcaaaatttacgagtttatcttactgatgatgtgtttttattccttctatcattgagtatcgagtcacatcaacccttatctaacatactcccgccttaaactattgtttctacaaaacaataaaagtttacaacaatagcaaacaataagttaaacgtgagaaagaacgaccgttgccctttcgccttcgttctttccatttggaaattttcaaatttaagagacaatttgccaaataattgtcatctcgctcgactcgaagtgctcgtacacacggcgattcaattttgggctccaagtacaattaagttggttttttcgtcttagtggtctgtgagttagtcaacaaaaggggggtctcaggttcaagtcctccttatgttgtgtgttaatttcaatttcttcttttaaagaaggcagaaatattttttattaataaattgttgatatcattggaaagctctaagtgtcctctatttctggagaatattgtaaattttatttggtttggccttaaattgtggacttggctaaaaaagaattaaatttattgaaaacttcacctagttgaaaaatttttccctatgttcaaattttcttgaaattttgcctagactagttttttggccctctctatcgaattacagtttattttttagctgtctagtttttaactcgagatcggctcttctatttttacaagggaaaatccccaaaaaaaaattcaagttttgcaaagttttggcgttctgattactaaataaataataaacctatttgcactgggagcccaaaattgaatcgccgtgtacactatgggtcaactccactgtgcagagaaaagcattctaataattttggttaaaagagtacaaaatcaccttggacacttagaatcagtaaaaaagaataaattttagcattttggttagaaacagctgcctcggactgagttataacgtaatgaaaatttgaaactctcacaacttttttcatattagttaaattgcttagcattcgattagaaaaagattctccttttcaaaaa

SEQ ID NO: 9063 - DNA, 1228 bp, Heterodera glycines
acataatgcagaaatctttgctccaaatcaaaatttacgagtctatctcactgatgatgtgtttttattccttctatcattgagtatcgagtcacatcaacccttatctaacatactcccgccttaaactattgtttctacaaaccaataatagtttacaacaatagccatcaataagttaatcgtgcgagagcattcgcactgcccttatcagtcgttgctcgcagtccgtaatcgcccaaatgacgagtcagtcaatcacatcactctcatccgcagactgaagtcatggtgcacacggcgattcaattttgggctccaagtacaattaagttggttttttcgttggtgtggtctgtgagttagtcaacaaaaggggggtctcaggttcaagtcctccttatgttgtgtgttaatttcaatttcttcttttaaagaaggcagaaatattttttattaataaattgttgatatcattggaaagctgtaagtgtcctctatttctggagaatattgtaaattttatttggtttggccttaaattgcgcacttggctaaaaaagaattaaatttattgaaaacttcacctagttgaaaaatttttccctatgttcaaattttcttcaaattttgcataggcccatagtttgaccccctctatcgaatcacagtttattttttagctgtctagtttttaactcgagatcggctcttctaattttacaagggaaaatccccaaaaaaaaattcaagttttgcaaagttttggcgttctgattactaaataaataataaacttatttgcactgggagcccaaaattgaatcgccgtgtacactatgggtcaactccactgtgcagagaaaagcattctaataattttggttaaaagagtacaaaatcaccttggacacttatttgttagaatcagtaaaaaagaataaattttagcattttggttagaaacagctgcctcggactgagttataacgtaatgaaaatttgaaactctcacaacttttttcatattagttaaattgcttagcattcgcttagaaaaagattctccttttcaaaaactttttttagatatcaaatttgttcagtttagttgggaatgaagcgagttatggcagatcaaaataaaaatacaaaaaaggcattttccagtgtaaattttgaaatagcacaaaaatttacgccaaatgcgctaattggcgttatgaac

SEQ ID NO: 9064 - DNA, 1438 bp, Heterodera glycines
  misc_feature (1373)..(1373): n is a, c, g, or t
  misc_feature (1375)..(1375): n is a, c, g, or t
tatacaaatatctcctgatggactgtagtcaaaaatacaaaaaattactttcaaatcgtctacgatcatctgctaactaatgtcaggtttgagtgccaaaatgcaattctgcaggctcttatagaagaattagtaagtagatcgcaaatccctcttatgtgtataagagcatgtgcttatcattttaattttaacaattaataattcttataacattagaacaagttttttttaattaaactttactgtcgaaaactaacagcaccttttttctaacactgggcttgacccatagtgctggtacatattaacaagagcccggtaaaaaatattttacgggagctgtaccgggaatcccgggcgggagtattcataaatttaattaaatactcacaaaaatatacttaatgcacaaattttgaaggacaatccttttcttaaagaagaaataaacagaaaatttaatagattgaaatttgaattttttaataaatttctcaaaaccagaaataaacgcctgttttagaaatcagaaatggtgcttactgatcagcgacccgcaagccacatgaaacattttcttgcgtggcttaaaaaatttcggttttgagcccgaaaatgtcgtaaatccctgcatccctgacactagtttattatattaatacgaatgttcacaatttccattacgatttgacttttgattttcctcgttgataaatcgtttcattaatcaatcggttgacaattcagcagaatttctccatctttcttcagactttccatccgattgatctctccgccgattgcgttcgccgaagaaaattctctgctgaaatgcctttgtcatttccccaaaatgactctttttgctaatgacccgctaattgctgaaggcgaagttgggccggtgagaagttggcggaatccgtccgattcgctccccgtgctttccccgcggcataaaatttgcgaaaaagtgcgattaatgaaaagaatggccggacgtgcgattctcttccaaatcaaagccaaaaacacttaaacaccaccgttttaaataagtgatttttaaaaatggtcttggccaaaacgcaatggttctgccggctgactatgcctttttttaaattaaccgcgagagatgccattttttgcccttttggggtattgcctccttttgatttcagcaccatggcatccctctaaacagcacttttgccatggcattttttatttaatgccctaaactgaccaaaaagggtggggctttgcccggctgtgcgtgctccgttcgatgaggaggagggagtcattgtgggcgagcggcacccccaaggtatggcgtgtccacgccgttgcctgagccgactgangncgaactgctacccgggacgacgccgccgcccgctgcggcacttttgcgacacgacgcgtgccc

SEQ ID NO: 9065 - DNA, 1156 bp, Heterodera glycines
  misc_feature (36)..(36): n is a, c, g, or t
  misc_feature (45)..(45): n is a, c, g, or t
  misc_feature (51)..(51): n is a, c, g, or t
  misc_feature (97)..(97): n is a, c, g, or t
atggtttttggatgtggtcgataaaacggtgtatanataagcganaataantcataaatcaaatggtcgaaattatttcaaaaatggatcccttttntagttgggtgtcatgagaactcgtacaattgcttaggttaggcctaggctttgactaaacaagtttattttgtaaaatatgagttgtcttttgtacgcgttgccattgacccttttagttgctttagggtcccttaacaagtccacctgaaaccacacttgggtgacccgcttgctaaggccggtcaaatgggcaattcgttccaagtcggcgccgtccgggttactgtcactctgaacaatgttttcttcctttttctgagttggtcttttgcttgcccactttgaaatattgctggaggatattcaactgatcttccccaaaagtcgtccgtactcttttcgtcttttgctttgaactgcctaaagtgtacggtagccatttcaattcacaatagcaattcaaaactgctgaaatgttattggaaatgtcttcattgtccttttcaatggatatgatataaaatgccattcactgatgaatgccattttacccaattgccatttgattattccaaccaaattttgcgaaaacaatgccattaaaaagtcagtttctgcttttccctccctctcactttgttcgcccaacacaagctcagtgtaatgcatttggcacaaaagtcgtgggatggcgggcggaggtcgggtcaaatcgtccagcgaatattggtcccccgtccccaattggcgcttgcaatgctcacactgtgtaatcgaaacgacgagggttacggtaatacggtgggtacggtataaagtgtcaaaaggaaatgccattcataaaattaatgcaaaacgaaataatgcaatgagaaccctcgcttttctgtgatcattttgcccaccttaaaacatgccaaatggtagaaaaactcgcgggcgcgccgtacccaaacgaacggatcaatgcgccggtcgcacgtcgcacaataaattttgacgaaattgctttttggggggagtttaaagcatttgcataattagtcatttgatattgcttttgtggctcacttcaagaaagcattcgatgcaataaattcgctcctctctcacataa

SEQ ID NO: 9066 - DNA, 4549 bp, Heterodera glycines
tactttgtaaatgaggagtgaatggggtgattcgtatgagcaatagccgaattaaaaagtggctaattgtgtactcggccaaagagtaaggtggccaaacaaagcggaagtcgtattatttatcatttcttcacgaatgtctatactgcgacgctttttttcaaatttattaaaattactgaactttttattttttcgattaacttaatgaaatcaaaaatatatttttgtataagtacatttgcaaaattgaaagtttgatgtattttttcattaaacatataattaaattaacaatgtttgatatttatttattacaattgaatattaaataaaactttaattcaatcggcattttcataacctccttaatttttgagttattaaattaatcttcttccattagtagaagctaattgataattattgtcctaaattaattgtcattgaattgaaataagatttcaaatctttttattcaatatttaatttatctttaagcattattttaaatacgtttctatttcgtctcaagtattttttttataaattttcactcttataaatgttaagtattatatttaattcttccatggaattgcattaccaagtaaaaattatatatattttttgtttttatttattttttcagttatcttttaattttatcaaatttattcactttaattgattaatgtttaactcaggctttaattttatgaaaaatataaataatcaactattgaaatgcaataaggtgaatagttttttcatttcgattccaaaaaaaaagtttcatctcaagcgccgtcaataatcttttggtcagagcgagaaaaaaatgcatgtcgggttccctaaatgtcggatccccaaatgtcgttcggtccccaaatgtcgggtccccaagttgcaaatccccaaaagtcgcattacgcagttttttttatttttttaaaattttgcgaaaaatatttgctcattaaaaacaaattaaaaattaaatgattcgcctttttaaaagaagcccgaacatttatttaaatatattctcgaataaaaatagcgaatcaaagatgttatcaaaatagaaagttaaaaaaagcaccttttaccggtgtacatttataacttatttgtaaaaaaatcataaaattaaggcacaaataagataaaaaagctttagcattccggcgtgacattaacacaacccaaatgcatgaaattgaaaaaatttaagcttagcctctcaggaaccttacaggaattgtctatttataacgagttctaaaaaatattaatttcactaatacataaaaagaatattaaaaaataaatattttcttaaatgatagtgtagtttaatagaaaaatatggtagaaaatcagataggaattgttaaatcattaaaatttgtataaacaattttcttaaggaaaactttaggaaaataaaaagcagtttcgaaacactaaatttccaaatacggagaaaagtcaaaaatgttgaaatcgaaaacgataattgttccttttttaagatagacaattatagctagacctgacaaaggaaggtccccaggtgtccgtgggatttccgaatgaaattttgtgggtggatagagcacatagggttcttaagaaaaatggtttaatttctgagaaataagtaggagtgccgagttatgatgtgccaaacctttatttttgcccccactagttcgaatccctcttatgtaaatttatttttttaaattttacccttgaacaccctttttgaaaggtaattattttcatttataatatgcatttatatttgaacgaaaatgcatgtaaatcctttaaatgtctctgcttcaaaaaaaattctcaaaaacaaagaacaaacagcaattaatgcatttgaaacggatattgcaaaaaattttgccgaagaaattgaaagatgcaccaataaaaattattatttatatataaaaaatataaattgtaaaaaaatcatagataaaaatcccgcctaaaaaagaaatgaaaaatggccagaaaatttgagtttttggcctttggctccactttcctttagtcgatgtatcgcctcaattcaatttcttttgcataaattgcacaaattgtttctaaaaaaagttatcttttgctgagcatataaataaaatagtaaaaaatgcttatttaaaggcatatcatattttgagaatcttatagaattagccacgcgaagaaatattgcttacttaactaccgcttttaaaattatgaagggttttacgagtcttgatgctagtaaactttttcctttttctgatcgatcaattgttccaattcaggcagataagacaaatcttcagggcattactaaaagctatggtatgagttctaagggatttcattgacatttacattgacatattattattttatttttttaaattttattctacattttcatatttttgtatttattttgacattctttttgcttttttttctgcatcacctaagagcactaacgtgcctgtgggcaaggaaaaattagtaaaattgctgttttatattttcagtcattttatagcatttaataaagcatttgttttctcatgccatagtaattgatttcaaaataaaattttattgaatttatcccctcatttacaatcataaaatattacattatatacccgaataaattttttacttgacatttacatttattttattaaatataagaatagattctgttttttgagatttttacactaacttagtttttctcttgagctggcattatcttaattgaattaataatggccatatattttgataataatttatcttgcaactcaaaatatgtaagttagttaacttctattctaaatcattattattcttgtttttattggagatatgaattttattttatttttggtaattcttctaaaatgtaaatttttaaattttagtaaaaacctttttttagtgtttgagatttttgagaatttatagaaatttcttgtgaaaaaattaatttttttttttgaaaatataccccgaaaaaacacaaaaaattaatttttaaaatactaaaatgtgcttctaaacatatttaggtttttttatggaatttgtgctcacctttttctaagaattttcttccccaaaaataaccatttataaaatttttatttacttattggttacttaaattttaggtttgttcgtatttgatcgttatttatttatattttcttttaaagtaatagtttagctaaaattagagataaacaatctaaaattgttttttatatttaatttttaatgcttttctatgagtcaatattttagttttacgttaattttttgattccaaataagtctacgcaatatttttggctgttttgcacttctaatcttacatatatatacatatcgttcataattccatttcaatgttcaggagtaatcccattatttgtaatattgtcaaaatttgcttatgtaaatgtgagtgggaaaaattgaggtcattttttctgattatttaaaatataaattgttttttttatctattttgaagatacaatatttttctttccttaagacaattaaaataaatattgaatgagtttaaaaatgtaataatataaggtaaagaaattattggaataataatcacatcttaaaaaataacaaaaaataaacattatccaaaaactgatgaaaatgaaaaattctaaacgatttaaaaaatgataaatggcacatttttttgacatcagaaccaattatgataataaagaaaaaacgaagctgctcagtaaataaaaaaataaactaaataaaatttatcaaaaacaataaattacgtacatacaacaaaaatctaattttgtttagttgcacttttgacggtttaactgaaatgcgttacgtttcgggatgatcaacaattgtggctcctttgtgattcgttttttagaaattttttaattattgttgtgtctttaggaaatatttattttgacataacaattaacaaatgaaaatgaataaaaataagagttattatttaaaaattttaataaaacgtttagaataaaattatcattaatttttaaaatttttcaattttaataatgataattttatcgataactgaattaatagattgtattaatggactgaatggcatttattggtttaaatctaaagtttgaaagtttaaggaatgtgtactccaacagcaattgcgtaaaatattttagttttattttataaatatatgttttatgataatcgataacattcgattggtggacttttttttgaatatattaattatgatttgattttttaattttttctgatactgtttaattaaatttgttttcttttatcttagtgacatatcattgttatattatataaataaatcacttctgtttatataaatatttagcataccctgtttatttgattatttaaaaatgtcttacaggaattattaaatatcatgatattattaagtatatta

SEQ ID NO: 9067 - DNA, 2966 bp, Heterodera glycines
  misc_feature (2159)..(2159): n is a, c, g, or t
  misc_feature (2189)..(2190): n is a, c, g, or t
  misc_feature (2195)..(2195): n is a, c, g, or t
  misc_feature (2203)..(2203): n is a, c, g, or t
  misc_feature (2205)..(2205): n is a, c, g, or t
  misc_feature (2219)..(2219): n is a, c, g, or t
  misc_feature (2237)..(2238): n is a, c, g, or t
taccctaattaatagtataaaaaatattgttagtttcattatatcccaaattatcataacgtactttacattttatttcatcttatttaaattgaattatacttaataatttaatttgctataataaaatttttgttagaaccctttaaataaaatagttttcgattcttactttagcatcaaagattaaattttaataattgtatttgccaagaatagtaaaccttttttagccgaaagtttttcgataaattaaaattgtatctcttatctacttgagatgacgattctctaataattaataattcaaagattattttcttcttgtgcaagtttcgaatcttttcaagtcggtcaaaaatgttgaacttttcctttaacaaagttgaactcacttacaaagagatgagaatataattaaagaagtcatagatagggaatagaattacatggaaatccatatttttttcctggactgtgggaggcctgaaacgcacgaaaaacatgtttttagcttggtttgaagcttctaggaaggatttctatatccatattttccatatttttccatatttagcgatttatgtccatatttccatatttttccatattttggcattttgtccatattttatgtccatattttggcatttttcaaaaaaacttttattagaaaatcttaatattttcagaattgctacgtacagttaaaatttcagatcgattggttcatgggaagcggtcaaggttttttaaaaaaaactaaaaaaaaacgtccctattctaatgcaacacagtgtaattgccgaaaaaattcgagaccaatttccgaatgttgaccgactaattgcaaaacgaaagccgtctttgtcagagcgccttaccgagtcaaaaaatttggaaatgtatctcatatgcaatttcaaccaataaatttgaagaaattttgcactcaattttgaaaaatttatgtccatattttgacatttttgccatttatgtccatattttgaaatttttgccattttatgtccatattttgcgatttttggtccatattttattgccatatttcgcgatttttggtccatattttatggccatatttcgcgattttatatccatataattacactccctagtcatagatatttgaattattgtcatgtcaatttttgtatttcaggtttaatatgttttggttttttaaggttcttgtaacattttcttgacaatacacatttggatgaaaattatgaaattttttataagaatttaataaaaattatcaaaaaattaacttaaaatcttttaacaatgttgcaattgttaggttattttaattagtcgttgtttcaatattatttatattcttttctttattggtttttagttttctttacatttttttaatctcttgaaccaataggtgataatatgtccagtttcatgaacacaattgtgtatttaatcaagttataaattaaattcttttatttactatttttaaaagtgaatttatttaatctataataaaattcatttcttgagaataaacaattcctttgcaatataactttttgaaaatattatgaatttaaattaaaatccgtaattttttaattatcaatttcttaattttgtatattttatttttaaattaatgttaattaattaatttggcgaattttgttttaaattattttcataagaaaaactttttatttttatagaatgataatgtttatactatatttataaattatgataatttatgatttaattgaatcaaaattaatttgtatcattaatcatatttagaagtatttctttttagtttattctattttgttttagtttttttactcgttgttgcattatcattgaaagaaatataataatacaaaaaaagtgttatggataaaataataaataacaataatattttaaatattttatataaatcaattttttaaatttagtttttggctttatttttccgcagacaatttttttgaaataattaagctctttaaaaaattattgtcatcaaaatagaatttattggtctcaggaattacagcaatatttattttattgtgaaatatttttacgccagaacagcagaatactatctatcatttgcttatatttccttntaaaatattggtactttaacttaataattnntgaangaatattngnattaaccccccgtncataaagtgtatgcttcnnacatcgatttcacatgattcatcggaaccatcgcatcaatacgaaataaatattaattttgaaactgatgaatttttctgaaatttttaaaacttgcaaaaatacttagggttatcaatgaatataaaaaaaaaaaaatttggtggttttaagttagggataaaaaattttactaaaaactaaaggggggttttttaaaaaaaggtctcccccctttaaaaatttcatttttcttaaaaattaaactcttcttttttaaaaaagcccgggaccggccccggtttcctttggggcccggggcccggtttttctggaaaaaaccaaaaaaaaaaacgcccgaaaaaaaaaaccttttttccgccccccccccccccccgggccgtttttttttacaccttttttaaaaaaaaaagggggggaaaaaaaaaatttttttttaacccccaacaaaaaaaaaaaaaaaaaaaagggggggttttttttttttttttttttttttaaaaaaaaaaaaaccccccccacaaaaaaaaatatttttttttttttcaaaaaaaaagttttttttttttttttgggggcgggcggggggtttttttttttttttttttttcggtgtgttttttttttttaaaaaaaaaaaaaaaaaaaaaaaaaaaaaaaaaaaaaaaaaaaaaaaaaaggaggaggggggggggggggggggggggggggggggaaaaaaaaaaaaa

SEQ ID NO: 9068 - DNA, 2298 bp, Heterodera glycines
  misc_feature (213)..(213): n is a, c, g, or t
  misc_feature (262)..(262): n is a, c, g, or t
  misc_feature (2233)..(2233): n is a, c, g, or t
  misc_feature (2240)..(2240): n is a, c, g, or t
ttttcttttttttctctaaaaatttttccactaaatttttctcgtatttttcatcaatttccaggtcccggtcccggttttgcccaaaagtccctgtcccgctctactctaatcttttttccacataatttccgctttcccagaaactttttcacatttgtttcatcaaattttgcttctttgttaattcatcttttttcatttgcatctctnttctctccttctcatctttttccgtttgttctttacgttgtttcttttntaattcgttaatttcgtttgttttttcttcaatttcttttttgtcattttttggcatttttttgtttctttttgtcctccattagttcgccctccttctccttccattggcttttaacaaaaacatttatcaaaaacaattacggtgaagtgtatgcgctatactttttcgtcagtaaacattttcgtcagtgaacgatttcgtcagtgattttcgtcagtggataatttcgtcagtgaacgttttcgtcagtttactatttttatttatttcactgttttccatttttttcgtcagtgttccaattcggcagtgaatattttcgtcagtggctatttatatttcagtctaatttttttatatataattttctttgtgtaattttattttaatagttgagaatttgttttattcaaaaaatgggcttaagcaccataaaatgatatgatttaattattttcaccacaaaaaaaaaactaaatatttaaacgcctatttaatttcaaacaaattcgacagtggacgattttgtcagtgaattcctttttttttttaaatgcttaattcaattcaaaagtgcaaatggtatgcacaggcccgaagatattcaagcggatcacggtttccaatgtcctgtaaaagagcatttaaattgttgtcttgtctgacatatttcccctttcttgctgcgtgtggcccccttattccatcagcaggcgcaatctgataatcaataattcgctgggaccacatatcatcttcttcaatcattttccggacaaaaccgctgagtcgctgatttcctttaagatgggcattccaaattgcatgccagccttcaaggctgttattcgtgcgtgaaagtccaagtgccaaatgcattgcaaaaactagataaggactaagaaaatatgcaaataggcactcgagaacgcatgggaacgatcgcgagataagaagttggagaagtaaatttactaataatattcaacagttttaaagtacaatttctttttatgtaaatcatttattaaagcacaattaatcattttattttgcttagaagtaccatacgcaaaaagcgataaatactgtattaaatagtttaaccaaaaatgaagcacattttaattttatgaatccactgacgaaaatattcactgccgaattggaacactgacgaaaaaaatggaaaacagtgaaataaataaaaatagtacactgacgaaaacgttcactgacgaaattatccactgacgaaaatcactgacgaaatcattcactgacgaaaatgttaactgccccgaacattcgtcgcctttgcatttggcgttgtgccgcactcatcggtcgatggctgtgcgaatgcggcgttcccccgccaattgagtccatcaactggtcgaactgttccaacaaatgattttctagcagccaataagccaattggacgagcagcgaaccgctgtaagactgcagaaggagcatgtaaaggatgacgaaaagttgcgcaatcattcgcttagaattggcacatcctttgttaattgaaggagatgattaatcgtttgatcgaataaaggtcataattgagggctaaggattaattaattgtttaatattaaaatttgaatttattcaaaagcaaatgtgcttcttctaattctcaatgtgttcgcgttgcaacggatcactggtgagagcgcagctgagggcacaaaaagagggggggggggggaggggaagtggggaaggggctttagccttttcagcgaagaaagcggcgaggggagagaccggtttcagaacattcgtgcattcattcccttttatacgacataataaaacaacaaaatatacaccaataaattatgcagcattttaaagttggcaaattgcaaaaaatgaacaaatggaaaagaaagtccgtgattttttgtatagaaaaatggaataaaatttaatgaaaancaataanctcttttctgtgcctataaagagctgaagagatgagcgagaaatgttttttacggaaa

SEQ ID NO: 9069 - DNA, 1488 bp, Heterodera glycines
ataaactcatattccaccatttttgccttttttagtccatattttcaggcttttttagtccaataatttcgagccctacttatcatttgattatccaagaagtgtttgcccctttttgaaggtcttgttggcggctttgttctgtctctgcttgcccagtggaccgctccgacaatgggcagcacatcgatcggactgcttttcagtctctcgaggtggattctctatcggtttttccgtccgaatcccgagagtcccgacattttttaacgtccgagtctaaaccccaagagttatgaatggatggacatttttaacattttcaaacaatttttgttttagaaaaaaataaagcaattttattgtctgtttttgaatgccttgcggatttcagctaaataccattttcggcatcttaattttcagtaatttctttctcttccatttacgtccctttttccaagggcatttccttgaaaattttatattacatggaataagtataacccttttttattgtcttcataaagtatcttttttttagtttcataattttttcctttgtccttgaaagtcattttatctgtccttgaaaaccagttttctgatgctcatgttcctccccccatgttcaaacaacaattctgccttttttactgaccacttgtctcctattcttttcagtttttcgtgccactttttagtgcaatttcgcacaatatgccaatctcagaaatctgtaaacaaaatttctcggcacttttagccacgccgccgttttggtcggtgccgtctgttcggccatcgaactgtacgaaggggtgaagctgaagaatcgctgattactgactaatcgatcagaaacaggcaaaaaggacaaaaaggaagaagaagaagcttctctaaacgatgaatccaaaggatttcgcacactaaaatgagcagtcaatctttttacacttagtcactcattttggaatttaacaatttttgttaaacgctgaattttgccatagttaaatttggatttgtacattgtttttctgtgattttcattgattgtcaaatccccaaaaatgatatttttttcggggaggtcaaaccatgcaaatcgatggcgtttttttttgctttcactagattttttgcgttgcgaaacttcgtgcggaaggaatttatggctgccgttaaaataacaaataatttactttgattataaaaagaaaatatttaaaaagtgtttattttttttgaaacgggttcatagcggaccagggatggcattccgaggcccaaaaaattttcggaaatcggaattccgaccccaaaaacgtcggaaatcggaaatttttgaaaaaattaaaaaatataatcaaatattctaaatattttaataagctaaattttatattattattcataaagattaactcagggttttttggacaaaaatctgttaacaaatcgcattaaaaattacaaattttt

SEQ ID NO: 9070 - DNA, 1776 bp, Heterodera glycines
gatttcacgtttcatgttgccaacaaccgggagatttcccatttcatgttgcaacaaccggaatatttcacgtttcatgttgtcacaaccggaagactttcatttgatgttgccatgattttccgtttaatgttgccaacaaccggaaaaacaaccggaatatttcacgtttcatgttgccaactactgaaaaaaacaaccagagaagattaaagtttcatgttgccaagaaccggaagatttcacgtttcatgttgccaacaaccggcagatttcccatttcatgttgcaacaaccggaatatttcacgtttcatgttgccacaaccgggagattttcatttgatgttgccatgattttccgtttaatgttgccaactaccgaaaaaacaacctgaagatttcacgtttcatgttgccaacaaccgggagatttcccatttcatgttgcaacaaccgggagatttcccatttcatgttgcaacaaccggaatatttcacgtttcatgttgccaactactgaaaaaaacaaccagagaagattaaagtttcatgttgccaagaaccggaagatttcacgtttcatgttgcaacaaccggaatatttcatgtttcatgttgcaacaaccgggagattttcatttgatgttgccatgattttccgtttaatgttgccaactaccgaaaaaacaacctgaagatttcacgtttcatgttgccaagaaccggaagatttcacgtttcatgttgccaacaaccggcagatttcccatttcatgttgcaacaaccggaatatttcatgttgccacaaccgggagattttcatttgatgttgccatgattttccgtttaatattgccaactaccggaaaaacaatcggaagatttcacgtttcatgttgccatctaccgaaaaaaacaaccgtaagatttcacgtttcatttgacacaaccgggaaatttcccatttcatgttgccaactaccaaaaaaacaaccgtaagatttcacgtttcatgttgccaacaaccggaaaaacaatcggaagatttcacgtttcatgttgccaacaaccgaaaaaaacaaccagaagatttcacgtttcatgttgccaacaaccgtgagatttcccatttcatgttgccaacaaccggaaaaacaaccggaagatttcacgttgatgttgccaacaaccgaaaaaacaaccggaagatttcacgtttcatgttggcacaaccgggagatttcccgttgatgttgccaacaactagaagatttctgcatatttgggcctttttctttttagggcatatatatttgaaggatttttagtgcatatcttatgcgcattttttgtatttcttaaaccctagtcgtgtgaattgtgtagtcggcacataaaaccaagtctagagaacaaaacttcttctctaaaacccgaaaattaatgccgattagttcgctcgatcattaaaaaatgagctaaaaaaagtaattcagacaaaatttgacgagtcaacgaaaattaaagaaaaagtcaaaaaacatttgacaacattaagcagattgaccaaaactgttgatttttcgaactggcgacaattttccgcaacagccggccttatgacaaatcgtacagacaacaattggatcaattaaataatgattttgaatactttatgaattttcactgatttcaaaaagataaatattaatatcactaggagcggattttacggggcgaaaaattccaaagttcatccttatggcattgcat

SEQ ID NO: 9071 - DNA, 890 bp, Heterodera glycines
tcgtcgcaacaaattcttgcggatttttatttacagacttagtggagtcaattggtattaatttatattgattttcaatcccgtcagtattcttcacttttaccgtaatttcccgtgcttctttttagtgaacaattcgatagaaatgaacgaacattcgcaactaaactttttcttaattactgtcactctcaaatgttaaatccaaattaatattttgtacatatccgaaacggtgcgcaaaaaagtcaaagtccgcctttctccgtgcttttatccttcgtccttattccaatttcaaggacgcacaggactaatgggaactctgattttacgtaattttatcaatgaattaaagccgcataaaaataagcaaaaaccctaaaaaccccgacctattcattggacacaccgactcaaaaaatgagacatgtgtaaatagagagtgccgagaaaaaacatctctcattttggcgcactatttctttaaaaggtagccgaatcaaattttcgaaagtccatgactttttctgatgcttcaaaatgcttaacaattgcttattgttagaaaaattttgaatgagatcaaaagatgcccaatttggcaggcaaaaagataaaaataattttcgaaaatagtcactttataatttttttctttttttataaagaaatagtatgtaaaatgaaagatactttttttatctgcgctctctaatcatgtccagcagacatttgcgcctatgaacccgatttggtcaaaggcgcaaatgttgggtacttctctatttattgaacatttctcatttttcgagtcagtcgtcagtgtatggacgcgtaaaaatcaatgcatttgctaatggacggctcggattatatcacaattgttc

SEQ ID NO: 9072 - DNA, 3916 bp, Heterodera glycines
  misc_feature (3814)..(3814): n is a, c, g, or t
  misc_feature (3827)..(3827): n is a, c, g, or t
aaaaattgttaaaaatcgtactttttttgatcccgaatacactaaaaaaattacgatttgcttatttcctacccaaaattgttaaaaatgatcatgggaggcgaaaaatatgaaatttgatactatattaattgaccaatgatcttttgtttttctaaaaatcattgttaacatgacaaaaatttagcaggggtgggacgggacgtacgctacgcaatttgcaccattttccacgaccgcggctttttacgatttttttgttaagaaattacaggttcaagaattttatttattgaaattgaagcgcaattttaaatgacgtcgtcaatgtcggacaatttggcggatcggatgaagcatttgttgagcacggctaaacttgcggatgcgtactttttggtgggggacggagacggaaaggaggcgagtttatgtttcaatttttgatttttttaaacctttttttgttttttaagcttttgtctgcccacaaaaacattttagtgtctgcttccgacgtttttgaggctccgttttgactccaaaaatggaaaagtggaaaatggtaaaaaaaaaatgcgtaaaaacaacaaatttcctagcaaaaaaacccatagtagtgacacttttacgttgaaaatgtttatttttcaaattagcctctgccgataatcccgtggaggtgcctgatgttgaagttgtggcgttcaaagtgatgctcagcttcatttacgcggacgatgtcagcggactgaacggagacaacgcaatggcagtgctttacgcgggtgaaaaatttagagtatggacccgaattcgtaaaatgtcgaaattataaaattgggtttggtttttgttagaattcagggtttggaattggctaaactaacgtcaaattcgtgttcaacggccccgaaaacaaaccatagaaacaccttttcagtgacttttgaaagttgaaattttcagaaatcatcgacagtattacccaaaacagattaaatgcatgaaaaaaaactaatattgtattatgcatatgggtggtatcatttttttgaaatttactttaaaattttttgtccttttttaatcaccgaatatttttagccagaaaatacaacattttggggggggggggggctgatccgtcgatgtatgcaaattccaattccaaatttgtccaatgttttcttggcccttgttcagacgcgtcttttcgactttgaggtgggaaaacgatgatttatcttcttaatttatgcagagttcccaagttttttgaattaagcataaacagaacaaatcatttttaaaagtgagcctgtaggctttacaagagaaaaatttcaatttttaatgaaatttgattcctttaaaaaatttctagccctcaaaattcagaaaatcatcaaacttgggaggaataaattctgaatatgagtattatataacacattgtagaattttgcccatcaatgtttgcgttacatttgtcaaaatgccggccaattgtttgaatctgaggaatttttgcaaattgatcagaatttgctgtgcgaattattcgagaatgatcagttggtggtcagaaatgaatttgaactttggcaagctgtaatttttaattttttggtattttaatttatttgtttgtttttcgtttaggcactccgttgggccgacgaaaaatgtcgtcaaaatgccatcgaatgttctgctggaaaccaacgttgtcagcttggcccggcactgttcaaaattcgtttcccgctaattccagcaattgattttaccacaagcattggtaacaaacaatttttaaaattgataaaaagaaatttatttattttgcagttccttctggcgttttgacaaacgatgaattggtctccgtttatcagttccattcccacccgaatctccgcgatgttcccgggcttcgaccattggaatttccatggcatgaacgaattgaaggcaacagagggatcctggcgatggaaattgagaaattttctaaatttgcacgagagagagtggggagtagccgattcagtgatgctgtacaaacgaagggatttgaatggaaaatattggcaatgctaatttgtaagcgcaacgaaaagcaatgacaaatgtttgggctttttccttatgtgcgtccctccaacaaatggtgaaaaattggagcatttctaattgcattaattttaattaccaaagatggaaattggagttgcaaatgttctatcacttatcgaattgtttcccaaaagatcggaacggaggatttgtcgcagcaaaaatgtgaccatgtttttaacaaggaagagaacgactggggctttgcaactttcattctttttacggtgagtgacagcaaaatcagagttgcgatcgaagtattgaaaaaactcagtttagtacagaaaactcattcgttaaatcaccataatttgcatccaaatcctaaaacgaaacgttaaaaatcgcgcagtcgcggaaaaatacggtggtcacgctccatccctgttttgcaccaattttcaaaaaaaaattagtaaaaaccccaaaatgaggtgcaaatatcgtaactctagccaaactccttttctcatgaaatatatgggtcggggtcggggggggggggtcacttcggcgcggaccatttcggcgccgcaaattttgaaatgctataacttttttatttgtcagttaactttagccaatctggcatcatttgaaagctctatgtgtgctctatattcacatgtaaaatagaaataaatgattcaaaaataaaaaagttatggcacacggcgccgaaaaagccaagaaaaagtcaatttttgaggttttttggccataacttttttgtaaactgactacattttttgaaattttgcaatctaatagagaatctcaagagctatcgaatattaacaaaaatatttaatttggttgataatgaaaaaagttgttagcaacggcgccgaaaaggccggcgccgaagtgggcggttcccaaataaattgagaattaaggaattgatggagccgagcaaaggattttacaacaaaaatgaagacaaagtgaagctggccattgattttacggtggaataagaagggaaaaagcggaaattggccgacggataagcccatccatccaatcactcattttctgttgattactttgattaccatttacaaaacaaaataatatgtacaataaatggatattggttttttccaattgttattttttgtgtttttttataaaagtttctccaatgaataagcatttcttcccaatgtcaacaatagacaatttgttcattcattttaatttaaacgaaaaactgtattttttttgacatttaaaatcaggtgtaccacttcaatttttaaaccatgttttatatgtaaaatcattgcaaattcaaaatttaaatttattacttttttggcaaaactgccgattgttcgttccctccctctcctttttggcataagaatttttgtattaaaaagtctgattttttagctgtttttgggtcactgattacgaatatggaattcattttgttatatttaagaaattgtggaaaagaattcaaacaggaagcgaaaatgcaaaattttaaaatttcttaaattttatattagaatttgtgaagtttgaaaatgttttgtgttgaaatagtttaagatttgtttttgctttttttaataattttcgaataatgcgtaatttgaaaattggaatttatgaccttttgttcgaattcgagtccaggataggaaataggccnaaatgaatgccanattcgtgatcatagagtgctcatttttcagcacaaaaaattaccgattaagcactgtaaaaagcaccaaattttcacaaaataagcatg

SEQ ID NO: 9073 - DNA, 2946 bp, Heterodera glycines
ttataaaagtttctccaatgaataagcatttcttcccaatgtcaacaatagacaatttgttcattcattttaatttaaacgaaaaactgtattttttttgacatttaaaatcaggtgtaccacttcaatttttaaaccatgttttatatgtaaaatcattgaaaattcgaaatttaaatttattacttttttggcaaaactgccgattgttcgttccctccctctcctttttggcataggaatttttgtattaaaaagtctgattttctagctgtttttgggtcactgattatgaatatggaattcattttgttatattttatttaagaaattgtggaaaagaattcaaacaggaagcgaaaatgcaaaattttaaaatttcttaaattttatattagaatttgtgaagtttgaaaatgttttgtgttgaaatagtttaagatttgtttttgctttttttaataatttgcgaataatgcgtaatttgaaaattggaatttatgaccttttgttcgaattcgagtccaggataggaaataggccaaaatgaatgccaaattcgtgatcatagagtgctcatttttcagcacaaaaaattaccgattaagcactgtaaaaagcaccaaattttcacaaaataagcatgaaaaaagcacaaaaaaggcaaaatcagcaaaaaaaaaaaaattggaaaaaagcataaaaattaagggattaaaggcacagaaaattgaaaaaagtggtcaaaaaaacttttatttgcccctgattctaaaaactaccaaaataggtgctaaaaatgggaatgagatacataattttaaaaatcaaaaactatttttgtcgctaagttttttaataaaaaaatttctggaaatttaactgaataattaagaaatctataggcttaatgattaaggtttcgttctttagaacaaaaaagcgcgaaattggcacctaaaaaggcagaaaaaatcgcaaaggcattaaataggcacaaaaaatgggcaactaaagagatttggcctataaatgtttgagtcacattgtcaaaatgccggccaattattcgaatctgaggaatttttgcaaattgattagatttgctctgtatattatttgatcgtactcctttggtgatcagcaatgaattttcaatttggaaagctgtaattttaacatttattttgttgtaattattattgtttatttttcatttgacacacctttaggccgatgaaaagtgccgtcaaaatgccaccgaatgaaattttgagggaagaaaaattccaaaatattagcaaaataaaaggcaaatgaaacgcggattacagcttttgtcattccttaatattctagagcattttaatttcttcaaatttttgcccaaatccatttatgaataatttaatgcaataaaatattttaattgattctttttatcattttatttgttttttatgtggcaaatccaataaactttttttttattaaagccattttccaatttaaattaaaaaaaagaaattaaatgagaatgaaagcatataaaagcttggagaattgtgaatgtgttcatattttataaatttgaaaccgaaaatgaatggttattattgttttcacattttcacgttttttgcgcttattttctccactcaaatggtaattcaaaattaattaatatataaacacaattattattttaaacatttggaggtcaatgctcagcagaaagaaaacggtttgaaaataaataattaataatcatatacataggaattaaaaaactattatcattaaaaacgaagtaaaatttataattttaacaaaaaacaatttaaaaagcgaaaaattcatttttttctatttaaatttaccagttttttaaaagggtaaaccgaaaatatcgataattttccattttttccgaaaattttctcgatctaaaatattcatttttagtttctcaacccgtgacagatgcaaagcctgaaagtgagaaaactgaataatataaattgttattatttgttattatatttcttgattaaggatcaaaaattaatccgatcggttttcttggtaatattttcttactaaaccttttatattattaaatttaggcaatcaaacaaatccacaggccaatagtacggaaaattgtaaaattaatattaatcggatttattttaaaaaagttcagtttctcaaccgatgaaaaatgcaaagcccaaaagtgagaaacacaaaaatgtggaaattacattaataatatgtattgctttaggatcaaaaattaatccgatcggttttcttggtaacattgttttttttattaaagattttatattattaaatttaggcaatcatacaaatccacaggccaatagtacggaaaattgtaaaattaatattaatcggatttattttaaaaaagttcagtttctcaaccgatgaaaaatgcaaagcccaaaagtgagaaacacaaaaatgtggaaattacattaataatatgtattgctttaggatcaaaaattaatccgatcggttttcttggtaacattgttttttttattaaagattttatattattaaatttaggcaatcatacaaatccacaggccaatagtacggaaaattgtaaaattaatattttaatcggattaattaaaaaaacagtttctcaaccgatgaaaaatgcaaagcccaaaaatgagaaaaatgaaaaattattattatattttaagaaaacggatatgttccacctccaccgcttccggtcggctggtagggtcttccgccagtttttgtgtaatttttattttgactgaaatttattggaaaataaaaaatctgtaatattatcaaattgaatacaattttttttcttgttttagatgatttaagttcattcttctgctccatgtaccataaaagcattat

SEQ ID NO: 9074 - DNA, 3702 bp, Heterodera glycines
  misc_feature (1619)..(1619): n is a, c, g, or t
caaataaatcaaaattcgtccgaaactatttttgaggctcccctaatctcatccatatactgtattcattagttttgtacctcatatgcccaactgtaatattggccacccaaaaaatggttgagcgcaattagttgcccaaaactgttcagcacatagagcattttaatggccaagtaaattagtgttgcattcagtccacatggtcgtcgaccatacggctcggagaagacggacacctaattaaaataagatatttaatagttaaagaaattttaatttaaaataaaaaaaaataattttaatttgttcgctttggtaatgccattttctttgatatttataatttttcgttaaaaaaatatgaaaaagggtgcttttaatagtgacgaatccaaatacgaatatttggggattaaatttttttttttacaaatttttctaaaataaaaatacctaaccctaatattttttgtgccaaaaaatctgtggcatgatgctaacaacattatacgatactttggcacttttgggaattataattttatttgaaacattttcaatttttggcattttcccccgatcatttacggaatcgctgatgtagccagccaacgcttcaatttctttgtcccgttcagcgccgatcagtacgcgacttttgcccgcctcctgcacaacacttcgcgcattgatcgccgtctgcttgtgcagcatattccatagccaattgggcagccaaaacagcagtgcctgaatggccaacacgaccggcacccaactaaaaattggagtaattaggcaaagaatttaaataatgataataaatggatgggcaaaagtcgtaattaatgaactaatttaataaattcatatttaaatacttattaatatatatttaaatttatttttaaattttgttaaagaaaatttatgaattaattagattagtaaagcattataatagcacaattaaaacctaattaatggtattaaaaattgacaaattcatatgtgaaataagaaattatctaaatattcgatagaattagatttaaaatattaaattctaatgattttcagtttttattttacctctctatccggacaaaccagaataatcacgaaattttcgatttttcgaattgatttatcaaatgaagaaaaaaaaattaaataaatatatgtggcaataaaataaaacatataaatatttgcattacaaatatctcccaaattgtaaaaaatggatttgtggcttttaatatttattatattttgcttattttatggaagtaaattcggcaaaatccgatcaaattttgacgaaatattcggcaacggatgggagaaaaatgaaaatgaaaaaaaaatgattaaaatggaacaaattgatcataatgaaagctcagcagctgatcaaataggtggagaaaatttaaatggtcgaattgatcaacaaaaaagagaaacaattcaaaaatttgaagcaattaaagaaaggttgaagcaaaaaggaaaatatgaatggaaaaagaataacaaaattgagcaaaaaattgcaaaattattaggcacaaatcgcgacaaaatatacaaatggaaaaaagaattaaatntaaataaaaataaaattttttatgaacaaaaaaagaaagaattcattgaacgaattgatgaatttaagtatttatatggccaaggcaaacagaaagaatttgtgaaggaattgggcatttctaatatgacatttcgtaaatggaaaaaagaattaatgccaaattgtcataaaagtaagtgaatttttggtttttattttaattttatatttaagcaaaaaacaaatattccaatgatgacaaattgaaaaagatgaagcaatatttcaaaattaaagaaggaaatccaaaaattagtgacgaaataattgctaagaaattgggaattgaaagagcaacactgatcagatggaaaaagaaatttgcttgaattcaatgacatgtgaagtgaattttgctcttgacatcagggctgcacgcaattacggattgcggattacggaaattacggggttttgggagttacggattacgggttacggatttttgggatttttccgtaattttgatccgtaatttgacttttggattattttttcgagacgatttcttgtacgattatttttataaaaaacaaagttttctattttttatttaaagggctacccgtatttcgatttatttaagaattaaaatagatttataattttttatttgttgttgttaaggctatttgggtagttcgcctagaaaatagaggcatcacttttttgtcacacctatttttcacgcattttatgaaaattcataaaaccttagccaggtgaggggaggaattccccccttcccccgcccgaaatgaaaaattaaaaatttttacaggaaaaattgggacttttaaattttttttgtcgatttttcttaataaaatcattaaaattaaaaaaaaaattgcccggcggcacctatcggcaccgccggaccacgatttactcgattttaccttatttttttaaattttgactacaaaatggcaaaaattagtctttttttggctaaaaatggttacaattcctgtttttgctgtccagcgctgaacttttttaaataacactaaataaattttaccaaaaaaaattcttcggattccccccccccccctccgtaatttttttctggctattaaaatgttgaaataattatatacatatacataaatccgattataatgatcagactttcaaaaaattttcaaaaatcaacccataaattcaaaaagaatgatttaatcagacacaaaattataaattatttgtaaaatttaaataaaaaatgaagaaactccatcaagaaaatcagttttttgatttttattaatcactatttaaaaatttttttctaaaattctgacaaaaattgatttttaaaaattacggattgcggattacgggaaattacggggtttttggacccccgtaattacggattacggagttccgtaactgagaaaatcgccgtaattacggattacggatttccgtaattgcaaatccagttgcgtgcagccctggtccctaggtattacctttttttgcacgaaagtttttaaaaatagaaaattgttcgtttactcttcaaattttgaaaatttggtacttatctagtttaggggacatttcgaagttcacataaatattcttaatgagtttaaataatcttttattgctgtttatatgattttaagatcactttatgtatttgaatttggttcgacccaaaaactcgaaatttgaaaaatttaaattttcgaatttttgttcgagtaatgtgtttaaaagttgaaccaatgactttagttggacaaaaattttttaaaagtttcagggggttttcggggtcactggtcacgagtccggtagccatttcgaccaatttcggacccagaaccggattcgaacaatttttgattttgcatatgctttatatatattatatatcaatcgattcctctaattgtcagttagaagttaaattcatgatttgtgaaaagacaaatttttttttggacgacaacgtctcaacagacagacgaacccaaatgaaggcagcgaaccaaaaatggaagtgtgttgaaactacaaaa

SEQ ID NO: 9075 - DNA, 1287 bp, Heterodera glycines
cccccccccccccttcccccgcccgaaatgaaaaattaaaaattttacaggaaaaattgggacttttaaattttttttgtcgatttttcttaataaaatcattaaaatttaaaaaaaaatttgcccgacggcacctatcggcaccgcctgaccacgatttactcgattttaccttattttttaaatgttgactccaaaatggcaaaaattagtcttttttggctaaaaatggttaaaattcctgtttttgctcttcggcgctgaacttttttaaataacactaaataaattttaccaaaaaaattcttcggatcccccccccccccccgtaatttttttctggctattaaaatgttgaaataattatattatacataaatccgattataatgatcagactttcaaaaaattttcaaaaatcaacccataaattcaaaaagaatgatttaatcagacacaaaattataaattatttgtaaaatttaaataaaaatgaagaaactccatcaagaaaatcagttttttgatttttattaatcactatttaaaaatatttttctaaaattctgacaaaaattgatttttaaaaattacggattgcggattacggggtttttggacccccgtaattacggatttccgtaattgcaaatccagttgcgtgcagccctgcttgacattacacaatcattttaacattttcatcataatttttatcatttttttgtaattatgcttttttaatccaaaaatgctttgatttgctttttaatatatatattctaattatttaaaaagcatttttttgcaaaaattaaattaaaataatttttcatgaattaattagtaaaaatgataatagccaattaaaatgacaacatcataaaataacatttcaaaattttatgaaattaaaaaaaattaaaggcagaatttgtaagaaaaaaacgaaggaaaagtgacgaaaaattgaaaaatttaaaaacggaattttgatcaaagaatttattgaaaatcatttataaacaaaaaatttttaccaaaaactatttttttagattaaaaaactggcataatctgcaaaacaaaagaaatgccaagcgcagaagaactaaaatttaattaatttagcaaaatatataaaaaaaaattcattacgcaaaaaaggaaggccaattcaaacataattttttttaaagtaaatatatttataattattaattaatttaacaccgataataagtgaattggtcgacgcgcttgctcaaatctgacggcacttccatg

SEQ ID NO: 9076 - DNA, 2820 bp, Heterodera glycines
cactgactcaccagtctcataggtgagcgcaaataattccgtagcatcagtggtggcgaaacgagcagaaatgattatgtccacgtccgcttcctccgcctcgatccaattgcgcgaaatattttgctgaaggatgccattggcacagcaaagcagggcacctgaaattggaaacgaacttttaggcattttctgcatgcatgaaaatttccgatttttttttggggggggggggggctaattgtaagccggaccggtgggagaaaattgggcgactgcaccgttttctacggtatagaatgttatggttttttgttggttttaaaaagtctgtttgtttcggatttttccgccaccaaattttgtttgctggccgaatgattacagtaccgcgtgctcgtttgtctttacggtagttgatctcgacatggttcgtgccgcaaatcccggcgcaactgagtgccttctcatccaaattgatgagtttgatgatcgctttttcacccttttttggcttaaaattattgtttttataaaattaatcatttctccgattttttgccttaatttgccaatggcagctgcacatttcggcactcgtacactttaatttgggcttcagttcacgaattttccaatccgcctccaaatggttgggcgtgccgctcagatcaacgcaattctgatctatacaattgccaatatgaaatctttcataagttttgcaccaaaaattttttcataaaaatttattttagaaattcaacaaaaaacaataatgattcaaaattttgtcttagtttgtcacaacaatcttcaattctctgtctttatcatcatactagtccaaaaaattaattgttaacgcaaaaattcataataaaaaaaacaaagacatattttattgttctatcgagaaaacaaatttttaaaatttcatgagtttcctaatttttcatttatatttttgcactaactctgtgccaactggtcgcaatgtgcaccagcataaccttctggacaaaggcattcattgcattgttttggacttgggtagcctccattttggcactcgtttttcgttccattacagtaatctgtacccaaataaaaacaaaaaaatatatattttaaatttcagccttacagtaaccacacctttacagtacatgtgattgattattgctgaatctttgaatgaaagccttttatcttggccaattgttcgttgataaaaacggcccattgtgatgaggtaataatagctggaaaccaaagaaattcgatttaagacagctcagattttttaattctctaagttttaaatcagtgctcacaatgtaaagaattttcagttatttttgaagcgcgaaaatacaggtcaggaacttggaattttgttgtatccttggaacattgcttattgttattttttattaaaaaacccattaaaatgaaaaaatgtttttttgtataatttaatgcattctctcatagataataaattaattactagagcgtcacgggaccgggaactttggcaaaaccgggactttttggctgggtaaagcgggaaaaaccccgggaatttcccggtcccggtcataactggtcaaaaccaggacttcggtactcagttgtccgtgttttggtcccgatcccgtgacactatattaattacccttgtttatcaatatgagccgggtattgcatcacagagtcaaagtcgtaggggaagccaaaattgtcggttttattgaacggttgataattcttcaatattatgaaaaataaaaaatattaaataaactaattagtaaatgtcatccataattataaattaattatatgtatatgtacaccaacaccgtccattctgcaaattggattgactttgataaagtaaaatgcgtcgtcacgctgatgttcatggtaaatagcgagtgcatgtaaaagttcatgggcggccgtgccattctgtaaaataaatggaaatggattaatagagccccgaggggcttttatttaaaaaataaattattaattaaccaattatttattatatacacaaacactgttccagcccagcgaaagttcctgccattttgccaaagttttcccaattttggaccaacttttacgaccgtcaacaatcacttcaatgccttcttccgccgttttgttggtgtcaagcatgaaagttatacatgtgtctttcctgtgataaattttgcataaattgttattttttttcttgtttaatattggagattgaagcacatacatgatgagttccatgccatgcttgatcgcttcctttctttcattaaaaacatcggcgggaactaaataatcaaagaaaaattgtcaattcaacaattgtaatacagtaagcctgtgaatgcgacagaaaaaaaaagtgaaaaaacggcaccgagttcaaaaaggtgggaaaaaaggcaaaataatttttttttttttttgacacttttatctagagtagagtgcaaccgggaattttgggcaaaaccgggaccgggaccatttgtttttctagtcatcgggacagtcaacaaaccagaagcaccattttttattggatttaaaaaacaacaactctaatcagggagagattccggcagcgcccgccggggggaaaaaaagggatttttagtttaatttattaaaaaaaacaaaacatgaaacaaaattaaattaaaagccaaaaattgtggtaaaatcgcacccctgataataaactgcttaagcttaaacaatactgtaacccgaacttttcggttaattttttttgtgttttat

SEQ ID NO: 9077 - DNA, 995 bp, Heterodera glycines
aaaattggtcaactttagaaaaagttgtatgaaaatacctaagttctattttagccataacttatgttaaattttataattttatttgaaattttccaggctaatagagaaaaagctgggatattgaatggtatcaagaatgtaaaatttgattgccaattaagcaatgttatgccatgttttgtggaaaaattcgttaaaattggcggattttatgaaacgacctagcacccttttttacacttaatttgtctaaaaattaggtaaaaaaagttttaaaaaattatatcatcatcgggattcaaatcccgattttatggggattccaatcctgaaaagtattttctcacacgtaaatatcgggatgttaaatattaattctttgcgaattaaagtggtttttttacgtccaaaaatttaaactatgttaaaaaattaaaagaaaaaaatacaaatatatttacttttttatttagtattttttaaattttaaagaaaatttctctataaaaatgttttttttgaaaattcctagaagattcagcacaagcaaaaaaatatttatatacttccccttaattttagggaattttaggtgctggcggtgcctataggcgccgccagggggaaaattgagaatttttactatattttaacagattttcattaaaaaattcctaattttgttgattttagaaaaaaaaaaattggtaatttcttgtttttatgaaaatttagcataattttttggaaaatttgggtgagattttcgttttgatgttctattacaaaatacaaacccaaattaaatgtcaaacattatgccaatttatcaaaattaattataataattaacagattccgatgattttccccaaaagcctctaaaatcctcaaaatttctcaaaaagccacaaaaatcctcatttcaaaaaaaaaaaatcctcattgacctatcaaaaagccacaaaatgaggataaatcctcagatctgg

SEQ ID NO: 9078 - DNA, 895 bp, Heterodera glycines
tttcgatttttgccactgttcactattaaatgcaaaaactaatctcattttgttgctgtgtgtactcctctctcctttatgcctgttattaaagtttcaatgtataatttctgtccaaaaatttttcatttttttttttgttttggcgtttcgccgccctcccattaatgggacaagtggagattagtggtcgtcgtcgtccccctttttgggcatcgtcggcgacgacggatcggcgcataccctcgcccccccccccgccgcacatttttatgctgctgaaaatccgatggacgcattttttggggctgattattaaaattattaataaaaatgtgcaaatttttgagttttggtttttgattttttacctttcttttgtccccacatatagttaattgtttgatgcacccgactctgacccatccgagctttggattctaaatctttttgggtgatttcgatcactcgataatcattatatcgcctaaatcggaacccgagtcgataacttttgcgggtgatccccccccccgatcacccgacactcttcatttcccttaaatcggaacccgaatcccttaccttttggtgattccaatcagccgacaacattcacatcccgaaaccgaaaccacaactcgaatccttcaccttttcgggtaatttcgattcatggcatcatcctgaacgactcccgaatcctccgcagctttttaagagttttattccctcaaattgacattctcgtcgtaatggaaaaggcatccatccccaaatcaccggccactggccccatatgggtgtaccatggacccacaagattgaattggataaacaatggccaaaacggccaaataaattggaaaaaaaagttctggctttttgtctctct

SEQ ID NO: 9079 - DNA, 3847 bp, Heterodera glycines
ttcacttttgcctatctgacggggtgactcattaatgttgcgcggaagaagattgagaataaatttttttattatatttattttttaaaagcttttgatcgcaccgccatctcattttcccctcctaatttccccgaaacgatattccccgaaaaaatcattcatttttgcctattggacgggctggtgactcattaagttgctcgggggcagggggggggggttgaaaaaaaaagttatttttatatctattttttaaaagttttaattgcatttgtcatctcctattccccgtaaagtttccccgaaagtttttcccggaagcaaatcattcacttatagccattttgcccgaggcattccgtccccgcaaatgattgccttaggcgatgtttttaaaccgaaccggaaaaacaaattctcttatcattatttaaaaatttcaattttttgctttaaatcggatatattattcttggcaattaattcaaatttatggttcttcgactaactcatctcccctaccgtaatgttgtttaattataataccgtaccaccgtttccccgccgcaattttacccgctttttttttatattgcgcctccggggacacaaaaaaaacacagttttatttttacaaccagcaaatccccgccatcgttcgtcgtcccattcttttgtcggaaggatgaagttttcatcatccaccaacaacaacgaatcgggcggatgaatgaatggatgggggggggggataaggggggaaaattttatttgtcggcccccgccccaaatccccgtccccgattcttttatgtcttccccgctccttccactttcactcgtctttcttcttcttcctcctcttcttccatccaatttaaccgtttgatcttcatcggttcgccgaacaaatgaagcgccccgttccaacttccattgcacacatttagccagccattaaatggggttaaattgaacttttagggcccagaaaggccttttaaaaatcaataaaattttaatttatttatttaaaaataagaaaaatttgattaaaaacacgtgaattcgtgtgattaactttttgactgaataatttatttatttttttaaattttttaattgtaatttggaccaaaatttatttatttttagatttttaatgttgggaaaatttttttttatctaattaaaagccttttacaaaaatatgggactgatcaaaaaatatttattttcattaatcttctctctctcactctctccattctttttcttagccatttattttggatgaaaaaccgatcgggatttatggcccggatcatgtgattaattacttggataggaaaagcagcttttgacgggaaaacccatgcacacagatgcgacgagttttgtttttatccagaatataaaattcattgttattacgaatttttcttattctagcttttttttctttttttttttttgcgttcgtccggccaaggttccgaaaagttcacttttaaaaaatacagcccaattttccttttattttctaccgcgcttacatgtaagtctattaaaaattatggacacagtaaccttaagattaatttgttcgaaattctcgacaaaaattggctgttttggagtctaggtaccaattcatgtgaccaactctcagggacttttggttcaagaacagcactgatctgtgtgtaccacataaccaattaattagtgatagtaattagcaaaatgatacgcaaattctgtacaataagacttgctacaatgtaataaatcctttgatatacaacaatccctcaattatatagtttctacagtaatctttacagtaattgtaataatgttttctctttttttgcagctcaaattgatcacccatccccaaatgtacaaagcaattttattgtgaaaatgcttgatccatacaaacaacagcccaatttctttttgccccatcccaatcattatgatcatcctgatcagcatcgccagcgcaatcatcggcaacacggatcagccgcagttgctggacgacatgcagtcggaccaccgatgccaccaccgccgccccaacgggtgccgtccccaaattgttgctcatcatccgccgcaacatcgtcggttgtgtcggagccgatcagccttgatctggccactgaacagtattttggtgggtagtcaattaaactaatgaatcgaactattttgtcgctaattaaaagcagggctgatgaccggatcattatcacattttctaattagtattattttttgctatacggttcatatttttcttttgatcatttttttgtggagtcacaaattttaattaattaatttcggtttttatgaaccaatttttgatatggccaattaatcagtccgtatttagatggggtatacataatttattagcctcgtttaagacacatacttttaaatgataagggttctttttactgatcagtattttttttttaaaatttctatacaaaattataccaataatttaaacttttttgtcttttctgtaaatttcataaatatttttaatgagcctttaataatttaattagttaattaattaattgattgattgaatttgcccctaattagtgaaagagaaggagaattgggccgccggtcgcttttcacgtcgcgttccgccccgtccgttgaggcgcacagcatgcgctgaacagcatgggcttgtaattccgttggaccgtttccggacgaaaaatttttcggtaaaattttgagttttttttgttgaaaatttatttatttttttcagcgccgcccaaataatgatgcgtttgacagttccgatgatgaatattacgatgaaggtgtgtggtgatgtttaaataaacattttattcgtgaaattttgagttttattttgggtaccagagatggcatggaattcctttccgacattttgggtcggaattccgatttccgaaaatttctgggcctcggaatgccatccctgacgagtacgttatcaaaaattttcgaaataaaaaaatccagttcaaaagaaaatattggaattttaaaaaagattctaaagcaaataattggaaattttttaatagtatatttaaattaaatagtgttttagaactaaaatatattgtaaaataagacaggaagaaaatttgaaaactattaataaacacgaaatttttttccaaaaaatgccgaaacataaccagaaaaatcaaaaaaaaattctcagtaaagaccaaaaaaatcatgaaatttaagaatatttaggcgattttgaacgcagacgacgggaacggtttgattggcacgcccgacgttacagtacatcagacctgacgacgtccgactcagagctgggacgcttagggactggaaagtgagttttgaattttgttggcattatgtctttcactgtggaaataacccaagtttggcattttgtgcaagttggcatattttttaacctccaaattcttttggtttttaaaaattcacgcgtaatttaaaattttttaactctttggcgcaatgttttgcggatttttttttaaattttggcgcattgtttggcacaatgcttttttttaaacaattctcaattaataatttttatttttgttgccaaatctttcatttcataaatagtacaaatatgtatttggttatctgtcacctctcagatgtcggctaatttgtttaagccctcctcccccccccccgaggggcaacacccgccgatgggatcggttttcattttcatgcctcacaaaaatccccagctaccaaataggagcaaagctggacaaat

SEQ ID NO: 9080 - DNA, 833 bp, Heterodera glycines
gatcgtatttgtgatcaagtatcatcatcgcctaaacttaattccttaattagttgtaatttgatatgtaattgctggcggtgatcgataatctcggtctgagttctcgagacgagtaatttatctgggttttggctcccgctctcaattctcgaggattatggaccaaaacaaaaacttccccccgccctcgtctttgaaaaaaaaaaattattttgaaaatttttcaattggaaaatttcataaaaattttcaaaaaaaattttccccgtcaccgcggcaccacaaaattctcgtaattatttttttcaaattctgatcacttatctctgactacaaatatggtcaatcaactaattagcccatatccattagccttttaatctttttgtattaatttttcaggaaatttctccaattttgccgagaccggttgatgtgcgcgatgacttggacattccgccgttgcccaggccgctgaagctcagcaaggaatggcgtccactgcaaacgtccacattgacaaatttccatgccacacttccgaagaccaacccgcaccattcattggccacaaaattggtgcaaaaacatttttatttaaatctaatttattcatatattttttaatataattattttgtatttaaagtttgttttgtaaaaaaaaataattcaattattataaattattatggtttttttttttaatttttaaatttattctttaaagtttaacttatttactttttattttatttaaaattttttttttttttttttatttatcgagcaaaccaaaggcacattagtgctcttacatggtgccaaaa

SEQ ID NO: 9081 - DNA, 2148 bp, Heterodera glycines
ccgaaatgaatttgagtagctttttagtattctgaactgtacaatttggtggacgatatatatttataatttgaataggttttttaaaaagtaattttatgtgaataatttcgctttggaattttgtcccagagaaaagtgtctgataagggatggttgattttaatagaattgccgatcctccgccctttttttcagttcggtttgcaaaaacaatttgatattgaccatttatcgtaagttccgcttctaccgtatttctggagtttaaccaggtctcattgatcagaattatagtggggtcatattttttgactatgtattctaagtcagatattttatttgctattgatcgggcatttattaaaaggcaagaaatccagggattattttctaccatttttccaatgtttttgtttggtttgctcgcgtatcccaagcgagttctgagcgggcgggggtctttcagagatctgatctccaagtcaaccacaaaataatattttattttgaaaagcaaaaaaaaaatcatctcccaattctattggtttgcaagttgcaacagctgagggtgtttttgaaaaatgcgtaaattgcttgtaattaacgattaaaaaagtgggaaaaattcattccggtgaaaaatttgaaagcgagtttttccaatgtgagccctggctgtccctttttcatgaaatttgttttaacttatatatcagggatgttgcaaaaatgaaaataaaatacgagacacgagatacgagaaaaacacgagacgagaattcttttatataaattaattaaaaatttttgattgttcttcttatggaaaaatgatcgggccggtatttcaaatgggccagaaataaaacgacgaatttttccaaagaaaaaaattaattaatgatttttttcaagttaaaaaattatattgacataaaataaaagcgttttctttaattttagaaaacaaaaaacaaaatccatcttaaaatttaaccaacaacaattaatccgaaatcagtttattttctatttttatatcaaaatcaaaaataaaaaaatcaatttatttaaaattttagtttgttaaaattccttacttttgctgagatctatttctggcgcagtattttttcaataattttgctgagtaaagaaagggtccggcggtgccgataggagccgcctttttttgaagattagagtgcaatttgttaacagattttgtccataaaacgatacttttctggctttttggattaattttaaaaattttaggaattttgggtcgggcggtatgaagctcagccgggaaatttaggaagtctcgtcattttattaaacgattttgcgtctaaaaattgtttttggctatatttaaaataaaagaaatattttttttgtttttgttcgttggattttcataaataccttttcaaaaaatatctcatccgttaggagaaattcgtggaaagttggtggtaagcagcatttattaacacaaattcaaaaaaaaatgatgtggaaaattgaaaataaaaatttcctaaaaacggtttgtccccccgtcgtttctcctccctttctttttcatccaatttctgttttgcgccgttcgtccttaataatacccggccgttggcaccacttttgcattcttcggcctcaccaaaatgattgtcgccccatttgctgccacaatgcgattatcattagcaattgtgctgttggtcagcagccattttttggcccattttggcacaaaatcgtcaaccaaatgttgccgaaatgaactgctcgcccacagcagaagccaactggacagcacgacggtgcaccagtccatggcacaagcgtactgggcataaagcgactcaacagctgttggaaaatccaaccgagcgcaaacggacattccgatctgataaaggcagagaatagacattaaatgttgcaaaaatcatatgcggtgtgaacggaaagggtcattggtgctaggtcatttcgtaaaagtgccaattttacagattttccaagcgaattcgtcataacttttcttaagcacatccaaatgaaaaattttataatatgctagctcttgtgttgctttactgtactataaaaatttaagaaaattttcatcga

SEQ ID NO: 9082 - DNA, 1412 bp, Heterodera glycines
acttttcaagcttttagattatttttagagccaaaaaacctaatttttttttaaaaaaacctctattttggcgtttgccataaattattaacaacaaaatgcaatgaaaccaaaaatacaccctatgaatcgaccccagcctaaagcctacctattttggcggtttttagaacctaaaaattggggccctaatgatgaattaggtaaagtttataaagggtggtaactaattaggcacggtttattttataaactggaaatgaatttggcatttccttcgacgcttaccatcagcaaagagactgtcatatgaccagcgaatgtgcacagcgtgtaaatgcccaactttcgttgcgttcgctgagtttccgtttcgattggcaaaattgacctcctcctcaaccgccttcgccttttgtacaccgccaaagtgccgaaattgagcagcagacaaatgagcagcgaaatggtggcgacaaatgagcaaattacgctgactaatggtgcaaaattggtctgaaaaaataaaccaagctatatgaggtggaaggaagggacggcacacaccaacctcggcactctcgccaagccgaaaggaggacgaggaagccttcagagttggcacgagagtgacggacatttcgaaaactaagaccaaggccagcaaaggcgtgacaaaaatcaccagaacggcaacggggagcaggacgacattccacagctgaaagcaccgaaacatgactattcaaattgtgcactaattggatagcaataaaaaaaaaagaaaatagaaaaacaatttgtccttgggtttaagtaggtccttggtaaggacatactgtatttgcataattagcacttttaatttgattttaaattgttttgccttttcgtgactgagtggggtcataacagcgctcagacggttcacagaaacaaaaacagtggctaaattgatggcctgaaatgagtaaatggcgacgaacatgctcaaccgcagcacccaattgggcaacatggcataaaagccggaaagtgaagcaccgaatgcgacgggcaatttgaaggcgaaatacgagttgagagtgtgtagcaaatcctaaatgaacaggggataattaattaattaattataaataataaataattaaccattaattaattgatttatttaccgcaaatgccctcgcgatgaataaagcatagaatgagttatgcaattgcttgtggcacagaacggtgacaatttcggcgatgtaaagcaaaacggagggcaaagtgacaatggtggacaaataaatgaacggaatttgatgggaaaggaaccaatcaaacaaagggtcgagaagcattttaattccttagcaaatataatttaattttttaaaatgaatttacacttaaattataag

SEQ ID NO: 9083 - DNA, 2750 bp, Heterodera glycines
atgtgtgctgacagaacattgtgtgttaaatggtgggttaattcattttttcagtcagttttggcactttggcacatgaattaaaaaaagtgtgagaaaaaagcatttcaaattaattgaaattttttctcataaatttttaaagagtttaaaggaaatggaacattggtgagaaacagtgaattggcaacagaattgctttttacacatcaccaaaattaatggacaaaaaaggcccgcggttaaaagcacagagcacaaattctcacaaacggcacaaaacgaggaagaataattatatgggcaattctgatctatacgatcaaatgttgtttttcaaaatattcatcaaatttcttgcctttttaacaaaaataataatttaaattaatttgaaaattcttaattgtttaatatttgttgtttatattaatgacagatttatttttcaaaaaactacgatgagtcgcggattgaatacattcttacacaggtcctattaaggcttttcatttttcatttttattagagtgtttctcgttgaattatttgtttgtctttcacctttttcaaattggtttaacatttgtttaataaacctagaaaaatttattttatataaagccaatttcaaaaattgttatttatttgtccgtatttacatccaaaaattcaaaatttttgccttaaatcatgacaggacaaatttaatggcttttaacttttcatatttatgtaagaaggttggtttagtttgaagtttgtcaaaatccaacaaattatgaaaatttttttgtttttatgagattttgaagaaaacaatctcaaattcattttccagcattttttagtcggaattattttttgtttttccgcttaaaatttttatgttttggaatattacggaacaacatttaataatttccttctcactaatgttgtaaggaattaggcgctaaaaatggtttatgacaaaatttaatttgtgtaaatcaatttaggcacaaaagtttgagtattttgaaaatttagaattttcgacttttggttcgaatttgggtcagggatttggaatcgataaaatggatgtcatcatattcatgatcaacgaacccaaaaaccctaagaaccatgtttttagagaattaaaaaataataatccgtattgtttgtcccaaaaatttatgccctggaataaatgtgtaaaatgaaagaaacaatcccaaagaaaatgtttttttgtgacaaaaaaggatagatcacatcgaataaagggaaaaagcttttgaaataggaggaacaaaatttttgaggtgtgccaaaacattgcaaattttggcatttccattgtcttaaattggtccaaaagcgatgaagaaatagccaccaatccaaacgataatccatagcaaaaagattgtaatgccaatgtatgcgccacagtcttgggcagagcgcttttgtcgtcgattgaatcctggggaaaagggaaaataaatatgtaaaacatataaacgcaaaaaataaattataaaagtgtataaataaagtggaaaaacctattgaaattattcgaacattatatatttttgccctaaagtgaccaaattttttatgaaatctgagtatgagaggtttactataaaattatcagcagatgaaaattcggaggggaaacaacaaaatgcttttgcacttctatctgaaaaatttttgtaactgaagaattgaggaggaccggtggtgaggaaattttttaatatttatacaaaattttatttaatcacaatttaaatggaaaaaacgcctttaagtgattggataaaaaatgggtcatcaatcgcaaaaatatttgcctgttttcgagttttcttgatcctgtttcaaggtttttgtgcttatttttcatacataaaacccacatctctagtaatacgtatcagggatggcattccgaggccccaaaaattttcgttaatcggaattccgggggtccaaaatttttcggaaatcagaaatcggaattccgaggcccaaaaatttttcggaagtcggaaatcggaattccgaccccaaaaacgtcggaaatcggaattcggaagtcggaaatttttcaaaaaacatcaaacataataaaaaattttctaaatattttaataggctaaattttaaattcttaaccaagtaaaaggtgactcaaaaattttttgatctatttaaaagcatatttgctttaaaaaattattcaatgattttcatcaaaaattttacctttttttgcggcgcgttttttcaaaattttttaaaacatggcgggagaggtccggcggtgccgttaggcgccgccggggaaaatttttataattttaatgcaaattcttacaaattttgtccaaaaaatgaccaatttagcgatttgaggcaaaaatttctcaagaaaaataagattttagggtccggcggtgccgataggcgccgccgggaaatttttgaaaatttcagcgcaatttattaacaaaatttgtaaaaaattgttaattttttgaaaaaaaattcaaaaaaaatttccgaaaatttccgactttttatcaaaaatttcggaagtcggaattccgacgtccaaaattttttcggaaatcggaagtcggaattccgacgtccaaaattttttcggaaatcggaaatcggaattccgactccaaaaatgtcggataagtcggaaatcggaattccgtgccatccctggtaca

SEQ ID NO: 9084 - DNA, 998 bp, Heterodera glycines
gggaaaaagcacaaaaatagattggatgtgggaagacaaaaagttttttggctttttataataaaataattttaatttagcttttttatggttccttttttaattaatttttctttcctttttcctttttatttaaatttataaatttattttatttttgaattatttttcttcagcaaattgatgcaaaaaaattatgtgctttggttatttaatgaattcaaatttcattcaaatttggaaaaacatttttagcaaccatttcacctacacattataattttgaaaagaactaaagcacattctaataaattatttcctttgttacataaattaccaatgattttaaaatgatttgtcgaattctcattaaataataaaaagcacacaaatttgtatcattaattgcttttaaatagcattaattgtttttaaacatactaaaattttatactttttttttaacccttgtcctaattacaataagaattttacatttaaaaattaatatttattatgttttcttttagcaagcccaagaattttgatggttttaaaccaaggtattattattattattattattgttattattattttatttagcttaaagaaaatggggtagctaaaagcgaaaaagaattaaaaatatttttttaaccgcttaaattcatttttatttgataatgcaatttcattttacgtttagattcgatgacataaaaattcttcgcttttatctcattttttcaatattttaatacaaaatacacataatggctgctgaatttaatcataatattccatcgttaaatgtaaagtcagatttcttagtgagtttatgcaattatttaaagaaaaaagcataattaatttaattacttatttttaaacggagccatattttatttttcttatgatattatgttaataatgtaaaaaaggcgaaaaatatcagttaattgctcctttaaaatttacaaaaaaaaaatactgaa

SEQ ID NO: 9085 - DNA, 4282 bp, Heterodera glycines
  misc_feature (4225)..(4225): n is a, c, g, or t
gtgcgtcgacgtccttcgcgttttatgagcagcagcaaacgttgcaaatgctctcctaccaacagcagcaggagcagcaaacggcacaacaggtgaacgatttgcgagggggcgaacatttcgatgggtttgttcagctgcatcaacatttgttgtactcgaccggcgcgggaagccacgcgcaaacgcaacaggcggagacgagcggcgcggcggcggcatttgcgatgggcaacgaggtgaactgcttctactcgacggaccaagcgcagcagcaattcgccggctttgacccattggcacaacagcagcagcactaccagcaaaatcagcaacaacacttttattttggtggccaaactcagcagcaaccgcaacaacaacagttctattttggagggggagacaatgagacgggtgagcaaaacagaaacatttaatttttgtccggtgccaaatcctcttgttttcgaatgccaatgactcgctcattgggtgggcttacggatcagcgctaaaattgttaattagggttcccaataacatattaatgtcatttcgattccgccgtttaccgtatgcttttagcccacagtttccccccgctttccatgcgtccgtccgccgcttcttccgcgccgcggcatttccccgacggcgacgccgcggccgtcgctccgttatatgcttcggaccgccccctctcagagggaattcattcgcccgcgccgcctcagaaccaaaagagtgtaattaaccagtggaaggaactccgactttagcaaagcatttaactaattattactttattttatttaatcgacccaacactttttgaattttgacacaaattgtatttgcttttctcttctaattattaaaaataaagtacattttatagaattaattggactcaaaagcacatttcaatgaataacaataagacaaattgggggggggggggtttgtggattaaaataagtaaaaagcgggggatacggtaaataagacgcaatcgcaattacttatccaacaataagccgcggaaaatgcataccaggcagaatttgatttataattatgttggaatcatacctttattcaacttttcacctttggccatttgaaacaaaataaatatttgacaaaatgggtatgttgacagcaataaaatggattgttaaaaattgggttttttcgcatatccgaacatagaaacgaataagaaagtaccgtcgtaaggtaagcaaatgttgagcatcgcaacagttggaaagagagttcaattgaacagaacaaagaaaacaaaaaatgtcaaatagcaaagtgttgttgttgttccacaaggcaataacatcggcagcagcaccaattcaatcatcaaccaatcagcagcgatcagttcgttatctcttccatcttttctccgtctcggttgagaaatccgccatggtagcgacagtaatagacgaatctgtaaaaatcaaaaagcaagttgaacaatgcaatttgaaattcagggtgctcccactttctccaagtgccatggtccgaaagaacgtcctcatttccaatgacaatcagcaaatacttagcacggctgatcgacgtgttcaaacgcttaaaggcaatgcggaattactttttttaaaatggaacaaccaaatcaagcgcaaaaatccgatgtcaatttgacgcactgtggaaatgattatcacttcgcgctcagatccctaaatgctttttttaattgcgtaaaaaaaatttgtttttaaaatttatgtgctcagataattgattcgttgtcaatcatttcgtttcagcggattgacagattattccttgaacatcatcgcacgatttcgagaatttaattgcgagaaatctttcactttattttttgtaattctgggaattgaaccggcagaaaaatcatataattaactgagccattgagacacgaaattaaggtaattttagagcctttaatttttgcaaaatttaaacataaaagaaaaaacaacctgaaagccctcaaccgaatcgacattgacgccgggaaaactgccaagaatgtgacgcagttttagcaccttaaaatgaagcgacaattagtacacagtttgattcgctcatttctctttttttccacctgatttctgtacggagaaatcactccgatggcattttccgcagttttcgtctctttgagtatcctttccacgtaatgccgtaccaattcagcttcgaacaaattgtggtgcgacctgttaaaaccctgctcatctttgctgccacgagaggagtgaaaaatgacagggaaccccttaaaaataataacatgtaggataaattgggttcgaactaatcaagttgactttttaattcagtttacctttgttggaaggccttcccattcggtcaatttgtgaaagtcgccttgtccatcgtcgacttggagaatgttatcgtaaaaaagataagagcacggacgcaggatggcataatgagaccgatacgtttgtttaagagtcacaaaaacacgactaaatttggggcgagggatttaaattggcaaataaaaataatcactcgtctgcttgggaatatacatcgccgtacataatcctctaaatatatacataattaaggatatgttcatttattgtttgctgcacatcaccttcatcagcgaattatcaaagccaaaccatttcaaattctctggacggaccaccgggccgagctgtttcgggtcgcctgcgaacatgaccgatgtttgagggccaaccaagccacctattgtcataaaagaaaaaattaagtatcgctatttctccaaccgatgggaatccaagtgtccgcctccgttgcttggctcgcttcgtccacaatcagatgggtgaaaaagccacgcaatccaccggccgaaaccaaataagaagacgtagaaagtgtggaaatgatcacacgaaacatcttcaaattatgtcgatccgggatgccgaaaaaacgatttttagcctctttcctgtaaaaacaataaaattgaacattaaattttaaaaaatttacgccaaataagaaatgcaatccaatcttttgttccgattatatgccatcgtggctaaaatgggagtcaaagggaaaaaaaattaaagtaaagtacgaccaatcaaaaatattaattataactcacagagactgtgcatacgaaagacgtatttgggctccaaaaagtcgtggtccaataaagcctcggcaaaattgtcagccgccattttggacggagtgcataccaaaattctgttttgatcagattggaggaccaaatgtcgaatagattcgattaaagtgatggttttaccggtgcctaattgtaatgaaagcatttaaaaaatataaaataggtgctgattgtatgcgtccacaggaaacttgtctaataatattactgccaaaaaatattttcactacccaccaggtggcccaaacagaatgaatggccatggattatgagccttggacagaatggaataaatagcattcttctgaaacaaattgatactccgattaaattcctttcctcttcgacactttgttgacctgttccgcgttgtaattgtgattttgttcttctcggaatgtcatcccactaatctctttactccttttctcttcaaattgctcaaaactctaaaaaatatttgaatcttcgtaactttaggttattgcctcgctgaaagtgagtttcggaaaaacgagttgggacatgtcccggccatgttttgaactcgccatgtactcaatcgaacgaagttgcgatctgtacacaaacgccgagcaattgatcgcaacatttacctgaacacaagcgaataccgaaattaattttaccataaacactggtgttaccttattactcgagctgagcacacggccaagtcggagagggtccacgaaaaagacgatgattgagtgcgtatccaatttcaatttctcaatcactgcctaaattgaattatattttcattgtcagctgttgattaaaatttctgttggtccataaatgtgctcaaggggcgaccccggcactgtttgttacaaaaatgccgagcagatacccgcgtgcccttttaaaaaggtttatttccctcctttcgtaaaccgaacaaaaaattcgaatattcgatcgaatttgctcggtgaatcaaagaggatttangggtgaaagtgaaaacaaatattagtaaatttgtattagtttaccgaggcgcacagc

SEQ ID NO: 9086 - DNA, 1991 bp, Heterodera glycines
aaaatatatatcagaaattcatttgaattgcagtgttacaaattcaaaatgtttatgttagtttaaatagaggaatgtcagtacgagagcctgacacttaaaaaacggaaagaaagcgttcacaaccagcccaaatcattgtcccttttcaataattctcaatccttcaaaattacctcgtaaatggaatcatcatcttgtgaaacttggacaatctgggctttttgaagcacaattctcgcgtcttgggaggctcccttagataacgtaatgttcaaaaaaataagcctttcataccccgtcgaaagcccagcagatgtggacaaaagttcgcattttttcaacaaatgcatgcattgaattggcattcgccagtggaatttgcaatttgactagaatatgctcgaaaatggggttgtccaccaggtcgtcttccgaataaacggtgcccatttcttggaattctggtggcaatgtctgtcccctttgaaagtctttgtaaagaagaagaccgccgcgtaaccttaagaagatttaaaaggaagtattgtcgagaatgcgtactttctgacgccgtccttttgacggtctcttcgctccattgggtcgttgtacgtgctaaagtcctccggcgcatatgtataattgttgataaacttttgggctgggcttgctttccccgttgcatttgcgtcattcgtttcatcggatggttctccgtttcctctgtcgttcgcttgctcatctctgtgaccattattattgtaacgggagccaccaccgcgtctccgtcttcgctttccgcctgcatcctaaaattaatgataattgactatgagtgtcaagatcagcgaccccgaaaaccccaaagaatagtaatttatttctctgccttttataataatttttgaaaaatatcggatcacctaatgtcaaattgaactacatgaaaaatccgagatagacctcaaaatcaccaaaatcttcaaattcgtctggcggacgttgtgccccttgcgccgttggacggcacccactccgcgacgtggaagggccagcgttctgccctttgtcttttttgccgaatgtgttttcgttttttgagcctggaagcagaatagccgcatcgatgtactgcttgagaatgcgataggcacgagttatttcctaaaattaatagtcgaaaactgcgatgtcttcggacggatttggttaaaacctgagatttctgtacagttccacctttgtctgagtggtgctctttaatttgctgaaataatatttttagtcaagtgaacagcaaaagaaacagacaatgaagaaagcattgcgcagccctttcgtgtccacttttgggccgacatgcaatatggccatcatactaagcaattcggagtccgagaaattaaactcctaaaaacaagtattaaaacctctttttcttcaaattgcctacccttcgagactcgtgcatttactgatttgctaatgctaggagatccaattttgaaattcagtataaatatgtatttataagctgaaaatagctaacagttgaataataaaaaaggagaaaattaaaaggaaatggcaaggtcacaatgtttgttatgtgatggcgaccggaccgacgctcagtgaaacgtccccctacccccacccacttcagtgactcattgtcattttcaaatgaaacgtatggtaaaaaatcataagcaaaaggcttgacaaagcgcaaccggcactatatggaaagtgagtttttgaaacaaaaggggggacccttttgttttgcaaaatttttttaagataaaaaaccatgataattttttatccggggttttaaaggtcgctaatcacgaatctgacatgtattttgactaatttctaatccctaacacgaactcgaataaaaatcgaaattttgaatttttaaaattatgattttttgttaaaatttagattaggaaatcggaattgatcaaaataat

SEQ ID NO: 9087 - DNA, 2799 bp, Heterodera glycines
  misc_feature (2676)..(2676): n is a, c, g, or t
  misc_feature (2706)..(2706): n is a, c, g, or t
  misc_feature (2733)..(2733): n is a, c, g, or t
  misc_feature (2737)..(2737): n is a, c, g, or t
  misc_feature (2761)..(2761): n is a, c, g, or t
  misc_feature (2780)..(2780): n is a, c, g, or t
tatagtaaatgccaaataggttgtaagaataggatcatttgctacaatttagaacagaatgtaatcggcaagaaagggtttttaaactaatttcaatgaaagaacttcataacaaataaattaatgacttctctaaatgaattgcctgcaataaaaatgctaattttctaaattcgcacgtgccatccttgagcaccttccattaaacaccatcttttttgaggcagacaatcaatgaaactcacaaccttcggttgtaattagtggggctgttagtggaatagaaatgttaaattttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttgtttaaattctacgcccgcgattatctgataggacaataatatcaataaattttcttctgaagaagcgaagagttagcccaaacgttttcgttcctttctatttaatgatctatcatttcagatataacagtcaaaatttaattggccggctaaaaatgaattcggtaggattttatgaaaatagtttgaaaaaattgaaaatttctttcaaagatttaatggaagctagtagaaggatacctttttgagtaatattccagatgttgccaattgtttaatggcaccccatacctcaaaaaagcattattctttggctaaaaaatatcattagaaaatagcgggcgtagatactgaaaaaactgttcttataattttaattttacaattagaaacgccaaaggttacaattatagtaaatgcctaataggttgtaagaataggctcatttgctacaatttagaacagaatgtaatcggcaaaaaagggtttttaaactaatttcaatgaaagaacttcataacaaataaattaatgacttttctaaatgaattgcctgcaataaaaatgctaattttctaaattcgcatgtgccaaccttgagcaccttccattaaacaccatcttttttgaggcagacaatcaatgaaactcacaaccttcggttgtaattagtggggctgttagtggaatagaaatgttaaattttttgcctatcaaatattcgcaataaatgcccatctatttaaaaaatattctattctattaaaatgttctgtattttgctatatattaagaatagccgtacatctaaaggagtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacagtcaaaatttaatcggccggctaaaaatgaattcggtaggattttatgaaaatagtttgaaaaaattgaaaatttctttcaaagatttaatggaagctagtagaaggatacctttttgagtaatattccagatgttgccaattgtttaatggcaccccatacctcaaaaaagcattattctttggctaaaaaatatcattagaaaatagcgggcgtagatactgaaaaaactgttcttataattttaattttacaattagaaacgccaaaggttacaattatagtaaatgcccaataggttgtaaaaataggcttatttgctacaatttagaacagaatgtaatcggcaagaaagggtttttaaactaatttcaatgaaagaacttcataacaaataaattaatgacttctctaaatgaattgcctgcaataaaaatgctaattttctaaattcgcgtgtgccaaccttgagcaccttccattaaacaccatcttttttgaggcagacaatcaatgaaactcacaaccttcggttgtaattagaggtgctgttagtggaatagaaatgttaaattttttgtcgcgacaacgcgaaatcctaagataaaacccaaaataaaaaagagaaaaataaaaaacaatagaaaataaaatggggaaaaataaaacataaataataaaaaatatttttacatttattttggaaaaataatattataaaaaactatcgaaaatataattacataaaaatgaaaaaaccttttgaaatgaataacggaaaattgtttgaaaaggaaaagtgcatttcctcaggaatgaaaggaacgaaaattaattaatattanattgcgaattctgttaagggattgtcgtanacaatttattaataattaatatattanaganattggaatttgtaagggaaacggnaaagcaaacaattaatggngaaatggcaaaatcaaacg

SEQ ID NO: 9088 - DNA, 1153 bp, Heterodera glycines
cggcggcatcccaactgcacaaaacagaagggggaaggtgtgtaaaatgccatacattttaaatgtaatgaaaaggacttattcccgatttattgaaaaaaacaggctgatccagggagttgatttgttaagattttgtccaaaaagggaattttcgacagatttgttaacagattcaccaaaaattggtaatttcacggattttcgtaattattttgcataatttttaggaaattttggtgataactcttggagggggtaccaatagagaaaaacggaaatttaaatcagaaaatattgtttttggtgtggaagggtttgcctaacaacgcccttttaagatacacccagcccttcaaaatcatgcggcactccctttggaatgccatctaaatcggttttgcacaacaactcatgccaatccaatgtgccaaactcacccatgccctgcggcggtggcattcctccaccggcaccgcccgcctgcatcatcgcggcagcggccaatgggtggtgggacggcggtggcacactggtgcagcccatcggctgatggggcggcgtctgctggtgcatgccgtggtgatgggcagccgccgctgcggcgacggaccgctggcgctgctccgcttccattcgctccagcacaatgctttgcatcgcttgctgcggggtctgtcgggggaatggcgttggcaattagcaacaaatttaatgaaagaggttgcggcgtcaaaaaacactaatttcagccatttgcggtcacatttcaaaaataatggttcaaaggggtccggcggtgccgataggcgccgctgcatcaagttttttcaaaaatgtttccagaaaatcgttgaaaatttttttgaaaaatttctaaataagtttgaatttttttaattttgggaaaggggaacgaagtaggaaaatgaattttttggtccattcattcaaaagagttcacggggccacgggaacaaattccattaccaaaacaatagttataccaatattaggaggtaattcaggaaagaaaaacttttctgtaactttaaaaaaaacttcggattttgtgtacctcgttggtctccttcgtcctgttccatgatcggtttcatcggctgcaaaatttgcatcattttcagctcgcgca

SEQ ID NO: 9089 - DNA, 3466 bp, Heterodera glycines
acaaaagggaaacgggaaaagcattggttggcattaaggcaaatagcaacgaaaagtatatttgtttccaggcccgttgccagaaaaaatttttggaaaggggagcccaagacttttttttcttgatgcctaaattcatgcataaaaatttcattaaagttttcacgggtatgtttttgggcacctcaggcccccaatttaattctttttttcctgaatgacaccaaaatatcaaaaatttggtcactttttttggcgaaaatggctacaaattcccattttagggggcgcctaacggcaccgccggcccccctgttcccgaaattttttttggaaaaacgtgccgaaaaaaagaacggtttttgaaaagcaaaaaaaggtcacggcagccgaccccccttcgcaaaaatttttccgacccaccccccccccttttaatgtatgttgtaagatatataaaactataaatacacactcaaattcgaccccagaaacaatgccaaccactcactgaaatcccttcggatgtgtccgccttgctccggcgagaactcgggcaatgtgatgctcattcggccgctctcgtcaaaaaattcttgcgcaaacgcctcccaccattgctcatgactttcgggagaactctgcaatttgaagtagatcagttaatgtgatttaattgggtacattttgaaaaatttctagtgattttttcaaaatttaataattttcgaagattttttttagatttgaaaaaattatcgggggagtcaacgagctgctccaaatttaattatagatgcatacaatttgagttaaaccatcgaatttctcgtccatttactaaatattttttgagcaaaaaaatggggagaaaagcgtatgaaagacccggaatttgtaggaaatgttaaacaataactataaataaatacatttgtgctgcgatcaattgcttaggcatcactttttgtaaaaatgtttcttttgtttcgccctttcaatttttaatttccgtcattaaatagaaaaagcaaaaaattttataagaactggaaaattttacacaaataaaatgcaaaaaaaatctccccgctggcaaaattgcttaaaaatctgtcaaattttctatttctttccgggcggcgccatccgctaccgtcgtttagtaaatcgatccgggaaagaaaatatttttgggtaaaagggcattaaaagaggttcggatatacgttccaaatttgttttacccctcacaattttcctccatttacattttacattctttactcccttcacctggtggaattggctgtggaactggaacagtcgccggttcatctcttgcagcctgtactccagaaagggcggttgcggaatggtgggcgggaacatcagaaaggggcccggcggttgcctggggaaagcgcccggggggaacatcgctgcagcagccgccgcggcggccgccgctgccgcggagccgggcggcggtggtatgggcaacggcgtcgtctggtggtgtagcggtcctggtccggcgccgcccgccatttgcggatgatggggagccatatggccgacgggcggtcccacgggccctgcgccgggcggtggcccacccatggcattgtgatgatgcgctgaggaagccggccctagcgggacgccgccgccctgctgttggacgagcgctgccggatggtggtgcgggtggtgcatgggcggcatcatctgtgatgaggatgcaacacattaaaaattgttgaggtaaatgggaaaaacaaattctcgggagggccaacaagttcgagcagtaaaccatcaattaaatacccccccccttttttgaaccaacgagttaaagctgtacatcgatcgtgaggatcatttatggccctcatcgtttaaacagattggtactcacacggacgtaatcgtaatcgggaatccgtaatttgaaaatccataattcgacatttcatgaaatttacggagcccgtgacagctctgactcgtaccaaacacacaaggacaatgtcacacccaattcaactcagcaacaaatttatttgacttttcccagacacatgtttatcaagctggagcagttcacgccccgaccgactcacccccatctgcagtacctggtgctgttgttgttgttgctgatccgcatcgttttgctgttgttggtactgtgccggtggtccgccgcctccgccaaccatttgcggaccgcccaagcccgccgtgccgggctgttgatgctgcatcaacatctgctgctgctgttggtgatgcgcagacatcggaggcggtccaccgccgaacattggaggcccaaaattgggacccatcggcggtccagcgcctccgggagggccctgctggtagaagaagtcggggggcggaccctgggaattcaaaattaaatttttggaaaaaaccatttttacgagagtaagtatagaaattgcaaatttatcattagtgtacacgcccgttgaactcattatcgggctttttaggctatggattgataattttttgagaccaatgaaaattttccgttttaaaactttattaggtatgtaattctttgataaaaaaaattccaagaaacaattttaccttttgttaaaattgaggaataattatgattttatgcatattgttttaaacatcattcatttcgaggcgcaaatgtgacgtaaccaaaaaaatctatgccaattattaaaaccgacgccgcactaattaatgccactgacctggtgcggtgcgcccggctgtccgtagggcggtgccatgcccgcggacggtccaccgccgccgccgtcatccatgatcatgccctgctgatggggcggcgggcccgggccggcgttgcacggcgtcccgttgggcaacccgccaccaccaccgccgccgcccatgtgatggtggtgcgggtgcatgccgagcatttggccagcgtccatagcgccacccgccgacgcagtgcacatggccatgccgggcaccgagttcagctccatcttgaggccaccgcctgcaaattatcggttttatcatgacaaaatcattatttttcactcaattttgtgccggaaacaaccaaaatggatacctaggtaattatgtttcacattttcggccaaaatttaaaattcgagttaaaattggtgacgaaaattgaaggagttcggctataaaatttttaaaaattaggcttcgataccgggcggatgctctccggtgggcgtgctgcaaatggaggacggctcgcgcttcttgcgcacacgcggctgtttggcgggcgcaccgctcgccgtggttgccgcgtcgccgtccgcggtgtttttgcgacgcggcatttttttttgttgtggtgcccttctttaccgctcaattatcgattgatcaaaggccaactgatggagatgagtgtgaatgaaagatgaga

SEQ ID NO: 9090 - DNA, 916 bp, Heterodera glycines
gtttttcacgcttctcagctttatcttttttttcaaaattctcgtgcctatttttccctaaagagtgttgactttcatttctcacctattcaaaagaattctttccgcttcacacactttgtgaggggccttaatgggttcaacaaaagtgaggtcctttttgcatatcgaaagcagctgaaaagtgccactcaaaacgttccatcggcgagtgccattctcacaaatagcatttgagaagaagcacacaaaaataacgaagtgaatgggacggcaaattggagatgtaataaatgtttctaaatccatgtgagtgagtaaaattgggatgggcgggcgccgcgtgagcgggggggggggatttagtgaaatgagtgccgaaagtgtcgaaaagccgagaaaagcatggcatggcattagctaattactatgtgaataattgttgcgacacagtgaaatagaaataacaaaatgagaaagaaaaagtatagtaaaaatatgtgacaatcaaaatccaattaattaatcatttcaatgagtcaattttctagacagaagcattctggaagtgagacttttgtgaaaattgaaaatttgaagataaagtttgatttggaaaaaccttgtcaagaattgctcgacattcattcaaaaccgacatttctgtctgatcactagggcttgtaattatattgaaatccatatttttttcctggactgttggaggtctgaaacgcacgaaaaacatgtttttagcttagtttgaagcctctaggacggatttctatatccatattttccatattttgcgatttatgtccaatttccatatttgtccatattttagcaatttagtccatattttatgtccatatgtttggcattttccaaaaaacccctattagaacgaccccca

SEQ ID NO: 9091 - DNA, 1744 bp, Heterodera glycines
tattttttgaaataaagccccaggggctttattttcaaccccttcaaaaggaaggctttatttcagcaggaggaggcactaattgttcaacccttatttttttcgaaaacccaacaaaatgaaggtttttataaaaattttcctggaacaaacttttttattctttattcatttaatttctcttcttgtatttacaaaaaaattttctggactagagttgggggccagcggcgccggggaattgttgaaattttaccccggtttcaaagcaaattttgcccaaaaagtgtccaattttgagttaatttacgatgaaaagtgttttaaattcaatagaatttattgttaattagatattaaagaaatatgtatttggcaatttcaaaaaattaaaatcaaatttgggcaatggtaaagaattgtggtccctaatctatttttaaaaatataattttttaaatcggggttgcgtactgggaccattcaaaatcccacgctgatctctatttattcaaaaagtatataaaattcgcaaaaacaagaaaattcaacgattttttttctttgttacgcaatgaggcaggggaaaacgtcgaagttcgccttctcttcttcactgtttgttttttgaatctgaaaatgccagcgccgccctgtgcacatcttcgataaagcttgggccttaacggaaaatgattaacaaacaaattgacacttcgtttgtcttttgcctcaccaataacattaatgccgtattggtagattttctgtgggatggaagaccgcgtgtcgtcgtaataagagagcacaaagtccaaacctttctggaaagcgaattcaacagtcaatgccaaatcagtcccctccccctccattctgtccgactttgtctaaactgtcgtgtgcgcgcactatcaaaatggattcatagcattccactcggacggtcgtttgcgaagggtccgggaaattgtcgctgctaagtgctctgcttaagatataaatttgtttccttggccgatcaacgaattggcgacgagcgaaaatgtaaaggcgtggccaaagggggaagggatatctgagggggaagggaaaatggtctttgaaattagaaatcggaaacggggcaggcccttttacggacccggtgtttttttgcggctgagacgtgtttttagcccgtttgtttccaaccccgtatatgtgggaaatgccgacctattttaaattatcgaaaaaaacaaatgccaatttatttggcggtgccaactcactcacttgctctcccaccgaatcacttgtgtccccgtgttgtaatcaaaatccaactcgtccaaactgttcacatttttatcccatttgagtcgacaggaaatgtcctcctgaaataattaaaacttataattcgtaatcgcaacagtcccaaagatacggccgagtaaacccaaatccaatagagaatgtctttcaagaaatatttttattttttcccaaaattgtcagcaaatgtccgtaaggcgttttaggactatattttcaattgatcccaaaaatataaggctttaatcaagtgcgaaagaaatgacgaaaatctgtgcgagaaatagcatgaaaaacgcttatgttgaaaaaaactgtaactatcgcttacaaaatgccaaacacaaaacaatttgcaacaaataatattttagactgcattcgtatttatttatttatttgcgtattttccatttttcttgat

SEQ ID NO: 9092 - DNA, 4460 bp, Heterodera glycines
gatgccgcgctttcttttgctaaacgatgctcttcccttttcttctgttgccgtcgcttttgtcgtcgctcatttcgctgtgacgccgacgaatgtttcgagcgcattttcccacttgtcgattttatgatcagaagagtcctcggaagggtaagcgaatcatttggccctttcctttccattcgtttggcctttttcgccccctcctattttcaatttccttttcagtttctcttcattctgctctatcttttgttgttgttcattttgctggtcactgttaccattgtaattccatatgaatctcttcacaaggtaacgcttaaatgccattggatttgtctgtttaaattcgcttttttagccccaatggtcgctttttctgctcattttgttcgccgtttatctcgtcgtcaacctcttcttccatttcaacaaggcgtgccgagtgaagccgggcagtccggccaaagtccacattttccgactcaatctgtcaattgaaaagaatttttagagtgacaaacacccgctctgttacatctgccaaaactataagccaatgaatgctcaccactgctcaatttgcaatatttgcgttgtaagtgccgtttatatgctttttatagcctttttgttcactttaaatccgctaattcctctcctcccccaatcagctgaacatggaccaccactgtatttggatcaaccaatgcgttggcgccgataatcatcgctattttttccaatttctcgtttttgtcactatcggctgtcttacttttgtattcgccgccttcaacactttttactacaattattggcgtgtaagaatttcttaaaacaaaaaaagcgatggaacttttccattctgtctctcgcatattaatgggcgcaaatataaataaaatggacatttttactgtgctttcccattgcaataattaaatttggccgaacggccaaaagattttgcttttcccatttttaatatgcccctaattttagtcataaaattaatttctgccgcaactttcttgtgaaaaagggaaattttgaacacggagaggccaacaataagaatggaaaaatatcaaaagggttttctcgataaacattaaagaaatgcaaccaaatcgaatgattatttccccgtttaggccttcaccaataaaatgttttgtgactccaacactttggccgactttttgccgtggttcgactttctttgcactcgtggcccccactttatcatttcctccgtcttcttcacctatttgctgtgcatcattgtttttttgctcgtcggctctcttttatattggaattttgtgttgatttcctgcggcgagacttaccttggaattttggttagctttttttcgatctctccgattgttccccctcctccccattccctccaattaaattataattccccaatccgtcccttttctttagctccaatccggcggtttcggtcgcatttggcatatgcttttgtcccccatcgccacccgcgcttccgtgagaattggcgctccttcctcggcctccaacgcaacagtcgccgctctctttggcgtcacattttactgccctcctcccacgccacgccctattcactgaacgcggcctcggcctttgacgaggagcagcagcgactggtgacagttaaaactgacattggaaacggacacagcacaacacagcaacaggaagggacgccgctgattgccgactctccccaaagttcgaccgaaacgaataattccgccgatggcaacattttaatgatttgatgattattacccttgtctttcctcatcgattccttcattttacgggtattgtctgtttgatcaattggttttcgtcttaacgtctcaaacgtaatgtctgaagcatttcttcggggcatttggtttaaattgatattgtaaatcagcatatgaattgaaattctttttttctcgatcttatgtattatacattcatggatgagtacttaatgaaaatgacaaatcaaaaaagtattgtaaaatttaatttctttttcaatgtttgtttaattaaagttaggcacaaggcttttttccatttctgttctaagtgcggtgattaatgcgctcgtttgacgaatagcgagagaagtgtttgtatgttgggaaaagagcacagtgcaatggtacgaagcaggcgaagagttggcactctgtccagacaaaaagtcccgggacactttgcctaagcgtgaagtgagtggggccgccagtgcggcaagcagagacgaagggagagcaaatggcacacaagcttgaacagtttgggacggacgggaagagtcgttgaaacatgttgaagaagtgcttatgttgtttgggttgcagagctaaacgaccaaattagtgaaattacaattcggcattatctccatttggtgagggtacccattcctttttgaggaagttgaacgacttttccctcaccctaatcagcaattcgccttcacaagtccgtgcaaaagtgatttcctcggcattttggccatcaatttcctccccattgatgtcatgagacggtccatcttcagtgtccaaatcgtccatgaacattaatttgttgaacatttgcttggcatctgtcgctggaaaggtttcataatgccaaatgccctgaggggtcgttcattttccttactttcctcgggcacataatgcaaagagagtgaagggctgcccacgcggacgcatttgtaggcgatcatatcgaagccgagaagggtcggtttgagagcattccgacacaaagtgccggaagcagtggcgcacagctcggcgtcaaatctggccaaaacggcggctatttgtgcgtccattgaacggttaaggactaattgaagcgatggaaggatttgggcacgggcgcgaaacgcattccaacccaacagctcatccaacagagaacgctgcactctctgccaaagttggaagtgaaattggccattgaaaatgccaaagcccactctgagctgagatcgcatggcatccaaaaaggtggaggaaactcgggaaacagagaaagaggaggaggaaaaggcggccgacgaatgggtgaggggaggcgcgacggtggacgaagcggaagagacagtgcattggttattggaagcgcagcgcgagacgaggcgcggcacgaaaacagagggacgcgcaaaggcagcgaccggcgagcggagacgcgagaagggcgaaagcagcgacaaaggggcgcggtggttgggcgaaagcctatcgacgacgatggacggcgacgggcggaccgcttgcggatgagcggaggaaaactgaagcggtggaaggcagggagcaatgttggaaaagggggggggtggggcacggcacagcccaacggcatgcaaatggcatttcgggattcaaatcgaaatcgtttgactcaccgccgaatttatcgattctctgagtttgttccaatgatgctaaaagggaattttaaacgaaatctttgattgtttcctcggatttcaccataattagccgttgcgtcctcggcacattctccagaaaagggaattgctgtgccattttctgatcgttcacccccaaaaaatcagtcgtcatttgcattttgttcctttcggcggtgccattgttcgccaaacagtccaacaatttctgctcattggccaacaaacggtcgcaccgttccaaaagcaaagggacgttcgaatttgaaaacggtgataaatgctccgtcgaaatgtccgttaatttgtccacagaatccaacgcctcccaaacggtgctgatcagttgggattgttctaaacactttcattgttttcccctttttttacatttatctctctccctcttcccttttgctctcccttttgatatctcttttatattactcttcccctctttctcttctccctctctctcccttttctccttctctttttatctctctctctctctttcccctcctcttttccatctctcctttttctcttttctcaccggtcggtgccgcgcaaatcatttcgatgcgttcgttcaatgaaaacacaaatacattgtgcagttgacggcgtcgtaaactcttcgagtacagccaaatgcccaattccgcgtgacttttcctccctctctcttccgcttgctctttctctgtactgctctttctcgtcgcgtcctttgttttgtctgtgctctgctgctgctcttcggcgtcgaaaaggggcggcgattggcgcgcgaattgaagcaaagagcacaaatcgtcgtgacaaaatgccgcggcagtgcgttcgcctttatgggaactaactgaagcaatcaaacgattggaatggaggaaaaggcatctgtcaaatggaagggatggcattggcattttgcaaattttaaagtgatcgactgatcagtgacctgcaa

SEQ ID NO: 9093 - DNA, 3036 bp, Heterodera glycines
atcaacatcaattgagtgtagtcgggtgaatccgatcaaaagtgggaacccaatcgatcaaaaacgaagcctgatcaattgatcggtcagtcgtttaatgggaaaacggagtccgatcggtcaatcaatcaatcacttaatatacaggtcccgaatgagtgagcgatcagtggaaaagcgctttcttcgagattatggcgacattttggttttttacccctcactaatgaccaatccgaaatcaatacactcgattatcacaaaatcccgaaaaagctgattgatggatccatccaaaatccgataatggctccacttgcctgattctgtgcttcgtcaaaagtgtgcgcagatggactgaccatattctggggaattgaatccaaagtattaattgctaattagttaattaattaattattaattctaattagtctcacccggttgataatttcgcgcacccgcgagtccaaagacacctccttgggtgacagaatggagatgaaatcctcgtagataatacgtgccttaaattggacaaaacattattatcggttcatcaatcaatcaatgatcggtgccataattgggccaaaagcattatttatgaccatcatttctaggatttattaactaattgatcatttctagggtagtccggggagaaccggtcccgagtgggtcaagtaattcaatttggcgtagaattataaaatcctgaatctcaagccccgatcgatcccggctttccttgtcccgatttttgatgaaaatcccggcacacggcttataccaagttagattataagtgattgatcgaagcagtcttttgatcagcagtgctgctgaagaccgaacatttacgagatgatcagttagcccgagactcgaaacttatatagaaaaccggggaatcggtccgggaccgaagccacccaaaaaaaagtgatacttttctcgagtcaatgacctcaagaccgagactctcgagcaatattatccaactgctgatcatattcaaccctgatcagcaattcaaaacagatacccttcggtcgctcaaaaaatttacgaaatgccaatcttagaccaatttaaattgatcagcccaaaattttgcgcgaatttaccttctcctcaattttctccgtgttccgctccctcttcagctcttcgcaggcttgcctgaacatgaaaattttaaaaaatttccgtaaattttccccataaaacactgaccagaacaggatgttctcgtcactgtattcgctcttcaaaaattccgcaaaatacttttggccatttttgtttttcatcagccgatcgaagttgacgccccacgcggcgacctcctcaaaagaggccctgaaaaaacggtggaataattatcaatggcacaacaaggccgtggccatggtgccgggttggaggcaaatgatgcggaataaatggcataagttttgaacaaaaattaaatgtttttttaaaactgacgaaattttgctatgaatttttgatagattcctccaagactcaggattttaggactgtttagtttggtggattagctaataaattgggattagcccccccccccgttgatttgccaccaccaccggcactaacttgtcgtcgatgaactcgaggttagaaacgccgccaattccgtccgagccgaacctaaatctgcttgaaagggactcattaagagcaaagcgatgtgtaaagccataaatgggcatggatttcatgctaattattagtgagaaaagtatgatgtataaagccaaaaaaattgcaaatattcccaccgaaagtgcgcaatttgctggcaaacatttgtgaatttaggggcgcacaaaagcatttttttttaattatattagaaatatttcgcacaaatttatttttaattctttcaaaaatttaattttgtaaaaaaaaaatttaaattaaatcatataaaaaaattattaattaattttaataaattttacataatatatttagtataggaatttattgttatttggtattttgtagtcactgaaatcattttaataattcctttagcaaaccatttaatggcgaactaattaatcaattattgaacagcaggtgttttacgcgaaattttatctatttgttaagccaaccgacggaaggattacgtcaaaagccgaaaaaggaggtcgtcgcttttgcgtttctgcgaaaattcgcgtgccaaaaatggacgcaaataaatgcccaacagcaaacatgccgataatacggggaacttattacggcaccagaagtaattcaattagataaacaatattttaaccccggggcggcggcactcatttcgcgtcaccaatggcacaaaaatagaaaaatatacttaaaaattataaaaaaaaatgttgggctatctttggcagtgtcggcacgaaaagatacaaaaaaacggaaagcgaatcatatgatgtcacgaaatatatgcttgaaaactacggtaacaaaaaaaaatgaaaaattagttcagcagattataagctggccgcgcgaaagtcgaaattttcagagacccaaatatatgtgccattttcatcaaatttgtgggccctcggttttttttaaatttcaaaaattttcaattttagttagggtctattcccgaccctggtcatctgtggcatatcaaaatcagatgagagtgccaattaaatgaatgagtttctgtttctatgattttttaaaaatctattgtctttttctctttcctgacgagcgtatttctcgccgacattttttaaatcggaaggaacaaaaacagcttcgtacaccaacatactctttaactaaaaggcaaaaaatgccaacaaaggcactcgtaataggcaatacaaatgccacttaatttaagtctcgtaaaggattagtgctgtcccgtgcactctgttaatttccaggtcaataaattttttaaggcttatagaaaataattttcttggctgatttgaaagtggtaaattttaaaaaagtttagag

SEQ ID NO: 9094 - DNA, 3067 bp, Heterodera glycines
aaatttttgagattttgcaaattaataataaacacacatatatatcgaacaacaccaacaattcttaatttgattgacagtgaacaaagttatggttcaaaaagtcttccgacgacgtttcggccgacgacgttttggggtgcaccgtttttaaatttctccagccattcccgacaaaattttggtcggggaatttcctttccgattcccgactcttctccatccatggggccggcacggcgaccaaccctaattttaattccttttaattggacaacaacaccaaacaaggggagacctttctcaagtggaggagtcgagactctcgaatagactgtacttcttcccccccccacccgactgacccgccacttccgatggacgaacagttgcagggcaacagtttcagcagcatttggcccaccgatttgtgctgctgctgttggtgttgtattgcggccgtgggttgctccgtttgttgcacttcggctgctgttgttgttgttgctgttactgcttgtgacggttgtgcggttgctgtcgccgctggttgttctacagctactgcttgcgcttgggctgccgctccgtttgcctcttcttcttcttcttcgctgctgtttctgccgccgcttcctactgctactccgtcgccaatggtcgtcgtctgttgcggcggttgcgcaacccaacaattcctgttgctggtgttactgtagttgttggtgttgcagttactgtggctatggttactgtagctggtgctgtgtttcttcttcttatggttgctaccgttgctgctaaaaatcgaaaacaactttattatgccaaagcgtcacaaaaaatagctaaaatccatgctggaattttcgaaaattcacaaaaaaaattagccaaaatccatgccggatttcgaaatttcccaacgatttttaagggtttttttaccaatttttgtgcctagtacaagctgattggagtttaatgctttgaatctaaaaatcagcagcagcgcaggagctagttaataatcctcttttgagggattcgggaatttgcatcgggatttggattgacatttaacccaaaatgcccaagtcggcatttgagccaagaaaattgaccaaatcggcatttaaaacccaggaaaactgtcccagtcggcatttaacccaagaatcatccgtcggcatttgacccaagaaattgtccaagcccagagtgatgaatgtaatcccggataatccccaactttgttttgttttttttcaaccaaaaatcacccacttttgactgcactttcgtccgtgtttttgcgcttgcgattgttcaccagcacaaccacagctgtcgttgttgttgtccttgttcccgtcgtcgtcgtcgtcgtggtcaactttgatgctgttgctgttagtggcacaattgcgctcctcaattgtgctgacaacaatgcgccaaaattagtcaaacagttgcggcgccaaattcaaaaaacagtgtcgcctttttcaagcagtacaacaacaattaatgatgggagggttcagcgataatgtcgcttataatagtgcttaaaaagttggcatttggacgatcaaacggcgagtcatgaaagagtttcaagagagaccaaaggtccgagagtagcggaacaaggcaattaactggagactcgaaattgataattggtcccataaaaagggtgacgaataatggcacgagaaaaaggccgagagcgaaaaatggcatttttggagttgattttaatactttcagttgggagcaagtccggcggagagtcaaacacaagttcgaaactttaatttaggggggggggggggtgataagctgcaaagagtcgagattgagaaaatatgaataaaaaatttcttccgaaaaataacaaaaaagacgaaaatttcgtccaatgccaaaaaatttctataaaaaatatttgaaaaatcgtaagaactgatgccaacccagcagaagtacataaattattgcacatcgagagcaaagaatgaggggcatcgagctcgagaatgggctatttaaagcacggtaagtgtcgagaatagaatcggacttatcccaagaattgactcgagactgatcattagccctattaaaaaagaacaattagcccaattaatgaattctctctcaggcatcaaacatttattgtcccacttaaaacaagaaaagtgtgtttttgtgggaaggaagaattaaattgcggggacaaaagctgttttgtgtgatgaatgggtgctcgtgatcggcaaaaaattctaattattggccattaagcggacggagcaaaagggcggcggattaataaacgcacacgttttccggtaatttaaaaatttaaaaaatgggaaatttatggcttcacaggtggcggaaaattgtcggcttggcatcgtattagtgcataattagcatggtgcataaattcattataaatttaattggacgaaaaaaaaagtttaaaaatttaattaattttttaaaataaaattacgaattaaaatttattaaattgccaaaataatggaattatttaatgagtataaagtctattgaaatgcttcattataatgacgtttttggcacattttcccacaattcccaccacagcaaaaaaaaaaaaattgttgcaatttttaaacaaaaatgcggcactttcacacaccgcacattttacgacggagggacagacgacggcactttaatgggccaattcacattggcacggcattttccctccataattccctcttttcaatttacgtaggaaatgccatcgcccgggaggcgtagggaatggaagccgaaaaagtttgccacttttgcggtgagggaaggcacaaacattggcactagccgcaattcgagaggctcggtagtcaagtttgggcccggttttttcgggttcggggctcggtcgtgcaccgagtctcgggataactaattttgtaaggcaaggcctcgatcgatctcggcttcaccaagtcgagataagtcaagtctcgactagaaaaaaaaagatttttcg

SEQ ID NO: 9095 - DNA, 2475 bp, Heterodera glycines
ttaggctaggtaactaaatttaaatattttttaattaaaataaaaatttgcggctacgtttgtcccccccccccccgaccacacctccttgaaatgttgatccaatcagtgttcgcttgtgcgttgtaattatcgcaacgcaatcgcttgggttgtccatcttttctcggagagtgcaaccatttggacaatgcttggccagcagaagttgttgaatttggcccatcaaaaccatcaccaatcgcagcgggcaacagatcaaatgaatggattgaattcaattggttgagatcagtgagaattgttggcgaaatacgacgaagcaaattgtccaaatgatcaccatggggaaagcacaaatggcgaatatttgccgaaaaaattggccaaatttcacgaccaaaaatgtccaaaatcggctggccattcgtagagtgtgatgatggaatccacaaatataaattggtgcctcttttgtcgaaaatttgctgatttgaacgaagaaaagcgatgacggagtgatcgatgtaactgaaaatgaaataaatgcttttattgtcatagctctgcttttgaattactcaatccgaagccatttaaaacggattttgctgggcagcggacggtccggcaatggaaatggcacaaatttgtcatccatccgcacagatagtttcggttcaggtcctttgtccttgctaatttcgattggtctccaaattgtcaattcgcttttgccatcgaaatgtttgtccaccaacgcattgaaacgtggcgaaagaagtgccaatttgaggccgagttgaggacggtcaaaagaggggaaaatgtccatccaaacgtcgttgcaaatccaactgaaatgggaaaacagtttagctaaataaatgacgaatttgtgtgacttttaaaatccttttaccgtcggttcatttttgaggcaattagcacaatttggccaaattctgaatgatgtcacacaatatatagcagaagaattaattgagttgggtaaagcttggatttttagggttttcctatttcttgacgtatattatcagggaacggatttatatgtttttatatatttttttatctatcgcatgaaaatctcaaaaatagcatttttacctgttttcctttcaatcagagcgagtttttagcacatataaaaaacatattttggactttttaggaataaaaacatattttggggtttcggcagtttttgacacatattttggcgattttttggaaaaattaggttttttttacaaaaatgtcttttttggcactcaaattcgtggtcaaataaatgcccaataatttttcaaaattttctttttttttgtatttttttgacccttttcatgactttttcacttttaaggcaaaatttgatttttagcgaagaaattccgaaaaatgagtaaatctttgagagcgaaaaaaaatttacgccaaaaagcattacattaagctagcgaaattgataaaaaatgagacttttttgagaaattaacttattttttgagcagtttttttcaatttttggcacatattttggcctttttttgggttttagcacatattttgggggttttttggcacataacacaaattgcagagaattaattgcgttggaaactttatttttatggtactaccgtagagttgagcggaccgggaatgttgggcaaaaccgggaccgggacctgagaagccgggacgggaccttggttttccgggaattttttaattaaaaaaaaaattcaaattttaatttatttcaagtgaaaataacacaaaattaatttttattttgctatttattttataaaatctaaaagttaaagctaaattaaattaatgaaatttttaaacgaatttacgtcagttatttcaaacaattaatcattttgtcgatatgtaggaactagagtccagtaaaaaaaaaattccgggagcgggagcgggatcgggagttcaaaattttccgggagcgggagcgggatcgggaatcccgtgaaaatcccgcccccgttaaaatcccgcagaaattttacgggagtcccgggcgggagcgggagtaattcgaaaatttaattaaaaactaacaaaaatatttttaatgcacaaatttgaaggaaaatccttttattaaagaaaaaatagatagaaaaatttagtaagcagaatttgaaattaaaaaatcacatttatgggtcgaaaatcagtattttttcaaattgcttcaaataaaatttttaaataatttatttgttgactccctttattaattttaacaattttttgcggcttattttttgaaaaaactttttggtgaccagggaggaaaagggaggcccggcggtgcccgataggcgccgccggggaaaaaattgatatttgaatatcatacagtgtcagattatgtccaaaaatagccaatttttgaaaattgaggcatttttt

SEQ ID NO: 9096 - DNA, 1460 bp, Heterodera glycines
aaaagcgggagtcccgaacgggaatcccgtaaaatcccgcgggagtcccgatcccgccggactctagtaggaacccatgaacaaaaagaaaatcaaaatatttgaatttctgcagagtgattgaaccaagggaaagaagtggaaaatcaagaggattccatattcgtgatcattgatcagcgacctcggaaacccccggcggatacttgttttctgaactttttaaaccaaaaaaagaatttgaaaaaatgttgaccaaaaatgtggatacaaactcctgtagtaccatttttataattagagaacaaagcggaaaacaatgaaaacaaaatttgagaagctcgaaaaacacagaaaaagggaacgcaacagaagaggagaggaggaccaccaaagagaatattttgcaaaatgatgaccatttgccgggcgttttaccttatccccccacccacaaatcaatcgatcaaataatcaattggacggatagaggaaaaggatgaaaatagcattggggaaggaggagagacggaagagaaagagaggaaaaggaaaaattcgaagcaaggagggggagaaagaagaggaaaaggatgaaatagcagtggggaaggaggagagacggaagagaaagagaggaaaaggaaaaattcgacggaagaaggagggggagaaagaggaggaaaaggatgaaaatagcattggggaaggaggagagacggaagagaaagagaggaaaaggaaaaattcgaagcaagaaggaggggagaaagaggaggaaaaggatgaaaatagcagtggggaaggaggagagacggaagagaaagagaggaaaaggaaaaattcgaagaaggagggggagaaagaagaggaaaaggatgaaaatagcagtggggaaggaggagagacggaagagaaagagaggaaaaggaaaaattcgaagcaaggagggggagaaagaagaggaaaaggatgaaaatagcagtggggaaggaggagagacggaagagaaagagaggaaaaggaaaaattcgaagcaaggagggggagaaagaagaggaaaaggatgaaaatagcagtggggaaggaggagagacggaagagaaagagaggaaaaggaaaaattcgaagcaaggagggggagaaagaagaggaaaaggatgaaaatagcagtggggaaggaggagagacggaagagaaagagaggaaaaggaaaaattcgacggaagaaggagggggagaaagaggaggaaaaggatgaaaatagcagtggggaaggaggagagacggaagagaaagagaggaaaaggaaaaattcgaagcaaggagggggagaaagaagaggaaaaggatgaaaatagcagtggggaaggaggagagacggaagagaaagagaggaaaaggaaaaattcgacggaagaaggagggggagaaagaggaggaaaaggatgaaaatagca

SEQ ID NO: 9097 - DNA, 1560 bp, Heterodera glycines
ggaaaacgataaaaatttatgaaatggcaaaaatttttgagtttttgagacataatttttgataattttttttccaaagtagtaaaatattcggggacggggcaactgccccttgcccccctccctggttacgggcttgtgtgaagccgaataaatttgtctcataattctctctcttaagcggtcaccggtcgttctccgatggttcgccgccatcaaactcaaaatcagcatattccgccgcccaatcaccagaaagtcatctctgcactcgcctcttcccgtcttcaatgtcagaatcagcaacctttgtcaaattctacgcagcaacaaacgatgccaaaaagcaatgccagtggaagccgtcccgggtcgcttaaggtgtcatatagagttagttagcgatgtgactccgtcctcttcgagactcgcttcgaatgcttttctttttagggtgaacgtccctatgggtcggctgctgataaaattcacaggcatgggaatcaggcgacgacttcaacattctctccggctgatgttgatacagttccgtcttcggctgttggtcctccagtggaaccatttctgcgtcgagtcggttcgaccaaacaccgaatccaacgacccccgccagtgccggacgaagatggattcgttaggatgagtccacgaagcatcaagcacaagcaacctcaagaaaaaccacagaaaaatgttgaagacgagggtacatcatatgcttaataaattcaaaaatttatttattttaagccattcattcccggctagaacagagcaattccctctcagtcacagcacaacaacaacaaccgcaacaatcaaaacggatagcatctggtaagaaagatcttcatgctttttcatttctgatattctgtaatattagtgataaaagacagtgccatcaatcgcaatggtagcgagttgaaaagggtgccgttggcaagtaaattgccacagccgaggtcatgttcgttaaaaaacactccatcggcggcacatcaacagccgatgcatttgcgaaggggcgataatggcaccgttgagcatccacgaccaacacaacggcaacatgagcaaatgatgttcggttactcagcgccagaggtgaagaaagctggcaaatcgatgtaatattgccataatggggaaacataatttgggctcgttatcgatttgtgagttgtaacttctgtaggttatttctaggctaattttgtgtttaatcaaattcttgaagtgtttgtttttgacgcataactcttaaaaaataatttcctcatcgacatttcccgcccagcacaggcaacagcgatccgagggcggcggaatcagcgaaggccgtcaccgggtccatagagcagccaacaatgtcacttacatatcagtggatgctgacgaagaaagtgttaacttaccaattgtacagaaggaacaacagcaccagcagcaccactcctcgctgccaccacaatggcgtcaccaaattgacgacggccaacgacggcacaagccaataatggaggaaaagcagcggat

SEQ ID NO: 9098 - DNA, 1912 bp, Heterodera glycines
caggtcgaagtcggcgatacagcaacagaagcggccgactgtggccacttccctcgtggaccaacagacgccatccgctggcagtagcaggaacagaacgaaacggtcggaaccgatggccaaaccattgtttgcacaagatgagaccagagtggtgcgacgcttttaaacgtgggtgatagaataacaaagcaaacacaagcgaatccacacaatttaattgtattttacagagtgaggcaccgccgtaacacttattgttagtcacttattttttggggttggcttcgaaaaaacaaatgtcgccctaacaatgcctcacaataaatgtgtttttgccgctatccttgaattctttgttatattgttcccaaataagtcccaaaaataaaaaggtatttgacaccattgttttcactaaacttattcttcatacatcttgtcaaattctgttctgttccgtccacccccttccccttttctctgcttttctcttccaaattcattcattgagcgatgagtggtttatccgaatatatacaataaatgcaagttgagaacacattcctccaatttaaaatgcatttcctgtacctttccaacgaaaaaagtgatgccaagaatttcgcataatattttcaatattattttaattaaaatattcaagtaatgaacaaatgtgtcagcttttatctaaataaagttttaatgaattacaagcatttatgactatgtgtattttttcggatttagatataccatcgtttgaattttgagttttttagtgtactattttttaaacaatcaattttgtatttttctgataacgttaattgttccatgccttctctgcacgctttcgggcgaaggtggaacatcgccaggtgataatgccgcctatttgacaatcggaattatttggttttttgagtgatgacttcgttttccctggtcttaccgatctgtttgctcgaagcgcatggtacgatttgaatgttctgttatttttgcaatattaattgacgaatccttttgttgggctattgtccaaattttcaacttccccagtcccaacatgcactgtttttccccaccttttcagggtgttcggctccgtggccctttttatccttcacaatcccttcgaatgcgattccgtttcctggctccctttggtgctgataatgctcgttttgaacattgtctctggcgcactttccatggctttggcccttctcagtgcccaagtgctcctttctccgaaaacctttgtgattcctttcagtagggctccattatgaacacgcagcggaggcgtcacgtttcgacgctgctttatgtccgactgcccatttttgttgctgaaatggcgtggactgttctgacaactctgatcgcattcggtaatttacacagcaaccgaataaaagcagacaatttcagatgtgttcagtaatgccagccatttgtgtcgaatttccacgggcattaggtgcgaaagaaaacatttttatgataaaagggaattaatgtcattgacagactttttattttggtggtttcaaatgcggaagaataaaatcggaagtgaatcattggtaaacgtttatgtcataggatagcggttgtgctggagcttttcctcgtcctctccactcttttcggctttgtcatcgttttcaatccgatcgacggtcgccgcatggatcgatcgatggttgacgaacgcctttactggcggaggcgcctttttcttgtgagtaatgtctgcattgccttccatcatttatttgtgttgtaatcgttcagtgtaaaatgggccaagatgcgttggtccgtgaagcaatcgacgacatcgccactttggtcgccttttactttgtggaaactgacttttgtctgtccgacatca

SEQ ID NO: 9099 - DNA, 1090 bp, Heterodera glycines
atgtgcaaaacgtttcaaaacaacggccggaatggatggaggtcgtcgaccagggcaattgaggggggaggggggggggggcttctgctaatccggagcaggtcgtttggtcgtttcctccccactctccccgagaaaacttcaaaaatttaaccgaaacttaagaatttttaagaaaccataaaattttattaatttgttacaattattttccttcattttcggaaattttaaatcttttctcgaaaatttattagtttttgtaaatttgtgaaattttctcgggggggggggggggaattgtacctctgaaaatcatttctctttttgcggaagggggcgtgggggggtgggaagggttaataaactttgtaaattgttggcctcactctaataattccctccagattccccactgtcttgagttggccaatcgttatttgggcttttctgtggccgtctacggatggcccttttacgtgctgacaaattgcgcttgctgttcctggtgtttgctgtgccgtcatttgtgcacattgagcaaaggcattgtcagcgaagagattgttgtcgttgcggacaattgttgcgcatgccatcagaggtaagaaaaaaaagcaaaaaatttagcagcattttcatatgtttttttaccgtttggctttgtcaaatataaaatttgtttccaagtgcgtttatgcttcggttggattcccattgtcgcctttgtttcctctcttttcgcaaccgcctcttcgaagtgccattcgctgtgcttgtggacaataaaacacgggcaattgttgtcacaattcgaggttcctttttgagtattacacaatttgctaatgactgaatttgaatgcgatgtcttctccgcttctcaattgcgtttcccaccttcccattttcaggctccgcttctttcatggatctgatcaccgatctttcgctgagtgatgaactgctcgaatgctcagtggacgttgattctgacccaattctgtgcaatgacaaggaattggatggccgaggggaagtgcgcgttcacaagggaatgcttcgcggagcaaggcgagttccaccaaaa

SEQ ID NO: 9100 - DNA, 1706 bp, Heterodera glycines
  misc_feature (1659)..(1659): n is a, c, g, or t
atgggactcgtaaactgttgttggggcgcgtaaaatgtcatggaacgcgtaaaaccgactagaaccgtgaaaccttaaacttgtctggacgcagttggcccgctgccgactaattttttaaaatttttgaagaaattaaatatttgacagaaatcataggcaaaatcaatatttttgcaaaatatgtatgattctcagggtatttgttgttttatatttttcacaaatctattctctttaagttgtcagtgtataacatgtttctggtataagtgtctttcgtctccacgtttctcaatttttgtccgggcgattgatttgccgctccctttcactgtcgtcactccaaaattcccaactcaactctccccggccaaatctccacgttcggctcttctttcaggggtcatctgagcaacctttttggaagtgttcagcaggtgaatgaatggactcactgtcctttccttcgcttccgtttcacttatctcaatttctcagtggtttaacacttcggccagcgcgagagttgtatcatcggcagacgaagcgttcactccgtccttcgaacaaagtgcacttagcccaccgctcagccaaactcatatgaattcgattaggtatttttgttcgtttatttctgttttatggttgtttaagcagccaaggactcgccgaaccatctgtgatgaacaattccaacaccaatctgcaaacatttcgcgaagtgttgttcaatgaaactgtgctgaagttgctgaggcgttacgaatttgttggggtgagaacaaacgaacggattcgtcatgcgaaaatatcattaattacttaaaccaatttagtccatagggtcgggggcacaaggattggttatgtgagtgaatgttcaaaataaaacgcaaatatagacagagtttcagttgctgcaaggatttgctgacgaatcaacgtgtggcaatcaaaaggctgacgaggcctttcgccaatgttatccatgcaaaaaggggtcggtccaagcttcgcttatgcttttcaatcgttgttcatctcatccatttagcttatcgtgagttcgaaatcatgaacctggtgaaccatcgcaacgtacgttttttgttttgtttttcctgtcttccgtcctgcctaaatttagatcatcaaattacttaacgcgtacactccccaatcgtccttggatgagttcagcgacatttacttggtaatggagtgcatggacgccaacctttgctcggtggtccaaatgggcttagaccacgaaaggctgtcctttttgctttaccaggtaaaagaggcgaaatgagcctaatttgtagatacatttttattttaagatgctttgcggaataaatcatttgcacaaagccggaatcattcatagggtaatcagtcctttaattatgccattcttttcaattatttgtgttaatgttctgtatgtattttgctgctccaggatctcaagcccagcaacattgtggtcgatatgaattgccaactcaaaatccttgattttggacttgcgagaaacagcggcgagagcatgctgatgacgccatatgtgagaagggagaggccgtacgcaccgaaggggtcggcctccataggaatattcatgatgcgaagcaagggcgtagccangggggcgcgggtgaggagactaaacctatctcattctaataccatca

SEQ ID NO: 9101 - DNA, 3617 bp, Heterodera glycines
agattttgcatagttttttaatagatttttgtacaacatttaaaattttgcgtcaaattttaaaattctatataaaatattattaacattagcaaaaaatttattattaaaaaaaaaaaaattccttcaactttgtcaacattttgaccctaacccccattcttatcagtgtatttttgttatccgggtacccggacctaccgacattgagcatgtgcagagaatggaagcggttttctccaggcttcagcagaatgatctgcgcatcaaaaaagagaagtgctcatttttgaaggataaattgatctatttggggcatgtgatcgacaaaacaggaataagtccatcaccggaaaaggttaaggcaataaaagaaatgccggaaccaaagaccatcagagttcgaatcattcctgggaatggtcaattattacagtaaattcgtcaaagatttggcagagtgtgttgaaccattgacagacttcgccggaaggatgtcgaatgggattggagtgatgagcagacaaaagcatttaatttggtcaaggaaaagctgacctcagacaaagtgctcgtgcattatgacccaaaaaacaatttgtttttggctacggatgcttctgattacggaattggaattcaattattttcggaattgaaaaattcaagcagtacctatatggccgaaaattcgttttacaaacggatcatgagcctctgaagaaatttacggccaataggcgaaatgccagtggtggcagcaagaagactacaccgatggggcctaattctgatagagacccaaaaagacaccttgctcaaattagtcaaaaaatttgtcaaggagggttggccaaataaagtggacaaggaatttcgaccattttacattgctcggaattcgttggaaattcagtccggatgtttgatgctcggaataagaaccgtgattccagctacatttcggcccgaaatttttcaactgatacattcagcacatccatgaatcgtcagaatgaaatccttggcacgacaaaaagtttggtggccaggattggacaaagcgattgaagaaatccgaaagtcgtgccggccatgtcaaattaatgcttctgaagaacgaaaagttccgttgcatccatgggaagaacccgaacggccttggcagcgattacatgtcgatttttgtggtcctttttggggatttatgtggtttgtaatggtcgatgccaaaacaaaatggcctgaggtcattaaaatgaaaaccacgaacacaaacacgacaatttatgaaatgcgacggatttttgccatacatggactcccaaaacggggtaattttctcgttcggactttgagaggcgtttggaagcggcacgctgatcagcttaaacccgatttgacggtcgaagatcagccggaaaatgaatccgtggacagcaacacggacttcgatgatcaacaacaggagactgaagatgagcagaatggtggcccagctcctcccgaccttcggcgatcacagcggactaagaagaaaaggcagatctacgatccaagcagctgatccttgataaggagggagggatgtggtgtattcatcctcttatttaattatcgatttattttgctgtcccttgacctctgctcctccccctctcatattgttatttaagtccgtccttctcccccttccttcttcccagcgtcattccatattttgtgctattgactttctccacttttgctctacatttattttgtattatttttgctccaaataaaattgtttataaaatgttgtcggacacaacactaccttcaattttgtttttattttgaaaatttttttgtccattttatctttttatgccattgaaattgctaatacatctactgcaattcattttttccttattatatactgtatattttaaattattaataatttatcattcaattattctttctactaaagacctgctgggtgaaaaaaaatagcgtgtacgagagagataaacaatgtaaaatagtgaagacaaaatggtcaaaagaaaatagatcgaaggtgagatagtttatctccacttacaaaggaggggtcaacaatggacagtggaatttcaaaatgaaacattgaggtgggtagatcaccccaaggttctattgagaaatttaaccatttttccaaatgggtcagggtcgggtacatttttattattttaaaaatttatttaaatgtgcggccgttcgtaggagtcggattttaaatttatggtataaattttggaatttttttttgcatgagcttttatcattaaacattgtgccattaaattatgaagttttcgcctgtgcattgtatatcttacctgtgccaattacaaatatttaaaattttgttttaggttttattttagttgataaactcacattacttgttaggctaaatatttcaattttgaatttttcctaattttattaatctttaaagtaaaaatatattatttcacgattattaacgaatgaattcatcataagcttttaaatgctgccgtcacttcatatagaagataatcaagaaatccttggtcaggcgatccaaaacgatttgttcatcttaaaaaaaataataatcatttttaagaataatataataattaaggtggtaaatttttgactgatattaactaaaaattttgtcaaggtttcttcattattttcatatttcttattttagacaaatttcaaatgactggagcaaaatgtgggcatgtgaattttttttgcgaagagaccgataaccgtactttcatgttaatccactcaagtgaaaatctttagcgctgtaaagcaatattaattaattcaaattttttgtgagcatttgccgtgaacaaattttttaaatagttagggttttattttattattcttttatctcctcagggattttataaattatttaaatataaattttctattttatttattttttatttcctctgggattttattaaaaagaatttctttaaaattaatttgctatttattttttgaatttaatactgaatgttccaatgtcttacaagtactagcctgggaatgaaacggtggcactgatttgcaactcccaaaatctgggtgggtggaactactggtctaggaaactttaggttttggcaagagatcaaaatcgaaactaaagtggactgtggaagggaggaggaaggaccaataattgggacaatgtcaaatgatgtgttgaaagtaatgccaatggtgcaaccgtggtgcgacatttggggactcgacttttggggatcccgacatttggggacccaacatgacacttagtgaacccgacatttgggaatcccgacatttggggacccgacttttggggacccgacacttagggaacccgacatttggggatcccgacatttggggacccaacatgacacttagtgagcccgacatttggggatcccgacatttggggacccgacttttggggacccgacacttagggaacccgacatttggggatcgaacgacatttggggaccgaacgacatttggggaccgaacgacagttgggaatccgacactta

SEQ ID NO: 9102 - DNA, 2645 bp, Heterodera glycines
actttattgttgataatataattaagtaacgatttaatagaatatattatttttttttatacgcaatatatcatttaaagttttataactgaactttaaacatacgttatataaaaatttaagaataaaatgtatcaaactttaatgtgaaaattcaataggagaaaaattggaaaatttttcgagtttcaaaatttttttgataaataaacataaacacttttttgttacaagtattactgtcgtcgttatcttgttaattattttttataaaaaatgattttagtttcaaatgttatttaacatccattaaatttgaacatcgaaaaatgttttttgcttcaaatctcgaaaaactgcaaaattatattaaatttttaaaagatatttcgctcttaccacataccattttgagcgttttatttaactctacataattgaacaaataatattttttacccataataaaaatattttttgtatattctttgaaatttttatttagaatttcagttttcaaagatctgatctaattattttacaaaatttttgattaatatgtatcataaaaagaataatagctgtattttcttgttaaattgtctttataaaaaggatttaacggattttcttttatatatttacataaaaacttttcgtacagagaatatttttattctacactcttaattttctcgcagttctattttcttttcaatcagagtaagttttagaacattttgaacttttacctcatataaactttgtttggtagtttgggacatatttttgcaattaaataataaagttaatttacgcagttttgtttcaatttttggcaaatatttgagctttattgggattttatcaaatatttcgcgtatttcttgtatcgtttttagcaaatataaattcattccatagctaaagctttggtttttgattttcaatgcatccgtagtgtttgtcaatacttttttgagttcaatgttgaataaatattttgcaaaccataaaaatattttgaatatattacaaatttttcatttttcctgcatcacccacgtaaatttcttcattgctattttcaatagcattttaatgttaagacatattgcatttaattatttctcccgaataaaaggtcggtatatcaattgtaattatttgtttttatatttttctttccgataattttttatggtcctgttttttataattaattagttaattatttgttcattcataatagagaatcaataaaatttttaaatggaaaattgctcattgtatcgtttaataaatatttaagcatcattatttaacaatatttttattagacaaaatatatggaatttttgggattcataaattttggttttgttttattttcatatcggctgttaatttttattactaacttataaaaatttatttttaacctctttttttgttcgcccccagcttgacctcattgctctttcgaatacgatgacagtcaaacaatggttttcctcctttatataaattatcattaaataattaagtaaaattttttattttttatttttctatacttgcaaatattattagaatcattttaaaagaatgctgttttttatttattttgttcatttttagccaagatatttgcccacaaataaatgtttattatgtttattttaaatatttcttttgactttgttattatatttcattcttgacatatttatataaatgaattactttgtttaatgttttattatagctatttttatctaagaaattagctccatatttttaatatgcaatttgttgcctaattttcttgttatttagaaaattgtgccgactattttgagtgaatgctcatttaattgcaattcctccggttgttgtgataagcatatcggccatggtccgattgtatcgttcaccgcttgacgactagtgatatggtagatgtttggtgtttgaatccccaaattttggctagagattcaaatgttatgttcagaaaatgagtgccacactcagtgacgagtatttttggtagaccgattaagctggtattatatttatttattgttaatttcaatctctaacagataaaattatttattaagaatatattttaataaaaatttcattatttgaatttttcagcaaagtatattatttatttttatttgatattaatgaaatcgtacaaaatttattgtgctcacgcggccagctttgactcatcatttttcatttaattatttacattaaatttgataatatctcttatttaaaatatttatattataattaataaattttttcattaaagttgaataataaaagtgtttaattttttgataatcatttttcaattaatagatatcatggattggtaaatcatcaaattttctttattaataaccatgacattaaccgaatgttttttttcaatttgaaataattcacttacaaatttctgctttattctgtcccgtttcacgtgattaatttgatatatgattacaaattgcttaaatttacatatgatcttttattacacaaaaaaactgttttttgttttttatattttattcatgaataaatttcggtgctaggtcgatcctaaaaaagtatcaatg

SEQ ID NO: 9103 - DNA, 3546 bp, Heterodera glycines
  misc_feature (7)..(7): n is a, c, g, or t
  misc_feature (13)..(13): n is a, c, g, or t
aaaaagnagatcntaccatcggcagtattacaatttttgtctttaatttttctggttcaaatggctgttggcaaacaggtaaaactaaaaatacaaacatatttcaaaaagaaaatatcttattttaattgaagaaaaaatccgcggagaatatcaatgcgaggctggccatggtgacaaaatcgggcaaatactgcctgggctacaaacaagcgcttaaaacacttcgttcgggcaaagcaaaattggtgatcatctccagcaacacgccgacactcaggtgcgattttgttttgaaattgtgcgattttttggagaaaacataaaatgatggaaattttttggatttttgagggcagatcaggccgatttaaataaattttctcggcggtgtctactgatactttgaactactaatttctctgaattttccaattttgactcaaatttcacatagcttgacaacttttggcataaaaataagataaatttcataaaattttttattaaatcaaaatttttggtaaggaaaaagcctttgtactagtatatacaaaaaagttgccatttattcgattgtcacaattattgttttatttgtttatggcctttagacgcagtgaagttgaatactacgccatgctgtcaaagacgggcgtgcacgagtaccatggcaacaacatcgagctgggcaccgcttgcggcaaactggttccgagtggtccatgctgtccatcactgacccgggcgactcggacatcattcgcacaatgccaaccgaggcctgacaaatctctgtgagctgttgtgatcacacactgtgctcatcgccgttgttttcttatgttgttgttgttgtttttaacttgaaaatttaaaaaaaaaatttcactcggttttttccaattttttgctttcgtaaaacgtatttatacaattacctatttgaaattttgtcgttaatttactatgagcaacatattaacagtcagtcaatacctaatgcccaattgtttcgtcatcggcgttgccggaggcactgcgtcgggaaaggtgtgtgggtgggaattgtaaaatgtggtcctagttccggttttttctcaggccgggttccgcgattatgatgaaattttgtaattttgctttgataatgaaaaatcagtgactttaatataaaaaattgttgaattttagtaatacctaaaaaaaatttgtgtcccccggtgaaattatgcggcaaaaaaaaataaaattccgacttccatagcttgttggggcctgaattccagaaattttcggagccgttcccgttgtttagccgaatgaatacacaattttccgctcaatgtttgcccgttcatttagtcgtccgtctgcggccgtatcatggagcggctggagttgcacggcagtcacaaacgcgtggtgattgttgcgcaggactctttctaccgcgatttgacctcggcggacgaaattgcgaaggcccggcgaggcgactttaattttgaccatccgaacgcatttgagcaccaactgatgctgaacacactgcgacagctgcgccagggcaaatcggtggtcatccccaaatacgacttgaaggagcagcgacggtgcgttttccatcgaaaaaccattcaaaaaaatttttttttaaaatatttctcattttttcgcagatttttggatctgttaattaatatggggagggcttaatgactggcgcaaagttccagatttagttcccttctttctggatacatgttcaattttgaattaaaattcaccaattgaagtccagcgggccatagtcaccgccgaggaaaattgattcaaaacaaaaatttattcatattcccataaattttttgctattctaatttaattgaaagcattttgaatcgtattccgatactgaaaatccttccccctttcagcctcatcgatgcgtcgcaccgtttggaagcggccgatgtcatttttggtggagggcattgttctccgattaaaggtttttgagtggtaccaaaattcaacaaaaacatgaaaacattttacgaaaaaaacaaacaaaatgccaatatatggagcggatttgaaaatgcttttttaaccattttctcttgtccagttgagcgtgacacgaccgagcttggccgtccgttggaccaagtgttgcatcagtacctttcgttggtgaaaccggtcagtctattatctgctgatgaagaaaaacaactaaataaaaattcccaaattccaagttttttccatcaaaattctttaataatttatttaaaaaaaattccctaattgctacttaaattttaaaaactcattaatttttgtttaaaaatcatttgaaatttttcgatgaaacgacctgtgcccctcccctttaaggcgtacgaagacttttgcctgcccaccaaaaagtacgccgacgtaatcattccgcgaggagcagaaaatgacgtggccattgatctgattgtgcagcacattcaggaaatcttgcggactccgacatcaaagaaaatgcgtcccgacaacggaagcgaaatggacggaaaatgagggggggggggggggaagaatcgcagagaaattttcagttttttgattgtttttcacttgtaattttttgtgtgcaatatctaatctacgaaagattactctcattttttgattttgaatttgactgtcgatataaatatgcttttaaacggttccgggacgggcgaatccgaataatgtgattaattgagcaaaaaaattcaatttgcgataaaaagcgaattttagcataaattttgctgatgggttagtaaacaaatgaaatggctgatctcaccaatccggctgcagttaaaactcatttcgaacccgaattcgtaccgccaattgaaactcatattaaaacccgaatccatacgttagaaaaaccaatttgtctatctccgtccttcgaatcaaatggaccattcgcccgtttgttgctattgctgctgcggcccttcttgcgcttgcggtggcgtcggcggtgtcgctggcggttgcggcgtcccctgatgctgttctcccgacggttgcgcgaccggtggtggtgttgctgacgacctcgctcgccgtgttgatgctgatgcccgctccacgcgccgttgcacttccgcagtgtatcgtgccgggtcgttgcggaacaaaacctgaaaatttggacgcaaaatgataatcaatcgcaaatgtgtgccgacgaatgaatcagacttacggcagcatccacattggcaggactgttgaagttcggctctgccagcagcacttggatcgacaccaaaatggattccaaggaacggttgggattccaacgctcggacggctgctcatggccaagcggatcaatgccgggtgcatgaagaatgctgatgcagacttggccactctggtcaactatttgctagagttgacgaatcatcttgttaccaatccttgggcgccccaaaattctttaatttccaagggcgtcccttggcatccaaggac

SEQ ID NO: 9104 - DNA, 809 bp, Heterodera glycines
aagaagacgacgcgcgaacaccctgccaccggcacaaagaagacggagcaggaggaacgccctgaattgtcatctgactctgatcgcgaagaggaggcggctcagaacacgaagaagcaaaacgcaaagcagccgcaggacgtggcaacaaacagcgtaaaaccaagaagacgacgcgcggacgccctgccaccggcacaaagaaggcgacgcgcggacgacctgccaccggcacaaagaagacgacgaacggacgacctgccgccggcacaaagaagacgacgcacggacgacctgccaccggcacaaagaagacgacgcacggacgacctgccgccggcacaaagaagacgacgcgcggacgccctgccaccggcacaaagaagacgacgcgcggacgacctgccgccggcacaaagaagacgacgcacggacgacctgccgccggcacaaagaagacgcgcggacgccctgccaccggccaaagaagacgacgcgcggacgacctgtcaccggcacaaagaaggcgacgcccgcgacgcacggacgacctgccgccggcacaaagaagacgacgcacggacgacctgccgccggcacaaagaagacgacgcacggacgacctgccaccggcacaaagaaggcgacgcgcggacgacctgccaccggcacaaagaagacgacgcacggacgacctgccgccggcacaaagaagacgacgcacggacgacctgccaccggcacaaagaagacgacgcacggacgacctgccgccggcacaaagaagacgacgcgcggacgccctgcca

SEQ ID NO: 9105 - DNA, 1226 bp, Heterodera glycines
tgggatggttaaataactcacatttgttggcttggactctcatggcgtcgtctcttcagcacaaccgctaattgctcgtccaccaatttgcgcaatttctcatccgcaatatgtttttcagcacccgtaatatcagcaaattttttatctaaaaatcaaaaacagaaactgttaaagttacgttttactccgacacttaggaaaaatttatttttgaaaacattttcgcagaaaaagaaatcgaatccaaactataaaatttagagagcctggaattctgagacaaatgggaccggaattggtgatggaccgggaatcccggctaaagtccggcgtagtctttatcccgtccgggcactaataaaattcaagtgcatgccacggattgggtcccaatttttcggcataatttctctgtatttttcctacttctgtcggcaatgattgaaaggggcgtcaaaagcatgccaccgcccataagcacagttgtccaatgaaacaacacttcctttgcatttttattcatgtttaatgctgaacagttgaaaattaaatgtaagcgattaaaaaggctaacaaataagtgccggccaaatttcgcggaaatcaaccaaaaatcctatttattatttttttgaaaattacgaaattgacgggattaatccgtcaaaattttccgagccccaattccggaaccgggtggtccactacttcgactttctcgctatttgtctcatttttattttttggcgccttatttcgagaagcgcgtttatttttttgccaaaatgttatgccaattcaaatatttccggacagaatttgcaaggaagtgaaaaatacagactccgtgggctttaaaattttttgaacgaatcaagggaagatttaccgattggacaacagataatcgtacaatttatttgcacctttcgtaacatacatacatacaatatacatatatagtacaacaacaacgatggttaaaaaataccatttacatggtgtacaatttagcgacatgataaacagatcacacatcaaatcacatgatgataacgggggaatataacacaatatggcatatgagacaatacataatatgggtttatccgaaataggaggactgaacgacgttgaaggttcccattctgccagacattggtggattcttcgcgcttgtgccagcttttggttccgccgatccgcgtgccgtcggtttggag

SEQ ID NO: 9106 - DNA, 2601 bp, Heterodera glycines
cgagacgcgagacattgttggtttggagccaccgcttgtgccagtcttttgtcccatgaggcgagccatcatccctttgaagccgccagaaggtgtagtcatcggtgccgatccatgcgatgtcggtttggaagagccatgagatgtcggtgccgatccacgagacgttggtttggatgatccatgagatgtcggtttggatgcgccaggtgctgagccatgagatgtcggtgccgatccatgcgatgttggtttggaagagccatgagatgtcggtgccgatccacgagacgttggtttggatgatccatgcgatgtcggtgccgatccacgagacgtcggtttggacgatccacgagacgcccgcttgtccttgccattcgataacgactcttgagttgactgtggcgtttcaatgccatgttctgctgcgtagccgcttcttgccgtactgccgccaaaccagtcgctccgcttctttgataatgcttcaatgcctcctcctcctcttcctccagcaacagccggtgccgccgctgcctttcgtcctcgtccacggatgatcaacaggcgtgatatgttccccgtggtgcgcgcccacaatgactgtcctcctccgcgtcccgccgatggatttgaccagtacgagcgtggcggttgtcgcagttggttcttgcgtcgtttgagtaccatgaagcatgtgatggccaagagcagggcgataagcagcagactgaaaaattgggggaaaatgatgaaatgttgtttaaaaatgaatgtgccagagtcagtagtgccaaaaaagcgatcacaacaaaaacacacacattgcagttacaatcagcgcccatgcccagcccggaagaccaccgctgcccgcaacacatttcatcaaattgtgcgcaggtgtaccatgcttgaccaacagacgcgcatctttctgaacggtaacaaaaaattggtgatgaacacgaacataagtttggcaaaacgttcaaaaagtgcgccgccgccgccaccactcacaatgagcacttcccagcgacagttggttgctatctgttttgtgccgatgttgactacagtgtgacgagcatccggcaattcgtgaacttttttcagttcgatagcgcaatacatgtagtaggatatgcaatgggtgccacagttaggcatgaacggaaagccggaagactgtggaagaaaagagtgattgatgtgatgtatacacataacgaaatgtccgctttcgctcacccctttctgattgcctgtcgacgaacatgtgccattgttaatacgcaagagatcgcaatttgtgtcgacatccggatgggcaatcatgaacatgactttgtgtccttcaggcttcatcagcagaattggttgagcagcatcaggcgatccagcaatgtcacgtttcgcgaaataactgaaaatgggagtgatcatttgtcttggtaaaatttgactggcattgatgtaaaaagacggcacacttacacatctggtcccctctgtttgaagccgttcaattcggtgccttccttgatgcaatcgtagtcgcgcgacaaccgcatcatttcggcactgcagcagcgacagaggatcactgaagcgagcacggcagcgatgagcagactttgttgaaacggaaggatggcacggaacaccatcataaatgggaagaaatgaagtgtttggtggaataaaagtgtgttttgtggaagtgagtggcaaatgcgggggaaagaagcgcttttataagggcaaaaaaaggatgaaaattttttgcatctctccgttatttttggttcgataaaaattgaaaagctactgaactatttagtatatatacctaactaaaattgcatcatttttatttcacatttaggtatacacaaaattttatagctaaaattcgtaaaatcataaattcatcgaaatccattattcactgttcgtatctgttgtccatattctgtgcctgatttgcaaaaaaataacaaaaatcacgtggcatttatatatcgacaaaatatcagaaaaattaaaattttgtgatgatttttaatgaatttgaggtgaacgggttgaagtaaaaaaaccaatacaatttaagacaggataatagattagtcgtacatttatgtatgtgtacaatccgttccgattgttccgattccaacattttttagagctcgaattccgccgactgctaattgcagcaattgatggtcgtgaaaagaattcgagctaattgcagtcaatctttgaactctctaataatcacttcattaaattcgctttacaaattatcaaacaagagcatttccattttacacacatgcttacctaatcttgtccaattagtcaattgattgaaatttcgaaactccaaatttgcttccatttcacaaatttagtcgctaatattccccagcagacaaaaggtctgctgatcccccaatagtaaaagcagcaaatgactgatcagcagagcacacatcatccgtccaacgggatcaccgacgagagaagaaaaagcaccagccaccatcacacactggcggcgatttgatctttgattaggcaggcgac

SEQ ID NO: 9107 - DNA, 2506 bp, Heterodera glycines
ttgaaaacaggctgtcacctgagcggttaagccttcatgaggcacgaccggcagcgactgtttgaagtcaccgctgaaaatgaccgtttttcctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagtttgtctaatgacacttctctacccagacgaaacgtggaatgggctgttttcccatatggcagcaaaatggctgcacacccagtggatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagaccttctgttggtcgctgttaagtggcggaggggtatttggctgtggacgaggatttggttgccctggaggcaaattcaaatcatcatcgccaaagaaaaactcttcaattgccgcgtcagtatttttggcaattgaagttggcgggtctggcaggctaaaatgcacacagcttaagttaaagcagctgtgcagccgccaatcaatgtcggctagggcttcaagctctgctactttatgctgtgccagagtaataatgccttgcggattgtacatttggtctttgtacttgttccacaattctatggcattactcggctggccatagaccaggatgctcacaaaaagccatctcatctgatctggccagcgcgacagagctgcctccgccagagttttgtcccaaattttgtcgtcttcaagaagaccatgcattattgcagcctcagtgaatgaggtacaaagcaacccattaaccatcttaagatggtctgggtctccaggaaagtgacgcataagtgaatagagcgcgaacctttccgggtccgatgggggtacaggaacaattcggccgataggtggccttttaatttgctgccttttgtacaggacccatttgtcctttgcccatcggaaccgctctgggactttttcgaaaagaatgtccttaaactttggatcattcttccactcattttgccattgtttccaataggctgaacactgcgtttctggcagttcgccttgctggatttgttgagctttgctcaccagctggaaagccctatatacaatgggctgttggtttggcaaatgaattgccaatttgacaacatgatgcgaaagacgggcaaatggcattgaatgaacaatggcatatgcttccgttgcaccacgaaagttcatcttggcatattgagccggctcgtcaattttgattttattgccggactcttctttgcactcgacataacaatgtcctggccctttaaaagggtacttgagtgcgtatttaatatttgctttgttaccatatgcaaacagtacattatggtgtactcggtaacgtagcagaatataaggattatacggcacgacatgtgagttgtcgtatattaggccgtttacctctaattgggcaccaccatcagttggtgaaggccggaaatacatcgcgggcctgtccgggcgcaaaatcgtacattttgagtaaggggctgggaaccccttcttgcaccgcccgtaaattgggtcgctaggaccacaccaactgtcactgcatctgtgcagttgcatatgcattgtttcgcggatttcgcgatgcatttttgcaatgggcgtgtcgtcatctttatcaggcaaagatggaatgtgcgcccatatgtattcctgaatgacatatggaactgcgtccaggtctgtttgcgccacaatgtgggcatgtgggcctcctcggccttggaactccattgattcaccgtaaccaaggattgttccgaagaactttttgtcataaagttcttctcggaactcagcgattttgctgctccagacacgcatccacatgtcaaaacggtcagtaaatacttgaccgtttttgtgtaaattctctttgaactcaggccattccctgttgttcgtgaaagtaatgaagagacgcgctttcttcgcgtcatggcaccgtgcaaaaacggtgttgcaatcttcatacattttcttccaatattggagagaatttacgttgtgttcggaaagccgaacaacactgccaatgtcatcaacagttttctgttgggcattggggttttgccgtgcttgctgcctgttgtattggttgaccaaatactgcagcagattttttggagtgctgatccgcagatccatgtcaggtctacgcaaaaatgttgctatttgccaatcaatttttgcagcctggtcaaggatccagcgctgaccaagtcctccaccacatgaaagaatgtggtggtattgcaactcc

SEQ ID NO: 9108 - DNA, 3058 bp, Heterodera glycines
tttagaaaatactaacttttaaaaaaaaaaaattttctttattctttttttgtgcaattgtcatcatcacattaaagaatgcaatttttttaattaattggaatgtttgaaaaaaaagaaaaatatgaaaattttcaaaaattcctaattttggactaactgttttttagagtcaaaaatttttgaagcaattctgaaaatttctttcatcttccaagcacgaacctgttatacatgttagttgtctgatcactgatcacatctctgatcataggatttattttttctatgaatttaataaataattaattttcttaaatctgattgaataattaatttaccacaggacattgcattcgaatggaatggaaatgtgacggctctggcgactgtcgaaatggcgaagatgaaaaagattgccgtaagtgcatttattaattaactaataagttaattagcattattttaaaatggagaaaattgttgcttttgacaaaaaattggtcgaaaaatacatatttaaaaaatattttttataaaaagttaaaaaatccttttcccaagttaaacaggagaaagagaataatttttaaatctcaattaaattaatttagaagcatacagaatttgatttttaagtcgaacaaaatcgatgaaacactgaaattgttgtaaatgagcagtattctgtacaaatttacagttttctgaaccgtatcccatcaaaatgttcatcaaaatgcaaaaaagcaataaaataatgaggaaaaatatttgtattaatttaaaaaaaatatattttaatatttttagcccatcccggatgcaaagccgaccaatggcaatgtgacaagtacgaatggcattccgtctcctgtattgtaagggaaaaaaacaaaatgccaaatacatttacataattcaatttttttaaagcatgaataccaacgctgcgacaacatcacagactgttccgatggaagtgatgagcgcgattgtcgtaagtttagatttaaatttttgttagacattgtttaaataatgataaaattggaaatttttacagttaaataagcccctagttacggtaaaattattttaatttttagggtaaaacaaataattttcaaaattcagaatttttcaaatttcttgcaaaaattcttgaaaatttggaaaggatggagaagggggcgggcggggacgatttggacgcaataaaaataaaattttaatataaaaaacaattcaaatttgaaatcagccaagggttcaaattttatgaaaaaacaaaattcagccgcaagtccggtgaactgtgaggtgaatgatgggtcggtgttcagctgcgcggacggccgccaatgcttcccaattgcacggaaatgtgacggcaactacgactgtcgtgacctcagcgatgaaaaggattcatgcgcaacaaatcatacggtaggagatcggttcagagggtgctgggacgttagtcaaaaaccatcaaatggaaattttttgacagaaaattattcataacttcacccaaaatgaatcaaattttattatcttggtatttttagctaaccctaagtgttttctattatcctgcgaaatttcaaaaaaattcattaagtttcaaaaaagttatcacctgagaagttcaaaaaaccaagtttttttcaatatttttggtcataacttttttaaatcttagcgcatttttttgaaattttgtaggctaatagaaagcacttagggctatcgaatgacatcaaaaattaaaaatttagttgttttggaacaaagttatatcaaaaaatattttcatttgatggtttttgactaacgtcatagcaccgttcagagtacctttggtgtacggtgctattttcccctttggtattcagtatgaaaaatcctaaaaataattaattttaaaagaattgcggggacattgaaaaaatgaagaaaattaaaactttaaaaaagagaaaaatctaaatcctcaaaatcttaaataattatttctgcatctcctttaagcctttcttttcgtctccctattatccctttaaaatttattgtgtgttttgatgtgcttttagaagagtaataaatggccaatttgttaaaaataatttaaaaattataaatttatgtttttatttataggcttgttttccttaccaatttcgttgcgcggacagaacacaatgcattcaggtcggcggcctcattaaaattggacaatttaattggtttttttttcacatttcagaaggtctgggtgtgtgatggaacgccagattgtgtgagcaaaatttaaaaaaaaaataaaattaaaaatatatttatttaaaattcaggcagacaaatcggtcagtgcgcgaagtttagtataaaaatttaaattgatttgttcaaatgccaggacgaaccttcgacatgccaatttccagcatgccaaactggcgattttcaatgtaaaaattgtttgattatttaattaatttaaatttttactttttttcattcaggcaagaatcgccgatgtgttccgcataaattccgctgtgattattacgatgattgtggtaagatatattaaaatttaaaaaatacgcataattatgtaactattattttatgatcaattctttattttttttttaattctgacgaatttttttgtataattatatattttaaataaatttactataattctataagaatatttatttacatttttaaaatgtttagttgaaaagatgtgttactaatattttaattttaattaactaattatttgtaatttgactttaaaatgttaatgaatgactttttaattaattaacaaattaacaaatatggtgaaaataaatacatttattgttaaataattagttgaagatttcttatttgttgttttaaacatttttaaatttataaaaatatattgtatattatttaaaaattttttttttataatttttccaacgacaaattttttttccaaaaatctttagtcaaaatcattattttttcctaattttctgtt

SEQ ID NO: 9109 - DNA, 4171 bp, Heterodera glycines
gcttattgaaggtcatgatcattatcttttaataaatgagattattcagtgcattttctgatcaactagtttttacagcttcgacttattttaccacgtacaattttaattaattatttaaaatttaatttttttaaaattcttattcccttttttgatcattactgctccttagctttgatcatcaatgattttataataatctgatcactttttccaggaaataacctttggtccacgcttggttgccaatctggctgtgttgcgtcgccgggcggcggtgtttgcacatgtccccagggatacaaattggacgaacgttttcaacgcacatgctcaggtgggtgtttgaaaaatagaatttttcgaaaaatttggaaaaatgcaaattttttaaattcaattttaagactaagaatttaagttttctactaattttctgtaaaataccttagagtaagtttcagttcttgcattttcttttattttttataattatcaaaataaaataatttcaaagagtccgcatttcaacaacaaaaaaaattattattttttagatttttactcaaacataaattaaatatatattttttttaaatacgaaaatttcttgtggttgaaaaaaagttttttttttttttgctaattgctgtccaccggttcccgcacagacatcaacgagtgtgccgagttcggctactgtgatcaaacgtgccaaaaccatcgtccgtcattcacctgtggctgtttgggctcctgttttcggctccaaatggtccaaagcatttcgtccgggcccggcaccggtggccactccaacatgtcactgcgcggctactgtgtgtccaatgaggcggaaaaaatgcgactgtttgtggcacggcgtgagggactgtaccgggtgaacccggccaacaaagtacgggttcgggttggcgccggcattgaattttcaactggaactggtcctgaatcctgcggcatttggatactggcccagactccccccgcccgaactccccaacttatactggtcccggaacttttttggcacccgaatgaaaaatgaatttcaatccgttcacgattgaaaatgccatccctttttttatttcatctataaaaagacatattttgtggctttttcaataacaaatcaaatgtgtccactttttttcgtatctgttttttgcacctttttgtgaaaattttgtaagaaaaatgccataaatcgatcgtgctctctaggattaatctttctaatataattaattcagctcacaataaaaataagatcaatttttttttaataataatatattatttttcttattttggcaaaatttaattgccaaattttttttttgcaaactaatagtttttgaataaatattttctttcaattattcatataaatcagaaaatattaaaatagtcatatccaactttatttttaacggcatttgggtattatttttttaaatatttttggtgttttaaatgtttaaattcatttttaaaggatgaacaggcggtgaaaattgcgtccggcgagttcatctatggcgtcgattttgactatgagcagaagaaaatgttctggacagatcgcatggcacattcactgttccgtgccgacatcactccgacgggagacattgaaaagattaaaaaattggacttaaaatcgtgagcattaaaatttttatccatgaaaaaaaaaactattttgtgggtttaaaagtcaatttttcttcattttttacaattttaatgggatgattttcaattttcatatatttttggtattttatttctattttggaattttcagaggaatttttatacaaattaatgacaaaaaaatatcatggaagatttctaaaaatttctttaaagaaagcaataattgttcattttctcaggctgatctatccacgcaatttggctgtcgattggatcacgaaaaatgtgacaataaaactaaattaaatatttaaataaatcgttaaaattaaaaaacaggttttcaaaaaattcaattaaaaatatgagaattataactggaaaatgaattaaataaaaataaaattgtaataccaaaattaaattaactaaaatgtcaggtctacgtgatcgagagtggctctcgacgcatcgatgtggtcacttatgaaggggacaagcggacggtgctgcttgcggacgcattaactttaccgttggacatcgcgttggacccgctccggggggacatgttcttctcaaatcaactccgattagagacaggtaaaattttaggattttaaatttaaatttaaaaatgaatttaatttattaactaaaaaataatttataatagtaattgaaaattaatttaaaaataaatatatttaattaaaaatattctttgaattaaatttgtgttcaatatcttatatttttatttattttgacattgaaaatggaaatatttgtatttaaaattttatattttttttattttgacattaaaaaagtatatatttgtaattcagagcatatttaaatttaaaattattattacattaggataaaattaaatattaaaaaaatgaaatttaattttaattcattcacaaaaatatgcctttaataaaaaataataattttcatttattttattttttttttgcaatgacctttttttagctcatatggacggaacaaatcgacgcgtgctaattgagtcccacactcaccaaggcaatttagttttttaacatgaaaaaatttaggcacccaaaaagttaaggatgcctctttttgagtacggtattaagaatacagtagtcaaatcatgagacggaaaaattgacagtacacagtctaattgccaaacaaacaaaagaaatttaagtgagcggtgtcgtagttgacattgcggccaaacgtgtgtattggagtgatccgaaagttgatcgggtggagtccattgactactcgggcaatgatcggcgccaaattgccagcggaaggtgaaaagttcaaaaaaataatattttaaatttataaaatatttcagcttttttaacttttattttgttgcaccccctcgatataatactaatgaaattctaaaataaaaatataatttttaaatttatatctcacgaattttgtatttcatttcttctgcagagattttgccccgcatccctttggactcgcaatgttcgaccagtttctgtactggacagactggacacggtaaataatatggtttcaaaattgtaatgtacaaaaaaaaattattttaatatataaatggtaaaaacaaattattttttttttcatttataataattatattaaaatttaatattattatatacaggatttcgtagaatttaatctttttttatgaaaattggtcaatttacagaacttctagaaataagacggaaaaatgatcacgaaaatctatgaagcatactttcatctaaaatttcatttgccaagaaatataattaattattctccaaatatttttttttttgaaaattttcttcaaaaattgtaagaaaaaaatatattaaaagatttatttttattagaaaataaaaattttaaattaaaagctatgttccataaaaataaaaaaaataaaatccactgtcctaattcagacttggcataatgcgcgttgagaagtttggcgcactgtcggaagtgatttggtttgttaaaaattaaaaaaaattaataaaaattaaaattttttgcctttgctaggtccatgaaggacagcaacgtgttcccgatgggcattgctgcttaccatccaaatgcccaaccaggccccaagcaaagcgagtgcttccagcagaccattgagaatccgtgtgccaagtccgactgcgagggcatgtgcctgctgagcaaggacagtgtcgggttcggagtcggcttccgctgcgcgtgcccaattggacaggtaaaatttatagtgccaagatggccaagagggagaggcatggacacttgggcaagcaatagtaccaaatagccaagtcggaagaggggatgatcaattggacaagtaaaatagtgccgagatggcaaatcggggggattgcggtatggccaatggacagacaggtagtagtgccatagatgaatggacaga

SEQ ID NO: 9110 - DNA, 1046 bp, Heterodera glycines
acaaattcatcaggcaagcgtttcagtatattctccccccccggcgcaatgctgaatcaccgatttcttcgattgccgcagacttcaaatatcgattgctaaacaagtaaattcaaaaataacaaaaaaaaattaaaaccaaaaattcgaatatacaaagaacataaaaataaggcaaatcgcattaactagcatttattaatttgccacggtgattcccaactcacaataacattaatctcgcgaagtgtcccaacaaaggccggttgtaagaagagttcagacccgttggaatccgcaacatgcacaggaaaaatggtgtcgatggacgcggggttggaattcagaatcaattccatggcgacagtcatcgattccttgaaagaaaaataaagaagggaataaaaacggaaaacaatgccttgtccaatcgtgcaagaacctctacgaaataagaaggaaatcgctgttcatagggcaaaatggcgagagtctgaaggatctgcccgatttgcatgaggttaaaacgagcgatgtgactgacgacaaaaaaggcaattttaattggattgtaacggaaaatgcagtgacaaaaccttatcggagtgtcggagattattcccaaaggctccggattgataaccgccgaacacaaaaaataagtaaagatcaaatcagtgcatatcagcgcagcctaaactttggcattcccacaaaacgaaggaatgaattcgaaacggacacctcttcccggccaatcatttgtttctcaattaacgccgtgtacatttggccgacaagccaagtgatgctccgcggaaaggaaggcattgcgttgagaattgctagtgacggaaaagcaatttaattgtttaagaaaataattttaagcaatgttacatgaaacgaatttctcagtgagaatcaccagtctgaatttgaaaatgaaaatggggggggcagaaaatcactgctgacttgtccacaattactcgtctgtgctgcgccaccttctctttataagacttggaattttcgtcggagcc

SEQ ID NO: 9111 - DNA, 3213 bp, Heterodera glycines
tttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccgataattagggttagggattccttttttaggcaaatgcctaaattttttgcgcacttgatacgctacagataaagcacgaaaaaagcgttttctgcttggtttgggatgtctacgatgacttttataatgcctattttgttgttatttcgtcatttttggagcttttttcaggactttcgaaaatttttttaacaaaaatacaataaaacaaaaaaaagcaatttttttaattatttactaatttcatttacaattgaaatataatcaaaagaaagttttttttatttacccatctaaaaagcggtaatatatatatatatatttttttttttttgcctattcgaggattttgtgcctattttgcgattttttgtgccaaaaaaggaatccttggtaataataatccgggatatgtatcgtattagaaaaatgcccactttgttggagaaaagctcctcggaaaatgatttgtaaatgcgtgaaaatgccgaattgcctttacgcagcaattttcttgggtctgagctttgtacaagttgcagcgttattaaatggcccaatagttcgagcacatttttctcattctcaggaaaaacgcatgagccgtacattacgttgaacaatgcaaaaccaagctcttcactcgaatactaattgtacgtttattttttatatagtgtaaatattctcgtattacctgcgtaggaatcttttcagcggcgttaataaatgccgcaactgcacggggggcacccattaagagtttaaaaacatgactaagctcggcggcatgttggttaaggattttatgcgcttcaacaaaattggaagaattcaaattgctgatcaattgacaacagttgtccggagatacacttaaatcggagttgatcaattgtcgtaaaatcccctgaaacaacaaatgacaaaacattttgtgtaatttgttgttggtgcctgtacctgctcatgacggcacatccaagccaatctgcatatctccgaaaattgacttttaacctgttttagcaatgtttaaaggagggaaaataccagtgtgaataccttcgagttaaggttccgcaaaacaatttgctcgcaatcaattagtaaacgttcagaacgaagtctttcacatagtgaggaaagttcagcgaaatttgcaaaattgttgggttgttttctgctcatttagtaataaaattcgaatatttctaaaataataaataaataaattttagagatgaatttttgagaaaatcacttactatatattaagcgagtaatagccccgctccttttttagctttttgaattcgcgccgaaagtggtgttctgtttacacagaggaaaagaaacagaaaataaaaaaatataattggagactaatgagaaaggttgggtagaggagagagtgcagtgtttgtttctttgtcggcgcggatgagagggtaagagttgggtaacgcgtgctagagagcagagagagaaagcgaagagagaaaaagcgaagggagagagagggagagagagaaagagagagagcgaaagatagagagagagagcagagagagagagatgagagagagagtcgacttttatgcgtcccatcaatttttatgcgtccaatcaatttttatgcatccaatcaaattttatgcgtccaatcaatttttatgcatccaatcaaattttatgcgtccaatcaatttttatgcgtccaatcaatttttatgcgtccaatcaatttttatgcgtccaatcaaattttatgcgtccaatcaatttttatgcatccaatcaaattttatgcgtccaatcaatttttatgcgtcccatcaatttttatgcgtccaatcaatttttatgcgtccaatcaaatttttatgcgtccaatcaaatttttcattaaaataaatccattaaaacaaaaaatgcactataatagccaagtaacatcatggttttttatcacaaaaaaaaatttgcaaaacaaaagggttccccccttgttccccccttttgaaaaaattttcaaaactggtcacttttaacatagcgcctttcagcatattttggaagaaatgagattaaattaccccgtatagtttgaactattgagaaattttgtaaaaatagattagtcaatgacggaaaattgtaaatgtactgaaattagacaaaaaaattgattggacgcataaactggacttgagccgccgttttttctgctaaaataaaaaactagaaaatagttgataacaatccgaaaactagcttaattaacaagcgacaaacatgttttcgtgcatttcaggcactgggagcttaggaaaaaaatagttatatcatccctacgtatgaggcgggggtctggagtcagcttggctgcggattattttttatgatgtttgatgagaaatcatagacaaaaacattgattttgcgaaaagaactcaaattctcagcgcatttttttaaccccattcattcggaaaaccttttcccaaattaaaataaaaacgatttgatcattattttgactccttttttgtcctcaatgtaagaggatttttctcttttgtggactttttctttgacaataaacaataaaaggttacataacacacaaattaagcaaaaaaataaatattaatgttataaacatctatacaaattacatacttctctctttcaagaaatatctgaacaaagcaccttcttcctgga

SEQ ID NO: 9112 - DNA, 889 bp, Heterodera glycines
  misc_feature (61)..(61): n is a, c, g, or t
ttcaaagaatattattctgaaacaaaagccacccttccttctctgtgagattgcacgcacncaactaaattgattttgattttaagtatttactaaacctaaaaaataaacatacggcctcaatgaatgctttcttttcagaatctgcacgtgttgtccaaccaatccgcaggcaatttgaatcaactgccatcttaaatttaatttctgttattttttataaaatttcacaaatgagaacaggttgagcttcgctcgatacttacgattgtttaattagtttataggtttgactcaatacgggttccccattttccattagtcaaaatttcgattctcattggtaaacgaacaaaagtccgtaaaaatttataactacacgaaacacaaaaatatggtcattttcaattttggttacgggcctgtaaacataataagatttaagcgatagaaataccacattagctcgacaaatgaagtaatggttggttttcttacttttaccagctccgccaccaatttcttttcgattccctgtcgctgttggtcagctctgacgcgtatattgtcgatggttatgtaaggtccagtccaagttgaaaatgcgcaacgatgaaacaatgccatgccaagaatggcaccgtcggaaacattctgggcttgaacaacacaaagtccaaaaaaacgacgcatcagtgagaatttcttttcggcagaagtcggttggatggaaacatccaatgaacgccagcactgaaaattgaaacgattaaagaatgaaggaagaaaggagaatgtgacctcgatcagattcacagcggacttctcattttcagcgtccagcgaaaaaacagcaaatttaatatgcggcaaacactctaaaaaagaa

SEQ ID NO: 9113 - DNA, 1004 bp, Heterodera glycines
gagcgctatgccggccatcggattgctgccgcgtcgccctttctcagcgaatggcggcgcagcagcgaggagcagtgcctggggtgtgaaccagcgggaatttgggtgtcataacaattcatacaaaaggctcttcgtaaaattacttgggttaggcttaggcttaggcctaaactttaggttaggccgaagcttaagcgttggcctgggcctattaagcttgcttgggcctaggcttagactttattttgtgaaatacgagtttcctcttgtacgagttgccattgtgacccggggcacggatttattttgtttaatttatataaaaattcagaattctgcgtccgatcatcggttctccagaaaagcagtgatttaattataatttttaatttttgtagagccgttgcggtgccattgtttacgacaaaggagggcacatttgccactatttcatctcatcaggtaattatggcaaatggggcggcagcactcttggcatagtgccaaggaatgggaagctcacgatttgtatatggatactcgagagccgaaatctctgagactcgagagccttgattcttgagcagtctattttttttattattcggtactccgcctcacattcgtcttttgcagcgcaatggaaagcccacaaatccaatagaaaaaaaaaattaatttaaatatctttaaatttccttaaatatttttaattttattaaaaatttatctttaattttttgaaatgggaggtggtgccagttttaagaaacgcatcattaccccgtcaaattcgcttaagattcgcccaatttggtacgacaacgaaaatttgtatatttgcgtgtcacagatcgcaactgtacaggtggtctattaaatggccaattaatgaataaataaattaattaatgattgttgcaaagaaaaacatttaacggccatttttaagtttgatcagatcagtaggcttatattgtttaatcagcagcagataaatg

SEQ ID NO: 9114 - DNA, 2336 bp, Heterodera glycines
caaaatgacatcatccgaaaaaggaaatcattatgccatccctgaaccaaaaacaacgagaacaacaacaacaacttctgttggcggcaacaattcgaatgccaccgattattatgaaggtggtccttaattacctaattagttaacaattatataaataagtgcgcatattcgtggattaataatcaaatgatcaactgtattggtggtttttaattgattggactttttttaattttaaaaaacgggctcgggtcagtcgagcgcattcaattcgattcggaaggactggtgcggtcagtcttgaaatttgacggatggtgctgaactgatcgctctggaaaagtctgcgccgagttggacgcgttccatacaaaagcagacaaataattcattcattatctgatgataccaacgcatactttgggttaattacccactcactaaaagttgtcaaaaaagttcagcacgtggcagaagcagcagcagtgccatgccaacaatcggtgcacttttggccgagtttgatgacgaattggccaaacgggcacaaatggcactgccatcgccatcacaagcagcaaatgccatcgaatatgaagcccttttgttggacaaattggccaaaaagggtccgctgcaaagtgagcgtgaaattcggcgaagtccgcgcatcaacgacagaggcggcggcggagatcaaaaaagcttttggccactccaaaatgccaagatgttgatggaaatggatgaacaacaacagtttaacgaaatgattgtgtcggagaaggagggacgacagcacatggcaatggccaagggggaggacaacgacagcgagcagtccataaccgctggaggaggtgggatggacggacgggcggaaggctgctgaatgaatgatcagtggggggggggggattagggctggaaaaggccaaaaatggcgcggattggccatgcccgggattatacctaaaataatcttaaaattacgagatttcttagttttgccatgccatcaggtaccgggggaagagacccaaattgattcgcgatgagacaattgctaaaaaagttatccatgaaaattgcgaaaagacgaaatttttgaagtttttccttcttaaattttttccaggtttgaaaatctttaatattagtccttttttggctaaaaggctacaaattcctgttttttgctctccgccagcgttgaaaccaaaagaattgtaaaattcatttcgtatacattctgaaaacgtattgtcaaattgcagaaaacccttgtgacaacaattcggagatgacccatcgcatttggttggcggtggaaaacgcgcgactcgccagcgccgccggcaccgaacgaatgccgcagaaggcggccaagacgccgcgcgagtgtgtgcgcgtgtgcacaaatttattggtgagttaattaataatagggatgtgcgagaatctcgatctgagaatttctcgggtttttcgcttctcatctcgtttctcgggattatttcacggtaaaaatcttttcgcacatccataattaataagcgcagtcgggcgcggcacgtatgtgtgaagcgggtacagtaccgactaatcctgctgcaatatttactgaactaattgacggaaacagtgaaaaactgtgaactacaaataatccaatgggattaaaatgctaaaaattacctagaaaaataagcgagtttaatttatgacattataattagtccattttgccactaattaggctaattaaaatccatttttgtttatttgtgctttaacgcaggtcggcctccgtccctgcaattcatttactttttacgaacacgaaaaacactgcgtttttggccattcgggcaacgcttttccatcgcgtggggcgctggagagcattcgcaacggcgacttttcccagcggacatttcgccaattttgctacccgggtaggctttggttgattgattggtccatgcttaatgtcctgagatcagagatttttttgtcaccatttcgaggccattttgtccctgacaattttgagacaattaaaaatggcataactttatcagatttttcttaatcagttgagcaaaagtgatcgggaaatgcgtcaatgagtgatacagtactattcagaaaggatacaggaaactactgtaacttctttttgtaaaataatgtttctctgacccattttctgggatgccgtttcattttcttctagtaaaaatagttgagaatggcgaatttaaaaaatgggttcctttccaagataattgattattttttggcactatttacgtataatcttgatcgag

SEQ ID NO: 9115 - DNA, 1830 bp, Heterodera glycines
  misc_feature (33)..(33): n is a, c, g, or t
  misc_feature (36)..(36): n is a, c, g, or t
ctgtattttgaggtggaaattttggaagaaatntgntaataaaaatgatttgtattttccatatttatttctttttcagaatggttgcgtcgaatcggccggagaaatcgcagaaggttttggcataaaacaacaattttgcaaaaaattaattagaaatttatttgctcaaattaagagacaagtcaaatgggctccgtgcgaaggatgagaaagaaaatatgagagaataaaatgcataaaaataaatatatcagagatttaattttttccaacaaaagcaaataaaaatcctaaatttacgtggcgttagaagcagaaatgaattaggaataaaatttagcattttctggagaaaagtaccttatttcggacaactaatgattcgaataattaaggctattaaagtcaataaaaaagttcgggtttcgtttctttttagaaaacaacgggaatatagaccgaaaaggtgtccaattataaatcattttcgattttgccaattcgttttttgactttgacctcaatttattattttcacatactttttgtcttttattcctgttatcatccatatattttgtcacttactccacgacccatttatctgaatattcgtcagagtaagtgcttttcgtccttctatgacttatttttatgaataaacaataaacaattcctaagagcgtctctcttctcctctattttttgttattcatttccccatcttttctcataaacaaaaacatcgccgtccaatcgccggttacgccgattcatccccaattccaattttaccctcacaaaaataaaatttggttgcagcattttattttacaaaaaataataaataattcaaacatttgtcagcctgtaaattaaaaaaaccattgtttccaaaaattatttttgtttacccataaacctgaatattcattcggaatttaatatttcgtgaaattgtgcaagggaaaatgccttttttggttgtcgttggtctcgtggtttggatttatgccggcttatgtgtcgcttgtgctgctttaacagtgaattttaatgcttattattagcgttaaattccaaattttgtgactcaaatttagtgatttatttcaaaatcttaaattaaaaaaaagtattaattggaaaaattttcgaaaattcaaatgaaaattcatggctgtttatataatattcatagttaatgggcatatgctacggcaatcaggggttggatttcttcagggatattcgaaaaggaaataatagtaaaatgagagtcattaaatagaaatgagaattcaaatgaaaattcatgggtgtttatataatattcatagttaatgggcatatgctacggcaatcaggggttggatttcttcagggatattcgaaaaggaaataatagtaaaatgagagtcattaaatagaaatgagaattcaaatgaaaattcatgggtgtttatataatattcatagttaatgggcatgtgctacggcaatcaggggttggatttcttcagggatattcgaaaaggaaataatagtaaaatgagagtcattaaatagaaatgagaattcaaatgaaaattcatgggtgtttatataatattcatagttaatgggcatgtgctacggcaatcaggggttggatttcttcagggatattcgaaaaggaaataataataaaatgagagtcattaaatagaaatgagaattcaaatgaaaattcatggctgtttatataatattcatagttaatgggcatatactacggcaatcaggaggggatttcttcagggatattcgaaaaggaaataatagtaa

SEQ ID NO: 9116 - DNA, 2925 bp, Heterodera glycines
  misc_feature (2866)..(2867): n is a, c, g, or t
  misc_feature (2882)..(2882): n is a, c, g, or t
taaattttaatatttgcctctaccaatttcaaatatatttttataataatatttttatatatatttttactaacaagcattacgaatcaaattattttcaacacatcgaaatacgaataaaaaattactagaatttactccctaataaattccaaaaaaaaatcaaactttataatgaaatttaaagcttagtcaattatttaaacacaaaaagtattaaataattcatctaatgccaaaatttttactattttataattaataattttccgaaaataaaacaaaatagaataaataacaaatattaaatcgtcatgttattttagtaattttaaaaataaactaaaaaacttaatccagcaaaattaaaacaaagaaagattctttattaaaaaggaaaaaagaaatgctaacttcttgtaaaagatagaaattaagaatttcagccttctttaattgataacaaaatttttgcaataatttttacctttctatcatttgtttgcgaatgtaataaataatgtaaagtttcataacataaacacaacacaaacatctaatattttattttttacaaattttcagttcataaaatttgagaatgagttgaatgaataaaatactttattttaataaaattaattaatttcaaaaaatccactaaaaatttaccgagtccagttttgcgtcagggccatcgctgcgtccacagtcaaatgcgctaatgagagctgccaacagactaaatatggccaaaatcaaaattcattatttgaccaagttttccctgattaaaattcgctctttttttgggctatttgaaaccgattaaatcattttttcgtgatcaaaattttttgatttcaattttcaagggttaatttgtgtgagttgcctcaattaacataccaaagtgcgagccaaacgttcatgttgaaaatcgttgatttgaagagtgggattgatgagaagaaacggttggaaaattaatgcctaaaattaagcaataaaattaatgaaatgtcaatgagtacctccaaagcaaatgagtgagtgctttattggcatttctcttggccatatcgttgcttaaatacaaaccaattgcctcctcttgcctttgtcattgttttttaattatttttactgtgatttttcctcattaaacgcaaataattccacgcaaatatttaatgttcttttagcagtaaaaaattactggccaataaatgtgtacataaaagtgctgattgaagtgggccaaaactttggtgaagaaagaggttctttgtctccaattttccccacgaaattcgccaataatttggcgtaacatttatttttactttaaattaataaaaaattgctggccaacaaatgtagtaattaatagcatttgccgggcgagtgttagctgaagaaaaatttgttgtaattttacttaactcgctttgtcacttttccataagaatgacaaaagttcagtcaaaagagcactttagttttttgcgtcaattttaatttttctatgataaccgtaaaattctaattttttgaaaaaatcaaaaataaacttccgaaaacttccaatcttttttcaaaatttcagaaaaagataatggcatccgacacccaaaaattttccctcgattcatagggattgattgccccgcttttcccccgctttaccacaacaaatcattcattcattccttccttttcaattgttcaattgtctcaattcattcatcgcaaattccactttttccgcgcttttcatcgccacaaatttctccaatcggttcaccgatttctcagattcgtttcaattggattggctttttcacccctctcccgctttttgcgactttccccgctttgcgtagtcctaaaatattttcgcgccacaaaaatccgtttatttttagccctttcaattctttacgacctttgaattttttaaaatttataaacaaaaattatactaaaatgattctaagctttgtgcttatttaaccctttacaaataatttttccaaaaaaaaaaattttttttaattttattaacatattttaatacctctttgttggtttttgtgcatattttatacacattttagcatttttttatacatattttatttacatattttgtcatcgcttcgcagagcgatgacgaagcacgaaaaaagaaagaaagaaatgactaatcataaagcgaggacggaggccaaattgactgttatttaaccgccacccttttgccttttctgtcagttgaagcataaagagcaaatttgttgggcttttcaatcaataggcaaataatttaatattgttcatttaagcttgtaaaatttcgggttcctctggcggctataccagagaaggttcacttaatttattataacagtaaataagacgtaacaaagtggtgcaacggccgaatcctaaggcaaaaagtttgtgtaaaataaaaagagtgtagtgggtgaaccgttataaatgtcggaaccaatcagaacggctttagggataatggtcgagaatttaatcggtagactgaatgaacttctaccaattgtcagagcacagcagaggaacgaagagggattaaataaattgagagaagatagaatatttttaacagatttattagaaagaattgagcaaaaaaaccgtgaatgggatacatatataagagaaataggagaagaagctcagaatgaggaaaatgaaagataccgcttatttacccataatgggcgacatttttatgaatgggcagaaaggggaagagaaatggtcagcagaattaatattattctagctaatgaagatggagaaagtttagcagagagtgtgnnaatcataagaattgngcaaagagaaaaaattgaacagaaggaaatggcgacaatgaaa

SEQ ID NO: 9117 - DNA, 2522 bp, Heterodera glycines
aattacatgtttttgtagatgcatcaaaagatgcatatgcgacctgtgtttatctgagaagcgaagagaaagaaacagaaattcaacttttatattcacgcagcagattaaggccacggaaaatgaaaatttcaattccaagaatggaacttttgggagtgctaattggaacaagggcgatcaaatttgtgaaaacagaaattgggataacgatagatggaatgtatttatggtgtgattctaaaccagtacttagttgggtcaattcaaactgtgaccagcctcgatttgttgccaacagacttagtgaaatcaaattaaattatgggttggaatttgggtatgtctcaactgaacaaaatccagcagatgtggcaagcaggggttgtacaccaaaggaattaaagacacacccgttatggtggacaggaccagaatggctaaaaaaggcacagttacattggccaaatgaaatgaattttaaaattatacagtcaggagaccctcaagacaattgtcaaggatgccaaaagtcatttggcgtcattgaagacagagaaccggaaatggaacttattaattttaagaattataaagaatggcataaattagtgaaaatttttgcaagaatgcttaaaattgtaaataaatgggtacagttaattaaaaaacaaacaaatttaaaagtatcggaaggagaatacatcacgccaatggattacgaaatttctgaaaagatactcttaaaattgggtcaaaaaggatggaaagaatatgtcggaaaaaacaaccaaataaggtgggaaaaggacatcgatggattaattcgattaaaaacgaggattgagaggagtgcaacaccaaagtcatttcataatccaattgtatttccaaaagggtccaaaatcctggaaatccttattttaagagcgcataaaaatgtgatgcatgaaagagttgacgcaactttaaataattttttgagtgaattttgggcgcctggagttagaaatgcaattaaacaggttctgaaaaattgtgtgatttgtagaaagaatcgaggacctccttttgctctaccacccatgccacctcatccaaaatatagagtcagaagatccaacccgtttgagtttgtgtcattagattatttgggtccgtcagtaatcaaatcaaaaaataaaggtgaaccaagtggaaaatattggattgttttaataacttgtcttacaacaagagccgtatatttagaaccagtgtttgatttaacagcagaaacatttttacatgtgttaagaagattcgcaagcagacgagggaaaccaaaaagtataatgtcagataatgctcaaacatttaaattagccgcaaaggctggagaaatgtacgaaccaaaaaacacaaatataaaaaatgaagaaattagataattatttaactaaaaataaaattctttggaaatttattccggctttatccccctgggaaaatggatgtgcagaaaggctggttaaaatttgtaaagatgcctttaagtctgcattgggacgaattattttaaataaagaagaactgtgtacttttacggcagaagtcgaaacgattctaaattcgagaccaataacacatgtgtcaattgaacctgacggagaaagagctcttcgaccaattgactttattaatcccggagcggaattgggtatatttttgtcaaaaaacgggaatgagaatgaccaagattatagaactggtcaggcatcattagaagagagactaaaagaaaggtggaaacgtacaattagagcgttagacatattttgggacaggtggaaataaagaaaatttaattatgttgagaaatcggaaccaatgggattcacaaggtcccaaaatcacaaagatcatcgggaaacaaaattgggcgaagtggggatggttgaagatgatttatatccaaggaatacttggccgatgggacgaaatgcttaaatcgaatggaataccaggggtgattagaagtgtgagtgtaaaaatgatttctggacgagtggtggaaaggcccattagcaaactttatcctttagaagcatctcaaaaagaattaaatggtttaaacgaggaagataaagcaagattaattagggatgattcaaaaaaggaatttccggcgataagggaacaaataaattcaaaagagaataagcataaaatgataacaagagcaaaaacgaaagcaataaaattgggtctgctttctgtaattttattgttattaattgtaaagggcgaaagtgaaagggtgaacaaaaagattttaaggtgtgaagattgtaaattaaaatgtgaaaatatgggtatttatatgaaaacaccaattcgtatggaaaaaattcaaatttgttgtttgggaagttgttttacccatctatatacaaaagagttacaagataatttaccgaaagagcaattattaattgatcatgaaagaatagtaacctattgtcaaaaagaaaaagaaaata

SEQ ID NO: 9118 - DNA, 878 bp, Heterodera glycines
ttttggttatttgtgtgttttggccgtgctcagttgcctctttgtgccgtttcagcgccgaattccaaaatttttaattaccgcaattggcaaaatgttataccaagctgacgcacacaatcatcgaggtgggcaagtacagttgtagcacaaaataggtcatcagtcgggatagtcgcaaacgcatgcgaagacatgcgtaagtgccggtgttggtgtgcgaagtgcactccacgccggtgtcaatgtggtcgagaaggaagttgggcaagtcttggccaacgcctgggcaaacattcgaaatgcaacaacagaattccatttttaaaatcatttcgaattttaaagtttaatatgaatttaaaatttaatgctccgaatttgattatcttttttgtgtgtacgattttatcgtaataacgaaaatttacaatggattagtttttgttgtaaagcaaaaatttcccgaaaaattcaataatttcatttgaaaaagtgacataaaaaagaaaaaatcgctttaaattaaattgagttttcagtgaaataaattattatttttttgttacttcaaaaagaacattttttcaattttccttgaagaaaaaatgtttttatatttaaaagttattaaaactaattttggtaattattttcttaactttttcccattttcatcactttttagttaaatattttggttttttgtaactaaaatccgcgcccttcttatgcataaatttcgcgttttgagaattacacaaaaaattattatttatatttggtaaaaaacggcgattgctccaccataaatttgcttgctcttttacttacatttttcggcaaataccccccccccgtaatggaacttttggggc

SEQ ID NO: 9119 - DNA, 2893 bp, Heterodera glycines
  misc_feature (58)..(58): n is a, c, g, or t
  misc_feature (2826)..(2826): n is a, c, g, or t
tcggtgcgcgtccttttcagtggggaaaaatgtatcgggtagccaaattcgcgcttcnacatggggaacagtcagaaattttgggggagatggactctgaaaaagagttaattagtgtaattaattaattttcaaaatgccatttgtgggcccaattgtgcatatgcaagccgtcggtccacccattgttcgcggaaagtgatttgcaagctgtactccatgtccaccacgtcgatgttgcttaacatgcgcaccagaatgttcacactgacacggacagctcaaacaaagaaaaacaacatcaataaattacttaatctctatttgaaaatatatttttaaaatttaattccttcccccgcagcgacaattttcaaacaaatgacaaaattaaatattttttaacaagctatagtggtaataagctattaaacatcctaattgaataaatttcccatatttatttaattaattagcatgctaattgaccaaatccccacccgtttcgtttgctcccgcttcgattggcggtcggacgcgtctgtcgtaattgcgcaataattggcccaaaatttgttggtctcttgccagccaattgctgtgcaatttgctttcattttgcttctgttgcagctgagtttgttgtcgcaattttgcataattttgaatggacaaaatgccgaaaagcggacaaagcgccgacaaaacaaaaagaagacaaaacgacgaaaacatttggacgaaataaaacaagagaaaaataatctaggtaaaaaataaaaatataagatagacagaatgaaaatgaaaattaacggattttcatttccgcgtcgaagccttttttaagaatttacccgaatgaaaggactaatttgtgaaagtgacacttctcggagttcttttgggacattgaattcttcttcgtgccgcatgaattgggccaaaattggcattttacagactgatgaattagcgggcatttgaatggacatttatttaacaaatggacgaattttaaatgtggaaacaataataaataaataaataatgaaataaaataaaattgacttaaataaaaataaataattcaagccggtttataaattgtattttgaaaaattaaattgattgataaaatagtattatctaattaattttattatttaataattttaattagccgttggaaactctaaaaaacaaatccttaactaataaaaataaaaattgacttatattaaatgaagaataaataatacaagcgttttataaattggatttaagattgataattaaagcgtataatacaatagatatatttaactaatttagcaattaatcattttaattagccgttggaaactctcaaaataaaatgatttgatagtgattttgactgaacggagcatctcacattttcattttcagttgagtttcgtgtactgttgttatgttagcaaacttttgtttgttttgtttgttcaccaattgtaaagtgtgtgcttagttagaccgactgaaatttgtgcagaaaaccaaaagcaaatatcgcataattgatcccaacggacgaaaagcgaaaattaaaaaaaggaaaaacatattattttagggaaaaagcattggttcaaaaatatgtttaattaaatccgtaaatgaaaatcaaatggcaagcattgattgactcacttcgagaagcaatttgagttgtcacttaaagctatttttaaaagacccattttggcttttcttcaccaatgctaatgacacaaatttcgcatttactctttgttaaattgacttaatttattaatacaaattaaattaatttttaggagtaatatttttatcaactttttatttctatcaatttgaccagttttttatataaaattttttaataataactttatattgtttcagagatgaaactttcatgttccaatttacactatatataatcactttgaattttactttatttttcacgaaaacgaacgaaattaaaaaattttaaatccgaaacgaaaaccaaacgaaaattttttgacggacgaaaacccaaacagaaaaacgaaactcaaaaaatgccaaaaaaggggacgaaacgaaaacgacacgaaatatcacacaacactgcccgggaccggagcagggcaaatgtcgccagtctaaacgtcgcctacaaatttttggaccataaattttttctttctcaaccaaattaaacattcttggtatcgtccgaaaacatttgaaagccgctattaacctcaaatcttagaaatttttttgttcatgtacaaaaaaaaaatcagggcaaaaaagattcaaaaaactcggtttttgagttccttctggccataacttttttgaaacttaataaatttttgagatttagcagaataataataaatacactgagcaattgaacaacaccaagaatgctgctccaaccctaattttaaggttcttaatttttccagaaaattatgaatttctgaaaagaataattcaattttttgttagaattaaattgcccaaaataaaatcatattttgaatcagcgacctataaaattctccgcgaaaatatattggccaaatattttggcacgaagaacagtaattttcttttatttttttaacaacttctatatctgttcatttaaattcacttgcatattgccatttgcttgccaatgactttccaattaagccaacactttaccatccgaatttggcatcccaaaatcgaaattggagacattttaaaagttcattaaataaattcgaaattggagacattttaaaagttcattanataaattcgaaattggagacattttaaaagttcattaaataaattcgaaattggagacattttaaaa

SEQ ID NO: 9120 - DNA, 1688 bp, Heterodera glycines
  misc_feature (21)..(21): n is a, c, g, or t
  misc_feature (1594)..(1594): n is a, c, g, or t
  misc_feature (1596)..(1596): n is a, c, g, or t
  misc_feature (1609)..(1610): n is a, c, g, or t
  misc_feature (1617)..(1617): n is a, c, g, or t
cccccccccccccaattgctntgctcctccttcgccgcacctcatcaaaatcaaatcaaaaaaataattgttgtgcccaatttacacactaatggacaacgaatgtgtgaaggctgcaaaagtttcgaaagcattgctaaaaaacaaataaaaataatttttatccgaatttacattcaaattaaaaaaacattttttgaaactttttttttcgatttatcaatttccaaatatatataaaaacgagtttttctcatttttcgtcaattcgtccgaaagtcaatttgtgtgtcaacagtcaatcacataattgccccataaacaatttaaaaacatgaaaaggacagccaaaatatgtgtatttggaaagtgaaatcaaatcaaaatatgagttaaatttcataaaaatcataattttatatgaaatcttatttaatttaaataataattttcattttaataatttttcattataatataatattgcataacgaaatgaccaaaaatccgattaaataataaacataaataaataaatcactttcattgggcgacattttaacacgaattaatcttcttttgtcgctattttaacctccgcttttgtacacaatatgcaatacatttttattcattcacattatgtgcaaaatcaaaatcaacccacaaacaaataaataaattgatctaaaaatgaattaaaaaataaaacattcaaaatgaattttcaattttaattcatttaaatttttaaattaatttcgaatttttattcagcaatttatgccgcagatcagcagaatagaagtgctgccgacagatgctcatcaactaaatcttggacaaccatcaaatagacaaaatgaacgaaatgccattcgaaacagagagtaaaaaaaaataaaatattaattaaaaataatggatgttgtttacccgttggcactttgtgccattgtccaattgtcattttgccctaattgtgcccgcaggcatcgaccccctttgtgccgtcggtgttccgcttctggcgcaggcccccgtcgacgcgttcaactgttgccgacctttgaccgtctgttgcagcgaatgttcggcgcgtacacgcgccatttgctggtggattggcaccgcgcattcattggtctctctctattcatttaattattatttaatttatttaaattaatttataattttcccaaatttttcgaattgcttttcacttttccaaagtgttctcttttcagttggtcccattcttctgaccgcgctgttcagctgcggctttctgcgccttcgcgaggcgaccattttggacgccaaggaattgtacacgccgcgcagtgcgccgagttgggaagaggaaagaacatttgagcaggcaaatgactattctatacaattttagtcggttttacgggtcccatccaattggattaattaattacaaaacaggcatttataaataggaaataattatcaaaaaataagatagttgcgacgcatttcctccaaaatattttttatttatttttgtgtttgaatgataacgacgaattgagtactgactagagaccagacactgactaangntcggagggatccnntgagtgngatcccgaccgaatcccgatcccgattgatcaagaagattttggaaaaatgatcggggccggatccctaat

SEQ ID NO: 9121 - DNA, 5685 bp, Heterodera glycines
  misc_feature (53)..(53): n is a, c, g, or t
  misc_feature (4602)..(4602): n is a, c, g, or t
ggggacctctagagtcttaaaaaatagaagaaaaaatgggagaaatttaattnttgtcacaaataatgaactaatgatgagagaaatttaatgtttattgaatgaaaatattacaaatttgctaaatcaaacagctaaagtatctttctaattcaacaatctgcaataaaaccaataataataatgagtaaaaaactaaaggcaaattaattatgctcaaaaatttaattcttaatattcaattgtaatatatatctcatagataaaaatcgcgccattttcttcttagttagcctttgctaattagtattaccctaagtaattttcaattagccgcctatcttttcgatagatgcgatgaaaaattcttaaattttattatgcaaaatactcattttgttttgttctctaaattaaatacattttagtgattgtataaaaaatttaagtttttgcataaatttaaatcggaagaaaagaaaatattttctcagcatttttcgaccataacttttcgaaattaatttattgtttttgcaggataaagataactattctatatatattcaaaaaaggtctttgttaatttttgagacaatccccaattcctaaaatattaagctaaattgtggatgatagactcttgattttatttcaaccacaataaatttcagaaaagaaatgctactaatatccatcataataataagccgaataaaggtgatggccagcgcgatgtttggtggcaaattgcaacggaaacatttgggcagagcgattggtggggagagaatggtaaagaaacacactgatcacttcgcgatgagtcaacacgccggacaaaactgtcaaaagcaacgaaaaattaaaaaaaagcaattaaagacgaaccaattttctctgaaaattgctcttttgcgaagagtggaaaacgaattttgaacagtgccgggccaagtgcggcacgacgattctcagcggaacattcggtgccattttggcggcatttttcgtctgcccaacggagtgcctgcaagaaataacatttttgcaaagtcaggaatttttgagcaaagcccctgtttctaaccccaaccccttttgccattttccaaaattctgggctcagatttttacttacggcattccaaattgagagttccccgctaatgttcaattggtcacgttcaagaattttagacaacaaattctgatcaatttgcaaaaatgcatcggaacggaacaaagtttccgcagttcgatcaatgtaatccaagcagcgaagggcaaaattctaaagaaagaaattttggctaagttatttcgattattaaagccatagttaatgtttaacacacccgcacggaaattttgaaaaagggtgaaattttgtaaaatttgccgaaccaatttaaattgtttagctttttaaacattttcaatatactatttaatgcaagtgagatgatgaaaaaataaagtttatgcgaaagtatgcctaactttaatgatcaattttgaaaattcacagaaaaaaaaatcatgaaaattccatagagcctaatttgatgttaaacaaaaacaaaatacataaaattattcggaacaaaaggaaaggtttcatatctcttcaagatataaaaaaaaaattttataatacaaaagggggtaaactgaaagtttggttcggaagtcccaacgtcacttgggtacatctcatttgtaaggggatgaaaatctagtcctttttttttgcttttcaagcatttatgccttaaaatttcatacattctcgttgagaaggcaagcttggtcataagcgaggaacacattgttcaattgagagattgggaagaccaagcaggcattgtccagcaaggagatgttgtactttttggcttaaaccatgtaataataaggtacttctgggttttgctacccctccccataaaatttatctatgactttcatcatatgattttgccggtgatttttcaaaaaagccaattgttgggctagaacttttgaaagaaacatcgaagaaccctgaaacaagtaccattcgattcatctcgactatgagaatcggttgatatttgagaagactggttctttttttaaatcattgacaaaatggctcaagtccagtttatgcgtcccatcgacttttatgcgtccaatcaaatttttatgcgtccaatcaaatttttcattaaaataaatccattaaaacaaaaaatgcactataatagccaagtaacagccggcctttttctcacaatttgtcggcaaaaaccaatactagccgctttttctctccgttcgttggcaaaaaacagccagccggcatttttctccattcttcaaactccggttgctatgtttcgacgagctatattactgctgacctgccctttaattttgtgtatggaatggcaaggctttatcattgacaaattcggatatcgaagagcgcaaccttggcattgttgcggaatttgtcctgacaataacaacatctatgacaaaggtcgttgtgttaacgaatatagctacgaaacggaaaccgatcgttatattcgcataaattaccccgtatagtttgaactattgtgaaattttgtaaaaatagattagtcaatgacggaaaattgtaaatgcactaaaattagacaaaaaaattgattggacgcataaaagtcgatgggacgcataaactggacttgagccgacaaaattacaggatgaaaatctgatcaaatcatagattttagtactttttatagcggacttgataagtgcataaaattatcgtagaaaagtgttttcctttgtcgggatcatgatatttttatggggaggggtagcaaaacacagaagtaccataataatatattaagggcaaattcaaaaaatttcacccgcgtaaagcactgccattgcgttgtgtccattcagtccgtttgaatcttccgcataaataaagctgagcatcactttgaacgcaccaacttcaatgtcgggcactttcacaacggcactttcggcagatgcttaaaaagtttttttattatttttaattttaccctttcatcacataataataataataattagggcgtccaaaaatatggatataaaatcgcgaaatatggccataaaatatggacaacaaatcgcaaaatatggacataaaattgccaaaatatcaaaatatggacataaaattgcaaaatatggacataaattttccgaatttatgggtaaatttccaaaaaaaattttaaagttcataaattctagtaaaatacatctaaaatggttaaataaggtataagaactcgtttttagaagaaaacaagcaatttctggagaaaaacgacccaaaaatcgaaaatttccatttttgcttatttttgacataaattaaccaatttttaagaaaatttaaatttaatcaattttttcgacaacatttcgctaaaaaatgactttttggaaaattttctggtctttaagggtcgaaatcccacttagctgatgggggccgttttattagaggttttttggaaaaaagccaaaatatggacataaatggcgaaatatggaaaaatatggatatggaaagtcatcctagacgcttcaaaccaagcaaaaaacatgtttttcgtgcgtttcagacctcccacagtccaggaaaaaaatatggatttccatataattggaagccctaataataatatttgtaccgtttttcgtttttccatttttttcatcaaaacggaacatcgcttcaaacacatcagaagcagtcatcataaccaatttgtgtgcacgcaaaagcttaagaacagaacaaatacaaaataaaattggggaataaatgtttaaaataaataataaacaaatattttaaattttaattttataaaattattttggaacccactcaggccccaggggtggagcgcgcatagaaaaatcccgcggccgcgcattaaaatttccgcggccgcggatcgagcaaaaaaaaatgccgcgaatcgcggatcgcgcatttattaaaatgtttccaattttttaaaccattttaaatttttttttaatcttattatttaaaatagagtgccacgggacagggaattttgggcaaacccggaaccgggacctttcgggttgaaaaaccgggaatttttggctgggaaaaccgggaaaaaagccgggaataaattttgagtggaatttgttaactgaatttgtcaaaaaaacggccaaatatttggttaattagtgggtttttagactgtttaaaaatgaaagaaaaataaaagcttgaaattttatttattaattaaaataatgtaaagaaaatatgaaaaaaatctattccgttcgagaatggaacccaagagacaaacactgcaggctacaaggttagcaactaaccacagggcccggatttacataaacaaatacttatttttgaatatattacataaaaaacaatcgcttcgaaaaataatttaaggctcaaaaaagtgacaagtgctcaccagagcaccagactcttaatccctgtaagaaaaatgaaacccctaacgngtggggtatggcccaaaaaaaaaggatatgggcaaaaggcgaggggccaaaaaatcagaacaacaatatacttgttcactttgcagtagcaccgaaatgggaaaacgggggccaaaattgggcacaatgaaaaaggcgagacgatcggcgacacgcgacagatgaaaagctgggaaacaaatttatttgcaatcttcactgatcagtgagtgagtgatcagcaggaacaggccaaggatattaattcaaaactataaaatttctttttttctgttaccaatagaatttaatttgttttgcaagctaaaattttaagacttaaaaaatagaaatttctgaatatttttagtaaaattttgaaacaagtattagcccttgagagcgaaaaacaaatcgaacccaaaattaatgggattgcccttaaatagcacaagattgctgttgaaattgacatgaaatttgtcattttgtcaacaatgtccttgggaatttgggaatttccctgatctgttcttggatttgctttctgctctgatctcctcaactgttgctgaaacataccattctgtggcgagacggacagttcgcattcggccgttttttgacgtgcgccatgggacagtgccgagttgggacccaaaaacagcgatttgtaagtgatttgttcggcattttttgatcagaattaccacctttacaattgcaaaaattgtgctgctcgctggcgcacactggtgatagcccgaaaatgggctgtcgttgctgatcagcagcagcagcagcggaggatgggagacgaatgtcgagaaactaaacattgagagagacaatcagtgacgactgattgttgcttaaactgcttaaatttagttaattattattagagcccggatgtgggcagagaccccgcggggattttgcgacggttcccacactcgcccccgaataatggagacggagcctccgcaaaaatcggcattttttaaagaagctcccgtccaaagcagtttgattaatccccgctcgtccaagtccccacaagaaagtaacagctagagcaggattaatggcataattagtgat

SEQ ID NO: 9122 - DNA, 1043 bp, Heterodera glycines
ccaggggtggagcgcgcacagaaaaatcccgcggccgcgcattcaaattgccgcggccgcgaccgcgcatcgcgcaaaaaaaaaaatgccgcggccgcgcattcaaattgccgcggccgcgaccgcgcatcgcgcaaaaaaaaatgccgcgaatcgcggtcgcgctccagccctgtcaggcccgtagcgagggggtggggaattcctaaaaaagaaagttttcggattccccactccgaaatttttttttgactacgggcttgggcccatttacctctttttcttctccttggccaaccaaaaagtgaatgtccgccccattagccgtgctcaacaaaagtttcattcggtccaccaatttggttgacattgaagtttctaattttaaatttgtaaagtaaaaaaaaaaatttaaaagacctaaaaagaaaatgaatatggaaaaagatacccaaaaggaacagattttctaattcagtttgttgaattttgaaagaaactttttgaaattttgcagacatagcccatatgctaattctctgcaaaaaaatactattttttttgttcatgaaaatgatttttcttctttcaatataataaaatcgataatgttattttgaaggaaaattgaaatgaattccttcgcgaaaatttttttgggttaattatgaatagggagcggatttgttaggtttttatttatttttactgcggatttaatccaaggagaaaagcacaaccttcgttttaacgcctctatccgtccctagtaattaatccctattttgggtgttcgccactaaaatagcggcgtccttattttggcacttttggcatttcgcccctatttaggcatttctgaaaatttcttatcgtaatgcaataaaaaaatacacacacaaggaccaccctcttgaaaaattcttcaaaatgttgggaaaagtaaaaaattttcaagttttttggacagaattaaaaaatcattaaatattcgcctaaagatgaaaaaataagccggaaagtcgaattttctgtatgaaaaa

SEQ ID NO: 9123 - DNA, 811 bp, Heterodera glycines
  misc_feature (8)..(8): n is a, c, g, or t
aaaattgnaaaattttagtgtttttagagttttcaatgattaaaattgaaaaaaatttgaaaatttgaagtttcaatgcttaaaatttgaaaatttgaagtttcaatgcttaaaatttgaaaattggatgccttttagagtttttcaatgaataaactgaaaaatttgaaaattttagtgtttttagagttttcaatgattaaaattgaaaaaaatttgaaaatttgaagtttcaatgcttaaaatttgaaaattttagtgtttttagagttttcaatgaataaactgaaaaatttgaaaattttagtgttcttagagttttcaatgattaaaattgaaaaaaatttgaaaatttgaagtttcaatgcttaaaatttgaaaattttagtgtttttagagttttcaatgaataaactgaaaaatttgaaaattttagtgtttttagagttttcaatgattaaaattgaaaaaaatttgaaaatttgaagtttcaatgcttaaaatttgaaaattttagtgtttttagagttttcaatgaataaactgaaaaatttgaaaattttagtgtttttagagttttcaatgaataaactgaaaaatttgaagtttcaatgcttaaaatttgaaaattttgtgtttttagagttttcaatgaataaactgaaaaatttgaaaattttagtgtttttagagttttcaatgattaaaattgaaaaaaatttgaaaatttgaagtttcaatgcttaaaatttgaaaattggatgccttttagagtttttcaatgaataaactgaaaaatttgaaaatttta

SEQ ID NO: 9124 - DNA, 2086 bp, Heterodera glycines
agcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaatggtctaacaagggaacctcgcgaactgtaactcggaaaatgggtataaatttggtaccattcgatagagcagggtcgacttctattgtgaatttttaattttacgtgcctatagcgaaaaataaaaaagttatgaggcctcaaaaaccctaattttcccctgtgttttcccttcagtgctggtggtcaagtggtgcagaatggcgccatggtgactggtggttcgactccgcgtgggttcaacaattcttattgtttttattaatcattttaaagtaccaaaaagtggtcaaaaacaagtttaaagcacgaaataattaattacaacggtgtttggcgagaataaaatgatcgaaacagagattattagaacaccaagcgcaccggataaaaggaggagaagtacaattttggcattcaatataaacatcaatttttttaaaacaatattcgggtggagtttcgaaagatgggatgtcgataatgcctaaaaaacctgacattttccagctatattgagtgaaagacttaaaaatgggtgcagaaaattggaaatggatttcatttaatacacgaccaatattttttttgcatttaacagcaattttttgcaggtgtgaaatcgtcaatttaaatttataataataaaaagagtattttgaaacggttataaataattgtaattactataattatttcgtgctttaaacttgtttttgaccactttttggtactttaaaatgattaataaaaacaataagaattgttgaacccacgcggagtcgaaccaccagtcaccatggcgccattctgcaccacttgaccaccagcactgaagggaaaacacaggggaaaattagggtttttgaggcctcataacttttttatttttcgctataggcacgtaaaattaaaaattcacaataaagtcgaccctgctctatcgaatggtaccaaatttatacccattttccgagttacagttcgcgaggttcccttgtaagtaaaaatcgtaattacgctcaaaaagcttctcaaacaattttagcacatccaattccttctacaatcgcctttatacatcccattatgaacgctaaaattatcagagtgccgaaaatcgcatgtgatctaagcctagcaaaaaatggtgaaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattatagcgcatccaattccttctac

SEQ ID NO: 9125 - DNA, 1274 bp, Heterodera glycines
taaaaatgcgaaattcgaaaaattaaatattcgattttcttctaagttcgggtccgggtttcggaattgttcgaaatgcctgtcaaattcgtgatcagcgaccccgaaaaccccataataaggtatttaattcaactttttttaaaaaaatttctaaaaaaggggggaacaaaccaaagtattacccaatttcttccaactaaccttttatctaaagcagatattttcgaaaggttggcgtgaaaatgaacgcataataggatggtgactcatcggctttgattgtattttaaaaagggagagaatcctcttgatacaaatactctgtgccgtatgttgtgaccattcgatgttttcatttctttatttatccattcgcatgtgattgttgttgttttgtttatttgcaccgaattaatcacaaaaggggggacgaatatcacatcactttgtatttttacagtcactcattttgcacagaaaatgccaatatactgtatgtaatactttgtttaaataaatgttgccaatttgcgaatgtgtgactcaaacccattggaaacaaaagagggtaaacaattagttgtcaatgagtgcttttcacagctcgtcgtgggatggctttaatttgggttccacgttttcgatgaaccattcgaacggcttgcagttcagcttctctttcagtttcaatcgttctgccaaatcgccgggatcggttctttttgctgctggtcgaattgcggtgtattttttctgaaatcgctgctgcgtggggggcgggacaaaaaacgcgccaacctcaaaatcgtccaaccaaacgcgggccgtcctcagcgagttgtacaggctcgagtcgacgcccggcttgccgcggtacgggcggcgcatgcgaaacacgtggccgacgcgggaacacggcgcgaccagcacctcgccaccgcacagccaaacgcggattgagaactcgatattctccgcgccccatatttccatgcccatgtcgtactcgccaatctcacggaaataatcgcgagacaccgccaaaaggcctttaagtgcagtgattggcgtaaccgatgagtgttttctttttctcatttctttgtctcctcacattccctctcccccttttttgaccatttccctttctcccccacctccactcattgctggcgttttgtacggcttcacattgttttcctccacgtcgaaatacgaccagtctgaaaaggacaaatgccatttggatgatttggggggggggggggggg

SEQ ID NO: 9126 - DNA, 1603 bp, Heterodera glycines
ctgatcagtccctgtcgttccgaggcctttatgaagcggattttgctttcccaattgcccttcgcaattttcgcatattccttcagtgagtcgccaatgtccaaattggactctgtgaagtcgtcgtagagaatcacttcagtcaaaagatgtgccggcgattcgttgaagattgagttgatctgtaaacaattggcaagttgttaacatccgtttgaatttttgcgttttctccgtgcgtccattagccatccattggcccattaattaaataattaattgccccattcgaatgcatttgttttttcggcctttctttccactgcaattaccattctgacgagcactgacagcatttcattgtggtaaatgaccaccacagtgacctttgagtgcactttggagaagtcaatctcagcgcaccttttcaaaaacgttgtgtactttttgtgatatttcaagattattctcgagtaaatatccattcgtttcgtccgtttgtccttcgttactcacttcggatgtgccattttgtccaactttctcgtcggtccgattttgtcgctcacccattggttgaagtaatacctgtgccgtactcttttatctccctctgtttgtcccccccccctctctctttctcctctctctctcccacctgtgctgtcccctctcccaatattccttttcgtctccgctttcctccgctggcgtgtctttggtcacattgcatttggagggaaacaccggcaaatttgcccatttctgcaactctttctccgggttaacccacggacattccggcaaatcggaggagcaaagggaagggcaaaagaaaggcaaaaggaggaggaactacgggagaagcgccattggagccgaaacagcacaagtggccgaacaatgagctaaactggtcaaattcgatattcaaataaggcggaggatgggcgaaggaatgcgacgggcaattggggggggggggaaaggacagcaaatgattcgactgcagcgcgttcattaagggacacccttttccccgtttagacgacgtggcgctgttccaccgattggtctcccgcgacgacaaaacgtgtctccaaaatgcgcgatatctttttccaaggtaagcacgaaacttctagaaaaagtcggcaacaattgatcgcccgggggcgcatggatgcgatgctccgctcgcagtcagtcacagcgatgcgcagatgaaagcagagggagagaagggaagggcggggagggagggaagaaaggcagtcactgcgcgatcagtgtcgatcagtcagttccccactctgccccccccccgacataatgaaatctatacactgacgtttaattccatccgaaagtgtcgatgatcaaagaaaaccgaaaacgtccaaaaaatttaaacagttttatatgcaatttaatatgaaccgaattgtcaattgtgaaagggcgaagaaaagacaaacagacatttggaagttgggaaatggaagtgtttggaggagaattcgaaatgaaaaagagacaagacaaatgaggaaaaggggagtggtcaacagctttcaggtaagctaagatgccatcttttcac

SEQ ID NO: 9127 - DNA, 1688 bp, Heterodera glycines
gtgaggggaaattgaagggtaccataagaagccgagataggctaatccatcattattgatttcttcgttctaattgtctctttgttaggtatgtttctttacctagactttgactaaatgttatttggctattaggttagaatagaaattcagctaattgggagataatcggcggatgaatggtcagcgagaggggagagagaggacaaagcgcgaaagcgatggacgatttacggacagtgagtgccattgccgttggtcagggagagcggccatgaaatcgtcattcatcttgtacattttcttcgttcatgaagatttgccaaagtttagtggtacgacaccgccggagggagtgccgccggggggtggtggcgggagatgctgttgttggtggtgatggaagtggacgggcggggcggccaacacggacggaggcagcgaagcgaaatggtggtgatgggcgtgcgattgttgaggagcggacgtgacaaaggccgtctgctgatgcggctggggcatgtgctggtgatgaccgccgcggcctccgaaaggtgacgccgttgagggaccaccgccgaattcgccgcccgcaccgcccccagccaacgaactcagctgattagcgtagacctgacaataacttggatttattttgggttcgcttcccacatgtattcccaccattgctgcctcgtaaactgcttgctgttgtgccaccaattgcgccgctgcaaagtcgcgcgcattcagccccgtcgtgccgttgttgtttgaactgctccgtcccgacgttgccatgccaaatgcgtttgtccctgttatagtgcccggctgatgcggaggatgagggaacccgtttccgaacactaaaatgagcccggatttgctatggcggaccattaatatcagtttgtttacttcctggattgactgttggataagcggtcaaaagcccgtggtgatggccatgcgaagacacggtcggcccgtaaaaaggcggcatccgcggcatatacgaagcgtaggcaagcaactgctcgggggccaacccgtaaaggttacgagcagccgctgcccgcgttttgttcaattggacggggagcatcacttccttgggttgggcctgaaagaaatgattcaatgggacggggggcaaatggaaagaaaaagcattggtacttacttatatgttatctgtgcggagattttcaaaaaaaaaaaattttttttgaaaataaatttgttttataggttttcggggtcgggaaaactgattctggcatctgttttgacccaattcgaaccccgaacccggactcgaacaaaaaagtcaaaaatccatttttcaaaaaaattcaggcgctatttaaaaaagagggcctttttgaatttttttttgcactttttttggtcgaattttttttatttattttaatataaatttgttttttaccagatggtacgtatttcacgctatttaataattgaaaataattttgaaaagaaaatttggcgatagttaaaaattgaaagatttttaatttatcaaaaaccaaaggggggacccttttgtttcgcaaaattcttttggcatagaaaaccgtgaatggacttttattcgccataatttataatttcattctccataattggactgctaatgtttagtattcattacgatgtgt

SEQ ID NO: 9128 - DNA, 1393 bp, Heterodera glycines
ccccccccccccccccgctcttcttgcgtacgtaaggcactcaccccgatgccgttgggtcgccttgtcaaacatcagcatggcatcttcaatctgggaaaggaagcaaatgcttagccatcatttatcaccgtttagtcctttgtcacctttccatattgcgcaaaatacgctttgatgtcgtcgagcgtcgaatttgaggagagaccgcctatgaacactttcttcgttttgaccaccattttcggctgctgcttctttggaaatgccactttcggatcgatccttttcccatccaactcatgacaatcattggccaacactttctcaactgccgttgggtcagcaaatgtgataaaaccaaagcctcgggcccgtttagtggtcgggtcgcgcataacctaaaagcaatggaactaaactgactgattgattgtgtgtatttaaagcccccttcccctcacattgtttcccgggtaatttgtttgatttcaaaattcttagaggattttgcaaaaaaagggacattcaaaatcaaaaaatgataatttttgaagattactctagatttaaaaaaatagttttcttttattgtggagcgactcaccatgcattcgttgacctctccaaatttgcaaaagtaatcacgaaggccctctgcaaagcaatggtaaaaataatttaaaaaacgatttcaattaccggctgaggtctgccaactcaagccaccgataaacgatttttctgaaagattttctttaaaaacccacaaagattgaaatcacagagtgccgcgagtgccgtgccctctctcccctccctcccaccaaccccggctcgttctgctgccctcccgcatcgctctccccactttcgtccacattcgttgtcgtcgcctgcgattccgcatccgtcgcttcagtcaatggagcggaactcgaactgccgccgccgagctttcgttctgctgacggcgttttctgcttgttgtttgttttgtcatccaaacattccttcgccgattgtttcttcggcactgagttgggcttaacattttgaagccatggttagttttattttcacaaaacatggcggaattaaaaaatattgggatatgtaactgtcaaatgatgcaattcgacgtggttcaaaccccttccctgaattccacccaacccccaaaattcaacttcccccgaattgcccgtcgtgcgtccacctggtgctgaagccgttgctgcactgtcaagttgtcgtcctgctgatcgctctcctcccgtccttcctcgtccttctcctccccctccgtctcttcgttttcgttcgcccccctctcattatccttccgtctgttcgcctcctcgccattcttttcacctccgtcttcactcat

SEQ ID NO: 9129 - DNA, 1640 bp, Heterodera glycines
aaaagccccagataatttgttaaaaattccaattctccacaaagcgccctaataaaattttttgattaatctcaaatatcttctggaccaccacaacccatagcttatctaggtagcgaagctcccaaagcgcgaagcgctttttcccagctaaatagtcgacggttcacgcacccgctagttattgaattatatatttacatattttaagtaaaataaaaatgtctgttgaagattaaatatacttcttgaacaattcattaaacaagtttaaaatatattgctgaaacatactatgagtataaatatgagttttaatattaaaatgagttttatattttaaggattttttcgttctttatttaataattttatttgaaatatattttaaggatagaatgaattataattatttcgatatatgtaatcttttcttattattttaattttcatttattttattaaaaataagaaattttttttaatattcacctgatgcggatattttatctaattaaggaattttttaatgaattatgtttattaactaaaaatcattaattcatttgtataattgatattataaacttaaaattgagtttaatagtctcttctcatatgatttttgttaatttttgtaatttttaatccaatttaaatttttaaatcttttttttaagtttttaaaaaacaaagagttcttttttgtttgttcgtttttttaaacaaattattatccttcgtattatataatttcaatatttatatatattatttaaaattacaatatataaacgaacgcgttaacacttttttattttaaaatcaaatgatttacgatatatttatacaatatgattcattttgaaatcttaatttttaaatatttacattttttcatgcattttaagactggtagtccaagtgtttttcacatgaagtttgctgttctttcttgtgctgtgagaaacatcgttttttggtattaaattgtatattttttaagtaagtctcggtatttgcctttttgatcgaataattagtatgtagaaaaaatgaacatcacaataaaagttttttatattaataaaataattgaaaataagttaaaaaagaaacatttaatacagcatcgaactacaataattttatatattaaacaataatcaaaaagatttaaaaaagtaaaaaatttaagaaaattaacaataacactaccaagaacaattagaataattattacaaaaaaatgaatagaaacgctaaaataaaagtataaattgattattttaaataaaatattatttattttttctttaaccactttaatatgatttaaaatcaaattttctgcgagtttgattgaattcttgaatcgctgaagaacaattacgaaagcataaaatactttattcagaaataatacctaaataaaaaaacaatataagacaaatacttaaatatattagtttgtatttttgcaatggaaaacaaaaaaacttcgcaatgcatcaaagaaaattatcaatgtaattcttttggggggtggaagtttgggcaccaaattaaggatttaaaaaataaaaatatttttatttgtctataaattgcaaccatcttatttaaaaggatattaaatt

SEQ ID NO: 9130 - DNA, 3140 bp, Heterodera glycines
  misc_feature (30)..(30): n is a, c, g, or t
gcacaagggttgttaaaatttactaaattntaatgatttatataaccttttatatatttattttgttttatttttgaaatccctcactctggtgcccaaacttccctgcccaaacttcatgtcgccattcgtttaaatatttatttttaaaaatcatcataaaatatgttaaaaaaactgcaaaagacgcttcactgtggctcccggaattttcgacagcaaaggacttttcgatagaagcacaaaaaataataatcagaattactagagaaacggtttttacgttttttaactagaaaaattttaaaaatgaatccaaaaggatcggcccttaaaattttaaaaatagacttctaagaagaatgaaaaaattttctcaaaaatttatctccaattttttcatttattttattggtaagaatttcagattttaaaaattattaatctcaatactggttttggcttcaaagtttcactttaggaataaatctgtaataaataacaactaaaaagtttgttaataattaattgttattttattgaattagctataaaaatatgatttaagaaaactttacaaatcgattaatctttattaattcaaaaacaacaatattgaatcaatcattttttttgttatttatggtttttttcttttttgtttttttagtctagtttttttctaatttgatttaaaaaattttattaaaggttttttagtttacgtttgaaaaaagttttattaaacagtcatggtctatgattcgctgatactattccgcatttatttgttttcattattatgctcagaatctcgttccaaagcatgccacataacttaaatagttcgagcttctttgtcttttttatttaattgttttttaaattcattatatttacacacaaacaacttatttatatttattgattcaaggttgtaatattttatctttttatattattttaatgacattaatgagaaggcgtaaaatatccacttacgaattttttttattatttattggtcatatattgtaagaaataactgctttccaactttctccctcatctaatatcaaatctaattcaattaatttgatgaaaattaagaaaaaccttatgaataaaattatgaatttttagctttgcaaatttaattttcaattgaatattaaacaattgtcattttttcaattaaattaattattcttttttaattttagtgcattgataaaatacattttttcttcgtgttcataataattattaagatttatttttttcataaaattttagtggattataaattagtctaactgatttttgcttacaatataatataaatatttcaataataataatttttcttaaattttcgttgcattgtttgtcctgctgttgcatttatcattttagataaaagttaatttttttattttgttaatctttcgatttttgtgtgctgttttttgaattttggcttccatgctaatttaattatttctgattattaatatattttcaaaaataaggcttttgtatatatattgaagcttgtgattagttgctatttttataataattgtataaaggggaagagtttataaaacttacataatactctgaaactattaacccgggaaataattcaagaacattacaaattttggaaatatttaaacagggtaagaatttaccaaacatatcaaaattctgaaaacatttaacaaatatattttggaagttattatgaattattaatttttttgtttctatttttttatttagatttaaattttcttattcataagaaaataattgacaatgatctgttaaaaaaaaattaatatggctgaatatatttcgtttgggtttcgatttttggacatagttcgaattttgtttagaacataatatttaaaataattaagcaggtgaaccttttattgttgcttcagtcgataatatagtaatatcaaccgaatttcattgattatttctcacatgttaaatgctaatttttataaaatttaatgttcacatgattaacaaatatactttcacaataaattattgcttgcgcttacatgcccgttccttcgaaaatagttaatattcattttaaaaatttttatttttgggattcctttctctcgaaatattttattaatcattttttcgaagtttttattttaactcattttccccgtttttatttttaatgttttttgtcatatcattgttgatctgaattattttggcaacggaatcaacagcaaagtgaaaacaccgaaagggaatggccaattgaggacaattgttttttcgaaggctggggaggaattggccgactcaacaggtccaacgacgaagttgttgaaagccgacacagaacgaaaattgtcagccgttgatggcacaattacgaataaagctgcgtcaagtcacgctatcaggcctgttcaaaattgtagttttcgttttttccgcacattttacaggtcaaattatgatgttggtctgtgccactgctgattgtccacccttactgtcccttttggaagtcgaatgccctgccgatggatttgaagcgctgaggacatagctttgtagagggcgaggatgtcatatcattgttgatttgaattattttggcgttttgttttagtttttgtgaccctttattttattttttttttggggtatgtgtgatatatgtgctcttcctaaatttgtaattgattgctgtgtgctgttttattaattggaagtaaaagaaagcagtgaaaagagacagcgatttggttttggatttgggatacaattcccctttcccattggactattctttttcctacgacgtggcgctcctgtacaaaggtggctcagcagtggcaataaacgacaaatttggacgagcaacgattttaaaaggaaaagtaaacccttctgcaatttgtaacagtaaaagcaaatcctggtctctggaaaagggaaacaaatccctaatgaagtttcttcattggttgtggccacgaaatcaataaaacggtaaaactaaatccctctgcatatcaaaaaaactcaacttcgaaaagagaaaagccgtaaagtgtgaaacaaatcacgaaaattgtcag

SEQ ID NO: 9131 - DNA, 1510 bp, Heterodera glycines
gctagtaataaaaaataataattctcaactatgagcaaaaaattgacataatgccataatttaatatccaaatatgttataaattcaaaaatttaccaaatttcctttgattattttttccacttttccaaatgctcattttcaaggacgtccttgcatccaaggacattttttattttcaagaaagagggcccaatttcaaggacgtccttgccattcaaggacggatcccatccctgatttataatatttgcttattgacctctaatgcacatacattattaattaatttttccttttttcaaacaataaaatcattattattattatttataataaaaatcattaataatattcaaatgtcaatttcgaatgattcgacaaatgacggctttacaccaccagcagcagcagctgatcagcagcaaggttgagaagagatcaattattatgacaaggaaaaaaaataattaaaatggtgctggtgcattcctaaaaaaccaccacccatgcgcgtttcttaaatccgccaaaatgggatatggcagctcgtttcctaaaagcgataaatgttatacgtgtatattttattgttcgagaaaaaccatatatcagaaaacatttgaataaatgactccatttcagtgttttgatgaaaattttaaagaatagcaaaatattttcgatctttattaactaggcgtctgagggcatgcgtgccgagtttagtcagccgtttgtttacaaaatgaaaaatacaaatggattatgttttttaaaggtttcttcagagagtgttaagattaaagttgaattccggcccaaaattcgcctcaattttgtcttcggaatcgtgcaaagtgacacaagtgaaaagagggccatcttcagaaggaaaaagtgccacaaaatcgacggaatctgaaaaaatcccattaaaaatgccgttttagtcatttgtcaacccaaacggtgtccgtttttcgtgaaaaaatttggtgcgttgccaaaataatgccacagccgatgacatctccgatgccaaatttggcactttgactgccaatttggcaggaaccgttgacccaaaaaaggccatcgcttcggtgtccgtaactgttaggataagtgccaacccttccgtacaatggcatttctttggtcgcaagtccaatcattgcgcacctaaaaattattataaattataaatttaaaatataatttttatttttctaagatttatttacattttcatactgatgattttcatttcgatgtaagaaatggacgaatttgtgctcagaatgcagacagagttttgtgaacattgagcgacttcctttcaattaaaataatcgtatttaaagtgattttaattttaattattaaatttctttaataatttttttgttaatttgtgacaattacctcttaagcgatttcctttgtattggaccatcaaacgtttggcaccaatgatttccaattctctgggccaaatggtgccatc

SEQ ID NO: 9132 - DNA, 2800 bp, Heterodera glycines
tttctgtttggacttagtcctgaatacccggcttagttgggcccgaaatatcaagagtcccgtctaattctgtttaaacgcataaaatgttaagtctttgaacagaccgagccttgtaatgatacaaataatacaaatgcatgacattgataaagaatgaatggtaatgagtctagcaaaataagcaggttaattgagcggatactcgttcaaaaatgttcgattcctagcttgattaaaatttactatgcttttaaattggatgattgcaatttatagtcatttaaaattatttttatttttaaatccttaatttggtgcccaaacttccccctccctgaaaaagccctgccccggcgagtgtccggtccaaattttgggcgcgagttaaacttttttgaactgagcgaaccgggcccattccataatttggaccgggcattctccggccgggaattttcgtagcgaattttaatatcacctgatcacccattgacaattcaaataatataaattaaaaatcgaacgatttgtggtgatcagtgatcgaaagccgacaaaaaattatgaaaaatttaaattatccatcttatctttcgcatattaacattaagctccaaccataattctttttatcaatgtttggattaaaagcattccctctcccattttttaggtcatcgttttgctcaacagcccaagcaaaaaaaaaaaaattacttttacatattaaaaaaaagaatatttttaatgatgggtcatcattttgccgtaattactttttgccgcccaatgtcagcccataaatagacgggagatttagcgcaaacagaaaatgttcattcattcatttatatgagctgatgaattttattttccaatttgtatattttctaattattaaatgaaattttaaaataataaatccaacaatttttaaattttagtccaatcaatagcttaaaacgaaaaaatgtcttcaaatttgatgggttcgccaagctgctttttccatccaacagctgagcagggtaagagaaattatttaaaaaaaaattacgaaaaatggaaaatatttttttaaataaaaataaatttaaaataaacattttatcactacaagcagcagtggcagcagaagaagtggacaaatatgaagtgttcagttggcacggagatttgagcgaccaattggcagcacaatttttggtcactgatcagcagctgttgaaggtgggacaattcaaaacggacaaatgagcaaagagagaagaggacaaatgagcacagagagaagaggacaaatgagcacagagaggggaggaagggggaagagaccgatagattcagtaccgggcaaaaggccgacttattccgagagcaattaggaggcattttgccaaaaatcattcaattaatgagtgaatggaaattggaaattatttagtggattgaaaatattttttaatttaaggaatgccgcgaaaaacttgccaactccgaattgagagagacgaaattgctgtgcaaaaacggggaattgaatgcagagaatgtgagaaaaataaaaaataaaaatgaattatttaaaaaagaaaaatggcaaagaaggggtaaaaaacagaaactttcaaatttttaaataaaattcagaaggcgcttaaagcagagttggagaagcagaagctgatgacggaacacagtcaaattaaggccaaagtggacaaaatggagcaggaaaatcagcagcaattggacaaaaaatacggtaggaaaaatttaaaaaaaaaacaaattatttccattaccgtattcggtcctactgttaaaatgaatatttcaaaatgatttcagtttcattcgatgtgttcaatgcattggtggagcgaatcaaacgtttggagaaccagcagctgaagcagaacaaagaggaggacaaaaagggtaaaaataaattaattaacggaccgaactttacatatattgattagttaccaaattttaaattaacattaattagctaatcagttccaattattttcatgttttgttgttcaattggatactcttttagcagaggaaaagcagcagaaggaaagtgttggtcaacagaaattggatggaaaatatgccgtggtggacaaaaacaatgttttgggtgggcacaattggcaaattattttaaaaattgtcattaataaattggcgctatttaaaaaatgcggtttttgagagggggctaaaccaaggttctgttctgttgaattttaacctgtttcaaaagcgtttattagtcaaaatacactatctaaatctaaatgttaatgagttaatttaactttttgaaaatgttatttgaattgctttagtgacgtcatcgggcgaccaatcgccgccggcggttgtctcagcgaaagttgcaaaggtgggaaggaaacataattatttcacaaatgccattttaatttcaggaagtgcctaattcgaagaaacaaaatgattgggatgccaaagtttgccacaaagacatcgaaatcattggggaaaagcaattgacgatcaattgcaagggcaacagatttggtaattaaaaataaattaaacaatgtaatttattattatttttttttaattaggatggcgctctgtttttgcgaaatttcccatcacaaacttttgtcgccccggcattttctacttcgaaatgaaaggcatcaaataggaaaggtgggcatttggaggaagaggcaacctttattaaaggcagggttgccagattaaaattttaaaaagcctcatt

SEQ ID NO: 9133 - DNA, 2134 bp, Heterodera glycines
ctattctcctgcgtttcatcacccggactcattctccttatttcatcactgggactcaaccctccagcatttcaatcactgggactcaattctcttgcatttcaatcaccgagactcaaccctccagcatttcaatcactgggactcaattctcttgcatttcaatcactgggactcaaccctccagcatttcaatcactgggactcaattctcttgcatttcaatcaccgggactcaaccctccagcatttcaatcactgggactcaattctcttgcatttcaatcactgggactcaagacaccagcatttcaatcaccgggactcaattctccaggacttcaatcactgggactcaagacacctgcgtttcaatcacccggactcagtttttatgcattccaatcaccgggacctaacctcacctggtccttcggcatcgcaatcatcgagactcaattctgcgaaattccaatcaccggaactcaattctgcgacattccaataactgggactcaaccctccagcatttcaatcactgggactcaattctcttgcatttcaatcactggtcaattctcttgcattccaatcactgggacctaacctcacctggtccttcggcatcgcaatcatcgagactcaattctgcgaaattccaatcaccggaactcaattctgcgacattccaataactgggactcaaccctccagcatttcaatcactgggactcaattctcttgcatttcaatcactgggactcaattctcttgcattccaatcactgggacctaacctcacctggtccttcggcattccaatcactgggactcaattctgcgatattccaatcaccgggactcaattctgcgacattccaataactgggactcaactaaccagcattccaatcactgggactcaattctccatcattcctattcccgggactcaatcccaccagcattccaatcactgggacacaattcttcacttttcacggattcttcggcatcgcaatcaccgagaactcagttctccgacattccaatcactgggactcaattctccgccattccaatcaccgagactcaatccttcactattccaaacaatgaactcaatgttacggattcatcggcatgtcaatcaccgggacttaattcagacctttcagcataatttttgaattttaaaaatgtatttcaattatgaaatatagagatcggcctgtacctggatccaggcctgtatttttcctggatccaggtacaggtacaggccatttttcggcagcctgtatttttcctgtacctgtattttcctgtacttttgtacagaaaatacaggtacaggtcatttttggaatacaggtacaggtacaggccttaaaaacctgtatttcctgtattaatttttaatcactattttttggcgaaatgtctgaaaaattaggaaaaattcaaaaaaaaatatcattttattcagtgaaactgtcaaatttgaaaaattaataatgttttggcgaaatgtcataaatagttcaaggtggacttggtcgttttggcgccagcccattgtgctatacctttttttattttcaacaaaatctaacgatctttgtagcattcgaacgcccttcacatgtcaatttggcgcatgctttaataaaattataatgttcttatgagcacaaaatttttgatcaaaattccgatttgtaaaagctacagtttcaggtagccccgaaaatccttataaaaaattggttaaaatcgcaaaaatgtgtctttttttgaaaaaatctgttaacaaactgctttaaaaattgcaaattttatcccggcggcgcctgccggcaccgccggaccctcgtcccctccccaagtttcccaaaaaaattttttgaaaaagcgcgacgttaaaaaagtaagaaaatcaaaaaagggtcatttagggatattaaaaaatttttggaaaaaattcttggtagagggtaagataggcacaaaatgtaacctaattaagcttataatcatcttttagtattcgaaaagttaatttttagtattttttatagggtaaattggttcttttctgttttgtgacccccccccccgccccttcctgaaa

SEQ ID NO: 9134 - DNA, 3356 bp, Heterodera glycines
ctgggactcagtttttatgcattccatcactgggaccctcttaggctggtccttcggcatcgcaatcatcgagactccattctgcgacattccaataactgggactcaactaaccagcattccaatcactgggactcaattctccttcattccaattcccgggactcaatcccaccagcattccaatcactgggactaaatccttcacttttcacggattctttggcatcgtaataaccgaggactcagttctccgacattccaatcactgggactcaattctccgccattccaatcaccgaggactcaatccttcactattccaaacaatgaactcaattttacggattcatcggcatgtcaatcacgggacttaattcagacctgttcagcataattttggaattttaaaaacgtatttctattatgaaatacaatttgcgtagaaaatccttttcattataaatacttgttctcttccattttaataatttcttttacataaacatctacatacaaaaaaagaacaaataaactgaccttatatcgttaaaagaaacttatttttgtcaaaacaaacaataagtgcgataaatccatccaattaaaaccatatccattaaaagaggcataattgacatccgctttaattacaaaaacaaaaaaactccatttcaaagtcaaacaatttctcgaaccaaaactttttcaatacaatatcaaaactaagtgtaagatcatttccattgactttgcatatacaaaaacaattctttttctttacaaaagtgttaagagcattcatttccatatgcactttgctaatataacaaaaacaaaatacttttctcttaataaatgcaatagaaagcattcattgcgatttcattatcattaataaaacatacaaaatctattttgtaattaaaaaaggaaaactaaaaagaagacaattagtttaactgtgattttacaaaaactgactaaaacaaaaatgaaaaaaccaaaaccaaacatttctttttttcaaattcatttttaacgcaaaacaattacaaaacgccacacaaattcaaacattggacacatgatacggaccggaccgggtcagtttagtctggccggtttagtctggccggtttagtctggccgttttagtctggccagtttagtcagagggtcggtttagtcagagggtcggtttagtcagaggatcggtttagtctggcaagctgtttttgcccataactcttaaaatattttttttgtcaattataaaaggaaaaacttaaaatatctatgtttagctacaatataaatgcatatcccaattagaaaataaaaacaaagcgaaaccttcagtttggcaccgcctttttcagtcaaatttatattcttctagcaaagtaaaaccctaatttttttcacgttttttccatagaaagcttctacaggcttttgcttgttcatattcaactgtcatccgcttcatcaacacaattcgatatgagaaaagtcaattgatgcagacatcgcacgatgcatcgctggtgaagtccctcctcaaaaaacgcgaaaatatcgtgccgttgatacgaattcttcgactcttacagggttacaataccatcaacaacattaaccctgttcaccaaaatgatcaaaattaccatgccaatgttaatcccgataatatcatcaattttctcgttggtatttctcgaaatatgaaatatgcccgtattcatttttcaatgttttgttattttttcgttggtaatacattgataaatatgttatggtgttaattttaaagattttcggaaaaaaaaatccgaattgaatcaatgtagggcaaaaacagcttgccagactaaaacgaccctctgactaaaacggccagactaaaccgaccctctgactaaactggccagactaaaacggccagactaaaccggccagactaaaccgacccccaccggatacggacaccaaactttattatataggaatgcaaaagttaaaggactgatttgtgcatttaattcaaaaaatccggctattatatgtaataaacagggcttccatttttatgtaaatacatatttttttcctggcttctccatgctctaaatagtgggaaaaacactttcttttttgtgtttgcgaacaaaaatcgggacttttatttcgggatttttctacatattacatatgtacatatttttataccagaggtcgcatcgaaaattttccgaaataagtaaatcagtagtaaaaaataagtttttagggtcaaaattaagtacatttttaaaacgttgttttggggcttgtttttgcattttattcaataaaatgagcatttacgaaatatttctcacctccagcaatttttttgagcaattcaggacgtgaaaaaagaaatttaaacatttccgaacatttttgatcaaaattcactttcacttgcaccagacttttcactgtttctacttcgagcgaattccttttatcagtccattgggcaccacaaagtgaaaaagctcgttccacaaatgcattagagactgggattgccataactttgctgatcagaacgtacaaatttgggagttgagcctatttttttgtaaataagcaagctagaaaatgccattcaccttgaaaaccagcttccatttctcctcgattgaaatgccaaaaaaatgggggatctctgccaggattctgttcatatctgttatttcgtcaaataacttgtcttccaattatttatgttttggaggagccatgaacctataagctaggctaaatagaacctttatgaatctcaataaagcgaattaaaaagtaatagaaagagaaaaacaagactgcaaaaaaaaaaaaaaattaatattcgctttaaaacaaagataaaaaaattgaatttctctagaatgccaaaataagtacattacttacaaataagtacatttaaaatatgtaagttttggaccctcaaaataagtaaaatacttacaaataagtaaaaatgcgacctctggttaacaccccttaattataaaagaaaatttacgttttccatctcgccattcggctcccggtaaattggacaccagaaaattggacgccgaaaagtggacactagaagattggacaccaatggaaaattggacaccggaatattagacactatttggttaaaaaataaattaattaaaaataaataaaacaaaaaatttggtttggctaaaagattttattttagtctgcacatacttatgttttttataagcgtaataaaacggaaataaataatgtttttattaaataaaacatcagcaaaagaa

SEQ ID NO: 9135 - DNA, 1051 bp, Heterodera glycines
tgagtcccagtgatgaaatgttggtggattgagtcacagtgatgggaatgttggtggattgagtcacagtgattgaaatgcagaagaattgagtcccagtgatataatgcaggagggttgagtcctgttgattggaatgttggtgaattgagtcccagtgattggaatgctgttggaatgttggtggattgagtcccggtgattggaatgttggtggattgagtcccactgattggaatgctgttggaatgttggtggattgagtcctgttgattggaatgttggtggattgagtcccagtgattgaaatgctggtggattgagtcccgttaattggaatgttggtggattgagtcccactgattgaaatgctggtggattgagtcccgttgattggaatgctggtggattgagtcccattgattgaaatgctggtggattgagtcccgttgattggaatgttggtggattgagtcccactgattgaaatgctgttggaatgttggtggattgagtcccagtgattggaatgctgttggaatgttagtggattgagtcccagtgattgaaatgttggtggattgagtcctgttgattggaatgttggtggattgagtcccagtgattgaaatgctggtggattgagtcccgttaattggaatgttggtggattgagtcccactgattgaaatgctggtggattgagtcccgttgattggaatgttggtggattgagtcccagtgattgaaatgctggtggattgagtcccagtgattgaaatgctggtggattgagtcccgttgattggaatgttggtggattgagtcccagtgattgaaatgctgttggaatgttggtggattgagtcccagtgattggaatgctgtgatgttggattgagtcccagtgattgaaatgctggtggattgagtcccgttaattgaaatgttggtggattgagtctcactgattgaaatgctgttggaatgttggtggattgagtcccagtgattggaatgttggtggattgagtcccagtgattgaaatgc

SEQ ID NO: 9136 - DNA, 2694 bp, Heterodera glycines
tgattggaatgttggtggattgagccccagtgattggaatgttggtggattgagtcccagtgattgaaatgctggtggattgagtcccgttgattggaatgttggtggattgagtcccgttgattgaaatgctggtggattgagtcccgttgattggaatgttggtgggttgagtcccagtgattgaaatgctggtggattgagtcccgttgattggaatgttggtggattgagccccagtgattggaatgttggtggattgagtcccagtgattgaaatgctggtggattgagtcccgttgattggaatgttggtggattgagtcccgttgattggaatgttagtggattgagtcccagtgattgaaatgctggtggattgagtcccgttgattggaatgttggtggattgagtcccagtgattgaaagccgcgaagcggccgagccagtcgattttatcattcataatcctataatacaagcgtactacctagcgggggatgcgccgaaggcgctgaccccgctagtaaacataaaccaacaaaaactaaaataaaacgccaaataattttaaaattggcgattaccgtatttcctgtatttgaaggcccccctctggtagaaggccccccccctctaatttaaggcccctttttggaggggttgaaaaattgaaggcccgggccttcaaatacaggaaatacggtatgtgtttttatgttttaataagtcgctctaaatcaaaaattgttcggagaaaatgctatttttgggcttctctcgccataactaagcagcaacaaaaaaatatgttaaaacataaaaatccgagccctaataataataaattttaattttttcaatttccgttataaacagggctgccaaaaatatgcaagaaaaatgaccaaaatatgcacataaatatgcaaataaaattgcctcaaatatgcacaaaaatcgtaaaatatgcatatatgcattaaaaaattgaaaattaggggtgcaaattcaaaaaaaaaaaaatttttttttactagtgcacttgccaatgagcagctaaatttcttttaaaaaaattctctttagcaaatattgacattttttaaatcaaaaattttctcatgaaaaaaaaatttgggggaagaatttttgagaaaatttccaattcttagtggtgtgtttttaaaaattttcggtcgattcttaggggtgtatttttctgaattttttagggccgattcttaggggtgtattttccgttttattgcatttttgttaacaaattttccaaaaaatggcgaaatatgcataaatatgcacaaaaagccaaaatatgcaaataaaagtcccgacttttatacgcaaacacaaaaaagaaaatgtttttcctactatttaaagcatgtaaaggccaggaaaaaaaatgcatttgcataaaattcccagccctggttataaatttaatcattccaattttttttcatttcattattgttacatagcttacgccaaatgaaaagttaaaacgaaaggcatttaatgaaatatttggagaaaaatgggacgaaaaagatgaagaaaaaataaatgaacagaaaaaaaagaaatcattggaaaatatgggttttcaacccgaaaaggtcccggtcccgggtttgcccaaaattcccggtcccgtggcactctagaaaatattataaaataaaagaaaaaagcaattattaaatggaagaagcaatttggaagagaaaagtgaatttaaattattaaaaagtgaatgaattattgaaaaatcattgctcattatgattggtaacaaattaatcttttaattgctcccaacatttattttatgaaaaaataaatcaaactttttagaaacttgatggtttttcataccatatttagctatttcgagattttaagcttaaatctaaccaatttaaagtggaaaattatggcatattttgcgatttattcggacatattttatggtcttcagtagaattactaccgggtaatttctggttcggttccgttcctgctcgactctaaaaatgtcctctattccactataaatatttgccagtcattttatattttcactaatacccggcacccgacccggtaggtccgggtccaaaagtacactggtaagaatggggtcttgaagttgatcagcttgggaaaaaataaaaaattaatttatttatatttttataaaattattcaataccctcgctcctttggcttagtggttattctgtttggtttatttccttttttctgaggttcaattccttcgcataaaaattgtgttttaaatttttttaatagatttgtgttgaaaattttgtttcattctcaattcagtgtttgtccatagtagaaaccctaattcttaatcccatcatgttttaatggccaattttctacccagagataaacaaaatgacgagatatggattttatttaattatttcggtttgtcgatggtcttggacccctaaattacaattaaaaatttgattttttacttaatttagtttttttacgtatttattccctaaaaaacaacaaaactgaaagattaacaaatgaacttcttgattctttacagatttcttctatgataaaatataatagcaaatttctttttattaatattggcatataaaaatttttttatt

SEQ ID NO: 9137 - DNA, 1527 bp, Heterodera glycines
tctagagaaatataaaaatatgtcggtgggaaaatatcacattccggatctgggggaccaattttacttttttaatctcttaaaataccagtagtgatattattttataagaaatgtaaaaattaaaattaggcctaaaaggctaaaaaaaaagttttatttagctttacagtctccattctataatttcagaaattttttaaaatttttttacgaaattttttttatttgatcccgaaattgtccgcaaatgtccgtccgcaagtgtccgtccgcaaatgtccgtccgcaaatgtccgtccgcaaatgtccgtctgcaaatgtccgtccgcaaatgtccgtccgcaaatatccgtccgcaaatgtccgtccgcaaatgtccgtaaggcaatgatggcattggagagcaactcctttttataggcccgccctttgctctgcggggaagcggcgccaatatgtttatttattttatttttcggctttggttccattagtggatcccatcaaagcgattgatcattttatgtctttgatcagattcattatcagtatcagctccgcttcgtcaccccttctcatgctgccgcggttgttccaagccttttacaagtcgcagttcggcagactgagtgatctgaatgaacagtgcagtgccattagccgcgctgccattgattatcaaagatcctctttgctatttctcgtccgatgtctaatttgtaaggtataaattctctgtctttacaaaattccatctctcgtcccaagagccataaataagaggcagaaacaattggtgcccggacaattttttgataactttgatcagaatcttccgtaccttcctacaattacaacctcgaaaaccaaaattttacaattataatccatcgatattccacacctttgccacaagttgacatgcgtccatgccgcatatttcgaacacaaaagggctttaaaagtgcaactagtcgtccatggtgctgcacaactcttccaagtactgactgttccccgtcgatgccgccgcttttgtcgcccaattcggcggttgcactgtccatggcacgcgacgcggtccgcttgcagtgtacgtactgctcgcggttctccacctccgcaaagcaatccgagtgttgttcaaacgcggcatacccagcaccgcacatataactgataagcagaaacgaaatttaaaaaaaacggggcatttaagacaggaaaagccaattaaggaccgaacagagtcaattagaagggtaaagccaacataaggacaaattgattagaattggacgattgaatgaagccatgggcaagactccctctaattataatggcaaaaccaatatttgataaaaatttgaatttcgcattttattgatgctaactttccgctatttagtcaatttctaatttaaaattgaaattattatttacccataacttgcttcaaccgcacggatggacggactgaaacatttgagcgaatctgtgcaagccaaaattgcaaagaaaaat

SEQ ID NO: 9138 - DNA, 2094 bp, Heterodera glycines
tcaggaatgctcatttccgaggccctctatttttgagatgtcggaaattcgggttcgaaaaacatcggaagtccgagcccataatttccatcccaaatcatggtaccgaattcccacaatttaatccattttattcggtacacttttatccccttttgtatttaagcctgatgaccatgcctgtccgaaatgtcctgctacgtttgattcccgtgttggtcttaccaaccatttgaaattgcacggttcggacaaggaattcccatggtaaacaaattgaatgaatgtgtcttcactgtatttatattgtatttgcacatctattttaatcacctgctgttgttcagcgagttgtgcgacttttcatgcaccaacaaaaagacgatgcgccagcatcggttggtggcgccaaatttgaaaatttattgaattgatttatgcctccgcccacacttttgacctttttttatgtctacgggttgtgacaccccaaatttgaagactttaaattgaattagccaccgcccccaatttttccatttagccgtgttcacgggttaagtcgacgacgttcacggatcagcaacaccaccaatgttgttgtcaagggcgagttcagcagtggtggtggcagcacaaccgccgccgccgctggggcgttgaaattgtcagaaaaaacaacgcttgttggtggcaaatcaccactaccacaaccgccatcatttgccgccgctcaatgggcaaaacagtgctgtgtgaatgtgaacttggacatattggcccaacgaagtcgcaatgaagtgggacaaaacaaaaaaaaatttttggttgagctctggtcgaatgaattggtcccaagtgtcgagaaaagtctcggtttttttggtttctctaatcttcaaaacaggccgattccgtctgattgtgtgccaaattttcgggcaataattttttgaaaaaaaatcgctttcgaatgatgcaaatttttaaaaaatgactgatttgaaaaatgccgtaatcgccttgaacggaaaatttaactttattgctgttttgtaatttattcgcattaaaaatgcatattttacgcaatttttttttcttacttctaccaaaaaaaaaatcggagagaagttccgatgaactttttttttacttcccttaacaataaaaatctcacaatcagtatcttctccttaatcctgctttcccccgtagaaggtgtctatatcctcaccaacaacagtgttcaagccgattaatagcagtaacaccagtgccagtgccatcaatgctggcagcagtagcaccaatttttatacaaacaaattctgttcaacggttgctgatgtggcaagattggtgaaccaaatgcatgaacaacagctgagaaaccaacgcaaggcggcggaagaggaggaggaggaacgacggagaaaaaacggaattggaaaagctgagcaaaagcatcaacaaaaacagggaagacgaaggagtaccgtgatggaagcatgtgatgatgaagaaaaaaatgaggagaagaaggtggataagaagaaggatgggcacaaaatttgtggccataatgatggtatgccaatacttgaaaaacaacagcaacaacaactgctcgaagaacggcaacaactgccgcagcaacaacagcaaagcattgatgataataagaatatcacaagcaacattgttaatgggtgagtacgaatattgaaattgatgaactccgtctttattgtgttacgtacgaagggtctagccagacccttggctttgggggggggggggctgaagtcaaaaattcgattttaagagggtgtatttttggttttttgaaatccctaattatggggtgtattttacaaaatttttctccgtttttcgccaaaaaattaatattttttgcgattttggcttccattttacaaaaaatggtaaaatgggggtccggcggtgccgatatgcgccgccgggaaaattttttgagtattttaatgcaatttgttaagaaaattgcttaaaatttcaaaaaaatttactgagaattttttactttttgggtttcggaggggggggggc

SEQ ID NO: 9139 - DNA, 1085 bp, Heterodera glycines
cccccccccccccctgctacgcccttgttacgtacatgtacatgtacaacgcgcgagtgtgtcatgccgaacggcgcaagagagagagagagctaaatgaatgttggaactgatttcataattaacgacccggaacagggttggacgaaattatggatttcaaaaagcacctaatgtattggtatatcccatatcaacccattctaagcttgaatttttaaaaaaaattttctaaaggtgacggaaccgacggcgggggggggggggaaacgagctgctcccattttgtatccttaatttagtcttcactcctgccaattttcttcttttgattgtggcttaaaaattaaaaaaaaatcaaacatttttccagcaattccactgttgatcatcctggaaaaagctgtgacaattccatcaatgttcgcaagtcgtcctcttcaaccagctcaaacagtggcacggtggcgggcggtaaaacggtgtacgaccgtaacacgatacagtgtccgcactgtccgttccgaacacagagtcgccagcggctggaaccccatctcaaaggacataccaggtggaggaaaatggaaaaaaatgagactaaacgtcactcatctcctgtgagcccttctctctgtatcgtttcccctcgaatttttaattttctaagattaatttttaaaatttttcagccatttaatggaattttttttaaaacactatttcatcataaaactgaaaaaaaaaattggctagaaaagtttcaaaattttttgtttttttgcaaaaatttcttaaggtttttctgaaaaattgtcgctttttaaaaaatgaacttataaattaatgtccgaacgatctcgactccgtgtttaatgccagtgttcttcattttccagaacatacggcttccagtgctctgtgtgtgggttcaaaaatgattcaagcggttttattcgccggcatagtcaattgcatgacgtgccgtgccattggccaccggactatgtgggtgtgccaaacaatgaacgactgcttgcgaaactgtggggcagacgccaatcaccaaccgccgcatcaacaac

SEQ ID NO: 9140 - DNA, 1744 bp, Heterodera glycines
ctacaacaacacactttgtttgttctgtcgtcggtgccaactcctatttcgttcgggccctgctcatttggcacttcacaatgcgcgccatcaccatcgtatcattggcactaatcagcatgcattgtgccgtgaattgttagctgaacgccttgcatggagggtcggtccttcaaatccaaaaaccatatttaatttatataaaatatctgtttatcatccatacaacaggatgatcgaggggatggcggcattgaatttgaatttactccgcttacatcatcaaatggacgggatgctgcagcagcagaaggacgccggttggaaaaagagacggggaaattttgacaaaaattgaaaaaaaaaattatcaacaattttgtactaaaatcaaaaatttatgaaaaattttaacgttacattttttgccaaaaatctggacctatttttatgcaaaggttgtacaaaatgtaaatgtttgtcagatcgccctcagctgcagcttcgcttgatggttcaacaacaacggcacttacgggcgcttttgttagcaaagtgtaccgttgcaagaattgcccatttagcactgatcagattttccgattgcaaaagcatgaaaacaaacatctgatcaaatcagaacatcaggtaaaatgagtatcgatcgaattcacattatacagtagctgctccgatcatctgtatcgatttgcattagtaatgctgatcacaactttgatcagaatctttaagccataaaattcggaatgttcagcttcagattttgttattaaatcattttccaattccccccccccccctaaacaacattttttttttgaaaatgaaaatttttattgttttgaatttccttgagatttttttttatgacagtcccagtttgttttagggatttctttcgtattcaatgaaacaattaaaaaaaaattcaaattaaaaaaacagacaaatcttttttatattttttttacttgaaaaaaacctcaaagaaatttaaaaaagtaaaaaatcataaattctcttttttatcaaacaaaaatgaataaaaaaaatacggagggaggaagcgagggcggatgagctgctctttttttcaattattttcttccattttttcacagtgcccgcattgctctttttcctgccgttcattggacattttggcacaacacaagcgccttcatgacgacaacactgcacagtgcagtaccagtaacagtaacaacggcggtgcatctccaacctcatcatccgcttcaccatcggcacaaactgagcaaaaagcattggcatttgctccttttcaacacaaacaacaacaaatgacactgtcttcgacacggctggcaccaattcgtcgcaacgaagcgcactattgtccacattgtccgtactcgtccaagcacaactgtgacatgaaggcacacatgagggtaaaatgggaatgatgatgatgataaaaaaacaactatttttggtaatatttaagctgatgactccctgacccctccccacatttttagcacaaaaaaacgaattcgatcaaaagtcaaaaactcagcccgaattcgaacaaaaacaaacttctcgaatacaaactattgaaacacaaaaaggatcattttcacgattcgatcaaatttggatttaaaaaaaaattcaattttgatatttgttcaaattgtggtccgggattcggaaaaatctgaatattcttgatcag

SEQ ID NO: 9141 - DNA, 1993 bp, Heterodera glycines
  misc_feature (47)..(47): n is a, c, g, or t
taatggactgaatcagaaataagattgtcttttatgtgggttagtgntcattcatgtcagggtcagcaatttgcccatttttaacccacgcccccgtctttgtcaaagtacacagagaatgggaaaacggagcctagcaaaaataagactcatcaaatgcaaacacaatttaaatgagcacaaatgaacataattaaaaaggaaagaaaaacttttgaagtgcagtgaatttcataaggtaacaaatactaatggaaaatctggtttttttcataaatcaaattgaacgcaaatgaacacatgtggaaaaggtgggggagaggataggtggggggggggagaagggaaaggttttcccccccggccgctgccggactaccgacaaccaatggatggcgttatgaatgaacatggttagaaggcatctggtgccgccaaatggaagccaaaattcagtttttgttaagtgtgggtccaattcaatattatattagcgttatcaatgataatattaaaaaaatccaaaccgcatgaacaacggcgggaatcacagggacggtgttggcctgctgctgcgcaggagtcactagggacggtgttggcctgctgctgcgcaggagtcactaggaactagtgttggcctgctgctgcgcaggagtcacagagacggtgttggactgctgcggtgcttttgggttcattttcttacggataaaaaattttttggcaaaactaaaacagagactgtaaaatgaactcgaaaaagcaacaaaataaagtaacaatgtgaaatggtgctatagacattgaaactaatattggtattatggcttcattagcagtggtgggatccgagattcacataaataaatcagaatttggttccaaaaaccagtcgtggccgtgagatgctttggtggtccccacaaatttttatgaaagagcggggtcattgagatcaatgttgatggcagaaagcccatcaaatgaattgtcattgcgaaatagggggatttgggtcttcaacaacacatgaaaggtggcgtaaacgacaaaagtcccatgaacacagaacctcgggtttttgttgagcagtgagcacagcttaatcgcatcacttcgcttcttcagttcttctcctgtcaacgattagcgaaggaagacatttggcatttgcgttctcagtgcagagtcctttttgcgtgccatgaggagacatttccgaacatgagcacgggtcggaagaaccaacttcatcggacgtgggcgggtgcccagttttcccattcggtactgtgtaataggaagcgcttcaacatcgcaaaggtccaggatttgcatggccgtacctttgtcggcggtggcacgaccggtgggcgttttctcctgactctccggcaagccaatcaccacgagtgaatgttggcgcctgtcttcctccacagcatcagctgctgcacactgttgttggagaagtgtggtcgtcgaaccgagcagagctgtgagttgtctgatgaacagctttgcatatgccggaatggcgttgtcggcttcgatttcgggaggaatttccagatttgagacgtcgtgaagaagttttttggcggtgactgctgcgataggcgaaaaatgggtcgatggccgcttgcgatatgtgtcgtttgtttgaagcttttgttggattgctccgtgtattgcgcaggagtcacagagacggtgttggcctgctgctgcgcaggagtcacagagacggtgttggcctgctgcggtgcttttgggtccattttcttagggataaaaaattttttggcaaaactaaaacagagactgtaaaatgaactcgaaaaagcaacaaaataaagtaacaatgtgaaatggtgctatagacattgaaactaatattggtattatggcttcattagcagtggtgggatccgagattcacataaataaatcagaatttggttccaaaaaccagtcgtggccgtgagat

SEQ ID NO: 9142 - DNA, 1141 bp, Heterodera glycines
gttttacacgactttgttaaaatttttaaaaatgaatgcgcacaaaaaacagacaaaaatttttgattggaggttacgccgttagtttttttaaaatttaatcgggcaaggatgagaatccgaaaaaaacgcagggtttttttttaagattttgcatttgacgctgccattgcttttttgtctttcattttctttccttttatatcttttattttttcgtctttcgttttctgtctttgttttgttgcattttccctgtgccattttaccatataaaagcaccgccaattcctctctttccctccattcacttctctttcattaacagtgccgctgaaatggcctcccaaattcccaaaattctgcccactcttctcttcatcgccgccgcatttctgctcaactttggctgctgtcagcaaaatgagaggtgtgtgaataactctttctgctgctgctgctgtacgtgttcaacatttaatttgttctttttcgctttcagccaaacgacggaaactcttcgcgccagaaatgcttcttcatcaaccgaaactcttccactgaacatcacaaccaccaaaaaagaaacgacggttgccactccttcgactacagaagctggcactgaggcggcgacaactgatgatactaatgacgaacaatcattgctgttttggattttgattgggtccgtgtcattttgttcaacgcttttcacagccattcattcatttttctcctcccatttttagcgtcattgtagcaattgtgctcttcttggtcctgctggtgtgcattgtgtgctgcatgcgaggaggaagccaaaaagatgcgcgcgaaaccgtcaatggcaagagcggaggggctgtgaccaaattaacgatgaatggggacaacgccgacagtacctgtgcttcacaatcagcatccgtgcccgacgaaggatggttcgcgccggaatcattacgggtaatactatagatggtacccccctttttgaagaaaatttttttttgttctgaaaagtcttggaaacatgtttatgggggggggggggtcgaggtcgctgattacgaatatggcatccatttcaaccaattcgggatcccggacccgaattcgaaaagtcgaaaactcaaaa

SEQ ID NO: 9143 - DNA, 3974 bp, Heterodera glycines
  misc_feature (3904)..(3904): n is a, c, g, or t
  misc_feature (3947)..(3947): n is a, c, g, or t
actcacgtaaaacacgttgtagctaaattaaactcagattcgtgattagcatcaaaaattagcctagaaaaaattattagaaaaaaaaaattcaggcgggggtggcaaaacccggaagtgccaaaaaaagaatttgtttaaataagtatatttataaagaaagtcccaatcttttacatacagtagagacaataggggcaattttaagcaaaaggaaaaagtcttcatttttggtatttgaaatgtgaaaggtgtgtaactgagtgcatttggccatgtatttaataattgggcgactctgctcgcctcaaactgtgtactttgtgatgctaattagctgttttgaaggctaaaactatttattaaggattatgtgctgaataccaataattaatgagtgagtgcgtcttttgcatcataaaaatttttttgtttgacagcgatttaattaatttctccgctgcgtgggattaaaatcgcacgtacccaaatgttttttgagaacttctgtgaggtgttttgtgtgcttttcttactaaccacctgctgctaaattttgaaataagtcgtcataaatattgggtttttgtacaccgaacgtaatgcaaatattataaaatttttcttgaggagtgaaaggaaaaaaaaaatttactttaaaaataacgaaatttttattctaaaaatatgtcaataaccaatgaaatttatgtacaatagtaattacatttaattttgtaaataaatcatttttcctttactattaaattcatttctttcttcgtcaaacttttttaaaattcaattttaattaattgtcactcaaatttgagtttttttcccttttttcgcttatgccatcagaacatttcacaaagatagaccgtcgccaaagcaatttttcttttcatcaaaattatttcagcgatttttgtacggcaattagcatcaccatggacactgtcgggcaaaataatttcaccgaagagtgccatcgcttttgtcgtttctttcaaaatccaaacagaaaaaaatgatggaatcaaaataaattaaatatattgaataattttaaaattaaatataaaaaagagagattttaccattagaacaattaggaatatttacaagtgcatgggatgatcggctgttgctgtgtcgacaacaaatgtgccagaactgtgaaatgattatttaaactagggttaagccccgagccctcggggggcaaaaagtcgggggccggggacctcgggggtcggggcggggaggagctcaattgtcgggggtcggggaccccgatcggggaatgaccaaattttattttaacccaaaaaaccaatttttctttttaaatactcgtaaatcttcctttttttccggcggcgcctgtcggcaccgacggacttccgccccgcttgttcccgaaaatctttgaaaaaatgtgccgcacaaaaaaattcttaaaaatctgatttttttgagccgattgtatttaaatgtacgatttgcttatttcctcccaaaattgttaaaaatgataatgggagactaaaaatataaaatttaatactaactgattttaaaaaattgttcatatttttgagcctaaaatcttatttttcgggcttggtgttcatggtggaagccctgtttaaaaatacatggaaattaacagaaatttttgcgaacccttctgaacatcgaatttgaccaccattttttgcggcgctctttttcaaaaaacttagggcaacagcagaaggggatgggcggcgatgctattaggagccgcgaggaaatttttttttttttacattttaaaatttgctaacagattttttctaaaaatacctaattttgcaatttttgacaattttttgcaaaaaaaaaattggattttggggggccagcggcggtgccgataggcgccgccgaaacaatttcggaatttttaattaattttattaagaaaattgttcaaaatttcataaattttcaaaactttccccccttcgttgttgaattaactttttagatttttacaactctcggagtccccaattccccgaattagtgtcggggagtcggggagcaaaaagtcgggggccggggacctcgggggacgacatgtcgggtgtcggagcggggaataggcccaaaaatgtcggggatcagggtcggggaccggggagctcggggtcggggcttaaccctaatttaaacatcaaaaaacaattatttattataaaggaaagaaaaacaaattcatgagggttatggcaaatcgtacaataaaaatttgtttacaaaataaagcctaagcttaagcctaagcctaggactaggcctagcctaagtcattgtacgagttgtcatgattcatgaaaccactgatagttttgcactgacaaatgagaggaatttgaaaagggtgccagttttgcgagaaacttcttcgcccaatttggacaaagttaaagcataattttatttgttcttttaaatttgaataaattttaggcgagtcaacggaaaaatgcaaattatgcgatttatcttcctgattgtcattttgagataaatttgtcctcattcaattttcgatttcggaaaaaaatcctttcgacctgcccccccccccccccaccccccagggcattgcttcgaagtgagtgaaagttcaccggtggcatgcgcggaaagtgaagtgtccggcggcggatttgcggcgtctccgccgccgcctttccgcgggttctttagccgacgagggttttgtgttcatttcagtagcggcagcagtttaatccgcccaaattggtcggcgctttgtttgcctaagcattgagtgaaaaatagcgaaatgagtggacggacgaaggcaccgaccaaatgggcggatcacaacacaaacatttcgccgaattttgatcaattttgacaaaaaaaaagcgggaattatttttattgaggctaataatgctattattattattattattataaaatgattatatttaataacagtgccaacattatttaattggcttttgtattatatgccgaagaagatccattcaacttgaataaattagttatatatgtattttgacattaaataaaataagcgcggcaaaaatgtagtggatcgggtgccgatttgtcggggttggctgaagaaattaaaaatgtcggggggagggagacacaactcaacttggaagaaattcagaaaaatataaaagaaaaaatttataaatgtacaaaaaattcttagaaaaatatttaaagaaatcttacaccccattagcagcacaaaactacgatataattaagaatagaaaatttacataatattcatatattttttaaataaaattttactcgtttaaattttgttatttattattattaagtctattttttgcatttattttcttttactacactaatcacccacattaaatttgggcatcaattgctcttttttcgtcccatttgcccgaaatgctcccccaactccgtgcggaccattttcaccatctccacgagcagttggttctgctcgcccttatccccctccacttgccgcttttgttcgcctgtgcccctcccccgcacccatcgccattttttgccaaaaatttgcccagccaaacaatgggcataatcgaaccacggcacacggccaacagtcgcgcatttggtgaacaaatccatcagccacgagtggaggaagacgcgtcctcaaccgatgcaccggcgcgaagtgcgctcggaggaatcggtcagtcgaatgacagtcggaaaaccattgcaatttcgccctatggattagccaaaaaattgaataaattttcgtaataaaatttcaactttctcttcgatatttatttattgnggctacgataaagaaaatttcccaaattgttaagatagagaanaccgatatttgagacttattctctgta

SEQ ID NO: 9144 - DNA, 2820 bp, Heterodera glycines
  misc_feature (21)..(21): n is a, c, g, or t
  misc_feature (2772)..(2772): n is a, c, g, or t
cgggccttcaattgacaattntcggtagataaaaaatccttcaagagttttataataggaaatatagaatttctttcgacttctcttcaattttatttaattgcctttcagaccaaagggcaagcacagcaagcggaccaatcaaagaaccgagagaggcactcactcaattaaaaaacataattgaaaaaaacaaaaatacgatgaacttttaagttattttgttatgattttgatgacaaatgccgatggcgaaacatggagggatttttgatggacgattttgactggtaccaaggcgccggatttctggacgaaaatcgtctaaggttgtgaagcaggaaaataaatgtttatgaatgaattggatattttttaagattagcaactggcacacatatcagcccaggtggaccaatttaagttttaaatgaacattaccgaatttattttttattccgtttataacacccaatataatggcataatcttaattgactcagtaattcgcattaattttatttgcatgagtaatataaattttgaattatcagatggattttatggcatcaccgcgacggacaaaattgaactgtcgggtgccaaaggcattttggtgagtgacgtcatccaatgtcagaccggcaatgctgaacttcgatttatgtattggacgagtccggaagtgaaaatcagtgggttacttacggattaattattcttcataagtgttaattcgatgtattttctttcgtcaattagccatttgcgtcaaatcggtcctccggctttttccctacttcgattactgctcaacgcccgtcgagaacaacgaccccggcccagcttacataattctgcctgatttaggaggcgatccacttcaggttagcaattgaatcccgtattgcctaattagttaataaagattatatggccataaccaaattgtcacttcagattttcatccaagcgcacaattttgtgttcaacagtgccgcattgcaaggcggatttgccatcattgacaacctcgaatattatggggaattttgcgacaatggcgccgacggatttctggcccaatcaaactccgtaagaatttgttaagcaatgagattgatcagtgaactgacccgcttttctttgctcgtttttcgacacttctcttaaggcccgctctgagacggcgcctcgcctcgcgccgcggccaaaaggcgaagaaggcactttaggctggggtcccgagctgatctataacagtgtgatcgaaaatgccccagcagcaggcggtgccgcgggtggtggcggcggcttctcctcgctgctcgattggatgctttacggcggcggtcgagggttgggcggaaatgtcaacggcacaaaggctacgccaaatactttgtcagcaacatttgaaagtccaactctgccaaatgcggcagaatccatttttgaattgagtccagcgaccaacaactttgttttcccaactcttgtgccgtcggctcaaggcttcggccccctacccacaatggcaccaatttcagacccaataccaacaaagtaaattgagattttcaagagttgaatccgtgattattctaggtttttgcaaattcgcttttaagcagtgatcagcaaatgtcctcttccgttccacccgcttttcctcccttcgccgcaattcgtccgtccaaaagccattccgaatttgaaaatgcacttcagccaaatttggaaatgcaaaatcaattaaatgcaaaattttttccacaaaatcggccctctgctgaaccgatgggcggaatccgttcattccgaattgttcagcagcagaaaagcaacacggaggagaacaacggaaaacagacaatgggtgggcataatcaatcagagccagggatttgcacttaagcgtaaagagtaaacggtgtattttggaaatttaatatatcagaatttttgctcattaaaatgggatatatcccagacaaaaagtttttcattaatagaaatttatctttgcggagggaagtcgaaattttaggagatttgagaaccgagaattgagtcggatagccgaggctaaaacccaccaaaagagagaaattccttgactggagaaccaataaatgagaatttcgaccaacccttgcaatgttacgaggcgcatcatttgaaaagtgtatttccctcatagaaacgcaccattcggccaaccgtggcagcaaaaggccattgccccatttggcattgttgcgaaaaatagaggaagaagaagcaatggagaagagtggaagaaagggggcggcaactgaactggccgaaaaggacgaagaggaggagagggaggaagaggaggacgaaagggaggcgataaacgacagggaaggaggaggaagcaaaggaagaggaggaggaggagaggaggacgaagaaagggccacggaggaaccgccggattttgtggagaaagaagaatggataggaaggagaggaagaagatgaggcactgccggcgcagagatgcgagcattaaaataataaaaatttaaaaaaacggcaaatatttgtcgtttatttggccgcttttaatcgctttcgcatctctgtgagttagtggtaatagcggcagaaagaatctcgctgatttttgatttgctttaatttatacaaaagttactataaaattatgtactcactaaaatatttaaaagaccgaaaaaggcatgaaaaaaggcgccaaaattacgtgcccggcataaggcnccaaaatctagaagaaggcaaaaaaaaaatagactaaaaataaataaa

SEQ ID NO: 9145 - DNA, 1808 bp, Heterodera glycines
  misc_feature (1742)..(1742): n is a, c, g, or t
  misc_feature (1792)..(1792): n is a, c, g, or t
gacaaaatcaaagattttctaaaatctcgcgctccgattcgtaatcagcgtatttttccacctcagagaaaaaaataaaataaaaatttttaagtttatttttcgtcgggaccacaattctacacaatcgccgttttatccctataaacaccgccccgtttaatcggtaaaaacatataattttaggttgaatacacttaaataatatggatttgctgcaacttccttcgatttcggatggtaatttaattatggattttttaggggggtttattttgtaaccctttgttagcatatttttaaaactgaaaatatttttgttttcgaaaatatgtctctatgaaataaaactgactagggaaaagggaaatagcaaattggaaactatgcgggaaaacaactagaaatttttattaaataaggataataaataaaaaaaatgtcagcgacccagaaaaacggaaaaaactaacggaaaaacttgctaaaattggtccttttgcttaaacatagtcaatttaatcgcgcacaagttgaagaagtattttaaacaaaacgaaattttcacagacgaactcgattacgacttggatgttccggccgatggtgtcaatgccacgctcaaaacccaaagggcctccaataacaacgaggtaattagcatatcataaagaatgcaagacgattggatacaagcttattttttaaatttggttatttaaaagtcaaaagttgttccaggctggacgactttgcttggtttcctccgttttccaaaattcccataagtttgtccttatttcgatggtgattcgtcggttctttaacttcatctcaaaaccattccgaacgatgatggcaaggcattagcaaaggtcacattttgagaattggggtggtcgaccgaagtttttttagggtgcatttgattcaccataaattcactttttctttaaagttaactaaattttaagtataagcaaaaaacccttggtatcttctatggcgtacattaaatattctcttttcgcctgtaaatctttaaaaacttattttttggttttggctgtctattttgatgcgacaaaattatataaacttattttgcggcgctatattcaccgttcatccttcctaaaaatcggctaccgataagcaaaaaaggtcgtcgcctttggtactcccctccccaaagtttacgtctctgattttttgtattatgtacaattgtgtttacattctgtcatgatgcgttttgagaattgtcttgatagcaatggaacattccgaattatcacggccaaataattttaaaaccacttatactgtagaataaagtcaatttgctagtaactaattcataaaagttttaaaatatattttgaagaaaagtcaaaataattcaccatctgtcgggcggacacgaacccatgacaaatgtcaggaaaaaacgcattaaaaatatatatttgctgctaattttattcggtcaaacaattttaaatgggtttgggcagtgacaattcggaatgttctcttgtaagactttaccaaaatgtctaaatggtattctgctttctctgtccatatctgtcctttctcctttaaataaacatcatcagacaaatgctatttgaatttgtcggcatatttttggttatttttttgtcttggtcaaatttgcctgttctctcctccctttgtcaatgcaagtgcgttggtacttgtgttgtgagtgaggngatattctctatacgtcgtattgtggcggataaatgctctgtcgattacncaatgcgccgctccct

SEQ ID NO: 9146 - DNA, 1712 bp, Heterodera glycines
ccctttgcctcgccatcgcacttccctccctttccccttcaattgcttttctctttcttctccctccttttctgacctcctcaattatgtggtgagggaagttagaagaaagatggaaaagagaattttgagagaatacggtgtctggttggtctgcttgtgctagtcctccctccccctcccttttccctcccaccgctccctccctttttcattttcgtccctccctttggcatccagcacaaacacacttccatttatgcgcttgctatggttgaggatgactgcgacgttgtgactattgccttccctcccctccctttcttcatccctctgtgtattccccccgtattccttcctttcccgccgtgggtaggcggcgtccattctgctctccccgccgccaaacatttcttgctccgactatcgccactgaaaaggccggattctgctgcttgcatttattcacttctgttttcgacgaccaatggaaaatcaattgaattttaacttgcgtctcatttcgggcgtttaattcattttataacccgaaagtgctgattaacgcttcctcgtgttaattgtttttcatcctctgctgcttattttcaacgctccaatttttttcctttccgtccatttttgtcttttattgctcttctccaccgcctttcatcccacaaccggtggttaatttaattctacgctttccaagcaaaaattgaagacggcaacgaaaaggaaggcgcggttggcatttccgtcctcacgctgctgccgttgctgactcaacgaagtggtgcttctccccccccccccccctcccatgggttttgtcttctcccttcacttattagcccttgccccacccattcttttcatcattcgtcgctttctcttcgcagaataaactaacgcgaaacggtctcccgggaggaatccttttcttcttaagcaaagaaacaaagaatccgaaaagggaattgctcgccgcctgtaacttcgactcaaccttttgctgttaggttaggtgagcaaagtttcaggtgtgcgagcattccaattgcgattcgcccaaacatttaaaaaaattttttgacttttctgccttttgctcatttcgaattgtttccaggcacagaaagaaacttcgacagcaaaaaaggtgctgttcgtcgatgcatcgaaaaatagaaaacggcggagtcaggagaacgcgtggccgaactcagcagacgaaaaagaggacagcgacagagaatggccaagtggcgaggaggagcagggggcggacgcgtttgaaggtcgactggccgggcgagtgaagcgcgtggcgagtcgaacggatgacgaagcggaacaaaataacgcagccgaacgctttggggagattttgggttgcggaaaaccaagcagtactcgaaggaaggtcggtttttctcacaagcaaaacattaattttgtttcgttgaatttgggtggcaccttggaaatactttcattcttggtatcaaacgaagctctaaacttgggctaaaagcaacacacaaaaattatacttgggcactaccttctttttgtctgttgtttggattaatgctgcaaatatttcaaattattctttttcaaaattaatattaaattccgcctttttccatgccttccccccccccccccccccccaagggattttccgttgttccgtcctcccc

SEQ ID NO: 9147 - DNA, 1949 bp, Heterodera glycines
catgccttcccccccctccccccccaatgtcattttccgtttttccgtcctcccatttctttcaacagtcatcgccagcttcgcttatttattagagcatacacacacacataaatatatgtgctctccgtttctgtggttagagaggacacgagtaaattcggaaggatgggggagggtaattggagatgacgacgactgctttgatggcagacgagcgccattgggttggttggattggcgcgagaatttcctgccgaccctccaaatccgtcccatttgatataaaattgagtgaaggtcggagagtgagtgagtgggcaaattgcagcaaaagtgacgcggcgggcgctgatcgttgaaaggagatggacggaacagcggacatccgtcgctgttgcggcaaagcgtcggcttcgcttaatcgccagcctctcttgcgctttgtgtgcattgggctgaatgaatgcctctttctgggccatcattagcaatgatttgagcgattgattgctttgggatgcggggggaggggcaataaaaacaacaatttcgttggatggtaaatgatttattatttgggcggttgcctttcaacaaattgttgacagaacaaaaataaattttgttcttttaccataacattttcaaattaatgtacaataaaagggaattgcatcttttgggttgtttgtgacctccaaaagtgaagcaaaagaaacagcgaaagggacgcgtcgcctttcgcttggagagaaaagggaggagagaaggagaccttgaaaatgtatacaaacaaatttatgtatttaacctttatcggattgaatagaaaatatggaaaataaaagaatggatggttatttatggtgatggttgattttacaaatgacataaatataaagattatatatataattatgcgtttactcggcgagtctccagatacgagacatgaatttgaattctgaccaagaccgggatttccgagacagaacagggacaggactgaagtcctatttcaaccagactcctgctggtcctaaaatataccggaccatgaaccctggatgaatcctgctgtatgtgcagcattttgtcctgtccagtctctattgttactgagaataatcgtggcctttagctaagtgatgcggctttggaagcgctttacaattcgctcgacgcagaccccgacgatgggaacctccgcttcaacgcactgttcgtccattgcccatcggtggaccaaatgaacacctttgacatttcaaggtaaattggggaccataattatgctaatgtcatttcattattgtgccattttgtcttggtcgttgacagttcgtactaaaaatattctttggttttctctaataaaagcaaaatgtacgaattgttttgacatttgtttgtctgtcttcggacacttaccaatttgtcagggtgacttggcaattggttttcccataatcatttggctgttggcccggagatggccgagtcgaccgttgggaaagtgtccatgttttgccaatggacactttcgcacaatccttcccccccccccactttctgccactgctttttcctcctgtgcccattaaaatattcatgagcatcggctctgttgctcattcggccgaatgaatggtcgaaattatttgccagaatttggccgtaaagcgaccgacgcctggggcgcactgtaccataatggacactttgccagcattaatgcataataaaaaggcacattttgagggttaactggtggaaatgaaacacgactaaaggggggggcggaatcatggattttcaaggtttggggagggagggggtgagggaggggaaaaaggataagaagaaaaagagagagagagagaaagtcagcgaaatgtcgatcgtactatgaaaatgaaatctataaaaaaaatgccttatttttt

SEQ ID NO: 9148 - DNA, 2117 bp, Heterodera glycines
  misc_feature (7)..(8): n is a, c, g, or t
  misc_feature (49)..(49): n is a, c, g, or t
  misc_feature (74)..(74): n is a, c, g, or t
ttgcttnntggtacttcgtccttgccaattctgatcatcctccaaatanccaaattggatttgtatgtgccttnatatatgaccgaaacttgggatgtttttgcccgtcacatttggccaatttttgcgacaagcattcgccatttgagctttgccgatggcgatgatttggataatttgcgtcgtttggtttcccctacaattctcactgattgcgaccaattcaaaatcaaacttctggccaggcattgtccaaatggttgcacactccgacaactgatggtcaaccgaagagattgtttgcagtgattatttggatccaccaaaaattgattggatcaacaacttcaaagaggtgtctcgccatttttctcaaattgtttttgtttttcccaattttgtttagacatttctccgtgccacctcttcggccagttacactgttcgaattatttttcgtgtgaaaccaatgccaattgcgccatttgaattgatgaacgaagtgacaaatgagaagctgacactgattaagggtggagcttttcgttggctgttgaaacggtgcccaattgttggggagacggcggcggtggttcagaaacagcagaagaaagacgagaaattggaccgtttgaacggagtctacttctgtctttacgatgccattttctcgactcccgggcacattgatcagcggaagaaaaagtgatcatttgagaaatcgccgaccattattgatttttgataattgggttgattgatgctaattgtttgctctttgaactcatatcacttttgtggtggacttttcaatgttactataactgaatctctagacaatttctattgatactaaagaaatttcccaacaaaaaaatcaacaatggtttatataattaacgaaagaattaaaagactttactgagagaaaataagcacaacaaattgagattgatcatttctcaaatatataattaattcattcattcccgtacacatcagacgacattttcattgctttgatccgcttcttcttctttttcttccgctggtggcgacaatggcctaaaattaattattgtttttatttttctataaaatcaaatgctattgctgctgctcacccaatggatttatcgaaactccacagatcaaaagtgacattgttcaaattggcactcggatttacgctttcttcccatttaattgctggcaccgtcgccgtctccccaattgggcaccgttgcaacagccaattacacacatttacgtcgaattcgtcgatctccttcgtcagtgtcagcttttcattcgtccgttcattcaccaattcaaatggttcaattggcattggttccacaataatataaagttgaattgtgtaactgacagaagtggtggcacggcgaaatgtctaaaaaaactggtaaaataaaaacaaattgacgaaaatatggctagacacacctccttgaagttgttgacccattccagctttggtggaccaaaataattattgcgatgcaattgcttcggttgcccattttttgtcggagtgtgcagccatttggccaacgcttggccagcagttgcatttggcccatcgtcagcaattccatcgggtaacagagcaccagaatcgattgaaaccaattgatcaagatcagtgagaatcgttggtgaagtgcgactgcgcaagttgttcaaagcatcggaattgcgaaagcccaaatgacgaatgcttttcgcaaaaataggccaaatttctcgggccaaaacatcccaaatgtctgtaagtgtttgtcggtggcaaaagaaggcatatccaactcaaatttggtgcccattctgtcccaaattggcttgtttgaacggataaatgtgagcacagaatggtcaatgtagctgaaaagggggaaaatgaagaagacgaccaaccatattaagtaattggtttctgtatagtttttgatttactgaatctgaaggaaacgaaaacggattttgtttggcagcgaatggtccggcaatggaaatcccacaaatttgccatcgatcaccacagacagtttcgcttttggtcctttgtccttgcgaattgtgatttgtctccaaat

SEQ ID NO: 9149 - DNA, 2049 bp, Heterodera glycines
  misc_feature (1972)..(1972): n is a, c, g, or t
  misc_feature (2005)..(2005): n is a, c, g, or t
  misc_feature (2016)..(2016): n is a, c, g, or t
  misc_feature (2027)..(2027): n is a, c, g, or t
tcgggatccctaagtgtcggatccttttttggtgccctcccacaagccgcaaaacattctcagttttctcgaaacaatgacttgccaattattattattattttttttttctatccacccaactcaaattcctatttttaatatcgccaaaatggtcatccgaacagcaaacaaaattatcatcaaataaaacagtcggacatctctcaaattatcactccttcttccgctgatcactgggcccgggagtcgagaacactttttcatcgctttgatcttgcggagacagcggcctaaataaaccaaatttgaaatgaatgaacatttaaagtactgtacggaggacactactgtaccctcctgtccatgctctattcaaaagtagagtgccacgggaccgggatctggtagcggacaactgagtacaattgagtaccaaggtcccctgggactattcccggttttcccaggcaaaaattcctgggttttcaacccgaaaaggtcccggtcccgggtttgcccaaaattcccggtcccgtggcactctattcaaaagtaaggccaatctttttgcttacccaatacaatcatgataaagatggaagatcactccattcaaattgtccaaattttcgtctttttcccattgaaccgtcgccgtctccccaacaattggacaccgtttcaacagccaaatctcttcgtccttcgtcagtgtcaacttttcttgggtcatttcgttcaccaactcaaatggctcaacaatattcatttggctagccactagaagttcaagccgaacattgtaagcgacagaagtggtggcacggagaaatgtctaaacaaaaaagggagcgtaaatcaaatggcgcccggaaaatgcgtcagtggaaaaagcgtcagcagaaaatgcgtcagcgaattttattgtcttaaaaacaagttccttgcgttttcgaggtcactgaccacgaatccggtatccattccggcctatttccgaatctcgaacccggactcgaacaaaaaactcaaaagtacaaaattttggcgctacttgcaaagagcactattttgaaaatgttttcacttttttttggaaaaatttttttttgttttttttatgcagaatttgtttttttaacatggaacgtattgcatactatttaataaactgaatttatagaaaatatggctagacacacctctttgaagttgttgacccattccagctttggtggaccaaaataattattgcgatgcaattgcttcggttggccatttttgctcggagtgtgcaaccatttggacaacgcttggccagcagttgcatttggcccatcatcagcaattccatcggggaatagagcaccagaatcaattgaatacaattgatcaagatcagtgagaagtgtcggtgaaatgcggcgacgcaaattttccaaattatcggcatgaaagctcaaatgccgaatgcttttcgcaaaaagtggccaaatttcgcgggtaaaaacatcccaaatgagcttgacgtcggtcatatataaaggcagaaacaaatccaatttgatgccacttctgtcccaaatttgcttgttggaacgaagaaatgcgagcacagaatggtcaacgtaactgaaaaggggaaaaatgaagattggttttctgtatattttttgatttactaaatctgaaggtccttaaaacggattttgttgggcaacggatggtcgggaaatggaaatgccacgcatttgccatcgatcgccacagacagtttcgcttttggtcctttgtccttgcgaattctgatacgtctccaaattgtcaattcgctttttccatcgaaatgtttgtcaaccaaaacatcgaaacggtcggaaagcaatgccattttgaggccgagtttggcatagttaaaagatgggagaatgtccatccacacgtcgctacaaagccaactgaaaaattnggaaacgaaaatttaatttttcaaaaatttccnttacccgtcgntcattttgganggctcattagcacacttttccc

SEQ ID NO: 9150 - DNA, 1278 bp, Heterodera glycines
aaaaaattgaaaaatatttattaaaatgttaaattgcaattaaacaaaaaagtccgagttcaccgttccgtctctgttgtccatcaattcgcaatattcgggccgtgtcggccctgaacattgtgtcgacaaatgtccagcggtggcctttcgcgcgtcaattattgttctattaaatgaaattttaaaattaaatcgattactttcttctcaatttcacctaatgtcctcattaatcacgccaaatttgagcggtttcgcgtcgacagagattaactcagcaggcaattgatggtaatgaacttgaacctaaaataatgaaaaatgtttaaaataattagttaatttaaaatcaaaatgtgtgaatcaccgtgctcggtgaacccggcacatttttggagtcaatttggacaatcaattgataagtgccgcccatcaatggcgtgtaaatgccctaaaatttattaattacccagtttcggtgattttttgttctgctacactcttgtagacttgattcctcagggcggacactttgacgggaatcttttaaaaaaaattattaatagttaattatttgtaaataattattcgcaattaattaattaattgattattaattttgttcaaattacgtccgctctttcgcccaacaatgccgcattgattttgccgacttgttcatgcatttcggatgcgtcaatgataaattcggccgactctttgacgcgtgccgtcgtcagtccttcaccacgcaaaaccacctgaacaaaaaaggcaaataatattttgtattaattatttcaatatttttattcgtttttcttctgtattccccactttgcttagttcgtctctctcctccgccgccgtttggccatttttttcagcaattgccaacaaagggtaagcacttggcacgaccaattctaaaagaatttaagcatgattaataaataattaaaaaaacctatttcccacctgaacagtacaagtacagcttgtacttggcggccctgggcggtgtgaacagcagctgatgtttgctgttgcccaacgagttcagctcaatgattggtgtgccccccgctcggcacctcccaacagttcgccgtccccgtcgcgcatctcggcacgcactttaactaaaaaagtgaatgattaataaattgaaaaaaatgagtaattcctttttttagaattgtaagttcagcttttaacgaaaaaaacaataatttaaataataagagccccggaatttttgaaatggcccgggac

SEQ ID NO: 9151 - DNA, 3372 bp, Heterodera glycines
aattaaacttaaaaaaaaaatctttaagctcttaagattaatacatttattttgttacataaattctcattttaaaacttggaatttcatggaaaaatgatttattttcgatttttgttcaaattcgggtccgggatttaaaatgagtggaaatgaatgtcattcatgatcagggccccgaaaacatgagaaaaagtaaaaacacttttttaatttttcaaacagaaagcccttgtgttaagttttttttgcaaaattgttttgggcattgtcaaataaaaactttgtgaagcttatttgcctaaaagttgcatgcctattgaatatataattttaattaatttaatttaattatttttgctgctaaccaaacacataattgatcaacgtgtaaatgttgtccggcagcagcaaatagcgcaatggaagaaatgcctgattataatattatatattaataatagtttatggaaaagtaaaaacagaaagtgttttccggaaaagtaaaaacgaaattcagaaattgttttgtggaaatacaattagcaaaacaggaattgttttttggaaaaaaaacctaaaacaaaaagcatgatcctccccacgtttttttttttatttttttggaaaaacacgtcgcaaaaaaagtacatttccggtgaaatgagaaaatggtcaatggaaaataagtatttaattctttatacgctaatatttggtgtacaaaatcttagttgaagcctcattggtttttttttttaaataagttcaaatattgagcaaaatgtctgagtattaaaaataagtttttaaataaaaaatgtattcaaacaaagcatgcacacttaattcaaaaacaattaacagaatttaaaccacaagttcatgtttattaaaaatttttcaaaaaaggggcgctaccatcgacagtattaccaaaactatgttcgaagcatttgttcacccaagaagttttacattattaagaaatgtagagtttgtaaaactaaattttagccttaattaaatccctaccgtggtgatgttgatggaagggctgatctcctcaaagacgagaatttgtttggaactacagcattgccatcaatgtcacatattttggacaaataaagggaacattttcaaattctgaaatgccaaaaaacggcacccacaaaaatggcagtatcagcatcaaagagtttgtgagatggcccgcaattgtacagacgtcaaagatggaagtgacgaacagcacggggcaatggcaaatgctggcaaaaaatggagcaaatttataaatcgtttttttgatgaatataaattcctaaggttaaccagtttttttgtaaaattatttcccaaaaaattgtgccaaaataatattaatccttttgttgtttgcaaattgtaagccaaaaaatgggcaaaatttgacgtaatttttgttgtttctcgccactgaagtttgtatttttagtggtagcatttttggttgcattggtgaaattcaaaattttgggtcaaaatatgttaacaaaccgcattcaagttttaaaatttttttcctgacggcgcctaccggcaccgtcgggcctcagtatttgatttcctgataacacaaaccaaaaacaggaatagttttctggaaaatttcaaaacaaaaaacagatattatttttcgtgtaagaatacaaaaaatacggaaatagttttccggaaaaaatacaaaaaacaaacagaaaaagttttttggaacacaaataaaaaattaaaaaagttttttaaaaaatataagcaaaaaatgggaattattatgtttttgatggttggcagggaaaccttttttaacaatgttagcgtcgcccggtgccaaacccaaattttgttgtgggaagaaagacatttttatggcattaaaaaacaatcccaaattccgtgaattggtttagaactcacatcagtgacacaaaagccacatatttggacaaaaaagtgcagacgccaaagatggaagtgacggacagcacggggcaaaggcaaatgctggcaaaaaatggggcaatttttaaatttgtttttttaaaagtaattaaaattgtttaggctaaccaattttttaaaaatgctttgccaacaaaattcgcaaaaaatatttaagtacaaaacaaaaatagttttgtggaaagcaaaagttagaaacataattgctttgttgtgaagcaaaagtcaaaatcagaaattgttttgtaaaaagtaatagaaaaaaatatattagcttttaaatttgatatggctcgctgtggcaaaatggcataaaaatgcaatttttgaggttttctaaataaatataaattaaatttttacatacatagggaacgcgacgaggaaaatgcaaccgaacaggaagagcaccgggaacaccatattgtcctgcaacgggcgcgggtaattacgcggcggcttgaaaagtctgaccaatttggcaaaaaaaatgtgtttaaaaagaataaaaattaaattaattaattaattaatttgtgttaattaaatatttaaatttatttattattaattattattttttactgatcactacatgaccaattgttaaaaactcataaaataaattagaatattattttaataaatctttattaataattgcagaaaaatgtggaaaaaagcaatttttttaaattattgaattgcaaaataatgaattaaaaagtatatatataattattttgtaaataataaaaagtgttccaccaaattttttggcaaaaatgattcgagttgttcttcggcagtgtgccatggaaatcatcagtgttgacgtttacagtgtgcgccattgttgcggtgcttcagcggcttgggcaacggcggaatgtccacgtcatcgcacacaccgaacggcctcggcaaaatttgagaaatttcctgaaaattaaaaaataaaggttttaaaaaagaatttttttttatgatgtttttgatttaaaaatatgtaatttaattaaataagcattaaattttgttgaacaaattaaagtatttgggtttcccttgctgtatttaaaattatgtggttacgaccaaatgaaagctttttgatcagtaaacattgatcatactatgctaaggaatgagtcgatcgattttcagctagcaaatttttgccataaagaattggccaattctactctcagaacccgtatttggtattgataaaatttttattgaaaagattataaaccaagaattagtcccgagagttaaattggcttattcatgactctttgtacagccagtgtcaccccacttgaaatccctgggtaatgtgcacaagaccgcaggcagcaagct

SEQ ID NO: 9152 - DNA, 1576 bp, Heterodera glycines
tagcaaaaaaggggagcgcaatgtgcacgagaagcggagagtcgggcggaagctgtgcgacaaagtcggaaatggacaatccaccagcagcggaggggatgcattagcgtgatcgaatgagtttggattaagcggagctaaggagggcaatgggatgaaaaatttcaaagaaaattaaattatattttaaaaaataagcgatgcttaagtcgtataattaatcacaaatattcggaatggttaaattaaagcaatggtacagccagacgggactgtgtcgtttttgcgccagtgttttggcggcagacttagttcaataacagaaatagtttttttgaaaacaaaaaaataaataaataaaggtttggggaaactataaaccaaaaaatggtaattgttttgatgtttaatacgaaaccaaaaagaggaaaagatttccggaaaattttaaagcaaaaacaggaatagttgtccggaaaatcacaaaccaaatcaggattttttgtgcggaaaaatattttttaaacataaaagttttgtgtaaaacacaaacaaaaatattaaaaaaaatttttggaaaaatgtaaatcagtagtgtgaattttgttttttgtttatacaaaaccaaaaacagcaaaatgtaattaataaaaaagttattgtaatgcaaaaatggttgtttatatatcatcttttaattaattactaattgattgcaaaaaaatggggtgagatgtggaacattgggctcagtgtaaactgctcaaaaaagctgaaaaagtttgccgccgtgggcctaattcaattcttttcagagggctattggtaaagtaattgtgcaagagtaataatgaagtggagatggaatttatgacttttaaaaatgcattaaagaattgtttaaatttaatatctttttgtttaactttctttgtttttttttgttaaattgtattttttaaattaaaaatgggtataaatttaattaaaatttataaattatgaatttacttagaaaatatggacgtacaaaaaagattaaaaatgtttgggttttaatcaaaccaaattttgcccattaatagtatcataatttaattggataggttaaaaagtaaaatgattttttacagtaaataaatgaaatttattttttgttaaagtaaaacgttttaaaaaatttcttttgcactgtttttttgacttaaaaatttgtaatttaattaaaaatgcattaaattttcttgaacccggaataaatgttatatggaaaatgttagggggttctcatcgccgctttttccattcacattttgctgctgcaaaatttttttgtgttgcagcaacagagaaatgggtggtgaatcataatgaaaaagggtcggtgcgaggcagaggagagggaggactgaatataacaatttttgttttttgcatttaaaagtacgttttatttagatgttcaaaaatggaaaaatttttttgagcaatttgcacactttaaaagaacgaaatataacagacaacattttaataaataatacaaatttaagtcaaatggaaaaattttgtgtta

SEQ ID NO: 9153 - DNA, 3967 bp, Heterodera glycines
ccgatcgttcaagtaccgcgtctaatttgatcgcgtgttcctctcgctgcttgcgtagcttttcaatatggtctctccgttgttgctcgtcttcgtcaaatccatctgttgactcatccatatggcgttctgttgcacctttttctctttgttcctgggcttcgtccaatgatttgttcgtcgttccttttgcttgtcgacacagtcgccgacggagaaagcgccaaaatagttcggcacgggtgtgcatcaaagtcacttcagaaagcagtaagtccagctcaatggcatcgatggttgcgttagaattttgctgagtttggaccaaattcgaggaaattggtcgagtgttgtcaatcaaagtgaacaccttcatttacgggttaacaattattgtaaatagttattacaaaatactgcagatattctcgcaattaaaaaaacacctgctgagctttctcctcaaaatgtcttcgttggatgaacgtgttcaacactcggacgcactgtttgtcacattcgggctgaatcagctcaatcagcaacagtaatttttctgggccatagaaattttcgattatcggctgatgcagctcaatgatacgtgcaacgccctcgaaaagcattgtcaaagtgtccgcataaagtacgtttttgcgtttgtcgtcagtcccaccggcctaaataaaataaaataaatggaatttaaagtgaaatgaacacctgcataatacgaaaattctggtcaccaagtgcctcaatttgaccacaaagatgagtcccaaaccgctgcagtccgctgttgtgttcgttgatcagaggaaaaagtttgaaaaagcgttccatcgatgccacgtcgccggaggactgcgcctcgtcaaaacgttgttcgatgatgcgctttaattcactggtcgcatttctaaggatttcataagaatttttcacggaatatccagcatctgaaaaaatgttgattagttaaaaacatttttaatggaaatggtttttccatgtcgacctttgctctcccgatggtcgcccattttgaaaacggccgtgtcaagcgtaaggaaacggtgaatatgttgtgctgcctcttcgtatttttcagctcgcaatgcctcctgcacgccgaatgcacaggttccaaggtcttttaagtcgttcactctttgcaaacactccacaacacggctttttccaagatccaacgcgacaactcgacaggaaatattttgagccaaggcagagacagaatcaagcgaattggccaattgacgagcattggacccgactctttcaaattcggcattaatgcgagcaactgattgatcgaacagacgctggaaattatcagtacctgaaatactaattaactgttaattttcaaacattttaaataaaataattattctaattgacctaaaactttctgcgtttgccgaaattcatctttgatccgtgatattatcgcttcctcctcctgtcttgccataaataattctgtacgaatttcattcatttgtctctcaatatcggtaagaggttttagtggtaagctgtcatcattagctctttctgctggtcgccatttcaattccgtcgttgtcaaatcatccatttccagtaaacaaataaacctaaaaaaattcattaggtgttcttgttaagacgattagctaaactaaaattcgaattttttttaaaccaaactttttttgttggtgttttggtataacaaaaaaattatgagtatccttcgtcttccgtacaatggaagggttttcacgtttttcaaaaaaaccctttttcaaatcaaataataaaaaatcaccaaaaaatgtaaaaattattttcaggaagtccgctgttacattactcactccgctaatatttaaaaggaatggttgttcaacacattaatgatgacgatgccttccaacaggcgatttcctccaatgcaaactctcggttgttgcttgtctgtgacttttttgcaaattggtaagtcattaatctgaaaatgtcatttcatctgtttacctaaactctcaataggtgtggaccgtgtagggcaattgcgcctctttttgattcactttccattcgatacgctgaaaaggcagtgtttctgaaaattgacgttgatcgctgtcgaggtgggactaaacagaaaatcacaagggacaaattaatgcttttttttactccatatttaatttttaaaggagaagagttgaaattaaatgatcgaatattttttgtcagctatgtactttcaggttcctgccaacaatacgcagttcgtgccatgccgacttttgtgattctgttaaatggtcaggaaatgggcagagtacagggcgctgatcccgctggacttgaacatttgatcgccagcttagcgaattccccggacattgggaaaggatctaccacaaagaaaactttggaagcgcatgttgccaattcagaagaaaggcgatggttggaaagattggtgtcacaatcgcaaagggtgcgccaaatgatttttaattatttgagtctcgaatttcagatgtcgatttatgaggacgaagtatcccaaacattggcactttcgcttattcccgctgaagaacttcgtgaaaaggcaacaacaaatggggaagtgaaccaatatgatttggccaaagggttgcttggctggttccatggcttcttcagctgggtaaaccatccaaaatgcgaaaagtgtggcgttgaaggaaaacccggtgatcgaggcgtacctatctatttatgtgagtttttaagagggcggcggaataccctcggaggaggagcgaaggaacggggccgatcgagttgagctgtttcgctgtgataaatgtggcgaccaaatccgtttcccacggtataacgacccgctcaaattgttggaaacgcggaaaggtcgttgtggagagtacgcaaactgttttacgctttgctgtcgatcaatgggatttcaaactcggtccagacaattttattttttaaatcgtttaagatttagctggatttctgacaatttggaccatgtttgggttgaagtttattcggaccaacttcagcgctggttgcattgtgatccctgcgaaaatgttattgacactccgttgatgtacgacaaagtcagtaggcaaataaggaaaatatattcgatgataattgtatgtaataaaaattagtaatttatatttctacccgtttaagggatggggaaagaaacatgcttatgtttttgcctttgccattgaccatgtccaagatgtcacatggcgttaccattttgaccaccgagcagcgatgaaaaggcgtaccagcgtgagagaacctgttcttcgcaactttttaaatgtgagcggagattcgatttagtaacatattttgtttgctaaagaagttgaacgcacgattggctcgtcaattgacaaatgatcgaactgccgggctgaaaaagcaaatggcctttgaattggtggagtttctcactgcccaccctcaacttcgtgatggaagcgaagcacagaatcagggccgtcgctcgggagctgaagcatggcgaaaggcccgtggtgaaagcaaataaagaaatttttataggatggacaaaggaagattattccccccccctccatttatgtataatcgtcgcacggtcatactgtatacactactgtacacctaaattagatttatttattgtctgaaaatgttaaaataaaactgaactgttctcttcaaaagcattaatttattttagtagtgacgccgttaaatttcttttgttatataaataatcaaattggaaagcatttcaagaaaccgaaaggaatggaaatcgaagaaaatggcaaagcgacttcatccgaggactccaacatgaaatggaaaactgaagaggataatttgtccggtaattataagtggttaaaaa

SEQ ID NO: 9154 - DNA, 1768 bp, Heterodera glycines
ccccccccctcgcccttcttcttcgtaggggcgggggtcgtgttttcccggccacgcctatcggcaccgcctgaccgcccgtcaccccttccccaaaagtttgttggaaaataaaagtgtggctgaatagcaaaaaaaaggtcggcagaaaaagaaaattttggaccttcaccttcgtatgaaaaatcggtcccgagacacccccccccctgtcccaatcgtccgtcgtatagcccttggtctgagacaccccttgaatatgtatgccttcacccaaaattgattaaattatatctcaacaaatacttccacccaaaccccaaatatcctcttgagacggtcccaggattttgaccttatgacgcacttttaatttcttagcagcagcagccacaacagcagcaacaacaacaatcactagctgcgcttgagtaccttttgcagctgaaaaatgcgcaattaagtgcaataatcgcatcagcaacgggcgaaaacactcaattgggcacaccggcggtgggcggacattcgcgtgagttcatccgaaaaaaagaatataaaacaagctaaaagggaatattaatggttttcgagtttatttgcataatcactgcttcaagttgcttcttccctgcccccttcgattctctctcttctcatgcaaaattcgctggccgatgtcgctggctctgctccccaaaatgtccaagtcggaagtgccgttccttcccttcctctgacggctaattcgtttgccaattttcccactaccacacacaatcagcagcagcaaaggtgggggaattcggcccgggtgcgctatattccctctagaagaatcattgttagctagaaaaatgtataaagggggtaggggggattgagctgctctctttgggctctaaaaattcaattgggcgtacatgccatgtctttagaatggtgcccgctcctcctcaaaatcagtcgtcatcgtcaacaaatgcgacgaatcagcagcatccctcacaacagcaccaaatgcatctccaacagcaacaagttacgaaggcatctcaaaaatattaaacatttgctataggttcaaaatgctgtcgcccaattgttgcgccaacaatttcccaccagcgcgcctggaattatgggaatgaacgctcttttgaacgcggccggaataagcggcggacaagcttttcctaacattggcacttttcctgtacatcagcaccaatttgacttacaatctgtgcgtatcccatcccatttcaacaatttatcatgcttttgtttgttcagctcgccgcggctgctcagccacatcatcaccaacagcagcagcagttgtcctccgctttgaacttgcaggcgttggttggggctggagcagtgcaccaaccgccgactcccatcacttccgccgcggcacccaataatattcccggcatttcgcaagaacttttattccaagcgactcttcttgcggcagcaaatttgaagtatcattcaggaaaagaagcaaaaatataataaatgctgaaatattaagcaatcccggactaattacgtcgaacacaacaccacaacagcaacagagaccaaaatgagaagaaggagagacaattaacaaatgttgtcgtcacaatttttagaaaaaactaaaatctaattataagatagtttatctttttttctttgaatatgttttgtcaatattatttgttttagaatggtaatcccatatacatatttttaattaggcaattgaact

SEQ ID NO: 9155 - DNA, 4461 bp, Heterodera glycines
  misc_feature (14)..(14): n is a, c, g, or t
  misc_feature (25)..(26): n is a, c, g, or t
  misc_feature (46)..(46): n is a, c, g, or t
aaaaaaaatctttnccagcacgctnngaggatagcctaattcgccngggtggtcacgtgccgccggacgagcaaggctgggagagtccggtcgactcattttctccgcaaaggtcgcgacaaaatttttgttggatttaggcgtactgtatgtttatcgtatcttcaatagtttgcgttattagagtgtattaaactattaataacgttaagttcttatggcttttgaattaaagctgtttattgaaatattaattaaactgtgtgcctattccgtgagggggattactgtatcggtaccaaaagtatttggtttaaatattcctatggtattccgtttcttccttcctcaattacaattattgtttgattagccccataaaaaaataattttattaattaccgtaatacagcaagtcatggattgaatattatggattactgtctcaaaactcttgaattgtatacctttttacatatttttcttggcacagttccggcgtggacacaggacgacgggacggcgacgatgaagaggaggacatggagaaacggcgctttgaacggctgttacatgaaaaattggacatgccaacgtaaatttttaaaaatatatacgaaggcttttggaatgacatctttttttgcctagcccgaaatttatttcaagaaaaagctatcagaaaacccaaaagaaaaaaaaatcaattttaatgtttatagaataacgggaccttgatatactgagtgatttaactcattaattttaattgcacgaattaattaattaaagaagtgacaatggcctctatttggctcggacggtcgctcccgtgctaacaaaagcattggctgaggtgttgtttaaaaaataaaattaaaataagttttaaattcaaaaaaggtccttcttcgtcgtccggcaaatcccattgggtcagtcaaatttggggttatggtaattaacacagccaatcattagttggaatatatatttttgactgaatgatgcgcataattttaattaattgtgtcccataatatttataatgaattttcaatgaaaaatggtaaaaacaaaattggggtttttataaaatttaaatgcaaacagtgaaaaattcttatggttgggttatattcatatttatagttagttattcagtatatcactgacgctttttccgagagcaatcaacattctctcgacccttaggccgaaaaaaaattcttgattttttgggtcttttatatctattttttggacaatcaacccccctgggtctttctcttccccgggggcacattaacatgaatgttgctactcgcttcttactttctcgcaagggctttaataatgaagcccaagctcatcctttcctgtttttcatttttcagctttgtctccgaatggttggtccgttacattgaaaccggcgaggactattgaccctcgggggacggcggcggaggcgctgatcggagagactgacagaagcaaaacaaatccatggatcattaacacactttaattggccaacatttcattgtcccgctgactaattagtaaacttattgtattttaattatgtttggatatattcaatttgtaaattattttaaagtaaacaaattcgctatttgccagaattttgtaacatttttaaaattgtaaaatataaattagagaataattaaatcgtaattaattgacctccctcccttcttctgctgcccattattctcaccattgtttcagtgttttattgttcaattaatgtggggtcacgcaaagctcaacaaatgaaaaatctctcaacaaatcataattttttacttaaaaaaatgagagacaatttaaagaaactctaattaattttcatttgaataaaacttaatttttttatttataataataaaaatcaaaaattaatcggtgagtgataaattgggaagaagaaataattcgtgtgaatggatcaaatttgataaataataaaatctcatcactcttttaattcccaaaaaatattcaagaatttatctcttttttaaaaaataattaaaataatttaatttaatttaaatataattcaaatttcttttttaatttccaaaaattcaaaattaataaaaattaatataattattttaatacattaatatataattttgaattgtaataattttgttttatcttttaaagaccaaaaattaatcagtgagtgaatgggaaaaagcacattatttgcatggcttatttttttgtatataaaaagacttaaaataattttaggaatttatttactaattatttgcacaaaaataagtatataattttataacaatttttattaatttgccaattttgtcaaggaaaaaagctcaaaatattttctacaaaaatgtcggacaaaccttcagcagaagatggagagcatgaacaacagaagaaaatgaaatgggaaatgtaattaatttaaaattttaattttaatttaaaatttattacttttaacagttggtcacaaaattttggggaaaaactttgaatgtaaaatataaaagcaaaaaattgtaaaacccaaacccaaagcccgaaaaatcccgacttttcccgcccgagggcgaaacctcgaatttaattatactggtagaaatatatatcaaatttatattttaatttgaataaaattcattatttgaatttgaattttattaaaaagtgccaaattttagcccaatttgtgccgacgattggctggcggtgtttgctttgctgccgccgcgtcaacttggccttgaaatcgcactgctcagcccgcgctttgaccgcatggtggacgaacacttcaaaacgcgtcgttgggcattgaaatattttcgcattaaaagcaaaattggcgagaatggcacgaaggaaatgcgaatcaaaaatttcaatcgaaaagtggcaccgattgtgccaattccgcgcattccgttgccggacaaagtcgtcgacttctccggcatttcaatacggtaaataaaacaaattgatgggaatattacttaatcacgcgggatattagagaccggataattggggccggaggaatcccgaccgacggaatcccggtccccatcaatcccgatgaattacaaaacggctcgtgacggatcctaaggttgggacccgaatttaatcaaatggatccctaaaaaatcccccggaatcccgattctcgacccgtccgttctctagcagaaatgaaaatgccaaaaatgggaggaccacagaaattatttagaaagggcaaaaagagtaaaataatataataaatttaaaagatattagggaaacaaagttggggtcgtgttttgtcggggacaacaagttcggagttgcccaaattggtccggcgtttatcagagttggaagcttcggggtcggaggcggggtcaggaataagttgaaaatgccaaaaaatgccagagtttttacctgtgataaaaacccaaaattcagccaaatttccccaactcaattttagttacattgacaatgatgtgatcacttttctccaacgttttcaacgccttttcgcctcttgcgcaataaatctgagcatcaaaacaaaaagtggccgcaatttaaaatccattgaacgtttcatttggccaatgatccgacaaaacatttgtggcattattttttgcaaagccaaagattttcgccgtctccgaaagaatgccccgtccattctccgtcacattttccgcatcgatgacgataaaagtccgcggaaaataccactccaatcagtgtactttgataagggcgaattgcccaaattgccaactgccgttgaaagtgcccatgacaatggcaatgccaatgccaaagtgccgttgaacgaaagcgaagcgttgaccaaatggttgttctcctctcgtccggagaacgatttgccgcccaaagtgttgcgatgccgtgtctataactctgatattgagagttggattgcgagaattgaacaatacaaaacggtgatggtcaattttggttttaaatttgtgctgtttgtagtttaacatttctggggatgggtacggtagagccaaaaactcaaaaacattttctagtaatgtggggatatggtagagttaggcggtatgatagatcgacaataaggttattgccacattggcactttttaaatatttaggcgagtgtacggtaggctcaaaaaatgtaccgtttgccaaccaatgattgattggctcctttgtttaggcatttgtgaatggcacttctcctcgtgccaatttcatcgtccttttcaaatcctggcctctcttttcttaccgcaatcgctcaatggcggacttcgctttgaaaaatcattcaacggcggaacgattaagatttagaccattaaaaccagggtagccaattgaaaaaatttgggagtttttg

SEQ ID NO: 9156 - DNA, 4110 bp, Heterodera glycines
ttaattgcccttgtttgttctctacccaaattcctttgggcggaggagcaccagtggggtccgcatgaatagcgaacatcccttcacccgtagaaggggtgattatttggtgtgggtgcaattttgggtctttcagaccagctggagccctgcgctcattcaacaaagtcatgcgaaagaagcgaagctcttccggagtttgttgttggagaagctcagtgagctgctcacgcgcctgcttatatgcctgcgcagcaggatgatgcaattggatcatttgttctaagatctcaagagtctgctcatttagctggtgaccctgcacaaactcatcttcgtttgtgattttctccccagtaaacctggggttgtttcgacgctgttccatagcctcgactgggtccagaatgtacaactggccaaagccaggaatctgagttgtaccagcctgcatgctgcttatgcggcgatggaattctccgttaagaataacggccatcggaccgccagcagggcttggtttgttgccagcggaaacgctggcaaattggagcaggttgttataacgcgacatgtgtcgaacaaattctttcccttcacgggattgcttattccccacaatcagctgtttgagctcatcaggatgcgggttaagcattggcagtacaactcttcccttccggcagcaaatgctactgtcttcatgtgagaagagatgtgcagcgcaatcggcgcattttttgtcaccgagtttcccggagtcacaatattccgggaaatgtttggctgctgctgcagcgcattgccaccccttgtgaaatgcagagcaacgccgtgtgatcggcgttgccactcccagcgaatttgctggcggggggcgtttaggcgccggtgaaggcgaacggctaacagaagctgaatgccttttttgaacgcgcattgatcgccttggtggcgtcttaggtctgatgaaaattacatcatcagcctgcgcaattggctcttgcgggatgcaagactccgacaccaaaccaagcgtgtcagcttggttttcaccggccacttgggcttgggtgagaatggcatcaactgcctgtccacttgtctgtggttcgatgatcattatatcatcatgttcatcaacttccattagctcagcggccttggatgtcgactgcacctcatccgcatgtcgatagacaattgggcaaggagttggtaccccttccctcggatgatatggcacattgtctgtgccataaagctcgttaatgtgccacaatatgcgccgcttttcataattgatggataaatcaggcagaacaaatgtgcgattgttcataagccatgactcagcatacaggcacacgaagtacccacaactattaccatcgtgttgggccgtcagatttacggcattaaaaatcccggttaaaactgttgacggcaaaatatccgaaatgatatttttaattttattcgtcagttgcggatccaacctgccatatgtggtaggcaaagaatcggcaaaatgagtgccaaattgcacatcatggacaatgagagtccaatgtccagggaaatgtactggcaaaagtataacttctgccggaacattagggtcgtacccaaatgtcatatttttgtaaggcatgactctgtccaggccattgctccataccattgggtcaacaacgaccacttttcgttgtgatatggttgccaagtatgccaagtatgtggcagcaaagccgtcattgagaaactgggtcagatcattccaacaggtctcaatgtatcttggaccagatctaggggcaagcggtgtttcgccatcacgttcgtaaaggccaattgctgcccatttccaaattttgcaggaaaaatttcgcgtggttgcgaaattgatttgcacagtgttgaaatcaattttttcagccacattaggcaaaaccgccacatttgtgccagcttcagagctctgatccattgacgagccttcgctaattgaagcatctgttttggacctgcctggaccaccacttcttttgctgggtcgtccacggcttttttgcgtggagactggcgttgaagcaattgcttcagtagcaaacttgggtcggttaacttcggcgaccttcccttttttgctgcacggcgatgtcccaatattttgagtggccggagtgatttgtgtgtcaattgatgacacactattttgcgaagccgtgatagactccgctccggttttcgggggtcttccccgtcttttacttccaatggaagaagccggcgtgctcaattgcaaagcacttaaatttggggtgttaaaaccccggggcgatgccgccccattcccatctgcactcaatgggttgtccagaataggacagtttgaattgccctgaggagggcaatttgggataggtgagcgacctggaatgacagattgctccgtccgtcgcaggtgctcttcttgcttccttcttttcaactcacgatctttagaaggcatcttaaatacaaaatcagtgtgaaaattgggtgtaacaaaaatatgaaggaaattaaccaatgagtgcacacaaaatcaaatatttatgcaaatgaagtaataatgtgaaaaatggtgtcgtttcttcgcttgccacaaatgaagccgctgttgaaatctatcagccagggctcacctatcatcccatctgccctaagggcactgagtgcagagagttatcattattggttaaggaactaatcgataaccattgtgaaccacaatctcaagaaagagcaggtccttgaaccaccattcccaaattgaggtctttattgtcaccaaggttttacttgataagttttggttaactccgatatcctatgttacctctcaccagtccactggtcttggcaaagtgcgggaccagcttcgcgccggatgttggccggtaacaataaggaaatcatcattgtaaaccgttgtggcccacaatcctcaaaaggcaggtcctcgaaccacaatcccaagaagggcaggtccttattttctttagggtctttgcgtcgcccgacatgcacttggtttcacttcattgagaagctgacacattacattgtaaatataatggaaaccggaagtgccctaatgcagtcattgatatataataaaaagacgatttaaatgtatcccgtgagggacagctctatgttgaccactatcccatgaggggcaggtccttgttgaccacaatcccataaggggcaggtcgttgttgaccacaatcccataagaggcaggtcgttgttgaccacaatcccataacgggcaggtctttgttgaccacaatcccataacgggcaggtccttgttgaccacaatcccataacgggcaggtcgttattaaccacaatcccataaggggcaggtcgttgttgaccacaatcccataaggggcaggtcgttttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcttggttcaccacaatcccaatggctagtgtaggaatcctacgctaggtcattagtcagcgtaggaatcctacgctaggtttttcaaaaatgatccgaggaagcgattttccactctcttttacagactttgagctcgagtaggataactacattagcctagtgtaggaaagctagtgtaggaatcctacgctaggtcattagtcagcgtaggaatcctacgctaggtttttcaaaaatgatccgaggaagcgattttccactcccttttatagactttgagctcgagtatgataactacattagcctagtgtaggaaaggctagtgtaggaatcctacgctaggtcatagtcagcgtaggattcctacgctaggtttttcaaaaatgatccgggaagcgattttccactcccttttatagactttgagct

SEQ ID NO: 9157 - DNA, 975 bp, Heterodera glycines
ttttcgaatatttaaatgctaaatcgaattatccaatatttggaggggtcaaagtcgagccacttccgaaattatacattcattttcaattccttgcagggaaatgtctttgttcaccaaatgccccgatggctttaccaatctgcagctgatcgaactgtttcgactcgactggcgccgcattcgatcagaggaggaccttctcgcccactccgatcatttgcgcgacggtccgttgggccgcggctgtctgatcggcccgaccaactccgccgactgtttgcactgtttcgagcgtctccgacgggcgattgagcaggtggaagccgtccactgggcatttgccaatttgctgaaccgttttgactgtcgtctcgctaaatttggcctcgcttccgcgacacagcccttctcgcccaacacgacgtgccacaattgcgcggttagtgccaaattcaaatgccaaaaataggggtgaatttggggtacgtctcttttcctcctccgaattgcgcttcatttgcttcccttcaaaggaatggtatcgcaaatggctgctcgtcaatttggtcgacctttggaagtacccacgtgagctttgctttccgttttcttcctttgatccctttgctcgtttagcttgtgtcaattggtgctattacacccaattagcgtgtccccatttggccactaacaaagtggtcgaatttgcaggacatcccgtgtttttgtgcaaaggtaacccaaaattctcaatagatgaatgattccgaacaattcttattcccatgcaatgaatgacccaaccaatgcttctcccccccccccccccccgcttaatcttttccctccccccacacctccgcctgggatggcgcaggccattttggcgcaagactctatatcattttgatttcacagcaaaattaaaaaatgcttggtatgattttaagtggcttgatagtgcctattaac

SEQ ID NO: 9158 - DNA, 4396 bp, Heterodera glycines
atataattttttgaaattttgcaggctaataaagaacatttagacctattgattaatatcaacattattttatttggtcgaattaaaaaaaagttatgaatctttaaacttgcctgcgccaaaatgaccccgaccccctccgcctcaccttccctttgtcatttgaggattttgggcaatcaaagaaaaaatatttttatatcaaaataaataatgccttctttcccgaagaccaacgggaagtgctcaaatgtcttggtactcaaatgtccgtgttggtactcaaatgtcagtaccccttctcgtcccccctctcccctcccctcctctcctcccacggcttttccattgattgtttccccaattattgtcaccttttgcctcagatcagcgactttcggcggagcagcattctctgaactgttcatgtttgcacccgtgcgatatggtggatgaccgattgacaaacgcagcgcaattgaacagcagcagaaacgaccaatcgcaacagcgaaaggaaaagggcggcgaaagacaacggaggccaaggccatccccccggggcaaacggtcgccggccgaggtcgaaccgccgttcgactttttcccggccgcaatttattgtgagcggaggagagaaatgtgcgcacggagcgaaaagggacgaaaatagggcaaacaaaaggaagacagagaaaaaagcgagcagtgatcagtcagagacgaaaaagcagcagagagagagagagagagaaggacagagaaaagagacaaaaaacaaaggggacgaagagacaatgctacgcgaagagggcaggaagagaagcatagcgaaacgaaaagccatgcgaacccatccaaaactcaactcattcctctcatcgatcactttgttaagttgcctttaacaaaacaaacaaagaaaaactgtacaatataatggacgggttcaattggcaaaataattaatggcacttaaaaaggggacataacagtgtttaaaggtccaacaaacatgatcaagttaatctcgcgaaaagactattaatttcctttatagacaactttaaatttataaaacacacttacatattagcatatctgctcattcatccaaaataaggtcgcccctatcttaggggcggaaagtccgtgggattcctagggacaaaaagggcttattcgtgcatttcctatcgaaataaaaccacagaaaaaatagaaagtcctaagaatcccatccctaattataagatcaatttggaaaggctacgggttttccgttggtccgattttgttttcagtttcttaagttaggttagcaattagcatgaatctttcagggtttttcctactttgaattgtgaacagttaaattttgagtgtattttgtagacgattttttatttaaaattaaaaagcagcaaaacaaaaatatacaaaaaggaaaagccaaataatacaataaagcgaattgtaatttgaatgaataggtaaggtaagtggcttcacttttactctccaaaatattcatattatttgacgttttttgttagcactgattcgaatgttaagagggaaaaaagagaattgaaagtttgaggacaaacaaatcaaataaatgcacatccaaagaattaatgaatgaatcaattaaattcatttataatttcataaaacgaatgatggctttaataatgtttctgcgtgtgttcaatgctttcaccaattgttcagtttggtgttcagcgacataaaataaatttgggaggaggagcctttggcggacgaaaagaacactttgtcgttgcgttcacaaaggaatttgagcttctgcgcctttttgtgcatgaaaacgccttaaaaacagaggaccaattagctaaccgacattgccacaatttctatggcacatttccaatggcacactttctatggcattctttccactctttttatggcatttttcttccctcccctttttttgctcaccgtccaaatgccccgtctccacgttgcgaatttcgatggctttgtttccccagcccattatttggtttgtggaaatgtaagctgaattcgttaacttttgccgttcattggcccattttggcacttaccaacggaagagggaatttcgctccattgcaattgaacattcttcacaattttgccgtaagtgttcacgtagacgccctcatctgtcgattgggttacggtattggttagggcctactgtacgtgactcccttggcttactatcgtagcacaacagtaattgcattccgttggtattcggcagaatcacaatgcaatgcgggcacatcccttggcacattgtgctcttcaaaagtgtatggtgctttttaatttgccaaaattacattcaaatggcacctgttgaggcgagtaaatgtcgtaaatggacgctgaaaaggtaaattttggcggcgaatgccaatgagtcattgtggggccaacccgagtccaagtcgatggcgtggaagccggcaaggctgccgtaaagcaccttcagacgcgcgttctcttcgatggtcaaatcgacgattaccggcgcatgggacaattggccaaaactctgaaagaagagaagcgaccgattgttgtgggcttaccatgagtaccttgaaggccatgaatttgttgtaaggctaaattcggatatttaaacaaataaagggaaaaaagagctggcccttcccactgactttgggtgcccacgcgtaaatggaaatggagtcctcaatgccaatcaccaaaaatttgatgcgctcatagcgcactgaacggaacaaatgcggaaggccaagccttggcgccgtttaccgattttgaaatgagtggcgcattggaattcgccgacatttgtccatccgttccttttctccgtctgttgcaactgaacaaagccatgtttctgagcttggcttttcctttggccttcccaccccttcagtccgcagaatcttttgcttcagccacgagaggtaataaacgcggacgcgccgtttctttccgctgattgtcaccaaaatgttctgtccctccatgacggacatttggtcaaagcgacggcgagtgatcagatggtaaactgacaaagcaattagcacggaatggcattggccatcctttgatcaccgctttacctttgccttggccacttctgtccaacagcatcagacccgtgtccgtgcctgaaattgcgcatgagaaaatgccatggcacactttgacggaaaagaatttaaatgccaattaaaaataaaaagctgaaagcctttgtaagtgcttgtcactctcacctatcagcagattaaccccccaaagagcagcacacaaaatttccccgttgaatcgctttttgtattttctaatctccggcgcgtctccgtcgctcgcggcactgtttggattcacattcacttggaccttaaaattcgatcattgtctaaatttgtgccgcccccgttttccctttacttggttcggattcggcatccgtccgggtcggtttacggtgcccgaatgaatggcgcccgccagcggcccctcgttgctgtctctgacgagtgcggtgccccctccggcgaaatatccgatgaatgacttttcccgctccttcggcctcacttggcattgctcttcgcttctcccctcggcgttcctcaacttcagttggcccggtctcttcagtgtttggaccgggtcctccaccatttcctcctcctccgccctttgctcttctctcaaaatgacttgggccacccgatttacgtaaacgatttgctcttccgtcggtgtgtcctcaattgccgatgagccgtggccactgacttcggacaaaggctttttgccgtgccgatggacgaccattccccccagtgatcggctgtccatttccacgcccgtcccttccgactcatccgacgaggaatcgaagtcgtcgcttcgcagtggcgaacgctgctgcacaagaaatggaaaatcaccgccaaaagtactgccattgtaacccgtctgccgtgccattgtccctcccgccctaagacccccaactactggggcacctaattaccctaatcacccctcccgtgccgtcccctttccctccctcgcacttctggcactgagcacggcttgacaatgcctgccactctgttcagacttccccgtgactccgtccgctgccttttctcctccgccctccgcaacaaattgctgctgttgctgcgccgtcgccactgcggggaaacggacgaacggagcaccaaagtgccgttgttattgttgttgccattgtcaaagtgtgcgctttcgcaatgcgtcggcgttgggggcaaaggtttgtcgtgggaatcgttgaaagcgttcg

SEQ ID NO: 9159 - DNA, 3505 bp, Heterodera glycines
  misc_feature (14)..(14): n is a, c, g, or t
ttctaataattttntggcacgcaaatgaccaaaaagcgccattttcaaagatacctttcaccgtttaggacccaccaaattatgcaattggcccttttcagcggcctaagttttgatgagagaaaataaagcgatgaacggggcaaatgaattgggcgaatgaaatgctctcgaaactcttttctcgagggccggcggagattcccccgcctttgttctttttccctcccatcggcagaatgacccatcactttccttaaaacttccgacgattattacacaacggaaggacacaaaacaaaacgaacgatgggaagcgaaaatgagaaaatggaagaataattagtggaaaagagaaagtcatttggggggggggggggaatcagaagcaaaaaatgggaacaattggaaaaagggaattcgaaatgaattttaaattaaatgcaaaatgattcttaaaaaattaaaatttcatttagcgttcgtttattttttcccttagattttaatattattttatacttttttttgaagtgactgaaaatggcggacaattgccaattcaatcggcaaatttatgagccagcaaacggaaaacggcacaatgagcaaataaaagcagaaatgatccgattggtttggtcggcaagtcaaattcatcggagcgaaatgatcggacgcacttttgggcagaaccgcgccaaaagggcacacagcccattgaaaatattcgcagttcttctatttacaattcacttttttatcaaaatataaaaaagtccgaaattcgtaaaaaaaagccctaaaaatattttggatggaccaataaatgtcaattgtcttccttctacctctcttcgtgtgcatatgccataccaattgaccttgtcttgccacgatcgtacggattaatcccccgaccattaatccctccccccccgccattgtccccttccccctctcattggcaatggctaatcgcatcgcccgccaattccatggcttttattaaaaaaaatgttgcttcactcggtcaatgacgacaaattaaacacttttcttaagctgtggtggtgttaattgagttggggtctgttcttccgttctcccccctcccaatttcccccaattttacggctgtgaatgaatgacacaaataaatacatttgcgtcttcccttccccccgccccctcccatattcataaaccattcgtggcatccctcgagggcattggagcgagtgctttctcccccggggctcaaatttgattaagcaattaattccctccattccaaatggcaacagcttttccagccagtcagacagctccttcctgggacatgcttgttccagtcaatttattattagctgcataattaatgggctttgctgagcaacgacgggggaaggggattagtggcgagcagagaattagtgggattaaggtgggacaatggtttaatgagaatgatgccgggggagtgaatggcacggcacgactttggcaactgtcgtgccgttggcagaatgattttccgatttcgcggatttgaataagttttctttttgttgcgctcacatcttctcttctaaagaggcgcgaattttgcacaaccatcggcaaatatttgcgaattttcacttcggcaccaaaaagagacaaaaaacaaagcaaagagagaacaatcatcgcaaagaagaagctccacattttgtgaatgggtggggaaggacggcacttcaagacaaaatgccaaaaacaaacaaacgcagttggaacgccattgtcgggaattgggagaaaggcgccgacgggtcaacgagtacttttgccaatttgtcctcaacagaaaacaccgaagaaagaaagtgccaatgccaatcaatcagaagtaggcgaactttcaaacaaatgtgaggacgacaaatgcgcaagtttcagcaacaatttgaactgctagcccattttgtcatccattaacgtaaaatacgaccctttcccgaaacaatcggtcgacccctcccaaaaatgacaatggaatgtcataataaatgccttcccgtgattgacaattgtgtagaaagggtgggacgaacagttgaagatgggtatggtagtggagaagtttattgccgctttggtacctgtcaatgggtgcaaaatgccatggcacgaacttttgggctgacctttgaatgacaaagaccgattaattagggggagagcatccatttatgaagaggtattaggcaaatgtaatatgagcagacaaaaaaggtaagaaaagggggggggaggggggggggaatgagggaccacccaaatgccacccaaaatgggtcaccagcgggcaatgttggaactccggagaatattaatgagttttaacgctaaacgaccttaaaaagactaattcaaatggagaaaaaatattcggcggtaattttttgtgacagattttcatcattcgctcaatgagaggagacatgaaaattgatgaatgactgaagggaagcgggcgggggagaagaggtggtaattaaggggtggggtatctttgttatatcttaattttattatttttatccccctttctcacacccgtatcgtttcataatccctccccaatctctcctgtccccccccctcctctcgccccccccttcctccgcttctttgcctcgcttaataattaccccgaattgctttgtctccgcttcgcttttcccccaatttctcttccgtttggggtcacattttgggctttgtcgtctcatcttttctttgcggtaaacatcaaatcttgcaacttgacgaaacaaagccttccgcgaccgactcactcatcactctttggcgccgaagggctcaattagtccgagtaccccccaccccggcaatgttttcctattgggcattttctgtgatgggaatggccttggatcggcgatgggggataatggaactaaacaagcgaggaaagagaggaacggagctgcgaatggggataatccttctgttggattaagccgaaacggataatatgtctaattattgagtaattaatgagtttatcttatcaaaagacaaacaattaattaagtaattaatgaattattttataaagttttatggcatgacaaaaaaaatattgcacaaaaaatgtaaaacaattgacaaaattacaaaagtaagtgaatgactgaaaagaaatgaaaaattaacaaaattagggttgagaatttattttaaaacaataaattaattgtttgttttgcattaagtgaaacctaaaagtaagaaaattttaataaaaatgtgttgcattatggccaaaaatattaatagtaaaaataaaaataaaaaggaaaataataataagaatttttaattcaatttaaaaaatcaaagaaataatgccgacaggctcattcaccacagtttgaacaaatgtgccaaaatccgcccaaaaattccttccggcgacttttcgctgctcatc

SEQ ID NO: 9160 - DNA, 1867 bp, Heterodera glycines
taaagggctgaatttaagaaagaattgtaactaatttcataacaaatacaaatactcatgattgataaagcttacaaagttaggttatggctattattttttgtaatttgccgccctttcttaccgtatttttggtggattcatttcgccgttggcaatggcaaaatccactgtcaatgcccttggggaaagagtgaggcgcaaaaagggctgatgaacggcacagactttggtgatgctgggccatgtccaagtcgaaaaggtcgggcagagacaattgggagaaggggggcgacggacacggagcagcgggacggggccaaaaagtgaacatctgaggaaattggcgtaaaagcgatggaaatgccggaaaatgccgaaaaacactcaccattttggcacaaaaaagcaataaaacaaagcaaaatattaagaaaaaggatcaagcaacggagaagtgattgattttaaggagaaatctaaatttgaaaaaattaaactcgcagtaaaataatgagaatggggcgggggaagataaattggggacgaattggcactttggaattgatgagaatggcgcaagaagggaacggatcaatgaccaaccaaatgaaaacaatgaaatgaattatgaacattgaaatggaaatgaatggcaaatgattgtccgtccgtttggtcgcggggcggagccaaaaaattatggcgagaaatgaatgaatgaccaggcgaaacgcaacctgagctgatggaccgaccgaatgactgactgttggacggcacggggcggggcggggtgagcgaatgatttgcgcattgggaaaaacggaagggaaatgagaaaatgggagaggagggaaaggaagatgggggaaaggaggaagaggaatagggaaagggaggaagagaaagaggaaaagggaggaagagaaagaggaaaaggaagagggaaaagaagaaagaggaaaagagaggaaaataagggaaaggaggaagaagaagaagagagagagagagatagagcgatagagagagagtgagagagagagaagaacaaaagaggaaaagaagggaaatggggaaaaggtgagaagaaataaacaaaattatcttttattttcgaaatttcatttcatttcttatttctaccgtaattaattaattacaccaattagcaaaggaatgtccgtggtgagttacgaaactcatctcccccccccccattctttttgctttttccatttctctccccgcggcttttgcgatttcgaaattttcatttgtgtccgtctctttacacttttgtaccaaatttcatcactccgccatgttcttgtcttcaccaaccagtttgtttgaatcttcgaaagaccgttaaaataatgcggcggcggtggaagggtccgccggtgatggctttttgcgataagccgagggggcaaaaaaaggataaattattaatgattggctgattaattaatcggttcttctaaaaaccgaggctaaatgaccttgaattttcatttggtcgtgtggtcaatgcgaacagaagcgaattgatctgttgaactgaatttcgaaattaggtcaaatttgatggatcgtttaaatgctaatttatgaatttgcctttcgtcgccccgcccctttcctaccgtatttatttttctttttttctttttctttttgtttcctttcaattaataatttttgcatggcttctctcgcaaatcggcaaaaacaaaggaatggaagacaataataataaacgccgaaaatgacctgttgtggagaaattcggattaaataatccgctgaaaccctttggcggctgagtttcgacgaatgattggcggcgaatgggcgg

SEQ ID NO: 9161 - DNA, 1116 bp, Heterodera glycines
agaaaaaaatgaacaatcatttcatagttttggtatactatccaaaaatacaggttatttcttttccaaataaacataagattcctcaataaaggagacgattcctatcatcgagatatcacataaagtccaattaaacaacgccattcaggcagttgcgtaaaagtgtcagtgtttcatctcttaaacataatggcagaaatcggacaagaataaatcggtgagcagatgtcgggggtcatttagtggggggggggaggggaaattgcgcgaaaattggccaattgaacacggcggcaaagcttttgatcactgaaaaacattcccttggggcaacaaaatcattcccacggcctcatgagaaaaaacagcgaaaagggacgaaagatcaaattgcaaagaaaagaacagacagagggacggaacatcattactcaacacaatcaaaacagaagaaaaagaggagggagagcaaagcgaaccgaacggacggagaaagggagacaaaccgagaaaagggaaaagccaatgtcaagaaaagggacaaaggagcaaaaaggggcaaagtcaatgccaagaaaagggacaaacgatcaaaaaggggaaaagccaatgccaagaaaagggacaaaggagcaaaaaggggaaaagccaaggaaaaggaaagggacaaacaatcaaaaagtggaaaagccaatgccaagaaaagggacaaacgatcaaaaaggggaaaagccaatgccaagaaaagggacaaaggagaaaaaagtggaaaagccaaggaaaaggaaagggacaaacaatcaaaaagtggaaaagccaatgccaagaaaagggacaaacgatcaaaaaggggaaaagccaatgccaagaaaagggacaaaggagaaaaaagtggaaaagccaaggaaaaggaaagggacaaaggagcaaaaaggggaaaagccaaggaaaaggaaagggacaaacaatcaaaaagtggaaaagccaatgccaagaaaagggacaaaggagcaaaaaggggaaaagccaaggaaaaggaaagggacaaacaatcaaaaagtggaaaagccctatgaagaaaaagggacaaacgatcaaaaaggggaaaagcca

SEQ ID NO: 9162 - DNA, 1032 bp, Heterodera glycines
ttttgtttgttttttttcagagaaaatttataaattataattaagaataaaacttaaatctttttattttcattaaacatattttttcaccaagcacgtctccgagatataacgttgctggaaaatcaacaaaaaaaaaaaaatttaaatttctaatgagcattcaattttcaatttttattaatcaattttttttaaattgaatttaatgttccgcttaaaaagttttatattattgtacattgaattattttataatttttttttaataaattaacccaactcattgaacatttaatttaatctagttattataattatttataaacaacttttacaaaattaaatacaaaaattagttgttataatatcatcattcacaatacctttttacgaattatttttttttaattctaaattatatttaatgttccgctctaataaatttagatgcagcttttccacctataaaaattagccttgagctttgagttccttaaattcaaacagctgtctttattttaacattgatcgaatcattctggccaaacaaaaaccatgaaaaattaacacattcacttaaactcaaagtatttcttgataacacttgataaatataatattttaaaacatttaaaaattgcaatttcatttaagcaggttaaattgaaatgagtttttcattgagttcaaaagacatcaaaaacccgcagtgcgcatgttgtgaaaaggaagtgccatttggtgacaaatttagtgtcgatcgattgacgagttggcattttttgtcattaaacttcaattttaaaaatctataaacaaaaaaaaatttgctatttttcagttcacaaatcatgtttcaaatgtgccatttgcgacaaggcgcttgaggttggctcttgttcgcttgagcgtgggctgtcccgctacgaccattgtgggttttgttggggacacatgtgagaataaaaaaaatctaaaaaataagtaaaaacaaaattaaaatttttgcataaatttatgattttttta

SEQ ID NO: 9163 - DNA, 2775 bp, Heterodera glycines
cgcgctccaattgcatgaaccctgttgcagtggcttgtcacaaatagcacatttgaagcacgatttatggactaaattgatgcgaataaaaaaatctccctttggcagggatagataaagtctttgttttctttttttaaattttttttgggtccaatctttgagaaataaaaattattaaaagtgctattgagcgggagccgataataaagttaaattttatataaaaacttaattaacatacttgttagtctgtccacgacaattttgtctgttggcggcacatctttttcacatatttggcacaacgggcttttgaaatctctggagctcagacaaaaactcattttttttctaaatataatttcttaaaatggctcatggacaaaatggtcagcctatactactgatacagtatatttttttgtcgtaatatacatatcgtatctttgacgcattttttcggacaaacgtaattaaaaaataaaaattccgttaaagcaaatttgtattcaatttgactgaacaattcaatgtgctttctctcaatttgttttaagccacaatttgtttttgagtcagtgaacagctgtttgagtaagtaaaatgaacacattgcttttgaaagaaaaatttttttttattttttatatttattttgcctaatcaataaggaaaagcattgatagttgaaaatatttgaaaagttgaaaaaatgaatgaaaaaaaattagtttaaataaattaattaatttgatggattaaatatagtgagtgagtagattcaaacatatatatatatatatatgtattagaggtatttatatatttttttaattaaaatttaggaaattattttcaaaaatcttctcgtccaaaacaacaaaaataatttctgcctttttggaagagcaattaaaaattaattttgtgtccttcatcatggacttcttgtccataataagcatactttttgtcttagaatgaatgtgtcgataaaataaattggcacccacattttttttttgttcttggcaatttattttgacgagaaatttttatgtttccctggagattggaagggcaaggcgaattttaggagtaaaaattaaaaacaaaaattattgccaaaaaatttttttttggcaatatcttcaatgagcttaaaagcagtcatttttgaacattacttctaaaaaacaaaaaaaaaatttcagctctctccaagatggggccaaagatagtaatctatttgcttggcattggggtactgtggatttttgccgtagtccaatgtttaccggtcaatggaatgtctgcctatggtatgccaaaaatgtttaaatagagaaatatatataataaaaaaaaatgataaaagcatttaaaaaaatgctcaaacaatgcaaaggcaacaaatattcggcgcggttttaaaattttatgaaatagagacgaactgactcccagaaaaaattatcgtaagtttcacccagtaattaatttttgtttcttttgatttatattgtatgaagatttcttgtcccggccatccagaaccggtccggaccgttaaaattcagacccggcccagcctttcagtgcttaatagcatgctgaactaaagcaattatccttaaaatataccgtaattaaatattatctcttttgtttaatttttatgcaaattctattaaataaataattcatttattattattttttaaattttttaattggctgcagttgttgacgaccgtcctgtccatttgtcgctgaagcgtgccattggaatttactggaatgccatccaataccctggaatcgaaaaacgtaccgcctacccctatccaagtccgacggatatcaaatacattggatttgggcgaaaacgtgcaacatttgatggtgccgacaaatgaatttaacaatttttttaaggatgaacaacaaacaagcaaattaatgtgtgaattgtgagattgcgattagaaaaaaaaaagtttttaaaattattttaaaaataatttgatttcattaaaaatttaacaatttttttgacaatgtaattatgactgaataaactaaaaaaatgaaataggcacaaagtatcataaaaatgaaatagcatagaatcccatttaagtatttaaaaataacatttcaatatctttaaaaatccggtttttagtgatacatttttagaaaatttttttaaatttcccaagaaattttaaaaattcagaaatctgaaaatatatataaaaaaaagaaaatatgtaagaaaaaattgttaaattttgggtttttttgttactaatcagtgcatgtaaaatccaggaaaaaatatcgtatttacataattttgccagccctaataatcattttatagtgatttaatttatttaaatcaaaatcagttcaaatttgaattttaattatttcgtaccggcatttatctggttggccttgtgaacatcgtgggaattttttcagcaatttctttgttaaaatgtactcagtggcgaattttttaaaattcccacttcaattttttgcatataaaagttatgcgattttgaaatacatttattaaatcaaaataatttcattttaaaattattaaagttttcaaaaattatactgtgaagaaagaaaatgaattcttctacggcggaagtgcaagtcacaagggaatatgaggtaaaataaaactttaacaatgccctagtaggaataataattaaatgaataatattaattttaattccagac

SEQ ID NO: 9164 - DNA, 1076 bp, Heterodera glycines
  misc_feature (51)..(52): n is a, c, g, or t
  misc_feature (59)..(59): n is a, c, g, or t
  misc_feature (73)..(73): n is a, c, g, or t
  misc_feature (80)..(80): n is a, c, g, or t
  misc_feature (96)..(97): n is a, c, g, or t
  misc_feature (101)..(101): n is a, c, g, or t
  misc_feature (104)..(104): n is a, c, g, or t
  misc_feature (106)..(106): n is a, c, g, or t
  misc_feature (110)..(110): n is a, c, g, or t
  misc_feature (114)..(114): n is a, c, g, or t
  misc_feature (128)..(128): n is a, c, g, or t
  misc_feature (135)..(135): n is a, c, g, or t
  misc_feature (137)..(137): n is a, c, g, or t
  misc_feature (141)..(141): n is a, c, g, or t
  misc_feature (143)..(143): n is a, c, g, or t
  misc_feature (150)..(150): n is a, c, g, or t
  misc_feature (153)..(153): n is a, c, g, or t
  misc_feature (169)..(176): n is a, c, g, or t
  misc_feature (178)..(180): n is a, c, g, or t
  misc_feature (182)..(184): n is a, c, g, or t
  misc_feature (188)..(188): n is a, c, g, or t
  misc_feature (190)..(190): n is a, c, g, or t
  misc_feature (195)..(196): n is a, c, g, or t
  misc_feature (198)..(198): n is a, c, g, or t
  misc_feature (202)..(204): n is a, c, g, or t
  misc_feature (206)..(207): n is a, c, g, or t
  misc_feature (209)..(210): n is a, c, g, or t
  misc_feature (213)..(214): n is a, c, g, or t
  misc_feature (217)..(217): n is a, c, g, or t
  misc_feature (220)..(221): n is a, c, g, or t
  misc_feature (223)..(223): n is a, c, g, or t
  misc_feature (228)..(229): n is a, c, g, or t
  misc_feature (231)..(231): n is a, c, g, or t
  misc_feature (235)..(236): n is a, c, g, or t
  misc_feature (238)..(240): n is a, c, g, or t
  misc_feature (242)..(244): n is a, c, g, or t
  misc_feature (246)..(246): n is a, c, g, or t
  misc_feature (250)..(251): n is a, c, g, or t
  misc_feature (257)..(257): n is a, c, g, or t
  misc_feature (266)..(266): n is a, c, g, or t
  misc_feature (269)..(269): n is a, c, g, or t
  misc_feature (279)..(279): n is a, c, g, or t
  misc_feature (283)..(284): n is a, c, g, or t
  misc_feature (287)..(288): n is a, c, g, or t
  misc_feature (293)..(294): n is a, c, g, or t
  misc_feature (300)..(300): n is a, c, g, or t
  misc_feature (304)..(304): n is a, c, g, or t
  misc_feature (306)..(306): n is a, c, g, or t
  misc_feature (310)..(310): n is a, c, g, or t
  misc_feature (312)..(314): n is a, c, g, or t
  misc_feature (317)..(318): n is a, c, g, or t
tagaatttctaattatttaaaatttaaatacatataaatctttacaggggnnggaaaanagaagaaagaaccncaaaaanggctttatacaggtgnnaggnaanangagnaaancaccaccaccgggngaaggananaaancnacgaaanaanagcactttaaaaggannnnnnnnannnannnatananaaaannanaaannnannannaannagnaannancaggnncncccnngnnnannngnaaanncccaancacacaaancanaaaaacccancaanncannacacnngacgancggncnaaanannncanngactcccataatgaatgaacaatgctcagcacgcgttgagcatttgttttttcatcactagcagcaccgaaaatggtttttggtaattttatttcattatccaatgcatcttttagcgcgaaaatattgtatgataatgtctaaattatgtataaacattaccaagcatacagtgttggaaaaaaagtttcttgactaaaatacacagaaaatttattcaatgattaataaaaaaaaataataatttgtcagaaagaccattgcaaaaattttgaatttatgtaaattttttttcaaaaaattttaaatttgaatacttttcctattataaaatcaaaaaagtcatttttttatttatgatatttaaaaaacaaaacatatttcgatagaaaaaaataaacttttatcaatatgaatttttgccgcaaatcatatgaaaaaaattttgccggaaatcatttgaaaatttgtgacttattattgattttaaatattacaattaaattttgcccaataaaatttaactcaaaaataaaaatttcgatataaataaataattgtttaataaaggattaatttttaattaatttatttttttttgtaatataaaaaacttagttatatatatattaattgcttttgacctttttgtcattatgacaattgctgcaatgtgaaaaaagtttttgttgcattccttcagtttcatgctgctggatcggcattaatttgagttgaatttcataattaaaaatgaa

SEQ ID NO: 9165 - DNA, 1807 bp, Heterodera glycines
tgttggagtttagaccggtgacgcgagtgtcgaggaattgctgcatgtgataggcatacctaattagaaaatacaaagtgccgcttggttggaggtcacctgtcaattatgtaaacaccaatggagcgatcgacgtggtgagagagcgaatcctcgccaacctatttcaatatgccaattttaaaacgaatttggtgcttgccaagctggacgaagtggccaaaacccgcggtgagtacactcgttgatacatcgactcactttggcacgtgtcggcaattagcagcaactcattgtaactgttcagaattggggggaaaggataagaagggaacgcgaaatgagagcactccccagcagtgatcaccgattttgctgatgcatcgtttcaatggcatctgccaagtcaacgtttgtcaactcttccgcgtcttgaaacttcaaaaagccatcgccgccgtggccggtcaaataaataagcacattactttggctatcgctgagcaaacgcctaaaataaacaccataaactaattaatgatagtttcttaaaaagtgcccagatggggtgtactacgtttttccgaagctcagttccctcccgcatcgttcccccccccccgaaaaattaaaaaattttttttactaaaagtctatgaatttgttttgtatttaactgaagcgtctttttttcttcggtactcagttgtttattgtcaaaatgacatctgatcaacttttaatatagctagttcgatttgtctcgtcgagaactgtcgattgacacatattttgttgaaaattttttattttcacttgtttttgtctaatttagggtcagttttcgtgggtttaatcggcttaaaaccctgtttgttggcgtcggaccgattcatcctctgatttttagactcacattgttagctcatcatgagcttcgaatgataccaaatttgtcaggtttcgatcgttttaaaaatcccccggataagtcaggaatgccggggggactgatagggggggggggaaggcggctgggaaacgcgctgctcccgcccagatgatagtgagttgtcataaaaccgttggagtatataaatctcagtattaccgtaaaattcacttgtttctgggcgtgtccgtatgtgttctgcccgttaaaattctcacgacactttccgcagtcacttcgtacccgcgatagtccacttcagtgtcctccaaatacaaattctgatgggcaaaggcattgttgaaaatagacgctattggaaaagaaaaattaacgaatgaagagaaaagggcaaaaccgggggaagggtttctcgcattgcatggaatgttatcggaaagcatcaaaatgatgttgctaaagggaatcagtattaagttataaccaattgaattaaagggaacaacacctgtcgggcatgccaagccgtttcaacgaacggtacagcgaaaggacattggcaacgtggcgataattgaaccaaaagcgcgaagagcaaaccaaaagagccctaaggaaggatgaaaaattttaaagacaaagacgaaaaccaatgaccaattgtttgtgtgagttgaacggctgaaaaaatcactcagagaatcggccaacgaaaatgaaggaacgagcgaagaataaaggaaaagagagaacaaaaaataaattaccatggtcgaactgtgttaaaaataagattatcggcctgtttaatttaatccaaatgtcgagcttttccatttaaaatgtgtgagattctgggaagaggaaagaaggaacagcttggataggaatcag

SEQ ID NO: 9166 - DNA, 2180 bp, Heterodera glycines
atttttttaataatattttaaccattcagaatttgaatgtcgacaaaaaatgactttgggagccatcagttgttccatccacaaacattaacgcttcaaaagactacagcttcgcttgtggtcagaccaacccgatagtgtgggccctaaaggactcaaatgattacgcagtcggaattacgctgaacaatgtgcaggtagaaagaaagaaagaccatcaattataaaaaaaaatttcataaagccactcctttcattacataaattcttttcaatttaatctgttcttgttttgccctgacaaagtggttggcagaaattaaggctctattgcagttcccacgactataaaaaataaaataatttagcaatataatgcaccatcactttttctagaagcatctcaattaaacattattgaaatcattcactagctctaagagttctatattagactgcaaaatttcaaaagaatttcctatgtttaatttgagtgctttcgaaaaaatttggtacattaaagttgccaaatatttatagtcgtctaaactacaatagggccgaaattaaaaataatctttaataaaagttgaataatctaaactaaatctatttacctttttggcttttgcatacaattagtcattccccaattcgccattccttttttaagttccaaccattcgatgcagcttacactgccggtggaaaagaagctgaccgtttaaagtttggatggaaagtcaacgattgccaggggctgttcagcattggcacttggatgggcttggtagttgccactctgctcatcggcgtgctctttttcggctttctgatgcttaattctgtgcagacaatggacagattcgatgacccgaagcagaaacagttgataattagttcgaaagagtgaatttcatcattttattttattacatttcccttaaaattttcattctttgtagctttataaatataaattttttccttgaattaagatttttagtagccattgttgtttcactttattgtattaaaaatgattgtagaatatgctaatttattaaagcattttatggaggaaagcgagaggataattttggttggtccgttgtttcgttttcctttacgttttttcagtgcagggaaagggaatgtgcacggcgtggcatcgccgttcctccgctttttgtggctgctccgatggtccgttattcgaagtgcgtcttgccaattaaacgatttatcctcccttcccattgcttttgttagacttccttttcggcgattggtttctttgtacggctgcgacttttcctacacgccgatgatttacgctgactgtttcaccaaatcggagaagtgtcgacaggtcgaattcgtaccgtcccccggtgatttgccaattgtgcaatttgcggccaaaagggcggaagaatttgcgagcgccgctcaactcgtttatgggttctgatttcaatccgatggagagtttcaatttcaaaaaagcgtagacattgccgtggaatcgacttgaactgtggctgccccaaaagtgatgtgcgctcggacggatacggctcaaaactcttggaagacccgcaattagtggccgatattgtgcgacagtgccgcgcttccatcgccgatcccgactttaccatttccatcaaaattcgcattcaatacccaatggaaaggacagtcgatttgtgcagaaaagtcaggaacataatcaagcaaattgtcagcagaagaaattctcaaagttccaggtggagcgtgccggtgtttctcacatcgctgtccatgccagaactgtcagtcagcggtcggagccgccggattatgcggcggtggcactgctgaagcaatgcttgcaagtgccaattttcgctaacggtggctgcaaaacttttgaggactcattggaaatttcgcaggcgacgggcgccgatggtaaaggcggggccatgaaaaaaaggcagggaggggaggggagggggcttcaaaatccgattttttaggggatgtattttttctagaaatctcaaattaagaaatgtgtttttcaaatttattgtagccatcaaggcgagcttgggggggggggggcccagggggccccgggcctcccccgaaatcaaaattttttgaaaaaaaaatttatttttttttta

SEQ ID NO: 9167 - DNA, 3286 bp, Heterodera glycines
cccccgaaatcagaatttttaaaaaaaaaatttattttttttaaaatattatattaattttttcgtaaaaataacaaacgagtttatgaaatgaaaaaaaacagatcatttacaattgaacgcgtctaatacacccctaaatattgaggtttacaaaaacgaaaaaatacacccctaagaaccgactttttgagttgcccccccccgaaacgaaggtcctggctacgcccttggcatggcttcgattgaattcattttaaatctccgtttttccaaggagtgatggtggccaacggtctcttggacaaccccgcaatgtttgctggtcattcgtcaactcccaaacaatgcgttcgtgattgggtccgttctttttctgtttcgcatttcaatttttatgtttattaatttagcttaatttggaactttccgaatgcattcccttcgatttgtttcatcaacaactcattttcatgctccgttcctctctcccaaaacagcaacgaaacattttcaacgcattgaaaagttcagcggcggtgagaaatttcctcgtcgatttttatttgaataatgtcgattgattggattgtccttttcgacctcacaatcagccttaacattgcacttcacgttaatatttttcttattaattaatacacgtttacgttgaataccttaaattacaactaacggattccatttttattgctttttgcccacatgatggtgctagttgatcagcttttaagtgcttttaaaagtgctcttcgtgaagtcaatccgagtgcgtctgttcagaaagttgggcttcccacaatcgcggctgatttcgaccaaattgtgcttttaaggctctatccgtccgcgatggaaaactttttgtgcagaatcgcggcttcgaactacataaaaatgtccatttggtcgctttcggaaaggcagcgccggcgatggtacatggggccgaaagagtgttgggcgaacacattcttagaggaatcgcatcagtgccgatgaagatagagtatgagaacgaagccaaaatattttttgaaagattaatttaaaagcattccctccggcctaaaaacggagttttgcacgggtgccgagcacaatttgcccgatgaaagagcattggaaaatacaaaaagaattgaacaatttgtttccgaggccaattcggcgccggaccaactcattctgttcctcgtttcgggtgcccttctttgtcttcatcactccgtcctttccctcaaaatttaaaggtggcggctcagcccttttaacagccccaatttcgggtgtcagtctgaatgacaaagtggctttgatacggcaggtgcagaacagtggtgctggcataaagcaactgaacgtgctcagaacggcactctcgagagtaaagggcggtgggctggccaaacttggccgatcgtcgaaggttttaacagccgatcacagtccgcccatttcccaaatgcacagatgataagcttggtgatctccgatatcgtcggcgaccctttggaattaatttccagcggtccaacaatgtctcagggaggtcatgtgcagaccccaatagccattctgaacgacttggaaattcttgacaaagtgcccattcgattggtcgacgcgctccgatccgcacatttagaaaaggatcagtgtaattttacattcctccccgaatgagactgattttagtcaagcatttagacgacccttctccaactgatgcgcttaatgtgatcattgccagcaattccattttgcttgacaatcttgctaaccaaattaacgattcactttcgatttctcctttcatcgtaaccaatcggttggagggcaacgccacagaattgggaattcgattttccaaactgataaagcaaagcatggtcaatggcaaattggacaggtcaataatgattgcaggtcaatttcaggagtggatcagaattagctgtttccgcacatttcattactccgcatttcgacagatttatacgacgacagtcaacgttcggccgaattcgattcacagcgcgtagtccttttatttggcggcgaatcgacggtccgttttgatgctaagaaagcgacacaaaacgcaaaaggaggcagaaaccaggagatgatcttgtcggcatttcatcacctcgccgaatgttggagcgatttaccaaaagagacaaaatgccaatgccaatttgcattgtttagcattggcagtgacgggcaggtaaacaatctgttatgcagttattcccattgtattgtgtcacacaaaacaaacaattgtaaggatggcccaactgacgcggcgggcgcctttctcaccaacgacgatttggaaggattgtcagagaacttacaattagcctcagaaattgagaaattactcaattcaaagtgctcatatcatttttggagcgactacagaaatggcaaaaacttgattaaaattggaaaaactggcgtaaacgtaatggacgtacaaatgctcatcctgaattttggaagaaaataatgacgacaatggctatttcttgcagtgattttaataaaatggttggcaatgacattagagacaaaaattagcattttcaataaaccatgagttttgggcattttctcaaaagctattcaatcgtttgaggaatttacggtagcaaaggcattctaaaagggtcggatgaagtgagcaaaagcggcggataatcgcaggtcagaaacttttgatgtgccgccggatgggtaaaaaagggaatccgacgacgaaccaaaagcgataggtcacttaaaaagtatattttaaagcttaaataataacaatcaccaaccgaaccacgagaacactccaatgcttgccccaatgagtttttgccaaaattcgtggtaataaagtgaagtgatcaacaattgcaaatcccatagcaagtgaaggagcattagagaaacgaaaagccactagaaaaagggagcctgtggtgaaaaagtcacagaaatgcatgaatgcctggattattttggtattccgttgaaatagttcaaattccttgcgggaaggaacgtgatgaatggtaacacgaggttttgagggccaattttggaatgaggtggattcctcgcagattatcaaaatgctgtagatcaacaggaaggcgtgtccactgatgtcaaaacctaagagattgtgttgaaattttattcggaaaggaagtttacaataatacaatgaccttattttggatttggaagtttaaaaaaatcc

SEQ ID NO: 9168 - DNA, 718 bp, Heterodera glycines
aatgtttttcatccaaatttgcttcggcatctgattgcactttttattttgttgatggcgtactaaataaaatgtgatttcgagaaaattattaaattaaattttgtgatgaaatattaaatgaagcaattaatgaaccaacagattaagctttcagacggcaatttatttgaaaacaaattaaaaatgaattactaaaaaatgaacatgaattcgagtaattaattgaagtttacataattccaaggttaaacaaccgtttttaaaggaaatatgaggatttgtcaataaattttgaccatttggaagcgtcctaatatgatgcttttcgaatggcttttcagctcaaagacgcaccaatttctggtgtaaaaatacgcttacaattagcagttaaaaaaaagaagcgcaagatgggtaaaaataaataaattattaaatgcggtcaattaatttttatttcagtcggatgcagtctttatttcataaaatataagaatttttacgaattaggtaatttttttaaaatttagcactgaaaaatattaaagtgggttttccggactgttcgtcttgcttcttcatattcacagcaaaaaacattcactgttcagctgcaacggacctctccacggcttttttctattttttcgtttttttatttattaaaaaaccaaagaaagcgggaacaaatacatagtttgaaagaaatcataat

SEQ ID NO: 9169 - DNA, 3240 bp, Heterodera glycines
gatggcagactcctgatgttttttttggcatttttaaaaaatttttgtttggcattccgtacaatgccaatgttcgctgtgtgtccaaacggcgcacaatccagtcaatgacgcggatgttctcacaatacccgggccacagaaatttgccgtccgccgccgatttgcggaaccaattaacctgaaatatttctataaaaaataaccgaaaattttgtttatttttacgtggaaaattcgcggcattttacggcccggctgcttcaaactgcaccaatgtgccaggtacttgccgaaattgtagcccataaatggacgcctaattaatggacaaaaatattccgtaatccgtcattacggtactaccgtaatttattcataattacagtactcagaaaaatgccgtaacccctccccgtaaatttaacattcgttttgttttaggataaacaattttactcatcagaaaaaacatacattgccatcgggtcgtgcatcactgtctttcctgaaatgctttaattacagtaatcccacaaaatttgtaactacagtaatcccatcacaaaaaaaagagaacaacaattcaccttgatgctccgcagcagctgttgtctccgactttaaacatgcgccagtgaaaatgccgtgctcccaggagaatgattccttgatgatgggtaacatttaaattggcatgccaaaaaccgaaaatttgctacatcacggagcggaaatgtaatttggtagtgttacagtcgagattttcccggggtcaattctcgatttcgagtctcggaaaagccaaacattccgacaaaaattgtgccaaaaaggaacacaaaaacaacttacaaacaccaacggcacaccctgcggacgtcgtcccccgaaaatgatcgcatcaatcggaacaccatctgaaaaaaattttcaaaaatatttttgtcgctgtccactctcgaggcgtggaaaaagtgccactaaaaccctggcaaaataccaacacgcgagactcactcggcgactcccagtcgggatggatgatcgggcactgtttggccggcgcgcagaagcgcgagttcggatgggcggccggcgttgggctgcccaatttccacggggcgcccatccaatcggttatggtgacgtcattgcggtcgcagatttcgtcctggacaaaattttcaagaattccaaggacaattcaagacaaaatgcccacctccaacccttcccagtacactttgccctccgaagtttcggcaacattggtgaagatggaattcttttggaacgtttgaacagccatcggatctgatcagaaaaatgaaatatttttttattttgagaaaaattaatatacaaattattcaaaaagccaggcattttggatttgaaaacccaaagaaatagggaggccaaagatttcaaaaaaaaaacgaaaaaattgatgcctgggaaaacgaagagccaggaaataaaaaataaacaaaaaaaattatacgaaaaactcgagcttgacaattttcaatttaatttttgttggaattgtttttatcgttttctcgcctcccccgctgctcactcgtctttttggaggtgcccggagcgacgccgaagaagccggcctgaaatgaaaatttttagaaaatttcaaaaaaaattgaacagccaaattttgcctccggattgatcgcgtaaaggcgtccgtcctcaccaaatttcatccacgcaatgtcatcgcctgaatatattgtcgaattttatgtcatggaaaaaatgtcaaaaaaatgatcatgattaactcttgattcgagactctcgaccggacgctaattagcgccactaattattgtgcctttttgcttacccacacagcgcactttccagccgggcagtgtcggctcaagcattgccaaattagttttgccgcacgcggacgggaaggcggcagcgatgaaatgctcctgtgccaaatttttgttgagcatttagcctcagggcattcaaattgatcaattagataattcatttaataattaatcaattattaccttgccctcgggactggtcacgcccataatcactgaacaattttaaatatttttgcaaaaaaaaatgcctaattgacaacataaagaattgaaaaataagcccaaagggtctttaaaaccaaaaatcaatcactgccaaatcattgatcaatttcgttgatcaggtccacaataaaaccctgctgatcaattcctttaggcccatgtaaccaaggggtggcaaaattttcatgaaattccctcaacaaatttcattaaaattttcaaaactctcacccatctggccccattttaccctattttttttttgaaaatttgactcaaaaacttagtttttctaaaaaaacggctataaatccctgtgctttttccccggcattgaagcctctgatcaaaattcattgcttacgcatatgctcggccagccatccttcgtcccgcgcaatgtttgaagcgatgcgcagcgcgaagcactttttgcccagcaacgaattgccgccatagccggagccaaacgaccaaatttcacgctcggggggccgatgggcgatgatcacgcgttctgtgagagtgtgccaaaatttgtgtggggtggcaaaacggcacaaattaatcaattaattaattgtgccacggcaccacccgccataatgaggtgccaaacaaaactcacccggattgcaaggccaacggttaatcactttctctaaaggggggggggtgaataaaatcttccatttttttctgatcaaaatgtgtattagaaaaaatgatcagattacgcgagacaaacaagcagagtacagtgccgaaaccgtcacaattttagggacatattgggaaacttatgtgtcatttttttttaaattttaattttgaaattcttttttttctggcagcctggtttaggcttggcttctattttctttaattttaaaatttttgacatttaggaagggcgtgaggctggggatgacggtaggggtcgaatttcaaaacatcttagtccggttcccacgcctgatcattttccccacgaattcaagaacgatcaaaaacagatctcggcaagcatttcattaatccgtttatatagttttataaagcttacgcttcacaggtcgtgggaggccaacggaaggaaggcacgcacaaaatctgatcaccgatcgcttcggcacat

SEQ ID NO: 9170 - DNA, 3995 bp, Heterodera glycines
  misc_feature (71)..(71): n is a, c, g, or t
  misc_feature (2913)..(2913): n is a, c, g, or t
taaaatttattaattaattgcattttttgcacctgaatgccaattttggacaacggactgcccaacggtcncatggaaaatgggatgacgtacataatacggccggccataccttcattaaatttataatgatttttaatccgaatcctctaattaattacagccgggaaagcgcgtgtccaattcgtccgcgaattgtgccggaggcatccaatggcccatgatcggctccacgcccgcgggcgtatgggtgaccgtcttgatcgggggggggggggaggaatgtttgaaaaaccgtgaaaaagtgcaacaacaatgtttaattatgtaatcagggatcaatcacttaattgattttttaacggtaaaaaacttagagccaataaaaaatttgatcagaattgtcgaacaaatttgagtgatcggaaacgaacgacatactaaataactgatcaaaatcagattcaagagatcagcagattcaggtgtaccggtcagggaaatgcctttttgccccctttttgaaattggaaaactttaaaattttaataattttttttaaatccataaaaattcgaaaattttcccgtcggcgcctataaaagttttttgaaataaaaggcgccacaaaaaaagtggaaaagcatttctaattttcgctcttaaatgtatgatcagagacgagttccgaatgccgtgccgtttctgatcagaatgggcaatcgatcgcattcaaaaatcccatcaaaagttggcatatagccaatcgccccccccccatctcatctgatcacacccattttttcacctcatatttctcccgtgtgaccatccacgttttgctctccacccgggcacagtcgcgcgggtcagttcggcacaaataattgttttcgtaggccaccaacggtgtcagcacaccacgctacacaaacaaacacagaggtcagcagaacaagataaaccatgtacatacaaaatgccatttttgccatgcttttcccatttttgttttaattaactattaatgatttttagcgagagtccctggtctcgaggagtctcggccgctcgagaaaaatcccggtttttttcgtcctcggtctcgagtttgttttttgggttgcagtttttttttttggtctcgagttttttggatctcggcacttctctatctgtctcggaaaattgtcggtctcaaaaatcgctactaattttggcatttagtcgggtcaaaaagaaaattatgaacagatttttgtcctcggaattcccgaattaggttttcaataaaagcatctctatcttctgcctgcccgtgtcagtcttgaggccagaaattggtccatcggtcttcattttttgcccacctcaacaagcaggtcagtcatctcctccgcttcatgttcggaaccgtcacaaatgaaaatgccctggagggaaattcaaagtttattttggcacaatgtcaattcagcgccagccaaagtgccattcattcattcattcatttacccgtggccggcacagttccgccttctccgccacaaagcgttgcactttgaaaggcaacagatggaagtcaccctttagggggaaaaatgggtaaaaaacggcggctgtcacaaaaaattttaaaaaattgctgccagccgacgccaccacaccttcaaaattgggatgggcccaagccgtttgatcaccacttcgttgaccacgtagaaagcgtccgcgctgatctggcgcagcgaggccgacacgccgggcgtctgcttgaacggcgtcagcttggcggggtccatcgtggcactttgtgtcgcggcagtggccatttttcagggatggcacttgtatatagttgctaattttataaaatatgtagctaaaccaatttaaatgattggaaaaaatttttagacatggggagttaggttttaatgaaaattgaaattttgaggtggcgtttttgaaaataaatcagggatgaggtgaattatttcgttggaaacatatttggaattattctaaagtactgctcgagagtctcggtctgtggagcatcgactcgagatttttgctgaggtatctgcctcggaaaattttgaaaaataatctaatatgcagtagggctcgagtgtcgagtttcaactcgaaaagtctcggatttaatggggtctcattgtcagtctcgcacccggtctcaagtcatgtgatctggatttctgatcactttcagtaaagttgggtcaatcgaactttttggtaaaggcattttttcagatcaattacaaaagaccagtgatcgattaatcatctaaaattttatggataatttaaaatgtccggaatttcaatttatgtttttaggggcccgaattccgatttccgacttaagaaattttttgggccatgaattccatccttggtatcaataccctgaaaattttcatacatcatttactctcggtcttggtttgactttgtctagtttatttttatttttaaaataccatttttaatatttttttttacaattttttcccaaaaataaatttgggcggaacggaggagaaaaattgtgtaatattaatgagctgataatgagagagtgcgcaatcagtttttaattacttgtttttcaccactttcatttgtttgtttacactttatcttatgataacaacggttgttgttgttgtgatcaattggaaagtaaactgattaagctgctgattgggaatgaacgattcaaaaaatgatttatttaaattggcggaaaaattgccaaaaaaacaatttaaaaaaatttctaaaaaaattaaataaacaaatgcaaagaacttgaagaaactcgagttggacaatttgtaaacttgaaccaagctcaaggtgatattttccaaaaaacttaanaaaatgacgggaagagctgaaattacggatctgtccttatttcagaacttatcgtccttatcaactcccttatcttcttgactttgtccatcgcaaaaattgtttaatattttttcttacaattttcaataatttaaaaacaaaaaaagaaagaatgaaaaaaaataataaaattaatgcttaacagccaaaaatgtaaattttttaaaattattatcataaaatcacaaaaaccatcaacattttttaaaatatacgaaatctctttttaaattcttatagacaaaacttttcccaaccccttaataattttttctttccgttttttcatgttaggtaaaagaaaaagaaatcatagtttaaaaagccaaaaaatgaaaattttttggaaactttcagaaacttttgcttaaaatccacaaaaaccctcaaagtttgaaaaaagcattcaaaaataggcaacgctaatttcaaaaaaaaaccccccctaattgaccccttcaaaaataattatgaggggatacaaaaaatgaaatcttatgtattatagcttaaaattaaaaagatggaaattttcaaaagaaaaacagttaattgttaatatgtatcagggttggtatcgtccaagtcggtttccaaggacgggtatgccgatttgcaaggacataacgcgggaaaattcatgaaatccaagggcattcaaaatttttattatatacaatgaaaaaaatgattaaatttttatccaaatggtttacctagatggatttatccgcacagataaatggatttatctacaacaggaggaggaggaatgaaaaatgtgaacgaatgaatgaatatagaaggcaaacaaaaaaatggcaaaatagtggcgaaaaagttccaaatttagggggtgtaattttttaaatagctgttttttaatttgaaaataattaaggcaaacaactttttcactgattgcagttacaaaatattttcttagcaaatatggaacaagaaaaaaaaaatttgggggaagaatttttgtgaaaattttaccaattcttaggggtatattttttgaattttttaggtcg

SEQ ID NO: 9171 - DNA, 3904 bp, Heterodera glycines
ttcggccgcttcgcggcctcatttttttatattcttaattaattaattctaactaatatttattctaattaaaacattcaaatattatgctgttttaaaattcatttaattaaatataaagaaataataacacggatttttgtagtatattactttttcgtgagttctcatttaaatttgcaaaaaatttaaaaaaataaatgttacaaaatagaaggcgttttaaattttaataatgctaaataaattttaaattttttgtctgttattaatccgttcattttctgaatcttattttcttataaataaatacatttatttattatttaattcaagaaaaattcatttaatttaaatttaaataaattaataattaaacattttcatttttattttatagaaaaattattttaatttttttaaaattgaatttaaaaaataacaaaaataattttgacttaataattagcattaaaaaatagcagaaaataaatttaaaaatgatttacaccgtccggattcgaacctgaatgcctcagaatcccagtttacgcagggattctgaggccttaacgatgtcaaaagtgaaaactgatcacgtatccatgatcagcttcattaaatggccttaaagacatattttttgaagattttgggtgaaaaaatttttacactcaaaaatcctatgctcacccctttggtcccgaatcccaaaatcacttttatttttataacttttttcaaaaaagtgataaaaatgccaaataaaatttatataatagagcaaaaaattgcgcattttatcaatatttttttataccttagcactttgtttggagtgagttattaatttttatgtgaaaaattgaaattttcaagtttttcaggaataacttttattgtttgcaagatagaaatcccaaataaatctcataaaattctccctatttttctctattttttaaactttaaatggactgaattggacctttttgatgggagttatgaattttcaaaatgtagcttaaattttcaagggccaaaaaattctaaaatttcaaaaatttttaaaaaattccaaaatgtctataactcaaaataaagttcatattcatgatcagcgacccaaattacgtaagaaaatatgttttttttaaattttagagcaaaaaaatgtgtccatgaaatttccaaaggggtatccctttggattttggctgcaaaagcagttttaattttataactctttttaaaaaagcgataaaaatgccaaataaaatttatataatagagcaaaaaattgcggattttatcaatatttttgtgtaccttagcacattgtttggagtgagttctgaattttattatgaaaaatcgaatttttcatctttttcaggaataacatttttcattttaataatagaaatgcacaataaaaaccataaaattctcccgatttttctgcattttttgatcatttaatcttcacatttgacccatttcaaagggagttattaatttttgaacattcccccaaattttcactgggcgaaaaatgaaaaattcaaacacacccaaatttggtcaaataaaaaatttaaaaaattgaaaaaaatataaaaaaattttagaaaatatttccagccccttagaacatcgttacacgtcataaaaaatcatccgcacaccgcgggattcgaacccgggcccccctccctgggggcccccagcacacaccactggaccaaccggttctgcagggaaaaactttttttgagttttcaaaattttttttatatcattcgaaagctcttgaaaagttgcaacccaaaagtgccgtgcgtttttctttggcacaaatgtaaaaaaagttataggcaaaaaaccgaaaaaccgtcgagggggcctggattttttttggtcgaaaatttcaaaaatccaaaaacacggttggatgcagctcaaaaatatgcactgctacttgtcagggaaaccggctccgagcacttgcggccgagttattcacgaaaaacagaaatccgcttttttgggtaccaatttttggccacctgtcccggtcacggatttgctcggatcgaaaaatgtttgctggcaatgttatccggcatagtccaactggatttcctcccagcaagcgtttttcgatctgagcaaaagcaaaaaatttcgtaacactgagactgcaaacaggggccatttcagcgccgctggcgctcacctggccaccggaccggaaagcccgtatttttcctgaatccgcctcaaaaagttggtcgggacatcgaatttgcaaagccctcccggcgctcgttaggctcaaaatagcaaaaaagtgcgaatccccacttctttctataatatataaactagcgggtgcgtgaaccgtcggctatttagctgggaaaaagcgcttcgcgctttgggagcttcgctacctagatcagttatgggttgtggagtaattgttggtccagaagatatttgagattaatcaaaaaattttataggctcattcggccgctttgcggcctcagacgggcgcttcgcgcccgtttctaaatttgttgggatagcgagagaatgttccaaagaggtgcaacatattgtagaagagttacaacaaatgttagaagacgtacaaaattgttagaagaggtacaaccacggagaaagagatacaacagttattagaagaggtacactgggattcttagggcgctttgtggagaattggaatttttaacaaattatctggggcttttaggccgcttcgcggcctctaacgggcgcttcgcgcccgttttttaaatttggtgattcttaggccgtttcgcggcctcgaacgggcgcttcgcgcccgtttctaaattttgttggcttggacgggcgcttcgcgcccgttgttaaattttgttgaggccaaacgggcgcttcgcgcccgtatttaaatgttgttgagctcagacgaggtacaaaattgttggaagatgtgtggaagaggtataacagtgattagaagaggtacaactgtgattagaagaggtacaaaagtgataaaagaggtacaaaagtgattagaagaggtacaactgtgatagaagaggtacaacagtgattaaaatttgaacaaaagtgattagaagaggtacaaaagtcattagaagaggtacagaagtgattagaagaggtacaacagtgattagaagaggtacaacagtgatagaagaggtacaaatctgattaaaagaggtacaaatctgattagaagaggtacaacagtgattaaaagttgaacaaaagtgattagaagaggtacaatcatggtttaaaatgataagaaaattgtattattggatgtattataaatttatcaaattaaaaaaatccttttacttattaaaataaagttagaaatttataatatagaatatttattgaaattgaaaggaattaatttctcgaaaattcaaattaaataaaacatttattcatcagaaaataatttaaaataattaataaaacaatattaaattaaataaaaaattaaataatttaaatgaacatcattattcatcaaaaaataatttaattaaactaaaaaaatttattattaatataaccaaacatttaaatttattaaaagtaatgaaaattaacccaaaaaatacaaagaaaaataatgtacaccgcccggcttcgaacttggccccccttccctcaaaatgatactcagaatccccaatcacacagggattctgagggcttaacaatgtcaaacgtaaaatctgatcacgtattcgtgatcagcggcccaaataacccctaaagacatgtttttggaagaattttggtggaaaaattttcccactcaaaaaccatgtgc

SEQ ID NO: 9172 - DNA, 4161 bp, Heterodera glycines
  misc_feature (4106)..(4106): n is a, c, g, or t
tccaaattaagtttgactcaattgcactttaataaatttaaaattttaaagcgactataatataatgaccatggcaaaaaacatagcaggatcaatatcttataacttttttcagaagcaattaaatttttaaaaaattttaaaattgtaaccggtagagaacgaacccagaactattgaatgataccaagaaatattaatttggttgaaactgctcaaaagttatgaatttatatttatgattttatatgtattattattcccttggcggatttaagaaaagacccaacatgatcattgaccaatgttgaccgcattttgaggcatttgccttttcgttgctaactttcctgaccgaaaacgcatgagaacgcgtcttataataataataattcgtggtgagacatttgcgccgcgccatttgcgccgcccagcaaaaatggactttttgcgccgcgttgtcaaaaatattattttcattaaaattgcactattataaataagttttactaaaactataagccaacgataaaaataactaattgaaaattgcaaaaaattactagtcacaaagatagacattcaattttatttaactattaaaatcttaactttgaataggttcacccaagatatgaaaaatgaagaagaataccaataacaaaaaaccgaaaaaatgatttttctctaagaaaacccaattgttttttgcttcaaaaaatgaataaatttaatattttgtaattaatttgttcaataagttatttgcatcgatttgactttaatttaattgaaaaagcactgattttcaaattttcgcccctatttaccatttttcgccttctttcgcaatttttatgcccttatttaagtacctattttgattttttttttttttttgccttaaaatccgccgcttaatgatcaggcaacgaaggcttgttatcgcatatggtcccaatgaaaacaaaagttcaaccacataaatttattttaatgagagcgcaaatgttctttttcgctgtacggcgcaaatggcgcggcgcaaaagtcggctaaccataataattattattttctgattaaatattgcattatattcatatatttatttttcgtgaattaaaattatttcttcgcttttaatctctaaaattcgatggtttaaaatttttcaaaaatttaactcattttagtgaaatattttcactttatttatcaatgtttcagcctttttatccctatttcgtccttattttgggatttttttttaataattagtgaaacttaccgctcctttcacaattgtcattgaaaaccgaaaataaaaaataattaaatgaaaaaatagagaaataaaatgggccattgacagaattgggaaaaatgaaaatgaatgaaatgttttattattttaaaagcttaaaatataggaaattatttattgtataaccggagaagcaatgtttgccaacattatgccaagttggcattttcatcaatcaaatgaaatgggcaattcaatcgaaatgcaaaataaataaaaaattaatttttcataaagcttatctatagggttatttattaacttataaccacgatcattcgttctttgatctgcacaattcactcattcattcatcgtgcgccggcggaagtgtgccgaaatatggccggccatccgttttggcattttcacgaagattttattacaaaatcattcgggaacaaatgttgaaattaattgaacatttatttgcatttgactttaggcacaacaaaatcacattttataaataaattttttcttatttctctgggatttgtccttcttattttgctgactcaaagctctgagcggacggcacggagaagaatgtgcagatgcccgtttttcagaaagtgcggccaaatcaatggcacttttgcctaaattgccgctttttatttgtttatcgctctaaacccctgttgagagtggtgggatgactcatcggttaaaatgaaagccatggaccatccatcgccaaatatcgtcggcacttcgactccgccatttcccccaaatttgccaaaaaagaaaagaaactgtgccttggccttaccggagttattctttgtatcagttcgtgcccctttgtccaacaaaaagcgcacaacgtgcgcctaagtgaatgaacaaaaatttgggggaagtccgaatttggcgggcctcacatgccccgcgagcgatgcgaacattagcgcggtgtgtccgttgctattcgtttgttcaatgctcgcgccattctcgacgagtaaagtgacttaagcataaaattattcctaattaggttagtaaagtggtggactacaagagaagtttaaacaataaaaccaatggaaaaagaatggaaattgtaaaaatgatggccaagaaagcacaccctcttctgacacaaccgaacccatcgaatccccattaagcggcgcatacccattaataataaccgatgaatgaacgaaccaatgctaatgtgtcccgcatcgcacgcaatcatcagcggagtcatgccaacttccaggcccaagtcgacgttggcaccgtgcgcaagcagcacacggcacactcccaaaaaagccgtacgaagcggcgacccaaaggagagtcccatctaataaaaattcgttttgaaaaggtccaaagccattttggctcacaatatttgtaatcgccgttgattttccgaaggctcatttggtgcgggtcggctcccttctccaactgagaaaaatagtcaaatgagtgccaatcattggaatttgttccgggcccaacggtggaaaagtctcggcttttagggtaacagaatttcttctataatgcaattagtcactgatcaggcctaatgtcccttttctgtctgttccatggcatgatcagctgttttttttgattggtgatcaaaatgctgcttatcgcccgatttgacagaaactcggacataaaccatgtctttgacttagtgtgccaagacattttttgtctttttgagatttaagagccaatgttcgaatttgctgttgacatgccaaaactgccgcaacttccggcttgtttcccactgtggcgatcagcagcggagtcagccgcttttcggtgccctttggggcgtactgtatgtacagtaagtgactgagttcgtcgcccgggagcgaattgagcagtgcacgcaactcttccgctttatttttgtagacaaaatcaaaaaattgcttcataataagcgaggactgatcagcagcagagggggcagcctaaaagtttatttcaaattttaaattggaaaattcggccaattattttggtggtgccaattccgctaattcgcgtaatctgttcagaatcaccgcaatttcagggaacagcaaagtcataattgtacatagaaatggacagacaaccgaaacagtaattgtgccgttgatcggtgtcattctcacaattaataatgaaaatgcaaaaaagaataaaatttattattgaattatatttaatttatatttttatggttttcaaagcttaaaagaatgggaatccgttaataaatattacccaaaaagattattcaaatgataaaagtgaatgaaaaaatgataattataatatgcagcgaatgaatgacgtaaaattggacggacgaacggaaaaaagcacaaaaagctaatggaaatggagagagaaaaatgtggacgagaaggcaaacccaaaaaggaaatagttattcatttaatttaattttttttaattttaagcaatttttctcaaagaccattttttgaataaaagaatctgaaaagcttcctgctataacgttgatgctgaacaagaaatgttctaaagcatttaaaatcattatttcgttccaaattagtttgaatttggcatattgtaagcgactgttgcacatttgtttaacttaaatgatttttcttgccattcatcttcacatcttttgatttttagggttgttcccaaaactcatcaattcatttgcttatttttcttggcacaatcggtcctcttcgacaacggcattttttatctttttgtgtattttactgtncgattgtccacttactgatttgtcgtataacgagcacactgaaaggagtgatctg

SEQ ID NO: 9173 - DNA, 1899 bp, Heterodera glycines
  misc_feature (1702)..(1702): n is a, c, g, or t
  misc_feature (1761)..(1761): n is a, c, g, or t
  misc_feature (1789)..(1789): n is a, c, g, or t
  misc_feature (1846)..(1846): n is a, c, g, or t
gaacttggccactgcttcagcagttggacgggggtttctgacaaaccgatgtctttttgcgcagcacgaaattgtgcctcctcagaaatttttgcaccatccaattgatgcctgaacaaaattttttatttttgtagcatactacttttttcactttgatatcagtgcccatgaacagcgcagccgccctctgtcgaatgatattccttgactcaggctgtttattttttctttttttggtgatccattctgccagttcagtgtcgatgtccggacggtgaactgggagacctgctccgtcgagtctcattcgttcagttgttgcacacgacttttccgccgaagccttcgttttcaactccgctaaaatcgccacagaatgtgtggcacggcaatttgcagacataacagctgtgaattcctccataaattgctttacaaacagcaaaacgattccatattttctgaacttttcattaaaaattcccatttttatgcataccggaagcaaaaaataacatttttgccatttttggtgtcaattttcagaagttctttaacaaaaatgcaataaatatgatttttttttgacgcgatgacattttttggcgacatgttcaaaaaaatttcaaaaattttccactaaacaaatcagccgaaaaataatctcttagtctccattagtctaccagtctccaattatctacccctttctgaggatattgaaaaataatataccatggcatataaatagagtaaatacgttaggtacactgtgttaatttaaaataaagacaccctgttttttgggagtttgaccacttcccatgaaccgatcgagctgaatttttaactgtacgtagaaattctgaaaatattaagattctgaaagtgagaaaccgaaatgatgacggaaaaaagttttacgatttttttttcaaaaatggggtgttaatttaaaatagagacaattgataaaaacgaacaaaatctcaacaactaccaaaaataaacagataaaacaaactaaataagaaagaataaatctttttttcacatttctgtttattttgcgaacagaaatatgttcagctcgatcggttcatgggaagtggtcaaactcccaaaaaacagggtgtctttattttaaattaacacagtgtataaataaacattgtaaatatatttgtttttgttttttttttgttaatttacattgatttgtctaaaaattagggttggccgccggatccgggtatttggacaaaaatcggttccgggtattgccgggtccagaaaagccgggtccgggtattgaaaaaaccgggtatccgggactgggacccggtcgggtacccggacccggccaaccctactaaaaactacgctttttaagttaaattgggtttaaaaatcttgaaatctttacgttttttcaacaacttatttttaatttaaaaatatatagtattgaactttaataaatttcaatatacaaaaatttaaataaaacaaagaaattcaacaaaattaatgttccacaagcaaataaaaaaaattacaataaacagatcttgcttgacatgtatgttgtggtaggaatctgaaatatgcccgaaaaattaggggattcgtggccggggtataaattcggggatccgtggccgtagtcaagatacggggattcgtggccgggatatanaattcgggggttcgtggccgtagtcaagatacgggggttcatggccgggtataaattcngggggttcgtggccgggatataaattcngggggttcgtggccgggatataaattcggggatccgtgggcgtagtcaagatacggnggttcatggccgggtataaattcgggggggttcgtggccggggtataaaaaag

SEQ ID NO: 9174 - DNA, 2669 bp, Heterodera glycines
tgatcgaggacttcaagaggcggaaacggcattacgtcaacgactatttggacggtaaaatgttttgctattttttaatgaaaattttaaaattttttaggcctccgaggccatcgaactgcccaaaaaatgttttcctcaattattttcctatattttgcttgccttttgccggctattgcgtttggtgtgctgaacgatgacaacacaggcggtggcatcaatgttcgcaagggcattttggcacaggtgaaaaattggaggggggggggaattattaaaatttttattttaaaaagctaaatttaattattatttttatttataatttattaaaagaaagtttttttttaatttgttaagaaaactggctaaaattccaataataattcattagcatttcccttctttaaaaaaatattttcattattaaataattttttcaatatttccaatttattctaattaatttacttttttcattaaaccaaaatttggcgtttggaattgttttttaaatattccatgcgaaaaaaacaaaataaattttccacataaatataaaaaaaactaatatttttttttaattaattttcttacgcctaaggcaatcggcggcattttctttgccatctttggcggacaaccgatgatcattctgctaacaaccgtaccactagccatctacatcaaagtaatctacaggatatcggagtcgcttggctacgatttcttcgccatgtacgcatgtgtcgggtaagtttttttttaaactttttagcctataaatttataggaaatgtttaacaacaggctagagaatacagtatgggcgtattgtaaatgtgtattgggtgggaatactgtaaaattctgaaattatcgtaacctctataagtgctatatgggaagcagcataccgtacatttcagtgggggggggggagtactgtaaattctgaaattatctattcccacgaaaagcttgcttgaaggacgggcatacagtaactgtataggagctatgcatacagtaatttcctgaaattaccgaaaatgcttatgactttgctagaatatgggagtacttactgtaaattttgtatgggatctgaatactgtaaattactagaattaccggagatgcttaagaaatatctagaatatgtgaacagggttactgtaaattgtatgaatgaaacacactagcaattctaatttttttttttaattttaatttcgttgaaactataccgaggtttaacttcctcggtttttacgaattttccattttttatgcctaatgccttgtaaattttaaaaaaattcacaggttatggtgccaattcttcctgatactgtacgcggccactgaactgtgctcattgatgaagttagctacacggtcggcagaagaaatgttctccctgttcattgccattgcgttcactgtggaaagcatccgtgccattcatacaagtgaattttcatttaggaacggaaattaaaagaatgtgaaaatttattttcaaaatttcataatttttttcagtaaaaatttaagattttttgaaaaaaaaatcttttattttttctgatattattttgcaattttttaagaagaaatttaaaaaaagaccaaaaattttcgatataaattcaaaaaatattttgtttaacttaaaaactatgaattttttaaaactaaaaaactttcatttttataagtaaaatccaagtttttcgaagaaattccaaaaaatattattttttttaattgaagaaactatgaaattttttaaactaaaaattttcattttttttttaatttttgtcttggaggggggcataaacttgtgtttttttctgataaacaaacgaactgctgagctttaaaatttaggctttatgaacaactacgaagtttgtgaggatgcacaggccgccgctgaacaagccgaacttgcgcatcgacatcaacagcagcaactggtgcagcaccaactgaacctgtcactgctacagaaaatcatcaatccggagttgcatcacaacctcacacaggtgatgatgattggattgggaaataattaatattattttttatattattaatattcggaaattaattaccgtattccaataatacaaaagctctcgtcaccgtgagggctgaaaaatcgaaggcatcctcccccaggggctttattagaagaaatatactgtgtgtattgttttttctgtaatttatttttcattttcaaattttttcataaattttattattgtatttaagtgtatgaccaaatttcagattatttcatttttaataaaatttaggcgtccaattgacccatttttaaaaatattttgcttgaataataagtaaaattctaaaaaaaaatttctttcgaaattactttactctaaaaaaaattcctttttaccaaaatgtttcatgaattttcttttaaagaattaaaaatagttttcatttttaattttttctctcagtttctttaaatatttttcaatttttcaagaatttttttttaaagatgtggagggcggtggggtataatcttccaatcacttcttgaataaatgaaaacgtaaaaatcgggaaaataaaattcaaaaaaattatccctaactctcaaaatgaatttt

SEQ ID NO: 9175 - DNA, 3249 bp, Heterodera glycines
  misc_feature (2458)..(2459): n is a, c, g, or t
aattatcttaacaaaaaagccgtaaaacgaaaaatacatccatagcatttacctcgaaaacgtttgaaatattcgtaattttgcaactgctaattatgaataaaaaaaattgtttttttttttttgcatttttttcgtgtttcatatcaattagaatggaatcttcatttttttgttttgtttctttacgtttacatttgttatttgatcaacattttcataaatcatttttttttgtaaaaaaatgatatgtcagaaatttttattaaaaagaattcaaagtgtttagtgtatggtgtttcatatatttaattacgtaaaattcctccgataaacaaaataattacttcgttttttttaaattacattgaatttattacacatatcaaaaattttatcagttaacattttgtatttaattgattcaacattatttacttgcagaagacatgttcaaaatgcgtccaaatgtgccattgtttcgagtgcccgaattttggcgtctttcttggcaggccattctcgtctgttttctgctcggctttttcctctcctttttgttttacatggaccaaaatatttgttcagcaattgtcaacaacggacaaaacaagtggaaacttttgatcaattatttaatttaaaaaatattatttttttaacacatctatctataaaatgggggttaaatggcaatttggcgcccccacaaagtgtcaaagccacgaaatgtccaaaagagtaaaaacccacgaaatgtccaaaatttttcaaaatttataaaaacaaaatgagtctaatttaggatttttagggttttcggggtcgctgaatacgaatataccctttatattacccgttgcctaaccttaggtccatccgaataataaaaaactcaaattcgagacttggacattttgtgggtcagcgggcaatttatgacaaaaaaattttttttgtttatcccttgtgctatagaagtgccatttttaaagtaaattaagtctttttggccagcgatgccgataagcgggcatcgccggagaaagttttgaaaattgagtataaaccaagattatacaaaacaataatattttgggtcaaattttgaaaaaaaaaattttaggtgaattttaagccaccgggtaaaaattttaagcatttttaatgaattttgttaagaaattggctaatagtgccagcgcataatttttgcattatgttatgaacttaattcaattaatttattttttcgtaaattttatattaatatttcgcaaattttaacatttaaaattttaaattcataaaaattagttgttttttgtttaaaaaagattaaattgacaacccaattgcatcaaattctatttttttcatttttctattttatttcctttattcaatgtaattttcataactattttttcccattaaacctttagactaaaaaaaggctctgcccagcacttggacatattcgtggtggccttgctcaacatgttcctgtccattgttgggctgccgtggatgcatggcgcgctgccccattcgccgctgcatttgcgcgcgctggccgacgtggaggagcgcgtcgcgcagggccacgtgcacgaagtgtaagtgattggctgataagggaatgattgattaatttgagattgattaatgattggcggattttggattaattgattgacttttgattaattaattgcttgctaattgcccgtcttgtactaaataataaattcttaaataaatgaagaatattccaatttaaaatttgcgtaatttaagcataatgaatgtgcgcgagactcggttggcttctttggtggtaaggttttaatttaatttaaaattttatacaacttaaatattatttctctctctttgtaaaatgttcctaaaataatggcatttaattttgaaaatttcataaaattcttaaaaattcttttttgaaatttctaacaaatttttcaaaatttttggcttccaaaacaatatcatattttaattttatcatttcaaaatgtgcattggttccagcatcttcagaaattcaagtaaaaagacggccgaaaatttccggatatttcaagccctagcgctttttcttagtcgatctaattttaaaaatttctaaaaatcaaaaacaaaaaaaaatgccctatttttttgaaaattgctaaaatttttggcatgatttatcttaaaattaaaaaaaattctcccccccccccaggcccatctgctcattctcggctctgcctttttcctgttgcccttccccctgcaatggatccccacgtcggtgctccatggcctatttttgtacatggcattcacttcactgaccggcaacgaaatggtcgaacggcttttgctgctcatcacggaacaggcaagcagaaagagagacggtagagagagagagaggagagagaggagnnagagagagagagacagagaagagagaggagaaggacaaagagtgaaacattgtagagagagagagagacagagaacagagaggagaaggacaaagagtgaaacattggagagagagagagagacagagaagagagaggagaagaacaaagagtgaaacattgtagagagagagagagacagagaagagagaggtgagagagagagagagagatgagaaggacaaagagtgaaacattggagagagagagacagagaagagagaggagaagaacaaagagtgaaacattgtagagagagagagaaacagagaagagagaggagaaggacaaagagtgaaacattgtagagagagagagagacagagaagagagaggtgagagagagagagagatgagaaggacaaagagtgaaacattgtagagagagagagagacagagaagagagaggtgagagagagagagagatgagaaggacaaagagtgaaacattggagagagagagagagacagagaagagagaggtgagagagagagagagatgagaaggacaaagagtgaaacattgtagagagagagagagacagagaagagagaggtgagagagagagagagatgagaaggacaaagagtgaaacattgtagagagagagagagacagagaagagagaggtgagagagagagagatgagaaggacaaagagtgaaacattggagagagagagagagacagagaagagagaggagaagaacaaagagtgaaacattggagagagagagagagacagagaa

SEQ ID NO: 9176 - DNA, 4234 bp, Heterodera glycines
cggcgtgaacgggattcccgcgggaaaacatgggaatcttgttcccgtttcccgtcttttttgcctgacgggatttttacgggaacgggaaaaatgacgggaatcccgttcgggaatcccgccccgttctttttggttttcccgttcccgtaaattttttctcaaaaacgggaataaaagtacactggtaagaatgggggtctgagtgaaaaaatttgaaggaaattggtgggaaaagagattttttgtgaaaaaataaatataaattcattttaattcaatagcgtatatatttatgtggcctagtggttaatacttctggtctttcattatttttctcctgagttcaattccccattaggataagatgatttttcatattttctttaaattattttatttgaaatttaattaataagaaactttgtctaactttaaaaaatattttttttggtttttaaatagccataagcccacaaattaaccaattatagttcattttttggacaaaatttgttaacaaatttcactaaaaattttaaaattttccccggcggcgcctatcggcaccgccgatcccctccctgtaccacaaaggattttgtaaaaggcgctcacaaaaaaaagagattttaaccaaaaaaagattttgtaaataagttgaaaacatagaaaaattctctaagaatattttggaattttaaaaataatagacattttaatgaaaattattgtacatatataaaaaaattttctaggattttagaacagaaaaattaccagtttttgccggtaccctcaaaaatattattaccggcttaatttcaaaaactcaagttttaaatttttcttcattaataaagcaatatttaatcatttgcatagcaagaaatttttttaattgtttaaaatataaaattttacttaaaaaataagtaaattaaaattttgtaaaaaaaaaatcaatattttttcgaaaaaaatttttcccgttcccgcccggtatcacgttaaaattgacgggatttttacgtgaacgggaaaaagtcgggaatcccgttcgggaatcccgccccgttcattttcgttttcccgttcccgttcccggaaaaaattttttaccggactctaaggattttggattcgttttgagttttgtctcaaataatacattttaatttatttaaattgaattttacatttgtgttgtagaattatcaatatttagcatttttataaatttaatattgaaaatattaaaaactttcttcttgctattataaaattattcaaataatataccgtagcaattccgtctcggaaaacgccggcatttagaggatcttgccaccatttgatttttttatgcatagtgtggatcatcttaaatgtgcatttaaactcaaaatcattggaaaaaatatattccgaaaaataaaattaattaaatataaaaataattaaatttgtaaatagtatagccgcccttggaagctagtagtttcaatggaaccctggaataatgaccagtataagccttcatcagtcgtgcttattcgttaggtgaaatcaccaattagaaaggtcagaattttcattattttttatgtaaataaattttaaattttttgcaagataaacttctttatgaataaccaaattcacatttattgcacaatgtagctttttaggagttttgagggttggaaaaatcgactctttaatccatttcgacaaagttcgaacccggacctgcattcgaacaaaaactagaaaattcaaattttttctgatttcgagtttggttcaaagttgggagccccaaatttattttatccttgccattgacatattccaatggttttgacaaattttaaattggttatttatattttttctttttaattttttacctccagtgtcattcgtgttttatatttgatttctttatgttctaacaccgtccataaatcgcggtcatttacgaacagtgttggaggaggaagcccatcacgcattcgttggatgcgtcgacccaaatcggcagtcctctggccggcgcgaattgcaatgaaaagtaggtactcctcttcattgctgaagaggtcacggcgaagtgtcgaatagtcacggctcatttttagaattttttgcttaactaaatttaaaaatgcaatatttggttttgaataatttaaaaaaacacaaaaaaagcattcactattagataatcaaaacgcaatatgatccggaaacaagaattttagcgtggaattcactccggattcattcttgaaaataaggtctgatccgggtaaattggaacaggataacggattatttaaaaaaatcgcaaaatatatgttaaatagacacaaatagtcaaataaaatttaattttgtttatattataattaggactaggaatttgatgcaagaaaaatcacgaaatatgtaaataaaatatgtataaaaaatgctaaaatatgtatgaaatatgtacagccagtgaaaatggacatcgttttttaacgggcccaattttatacttttcctttgttttagcatatcataaagttaagattaaaaaaattgaaaaataataaattagaaaaaatacaaattttttgcaattatttaaaaacaaacaaaaaagaacggggcgtgattcacgaacgggattcccgtctttttcacgttcccgtaaaaatcccatcaattttaacgggaatcccgccaggaacggtaaaaaaatttttacaaaaattttgattttttttttaaattattaattttgtttatttttaaatatttttaatttgtattaacgtaaatgattaaaacaaaaaaattaataattaaattttcggaaatgatctgtttaacagggtttccaagtgtgcttatttctaagatttgtgcttatttcagcgttacgtgcttattttgtgcttatttttaggtttgaaaacaaaaaaaatgtaaaatttgaattgttttgacttatcgtcttttattgaagcgaatatttgaattacctaattcgctctttgtcattcaaatccaacaaacctgggaaagggtcatttcggcgcccacgtttcggcgccaagccaaaaataaaatcacacaataaagggttttaaagtccggtgaataagattatgacacccatttcgacccaatcgaaccccgaaccaggactcgtacgaagactcgaaaatgaaattttcaaaaaaattcacatttatgcaacaaaaacggccaaatggacttaaattaaggtacttaacggttctctatgtacagattttcaaaaaattttttaaataaaatatacttattttaggggttttcagagtcgggataacatagaactgctatttttaccccttattcaaagtaaatgcactttatgtggctttgaagttcattttaatgtatagacctagttcgacccaaaaactgaaaaatttaactgtttgggattagaaattggtcgaaatgaatgctacatcagtgatcagtgaccttgaaaacccctgcatacttgttttcaggactagaaaaaaatttgaacaataaccaaaaatgtagacccaaatagggaacacaattttcgttaaaaaatttctttctggtttgttttttaaaatttggtttggcgccgaaacgtgggcgccgaaacgaccccgacccagaaaccttgagggccgaactgagataaaccggaaaaaattaccagtttattttattctcttgagtgataatacccaaaatttcagagaaaattgttaaaattgggcaaaatttctatttttcctcatcagacggcgccgatcggcaccgccgggcccccccaaaacttattttttttataaaaaatggaatagggcaaccgggaaaccagccttttttgtagaaaatctgttaacgaaccacacactaattttcaaaatttcccccggcggcgcctataggcaccgccggacccccttcttccgcaaaagttgtttggaaaaagcgcacagaaaaaaagtgatgttaaaagcaaatctgaatttctattaatattcgatcatttggtccaaaaatgattaattgtttaaaataactgaagtaaattcgatttttgagaattttcattaatttaatttagctttaacttttggattttataaataaatagcaaaattaaaaattaaattactgttattttcacttgaattaaatt

SEQ ID NO: 9177 - DNA, 1389 bp, Heterodera glycines
tttattatttaaaaatttcctcctaggtaattcaatctggtcaaacattcgcttcggtctcttgacataaacaacaaccaattggaatttgtccatgctcaaattttccagggctttgagcaactccgatccgttgatctttcgcacaacgatttgatcgttcgtaattaattaaattgattataatcaaaagaatttaatgattttaattaggacctcagtgccgcctctttttggggcagtgtccgtttggaacgaattgtgctgtcggaaaacaatttgcgcacaatttggcgtagcacttttcgcgaccaggtggcactgtcagaagcaaatccatctaattaattgatccttttctccgttagactctgatcattgagcttaatcttgccgggaatgttcttcactcgttggactcagttgaaaattttaaagttttattttgtattttaaaataattaagggagtttttggccaaaacaatttgctgggcttggacctcagtcgaaacaatttcacggccattccaatccgagcattggcatcggtccgagcaagccttacggtgctcaaaatgtcaaaaaatggagtgaaagtgctgaatcggagggattttgaaggaatgcgcaatttaaattcgttggaattggcagaaaatcgcatcgaaacgctggaagaggcattttgccaaggaaaacagtgccttaaaagcgtaactggttcaggaaatgttctcttttttgccaaaattgaagcatttggacctgtccggcaacccggtgaacacgtggagcccccacatttttttggtttttcattttttttttgaatttttcggtgatttcgaatcccccagggcctttccccttttgtccaacatttggacctttcgcgcaccggtctcttttcgctgcccaagttgcacaaactgttttccctgcgttatttgaatttgtcgggcaattttctgtacgaattgcccccggcagacattgaccctttgccggcacttcaaacgctcgacctcgcccgaaacaggcacaaaaataacaaatttatctttccttttagcgtattatttgtgttttatttttggagattggtcgaattgcgtgcccaactctttgacagaatgcccgagcttcggatgcttaatttaagcagtaatgtcgaactgcgttggatcgataaagcgcttatcaaagggttggggcaggtccatccgttccaataataattaattaatggctaatttggcgcttttcagttggagtctctttcgctttcccaaatgtcgtcactttcgcgactccccgacacttccgaattcgcacatctgctcagactacagtcgcttgaggtaattactctgtttgcattcattta

SEQ ID NO: 9178 - DNA, 2371 bp, Heterodera glycines
  misc_feature (154)..(154): n is a, c, g, or t
gctccgatcactccatttccaatcgaccgatgaaaccttttcgggggaggaattggccacggctgaccttcgattattgcgcgaattgagcataactggtgccaaaataaaaaatgtatgtaaaattaaaatttttctttaattttctgaaatntcagattggccataatgccttcggccaattgcgcggctttcgtttccgtctctccgtccgaaacacccaaattcggcactttcctcccgaggcattgaatcgtttggtcggcgtgacttttctccgtctttttctgaggaataaccaacttaacacttttactccatttttgcccggcgatcagaaaacaattaacgaaagggggacaatgctggaggcaattgatttgggggtaatttattaattgtgtaattaatattatttaatatttaattaaggaaaacccattggaatgcgattgtcgaatggaatggctaagcgaatggatagcgcagcagaaaataaaaggccaagcgcagaagcagtgggccgaaacgaaagaattgttgaggacatccgaatgtgcagagggaaaagtgggggcatttcacattcatttaattatataattatggcacttttaataaatgccaaaatatttaatttgtctttggcagggtatttttggcgaattgcgcggggaacgaaacgcaaaagcgaatttgttggacacttacgaaggagcacaattcatttggtacaggtcggtgtaattaaatgatttttggaacatataaattgaattgttaaagcactgaaaagggacggccatttcggcattttccatcggcggaacaaattcttgattatggccaaaaaagcatgggtgaaggtcaccagcagcagcagcggaggatgaattgtgacgagggaggacggcggataaacggggccaagggccaaaagagaggggcgacggcgaacattttgggcattttggcactttgggcattcattcggacgacggaggcaaaacttaccaattggggagcaatgacagcataaaattggacaaaaaatatgggtaaccaaaaaaataattaattaattgtaaaaattgtcttgtggatttatgaccgccgaaatttgcatttaattttcaataataattctatcaaaaaaattatagggtcataaaactaccaaaatattttattttattttgtgttgaattgtaaatttatttccttttaattgcgggtaaataaatgattaattattaatttgattaattcgaaagtttggacgattagcgaaatgaaatcaaggacagactcttcaatttaatttccaaatcattacaaattaatttggcgaacgtttttttattataaatttaaccatttgatttaaatttttcggcttattggttactaatttttaattgcgaaatgttttaattgttttttaattttgtccttggtttgattgacggtttctgccaataaaaccaattatcaaaaaattgttaaatgaaaattctgcaagaacactgaggaaaaaagcggcgaatttctttcgttttcctttcactgctctttcaatgatcagcagcgaaaatcaaaaagtgagtgataaatcaaataattaacctttggtattcgttttatttctaaataatttccggttattttttgcaaatcaaacgaaaaaaattgacaatttttgtaaaaaattgcgcaatatgttgaaatttatattcacttaattgtgtaaatgaggtgagatgaactttttgacggaaattgtcaacaaaaaataaaaaatttatagagacaaatgattgctaatctttgaagaaaattggcaagaaaaggagccggcggggcggggcgaaaaggggggagggggtaattaagggagtgataaaaggggaaggggtaattagcggggggtgggcagaagaaaaaagaaacaaaggccaactccgtaaacaattgcgaaacaaaaatgaatttcgtcggttgactactcatttgttaattcagccaattaattaccgagtgaatgggcaaatgacccctcctcccccccgccctttcctataaattcgcactcattagcattatcactcaactcattattgcatttacccaccattcactcattcgttcattattctctgttctcgcaacaccaaaaatcagtcacatgagaccaaagcaaacggcgattgtttcctttgccgttgccggacggacggacggacgggacggaagcccccccccccgcggtgctcacctgatcattgtgctgatatgacaacagtcattagtcacgcaaatgagcttgccgaatttacccaccgcactctttcctttttagccgccccccccc

SEQ ID NO: 9179 - DNA, 1343 bp, Heterodera glycines
gatgagaattaggagtcgttgggaaatttaagtattttaaaaataatttgatattgtagcaatttttggcatttctataaaaaatttaaaaaatggaaaacaatgaaaaccctcagaatatacccaactatttttttagccaaattcctaataatatttgactattaactgattttgtttgtcttaatataaattgttgaaactttaagcagaactataaactacatcatgcattgataaatttagtaattttaaataaattaaaatgataatgaacaaaagcacaaacaaaaaaccaatacaaaggcaaataatcacattttttttctaaattttattattacactaattactacctgctgattgttgatgatatgataatgtttcgctttctaaaaagtgatgaaattggtccaatgaaaaaataaataaaaatgatgctaacaataagtcgaacctaaaaagtatcaatggaaataatatttaaatttaatcattattttatgtgtatttgctgaataataatatatcataagttagctcaaacttattcaaattaaacaatcttgatattgagcgataggttaaaaattagcaaaaatttataaaaagttgtgttgtaacaaaaaaattcctaaaatttagactcaataattttgtccctgacctttttgaaactcaataaataattttgaaatttaacagacgaattgagaaatctttgggctatcatatcaatatcgtaaaaagtgatatatatgacttaattgaagtttcaacaattttcatgcatttaaacgacattgcatttttgtatcaccataaaaatatgacacaatttattcatgcgtaattttttactgaaacaaacaattttaattttcttttatatgtattgatagctcaaaattttctcgataattggttaaagtctaaaattttttattgagttaaaaaaagttagggacaaatattcagtctaaattttacaatttcggttacaactttgaaaatttttgcaaaaacatataaaatagtagaggacacaaaaagttttaattgtttagattgaataacttttttaggttcggatcagcaccataaaaattgttgaaactgctaattgtcatcctgcacaaagacataaattttcatagaaagagtgatagtttcccttaatgttttgataaaatatattttttaattacatcattttatgcgtttttatcgccgtttggctccaatcggaaatttgtcaatgtgaaattcacattaataaaatacaaattcacatgtctatgtataattttaaaaggatgcatatgaaaaataacaaaaaatta

SEQ ID NO: 9180 - DNA, 1092 bp, Heterodera glycines
aattaaaataatttgtaaattattgaaatcattttttaccccacacccgaaaatttttgagccactcatgttgtttggccacctctatttgtcaaatatccacgaaacccggagagttgcccactgttggttgaacggcaatgccgaaaccaattcatggacaagttcaacggaacaaaacgacggcagtttttcatttttgggttattttttagtgttacaatcgaaaaattacataattagttactgaatgggaatgaattttacaattattgacgggataaactgtcttttagcacaaccttttttttgttgaccctccccaaatgataagagaaattgaccactttacaagataaatatgaaatattattaaaaatacacaaatacgttttgtattttttgaattttattgcctagaatttatgataaatttattataaatcttttagcttaaaattttttatttataaatcaatttgtatcgaaaaagaaaaaaaaattaaaaaatccgtatccgtatacggatccgtatttttcttagatacggattttttacggagtacggattttattccgtaagtccgtaatcctgatccgtattttcccaaaataccgctctctatttttttagagaaaattcgatgtgaagcgttaaaattgtggtgttctgttaatcctggcgtttattcaaatttttttgccagccaattttttatttttttttttcttattttcatttgcaatcggtttacctcagttcggcaccagctaatttttttgactataacttttttctttgccaacaacatccaacattgttggtatcattcgaagcttaatatgttcagaagctttttctattattcgaggcttaatatgttccgatttacgattagacaatttataaaaaaagttataggcacatgaaaattgcgaaaagttgaaatttttgaagttttttttaataaaattttttgaaggcttaaaaatcttttcgcttttgtaaggctaatagagcacgtgtgaagagcttttgaatgataccaacaatgtggatttgattacaaagaaaaaagttattaatcgaaa

SEQ ID NO: 9181 - DNA, 2132 bp, Heterodera glycines
  misc_feature (2083)..(2083): n is a, c, g, or t
tcaaaaaatttggacgttggttgaagaaatcaaaagctatggttaaattattggaattgcttattttattttctaacttaaggtaaaggcatgtgcggattacaaaagcgacatctctcggcttattcggcgtgttccattggcttggatgcgcattgatgaggcgggaagattcttgaaaggtgtgtttcacaaattttgagatgatttcggctcattttgatctcacatttccaaattttattccctttcattttagtggtcaaagaattttcacagaattttccgactgtccgaggcttattgccatctccatcaaacgagacggtaaacatcagcagaaaacattgtgtaaattaattaattttcaaatttcctttttttagttggacgagcttttgcggtgcgctcgtgaatcggttaaaattttgatcgaatcggacgccgtcacggactatgacatgacgatgcttcgtgggggtgagttcgatgagattaatgtgctttatttaaaaaatacatttcgcacttcgggtcgttaagccggatggcatggaagggtcctgggatttttggttttacctccttttttacttatcacgccaatttttgtgcctttttaagaatttggttaaatttgagtgagtgagtgagatggaggagcggggggggggggtaccaaaaaggaaaaccggaaattttaagcgtaaaataccctctcccccatgggatcttcccaactggctggtagttcatgtcaattggtaccaatgaatttacaaaatttggtacactaataaacttttagcttaattttaaaagttttttgttgtttcagcccttttcggcatctattactacgtcatgtaccactttccgacgcctgcctaatttttgatgagagattttattgtggacgaaaagaaaaacaaattgttgttgatttctctgttgatcctgttaaattttatgcaattgagataaatttctcaaattaatcctatagactaaagtgtgacatcaaaattttcgactgacctgccctcaccccggtagaatgttgttttaaattgtttttttgacaaatgagacaaataagtcagcgatggcattcacatcttaatgaggcaaaatgccatctccgacgaatggctgggaaattctgacaataaatttaccgttgtccacccaatcttatgggcgttggcatttctttcatttccccgttttccaacgaattttcccatttttcaatgaatcgaaaaattaaagtacacaacttagagtgagcatatacaaaacaataaatgatgttttattcaaaggcactgaaatgaagacaaaaaagtgaattatcggctgaaaacaccgagaaaatgggcataatttgttgagcgccaataatttgggtgacaataatcgaatcaaaatttgaaacggatcaaaaattatttactgtattttttggtatgggcactcaactgacgagttcatgggaaaagtttggcttaatatctgcggaacagatcagcatcaaagttggcaaaacttctaattgcttactcattgatttccacccgaattaaatttgcgttttaattgcctctttaatttgtccaactttggttatctgatctaattcctcttccggcattaccaactgataatttttgatctctgatcagtgtgtgatcggattgtgtacatatcattcattgatcttttgccagatcactatcgcattctgctcctgatcccattccattcactgatcacgtccccgccgcgtttttgtgccaatgattgtcgccgcctgttgctggcgttgacccgcgatatttgtcgccggcggagcgtttgcgcccggtggcggcggtggatcatggcgcggcggtgcgccacgacgaccgcgaccaatgccactgccaacgcttgctggcccactgtcgcccctctcgtccgccagcgtagcggcgagcattgcaacgcgaccaccgccgtctccgccgccaccgttggcactcgcgcgtgccatctgttgtggactgtgctccaccgatgaacacattgtgtcctgcattgngtcaccaccagtgtggttgtcgtcaatggcaccactactgaggccattt

SEQ ID NO: 9182 - DNA, 3440 bp, Heterodera glycines
aaattaacccattaataagtttggattagcgatggcaacccgcatatcacaaaaaacaataacaacacataaccccaccaaccgggtggacaacgcgtcgcttttgtggctgctgctgctgcttttgtttgtccaccgcgcgagcgccgccgccatttccgccccggctgttccgtctccgtaccagcaacaggttgtaggtagcagctgcagctcgcttctgctgtcctcaccactaccaccagcacgcttcagttgttgttgctgtgattgctgttgctggggcgaaaactcgccaccgctgccgcttcggtcgccagcctcctctgatgaacagtcgctgctcgccgatgtcgtagtcgttgttgtggttgtcgtggttgtggacgagtcagcgactgggtggtggctgccaacgactgcgcgtgcctcagtcgccgtgtccgtgtgctgtccggcaccgccgccgccgcgtcgctgctgaccactcgccgttgccgctgtgtcgcttggcattgttgtcgctgctgtgcgagcgcaggcgctgccatcgccgccgacgctaccaccactgtaaatgccagccgatgcgaccattgtggcacgcgattcgggccttcaaaataaaagagccaaattaaaaattctgtacttgagaggtgcactacgcttcctccctcccgtatcgttcttcccccctccccaaaaaaaaaagaaattttaaaccatcagttgaatccctggtactgtaccagggtttttcttaagcgggacatgaaaaagttccaggagtcggttcaggaaggcgaaaaaattattttcaggtcgagaattggtgagaagaaaaaaatgtgatccctgcggcaaccccctgtactgtaggtactgtataccgttgaatttaccagaattttcgtttttacccctcccccctcccttcccccgtccgcttgaaatgcacttacgacagggtgcactgctccaatgccttgggcatgcgtcgggccaccgccgcggcatcgctctgtgccattttgcgcgtgatcagctccacgttgtacgggcgtggaccagcctgttgtgcgtccagcatgtattcaacgtccgatttggtgatggtctgctgttgtttgctggaaaaaaatgggaaaagaaatggcaaaatttgtgccgtttttttatttttaattactttttgcaacatcgtaacagcatgaaaagcatggcacacacgccgaacacaagcagtacactgatggccaacagagtctgtagaaatgaacaattattaaatccattagagataattatggcataattatccccctcatttaagtggcgataaatcttccgagggtcgtatttgccaatcgctgaattatttgaaggaaaaaggtaaattaaaaaaatcggtatgataattagcgatttgatactgaaagtggaaaagcgcaatttgccccaatgactaattagatgcaatttcgtcaggatcatttggtgattgtcctaggatttccatcctcgaaatcatgaccttttccaggatgtcaggatgtgaaggtcatttgattgcccttggatttccatcctcgaaaatcatgacccatgtgaaggtaatttgattgcccttggatttccataaggactgtgtacacagagaggcatccaaggataaagtcagattttttccagtgcttgagaatccgattttcagcttatcaaatttgaatggataaatcagaatgccagaaaaaccaaaaacttacaatttccgctgttgtcaaacggaatgtgctgttgttgtgctccatggcaccggtgtagtcctccggcacataaatgctggtcaaatagcgcaggggtgagtcggccgccacagtctcagccccggcaggaggcgttgacgacgcggagcggccaccagcagcagcagcgccaaacgcgccgtcaagcagtctgtgaacaggggggggggataatgatgtcattgggtctcgagactctcgaacagtgctgcaagcaattactgggaattatggcgttttctagaccccataactacggatgacggattaacatattttggtccataaatagaagattagataatttttcgagctaatttcttgcatgattttttttcaaatagtcaaaggcttttttctaatttgatttaaagagaatatctgtaaattcatattttaacggatttccaaaagaaagggttttttagttgaaaattatggattatgaaatgaccgcctttttgggccttctacaattatgttttcttaattgaaaaatagccgtaattacggattaaaaaattgtgtatactctttgagttttgccgccggaaccggcaagcgcgtgcgcgagtcaaccgcgtacaccagcagatgggtgcgtcgtgggtccgcttgcccgtcctcaccgatgaacacctgcttgaccagcacatccgcacccatgccgggcagcatcgcgttcatgtgcctgagatttggatgtgagattgatcggcatagtgattagaatatttgacgggcggcgatgatcagaaaataatgaggaacacgagacataccgaacagcatgaagaacgtccacctgatcagctggttgattgatcaccaatagcacaatgtttgtacccggctggagtttgtatatctgatcaaaatgggggtgcattgtcaggattaaaatttgaaaaaatgggtaatcccagctgccaaaatgatcgtcggggattggtcccatctggtcattgatcagagcttgaagtacccattcaatttttgattacaagcagtccattgtctgtgttagactccagtaagtaccaaaaaatcggttatcgtaacccgtgatggtttacagtactcggaattttgatcaaaaacttccaaattgatcactgactaaaagtggcgctttggcgacgtgtcgcccgtcattgaccagcacattcatacaaaattcatcaccagcagatgtgccatcatcattttggaagcttctgttgaaaaagtgtataggatttgcaaattgtgaaaaattaaaatgacaaatctagagtcacccccaaactcaccaaacccaactcatccatagacccaactcatccatacccaactcatccatagacccaactcatccatacccaactcatccataacgctgcgagttatcgtcgtggcatggcattttctgcttatgtggtcgtggcatggcattttctgcttatgtggtcttgaccgtggcattttttggttgtacggtcttagtcgtggcattaaatgccacggcgacgactcgtatcgtgctatggatgagttgggtatggatgagttgggcatggatgagttgggtatggatgagttgggtatatggatgagttgggcatggatgagttgggtatggatgagttgggt

SEQ ID NO: 9183 - DNA, 3493 bp, Heterodera glycines
tttatcccccagtcagcttcttcattacattcatttttgattttgtaaatccttttctttttctcagctctccgctgtttcttctctgaccaaagtccaaattgatcagttcaattcggtccctcagcttcatttcaccttccaaagtgtccaaatgaccgttttggcctttgttgtgcccgggttggccaatcttcggcccgacgaatcattcgatggccgtcaaattgacagaattttgcaaaaatttggcgacgaaattgagaaactgatcagagaagatcacttatttgacgaagggcaatttcgaagcagcaaaagcataaacagccaaacgatggaattgctgagcaacgctttggcattcgcaagtcgaaaagagcggaacattttaaatattaatttaattttaaattaaaatattaaaattattttaaatattattttattaagaaacaaatgaagaaatgccgcaaataatggcacaacgtgaaatgttcagccaatttgacgaaatgttaacgaaagatagacaaaaggcacttcagaaaagagaaatggtgaagcatttggtgatcggaatgaaaacattcgcaagtgaacaaaagaaaaaataaaaaaacaaataaataaaatttagattttggaaacattttcaaaattttggaaatgatttcggacaaaaatgacataaaaactgaggaaaatggcacagaaaatagggaattgatcagcaaattcagtggaagcgaaatggtcaaaagattcagcgtcactttggcatacgtcgaaacttggacaaaatgtcttttttctttttaaattgaatttttaaaaatccatttaagccaattacattaatgagcaaacaattggttttttggatttcaatttgttgtttgtaatggtggcgaaggttttccttttgtatccaaatgcgacggttccaacgctaatcgaaaaattctttgtcacttattcgacatggtaagtcaaaataaatttattttaaaattgtaaaatgccaggaaatggccaatgccaattcaattggcacaaacggacttcactcagaagggcgaatttctgagttggacgccgggccgagaacacttcgtaaagaggcaattttcgccaagaccaatgctcagactgatccgacccgtcctggccatggctatcattaccccaacattccccgagcaaaacttggcacagaatgccaatctttccacccaaaagtgcctaagaaatcatatgacaaaaggtaaattatttgagaaaaaatagttcaattaaatcataaaaaattaattccatttttagctttggcaaaaatacgaaacggaaatgaccaacaaaaggcattgtttgctcctttggagtccaaaacatttctcactatggtggggcgtttgtttgttgttgagatatttgtgggcaaaattatggcgacgccaaaacaaattgggcacttttagcaaattttgccatttcccccgggggatttttttgttaattttaatgaatttttattgcaattgggtaatgttttccgctaatttagtacgaacatttcattgtggtcacatgcacagcaagccaattccaaattgagcagttcagtgatttcgttggccaacgcattgggacggagttaaccgaaattgttgaagaccctctgaaaaaatggatcaaattttgccatttgttccccgctcggatttcggtgggccaatgcaatgggccaaattcgcagaattctcagaaaaagtaaaaagaaatatgtatgataaatataaaatattggataaataaactcaaaaaatagaaaaataatataaaaataaaattaagcggctgtaataaaatttggctgattggaattgaaatgaacgaatcgccaaaggaaatgagcaaatttaagagcaaaataaaggcaaatctaaagaagaaatttgacgagaaaataagcaaagatttcggcggatattctgctcagattgaatcggaatatgtggacgaaaggggaagaattgagcaaatatttgggtaataataagaaaaaaataaaattaaattaaaatgattttttattattttaggggaataaactcacaaattatttaagagaatgggggaaaggattagaaagatttaacaaaacatacctgaagatttgtttatccctttttttaatttattttttagtatttggggatacggtcatgcacagtatgccatccgccttttccatttcattttacaaaaataaaatactcactcatcactcccttttttgttttgtgtaattttggttgttttaattgttgttcattttttttgatcatttggccatttgattgttttggccattttggtcaactttcgttcttcgataaatgcgacaagaaatgcaaaaacaaaaatattttttagttattaggtaattaattaattctgactcgggagttattgttttggttaattttctgttgatcaaaattagtgttccaaaccacgagtgcttcccatttcattaaattttgttgatattttcgtccgatcactctccgccgtcgttcgtttgatttttgatccgccgatcgtgcctttattttcgtgctaaacgctcttcataaaaagagtcgcaatttgcactaaatctcacaatgaatcccttatttttttgtaaaattattattttattaattttaatattttatgttaatagatcaatgaatattcgttccaatttcgtcctctttttcttcatcgttttaacactttttgcgctctctcgcggagttccgctcgacgaaggcgttgacgaggagggactgtaagagaaaccatttaaaagttcacgagaatatgccactccattaaatagatctgatttaaagcatttaggcaatggtaattatctgttgaacttttatatgcttttgcagtgatttgaagccggtgcctgcctcaaaagtgacggaccgtgccgaacgcatcgcgcgacgatgcgttcgatgtaagcggcacggatggggccgatggagcagctcaaattggggctggggctgatcagcattaacggaaattgagaatgtggaagtgacaataaatacactcttctatgaatggatgcattcttttggaacatttgttagtttttttggatgataaaaattattcaaataaatcaaataaaattgtggtaatatttctgaatggttaaaaatatgaaaattttttatgttgggcttaattgaaaattttaaatactagcggggtcagcgccttcggcgcatctcccgctaggcagtacgattgtgttatagaattatgaatgataaaatcgactggctcggccgcttcgcgccctcgcatcatttttttggcttttctccaatctctgggactcaacccaccagcaattcaatctctgggactcaattctccggcattccaatctctgggactcaaatctgcggcattc

SEQ ID NO: 9184 - DNA, 904 bp, Heterodera glycines
ccccacaattttctgcgccaatccaccatcatttaatcactgggactcaacccaccaacattccaatcaacgggactcaatccaccagcatttcaatcagtgggactcaattcttctgcatttcaatcactgggactctattctcctgcgtttcaatcactgggactctattctcctgcgtttcaatcaaaaggactcaatccaccgcattcaatcactggaactcaacccaccaacattccaatcactgagactcaatccaccaacattccaatcagtgggactcaacccaccaacattccaatcaacaggactcaaccctccagcattcaatcactgggactcaacccaccaacattccaatcaacaggactcaaccctccagcatttcaatcagtggaactcaatccaccaacattccaatcaacgggactcaatccaccagcatttcaatcagtgggactcaatccaccaacattccaatcaacgggactcaatccaccaacatttcaatcgccgggactcaaccctccagcattcaatcactgggactcaacccaccaacattccaatcaacaggactcaaccctccagcattcaatcactgggactcaacccaccagcattccaatcgccgggacccaactcacagcattccaatcactacgactcaacccacagcatttcaatcgccaggactcaagcaaccatcgttccaatcgccgggactcaacccaccagcattccaatcactgggactcaacccaccagcattccaatcactgggactcaacccaccaacattccaatcaacaggactcaaccctccagcattcaatcactgggactcaacccaccagcattacaagcactgggactcaatccatcatcgttccaatcgccg

SEQ ID NO: 9185 - DNA, 1351 bp, Heterodera glycines
cgaaaacactttgggctccacgcagagcatgaaaaatgtcttcggtccgcggaaggggatgcctgttcaactccagcgcatcgtttagtcccgtagaaaagtcaatgcaaatccgcacattaccacttttcttacgaactgccaaaacgggagctgcccagcgcgaaaaatcaatgggcttcagcactcccgagtccaaaagtcggtccaattcttcgtcgactgctgcttgaactccatgcggcacaggtcgcgcacggcagagcactggcttcacattttgcttcaaatgcagcgtggccttcgtcttcacacaatgtccgaggccaggttgaaacaccttcgggaaggaagccttgatttgcccctccaatttgaccggatcatttgttggttgcacactgttgacaatgagcgactgctgctccaaagtcgtggcaattggctgttgggtggcacgctcgaaagggatgatccaatccaatcccatgatgctcggcgcttcggtgtctgccactgaaagttcaagccgcattgtgactcctctgaacagaacgtcacacttgaaacttcccaacaacttcaatttgtggcccgaaaaggaacccataatttaccaactttttccaacctcggttcacccaaactttgccaaaccggaagctgtatgatcgacaaatgtgaacacgaatgggctgcaagtttgatctggtggccattgacttgtaatgaaatccatatccattctttggtcgcaccattcacactgaaagtcgaaaccacgacgtgtgattgaacacgtggatgagctgaattggggcaaatatttctcgtgtgcccttgctttcgacatccaaaacatttgacgtccacaggaaatgaacagtctcgcaccgcgtgtgcttgaccacaccgcttacacttttgactaactggtgcctgagaatgttgatatttacctgtaaatgttttggtagcatttgaatttcccgaatttggttgcttaggacgaaaattgttgggtttggaatgctttttgaagacccatccccaagtttttgtggtcgggttgaaattgcatggacttggcctggatttgcgagcgcagcggacgagtttttgagcgacagtatggcgcggcactcctcgagaagcttttccagcttaatgtcctgaggcggcgttgcggctcttgccttttccaactgccggaggcactcctaccgcaagtccttatgtgcgtctgtcaacctgaaatgaagatcatgcacttgacttcctctttcgacagagtcatttcggctcgctcgcaacgggcgttgacaatcgcgccaaagtccagcacgttttg

SEQ ID NO: 9186 - DNA, 2417 bp, Heterodera glycines
gtttttgttgtgcgtccaaaatagcttttagctcctctttgtcgtcattttaccagatcagacagaagatgaatgatagatgagacaaagataaagttttaaaagcttgccactagcaaaatttggcaaaaacgaatccacacatagcttttctcagtcaaaatactgagaaactcttcgggctacgacagatggtgaataacttgtttgttatgggttatgtgaggggccgtcagagtcgcttttttggtgaattcacggttaagcgcaaaaatgcacgggcgtcgccagttgttgtgttttgctaacacacaaacaagataaatttattaaatgaataaacaataaaattagaatcacaaaataataataaaataacgacggagtcaaattagagagtccggaaataaacaccgaattgcaaaataacacaaatgcaaagaatgagtcgatgggagaggacccatcaacaaataactaatcaataaaagtattcgtgtcgaaacttaataatattaaatatcaacacatccaacatatgaaaaaaaaactattttttaaatttaaataatatattgaaaagccgaaaaaagatcaatttttcgtcttaaattaatacacgaagtaattttgttaaataatgcattaattcctttatagatattttaaaatttaatttataatccacaataattttcattcagagaatgaaaataatattttgatttaataaacattaaatttatctaaaaattttaatataaattataaagcctttgtttttaatatatataagctaaattcagttttcaaaccatcattttggtcatacatagctatgaaaaattaaatttgataaaaaatggagaagatggaactctggaacaagagaataacaaaaaagaatttaaaagtacgtaataaataatagtaagtttgaaaaaataaaataaaaccttcaaacaaaattaaactaaaaaaccaaaaataaaatcaattagttttttcaacaaaaagataaaagtagatacaaactaccacccaaattaattattacattgtatcatttattacggtgtaattgtagaaaatatgataaataaattttaaaacaaaatctaaatgaaataaattgaacatgagaaagttcattaattaaaatacttcttctataagttcattgcgataaacaataattcattgaaaatttaacctgagcataacaaggcagattgaacaagctaagagattttgccaagagaaaataaaatattcggccgtttacctaaatatatataatagttgaaaaatttagtcagaatttattaaaaaatctccctattataaataaagcaaataagcatagaagaagctataggattcaattgaattaaaaataaaatttataataataaaattacaaaaaaaagaaaatattttaataaaacaaaaaagtaaatttaataattgcatgatttaagcatattttctacataaacaatataattcgcccaaaagaaattatgtaaatttatttttttttaaagaatttacattaacaatttaatgcttatattttatggtcattgtcaacatttttttttcaatttatcaattaaaattatcttctgtgatatttgacctcgtttttaatttaaataattaatttgtggcattttgtctatttaattttgttccccttctaaatttttttgttttctcagtgcttttctcatattatattttggcttcaaaatgatggtaattttattctcatcgctctccccgacttttgatttttattgaattaaatttgttctgttttgtgctgtggactttaatttgtgttggagatacacttttggttttaattgtttgagtgcaattcttttttgttaattttggttgacgacgaacggggacgagaagtgaattcggaggagaagagaagagcccgaaaaagccccgcatttgtgttctcccccattttcttcaaatattttcgacgtggcgctcctgcttttctgggtaagctcagcgacgggatttgattcgattttcggttttcaacaaaaagggagcaaaagtgggaagtaaattgggattgagcgcattttgaggaaaattagtgattcacagggtgaacactaaacaatttgattgctgtcattcgaaagatagatccacaggttgggctatcagattttgaatttgttatcggatcaactcgccgtttttcttcacactcgccatttttgttttgttccgcagtacggacaaagcacaactcaacgattttgtttcaacagcgacactctcagtaaggggttgcaacaaaactgcatcaaaagcgacactctcagaaaggggttgcgccacacagattgtggttattgaaattcagtggataaaggaaa

SEQ ID NO: 9187 - DNA, 2431 bp, Heterodera glycines
  misc_feature (23)..(24): n is a, c, g, or t
  misc_feature (45)..(45): n is a, c, g, or t
  misc_feature (56)..(56): n is a, c, g, or t
  misc_feature (60)..(61): n is a, c, g, or t
tcgagagcttgaactgtaccgtnngttatattctctgtcatatanaatctcataanagtnntctcaacagtactgtaaggaaaaatataataaactcacccggatctgattcgaaaataatcaatgtgatattgacctcgtttttaatttaaataattaatttgtggcattttgtctatttaattttgttccacttctaaattttttttgttttctcagtgttttctcatattatattttggcttcaaaatgatggtaatttattctcatcgctctccgactttcgaatttttattgaattaaatttgttctgttttgtgctgtggactttaatttgtgttggagatacacttttggttttaattgtttgagtgcaattcttttttgttaattttggttgacgacgaacggggacgagaagtgaattcggaggagaagagaagagcccgcaaaagccctgcatttgtgttctccctcattttcttcgaatattttcgacgtggcgctcctgcttttctgggtaagctcagcgacgggatttgattcgattttcggttttcaacaaaaagggagcaaaagtgggaagtaaattgggattgagcgcattttgaggaaaattagtgattcacagggtgaacactaaacaatttgattgctgtcattcgaaagatagatccacaggttgggctatcagattttgaatttgttatcggatcaactcgccgtttttcttcacactcgccatttttgttttgttccgcagtacggacaaagcacaactcaacgattttgtttcaacagcgacactctcagtaaggggttgcaacaaaactgcatcaaaagcgacactctcagaaaggggttgcgccacacagattgtggttatttgaaattcagtggataaaggaaaaaattgttgaaaaatgataattcgttcaccgcgtagaaatccatttccaaggcgtttggctggagaaaatccagagcaacggaggaatgagaacaatttagaaaacgaagcaaatgcattcgtttttccagaacagaacgaaggaaacaatccgcaaaacagccgaaacaaccagcattcacgacaaatgatgggagaggaagaaattcaccgcgcacttttggacgtgaatggtcagcagaacgagcagaaccaacagctcaacgcagacgaggagcaccgccttttggatcaaagtaatttgaatgtgctggcaaatttgggtggaaatttcgacgcaaatttgggaaacaatcggcaaactgaagttgctgcaaatatggcgcagcgtcaaaacaattttgtgacgtccacgcccaacattagtcccggtcaccaggcgcgacaaaattttaattttgttaacaaccgcgttaacaggcgcgttgtagataggcctagggatgcactcggacgttttattcgtattgaaaataacaatgagcaagaaatgccaaattttttgcaaaatccaccgcggaacccgcaaattccgccagtaaatcagcagcagggtaacaatttgggaaatttcggaatcccaaacaaccccaatctcatgcaaccgttacaattcggtatgaacggcatgtatgcgccagtcgcttggcctcaacaaccgatgatggcttatccaccaccaaattttcaaatgttttgtccgccaaattttgttccacaaatgccggttcaaaattttgtgccatttatgaataatttggcaccaaatgcgtttcaaccacaaattcctcaaaacgcaattcaaccaatgagagctcagccaacaaatgttgtgcaacaacagcaaaatccgccgctgacaaatcaggcgatagcacaacacaaccctcagcaggaggtgatccggcaaccaacagggttaagtggcattgaatatgctatgatcctggacaggctgcccgacattaaaggaaacgagggaagtgattcgatccgcaactttttcaaaaaattttcacaatatacgagtgaatggccaaacaaaaagcgaatcgaatcattagaagccaaattgagtggccgagccgaacgtgcctacaatgctgctttagcgacagagccgttcgcgtacgaaaacatcaaacgaaacattttgcagcagttggaagaaacggattgtagggagatgagtgcttttgacgacctcatgaacggtgtgtacagaaaatcgggggaaaacttagacgatttggcaaatcggatttcgggtttggtgcgtagagcgtacccgggattaacccaaaatttgtccgatgattattccatcaaacatctgatccgcagcttaaacaaccccgagctcgctctaagtttggagttgcatcgccgatccggcatgagcttcgacgagtttgtggctttggcttcacgagccgagacaacacaaagggcagcgaaaag

SEQ ID NO: 9188 - DNA, 944 bp, Heterodera glycines
  misc_feature (62)..(62): n is a, c, g, or t
  misc_feature (887)..(887): n is a, c, g, or t
attgatcagcaattgacaattgctaatcaatcatcctactagataatcagtgcttgatcagnttgtattctttctctattatttgttgatgtccgttcaattcagtgtgatcggagtcgtccaaatggtcaacaaacgcagcggagtggcattcactcaaatcgacgaagaagcctttgaaacattcgctatttattgtggtctcgcgttgcaccacgccaaactgtacgagaagatcaaacggtcggaacaggctagttttcgtctgcttaatttattttccatttgtccggttttacttttgtcccttttggcatttccttttggcttttccttctggcatttccttttggcatttccttttggcttttcctttttcatttgtcccttttggcatttccttttggcttttcctttttcatttgtcctttttggcatttccttttggctttttccttttgtcccttttgccttttccttttccattggtttcttttggcattttctttctgaattttcccatttgttttttcaattcagaaatatcgcgttgccctggaggtgttggcttaccacagcgtgtgtaaccgtgacgagttgaacaagctgaagaaggtgaagctgcgcgacaaaatccccgagttggacctgtaatgaatcaatgcccccccttcccaaatgcgtttggtttgttcagtttcgagttcaacggaaaccgtttgtccgagttggagaagccgttgtacgccgtttacatgttcagaactctgttcgacggagtgatgtaatccctcccaatccttctcctttcccccccccttctcttttcattttgtaattcatagctattcattttcgtcagttcgtacgatgctgatgatctgatncagattatgctacccgtgcgcaaaaactaccgcaaagtcccttaccataattggacc

SEQ ID NO: 9189 - DNA, 2999 bp, Heterodera glycines
ttgaataaatcccaaattaataggaaattcatgcccatttccaaattaggacgggcacaacgttctaaaatcgctgagctcgtccgattacaaaagagctttgagcacaattcggcactgcattttggccaccgatttggcacttttcttcccgaacaaaggccaactcagtgccatcgtcaaagaaggcattttcagttgggaagacgacaaacacaggcaaaagagaaatgctttaaaggtgcagaagagtttgtttggttttcaggtgcctcgtccaggccattctgatgacggcttgcgatttgatagcaacagcaaagccatggcaagtgcaaacggagacggtcaaagtgatcttcgaagagttttacgagcaagtcggtgaagggagtcaaacacagccaaatgatggcaatttgttggaaagggcgacgccgagcgactgaacgggcgcgaacccatcccaatgatggaccggaacagggcacatgaactgccgcagatgcaggtgaaacgcggggggggggtgaagcggcaccggccaaccgcgcactgttcaggtgggcttcatgaggggcatttgcatcccgtgctacgaagtgttggccgatgtaatacccgaggcggaaaagctaagggagcgctcgaagtgatcggaatcactgatagtggccgaacaatcgaccgatgttggcacgtttaggtacaatgccaccaaatgggaggagatggccgaggaacagaagcgcattcgggaagcggcgatgaagaaggaagaaaccgcactgagcaatggggactgatcagcaacagaataactgattttacgaagggggtccgcttgacatgtaaatcgacgagctttttctttttttttgctttccaaacaacttttttcggcactctttttccaaagaaccttttgggtccgatggtggcgataggcgccgccggggaaatctttgaaaatttgagagtgtaatttgtttaacagattttcaccaaaaaatgataaatttttgcgattttgagcaaaattttgaaggaaaattggggaccatatgtgccgataggagccgccgggatttttaagaatttttatgaatttgcttagagaaaattatgggaaattaatctcagagataaataacaccaaatgaacattgaattgattgatcgggggatggattggggaaaaatggcacacaaaaagaaaagccattccaaaatgagagcatttgtgatggaatttgcatttgataagtcactcaatttaatttgtatgtttaaaaagtagaccatttactgctgctgtggtgtgactgacaattcaatcatttcggcttttgatcaaattcaaaagggtggtctggcgatccgaccgttcatccgtcacttccccctaatgaggctgttaaataatgtaaatgcaaaagttggacttgaaggaaggaagtgaagctgacggattaattaatatgcattaggcgaaagatgctataaacggacgttgtcgaatttatgtgaaaatgggaaactgcagctgatcgtgacggctaatgtgtccggtttttctgctccgtccaaaattgcaattagcaaattgccccaggcaaatgcccattaatttgccattagcatcgcatataaatttggttcggttgtcaaaaaataaattattttttcttttatattttaaccgaaaatcttttaattttttttttgtttgtttgtttgtttttcaataaaatgtgaatggatacgaaaaaaattttgaatttggcggccgctctttcggtattttccttcggagccgtgctaattggggttcctttgatgttcgccgacatggccaaactgcaaatagaacaaaagcatcagcacaaattctatatggacatggtaaatcattcctaatgaaatggtgacaacgattaaagcaatatttttttaaagacagtgaaaatgtggcatgacattttgcagcaaaatgaggcgacacacgacaataccggcattttgatgagacaacgaaggcaatgttagtagcaatcattgctcaacattgctaataatgcataagctaaatgctttaagccaaaccgacaaattcgccgcaatgtgcgcaagggccaaagggaatgcccggaattccgggagagccaggtaattaacaaagtgaagaaaaacaccaaattacttctaaggccaagatggtcttcccggggttcaggggcagccgggaaatgcggcggttggcgggggatcgggcggagggtacggcgaaggagcgtcgccatcgcaatgtgtcccctggtgggggaggggggtggaggtgccttttcaaaggactttccaatttagcccgtcaggccctcccggaccgccggggtacaaaggcaaacgcggacagcgaggggaaaagggcggcaaaggtaaaggacaaaaaagtcattcgtaattgcatcatttgaaggaacccccggggcacccggaagagacggacaaattggtgagtgaaacaattagaaattgagttgaatgtttggcaaattgaaggtgatgaggggcccgagggggagatcggattgccaggggacattggccaaatggggccgaagggcgcgccgggtgaggacggcgtcggatacgcaaaaggagcccagggaccaaaaggcgaattaggcgccccgggagccgctggggaggagggaccgccgggggaaagaggcgaagacgcgtcgccaggtgagtacggacggagacttcagagagaataagcgcgatgcaattcaggcccgccaggagagttgggcccccagggacggcccggggaaaagggcaaaaacggagagacgggggcaacggggatcgccggaccaccaggcaagtggaagtgccgatgggacggatcaccaggagaccatttgaaggcaaagacgcggaatactgtccatatccggaacggtcgaacggacagagcatcccggccaaga

SEQ ID NO: 9190 - DNA, 2124 bp, Heterodera glycines
tcaaattgtcacgaaaacaactcatacaataaaacaaaattaaaacgatgattgttttcacccatttacaaaaattttgtacaaaaaaagccgacattttttcccttattttgtgttttgactatatttctctgtgatcagtgatcagagtaagtgattccccgcccttttgacgacaaattttcttatcggtaaataaaggcaaataacaaaattgaagtgagcattaaaacaattcaatgggtgaaatttaaagctgtttattgttggttaaaggccaaaatcgaattcgtattgcacctcgacgaggaaacgctcctggatttgatcttaaacggctttaattaaacagagaaagcaccgatccgaccaataataaataccgaggctatacacaacgaattcgttgtaaataagcgaagtttcgtcgtccgcttcggtgtttttaattggttttccacagggcacttcaacatctccgtcacttaaatgccaattctgattccccataaatgattgttgtgttcgtctttggctcacatcgttttccttccgtttggatgcggcacataatgcccgactcccctcacgctgttctttcccttcggcaatttttgatgcattttcgagtcggcctctttcagttcgaccgcctccccaagggcgacggcggaaagcaaaagaaagccgggctttttcggatcagagagagaataattggccgatttactcgaaatgtcttcaatgggatgaaaagggaaaaagcaaaaagagcacctgcaaagtaaagcccctttccgaacataaagccggtcttaattagatttgcatgattaattggtaatttgcgcctctctctcaccgacggcgcctcggggggtgcgattcgcaatcccttggccaaaatgctgtaccaattggcgaggcgagacccttaaagggcggacaatgccttcgaaaacgtttcaatccctctttggtcagtaccgtgccaaagcaactttcggttgccaattctgcccttttgctcattttgcgtctttcgcgtttcccctttccctttgtcattatttgcgcttttccgtttttcttcggcaccctttcttttttccccgtcgtccgccgtccctttgacgctcaattcaaaaatatttcgcactttcatccgatatttgtcgtgcgttggcccgtgcgtcccttgcaaatactcctccacaatctttgggggttaattcttttagtttttgtgttaaattccatttcactttgtaattcgcatcatctttttccaggggaatcaaatcccatcgcaaacgcgcgtaatggcattccaaagggtcggcgccaatgtttgaaacggtaatttcgatgccttaaaagcgggtttggcctgaaaatgacatcttttgtaaaaactcgcccgttagcatttccaacagttcgttttcccgcttcaattcctccggcgatttaattggcggcggcgttcgcatcccaaaactgtgcggaatgcgcgtgtaataactgaaagagaggggcactaaataacccgggtaaacataacggcggaggatcaactgttaggcccattttggtttttttttggattttcgtggggtttcccccccccattttctttgcttttcctcactcattcattgcctccacaaagtctctgccgaaagtccctttttgcacgtggcgctcaatgcggcccaatgcttcgtacccaaaacggagctgctctttggtgattttgccttgacatatttccatgggctttttggattccattaaaattggaccgtccccaaaaagattgccgccaatccgccaattagggctgctctagaaacctcggtctcgagtctcggaattttgactctcgaggagctctagcgccaacaaccggacaaacctggggcagcccaaaaaagcaaatagggctgaaaaacatgttttttaacgcgtaggccccaaaagctaaaaatgctgggattatcatggcttcaatccctcattaatcggaatgaaaagcaaatttcaaaattattgtatgttttcggtgtttgagttggtccgtttgtgttccatggcgcccatttggggacccccctcctatcg

SEQ ID NO: 9191 - DNA, 903 bp, Heterodera glycines
ccccccccaattgcccacccaatggaatccgtttgaagtcgtattccaattgccgtgcgtcgctttccatggcttttaagtcgcaaattgtgtccaaaagagttctgaccctttcgtccattttttctaatgccttcgcttcggtttttgcaacttttcttctcacttttgcgtccctttcggcttttttttattttttattttgtttttctatttcctatttgctcactttccgtcgtcacttctcgcgagtggtcaattttgattaggtcgtatttgccggcgacttttttgaactttttaatgtccgttaggaaatcattttgcgtctgaaattaattgcatgtaaaaggaaaagagcaaaaggacggattcgcttactttgtcagtgaattttctgtgaaataattccaacgctccgtcaaagtccgtcccaaaaggcaccaaattcgtctgtccctgacaatgaaaagaatttcctttattatttcctccaaaaatcactttgaatccgacgcggccccaccgaaaccaaacccaaaatttgttggccgccgtttggttgcacagcaattggatcagatagaatttgttgttgttctgctgaatgttcgtttggctgagcattacgtcgtagcaacggcccttcccatcgacgaacactttggcattcccccgcaattcggcacattcggcgtccaccgtcgcctcctccgattgcattttgtttctcttcgaaatgcgtccatccaaattttccttttcactgtcctttggcttttcccgatttgttcctccattttctgtgtctttctctttctttcgccgttttgtttttgtcgttttctgctccatttcctacatctttttgtccatttttctgcattttccaattattttttt

SEQ ID NO: 9192 - DNA, 6491 bp, Heterodera glycines
  misc_feature (58)..(58): n is a, c, g, or t
  misc_feature (6485)..(6485): n is a, c, g, or t
cagcgaccccaaaaaccctaaaaatcctaaattagactcattttgtttttataaattntgaaaaattttggacatttcgtggcttggacactttgtgggggtgccaaggaggaggaggagacaaattgccaagaaaattatatggcgaaacgttttaaaaaatttttgaatttgttaaatttttcttagaattacaaaaaaaacatttgatatgatgttatttgttcgttcttcattttacatacattttttatggaatcgtataaatttattttacttacagataattaaaatcatttaaaatggcaataaaattggaatttgccggagggcttgacgcaatttttaatgggaaacgcgagaccgaagctgaaaatgacaatatttcggtattattttttatctttgtgctttcataattctgcttcataattacataaattttaatttttaaaatttttctacgtgtgttaaataaaatttcaaattttattcattttgtcctttttcggactgttcgtcaattgttgcggtggctttcggacgggcccttgcggggcaatgatcggtcggaaatgctcatccaacgcgacaccgtcagaccgggcgttttggtgctgatcaacgacacggactgggaaattctgggcggagtatggcaaaaaataaaaacgaaagaaaattgtgcactcatttggtgtacatattttgtaaaaattcgggaatttagtttttttttttaaagtaatatttggccttattgcacagcgaaaatttgattttgttagggttcggacgaatgacgcgatttggcattcttttgactcaccattaaaaatggtcttttagtaaaaaaaaaaaattaagatggttaacccaattttcccaatattccttaccaaaaagggcaaaattttataaattttcatttgaatttaattgtttttgaaaatgcaatttttgccgtcttttttcagttggacgctcagctcaacggcggagacaaagtgacattcatttcgactttacacggcggataaaacagcaaaataattgaaaaataattcattcgttttttgtccatttttgcagaagcataaattataatttttaatcatttttcactattaaatttacatttcaatttttaaaaaatatttgtccattttatttgccttttttctcatttttattcataaaattccctagcaaatgaatgaatgccctgtccccgtgaaaagagtgcgtttcgatcatttcccaatttatgccgccgacgaccaccgacacaatcggcggcggccgtccccgcaatttcccttttttggcggcacatctaaaagaaatttgcacaggaagtgagaatggcatgaaggggatggcacatgcgggtgggtagtcgataattgtacggctattaagccattcattatcggacattgccaagggcaaacagtgacaagtgcaaacgcatttttaattgccatctcattttggttccgaaatcgaatgcactttcaaagatgttgaaacttttgaaagcaatttgggctgacccagtccaactaaattctatcgtgcattttgtgcccaaatgcgctgattgatgtgccaacttttgcaggatttgtgccgacctttggctggccattttccgctgtttgtccccggccgaactttggctgaaaattgcgctgctcagcggccgattcggtgctttggtgggcacccattttaagggccgaagagtgacaattggccacttcaacatccaacgcagcactttgtactcgctgcgcttctgtgcccaaattgtcaaagtgtacgccgacggagtcgcggaatattttccattgccgatcgacccgccgccgcgttacattgtcggcttccgggagatcaccattcggtgatcccaggcgaaaactaagggatttgcacaattagtccccatcaatgagaatgggagttggccattaattgaatcagtgggacggaacccggccgacggattaaatccgccatttaccgggggaactctttggaaattcccggcataatttctccatgccgttcattgtgctgtttgtaaaggtgcgtcgaccccgacgtgatggcctttctccgtctcattcggtctcttctctccccgggcgtttgcgtcagtttggggccgcttgacgaccaccagcgcagttggcaatttgtggtggagaagtcgctgctttggcctctgttggccccgtcaatcgtcagtttgggctgttacggtgccgaatgcctttccctgctgcgacggcacagttcgcccaccgttctgcgcgaactcactgcccttcgctctgtccgttcgggcgatttggtgcccggagggacggccgatgacagcgacggcacgactccctctgaccaagcgctgtccaaatggctgcacaccgtccgcccgggggacgacggacggcggccgaatttgctgcactgtcacaacttttgttgcatttcgaacattgacacaaaagtggaggaactcattgaagtgattgatgagcaattaatgaagcgcaaagtcagcaaacggcggaagaaaattgatcagagttggcaaaactgatcagagggcattttggttgaaaaggacagctttttgttttcgataattcattttctaatctctggtgagtgactgattaagtaatttctttcttccgccgagattgagactgatcattcccgccattatccaacctctcttttcgattttcccatgcgctttccctattcaattcaatgctaattattgccgccctttcgtaggcatttctccgtgccacttcgcccgttagttatgccatcgttcttcgtctgctaaaatatgccactgacattgagccatttgagacggaaaacgaaaggacgcgcgaacgaatggcattgagtcgacgaaatttgtccacgaattgcgacgaatggctgatcagacggggaccgattgacatggaagcgaaccgatgggcaaaatgggcggagcaaagtggcggagatggacttaatgtgatagtgatcgacatcagagaatgaggggaaggacagcaaaagaaggaatcggtcgaatgcccggggggggggaaactttgatgaatcgaacccggttttaatgactctgttttggtgccaacttttccactgctgaagaggggccttctctgtgattcaattgtctttgttttctttaatttctaattatttatgcatatacacaaatttaaggctttccatttgattttttcttaataaaaggaattactataaaaatttaaatttttcatcccagaaaaaccaaactaatcctaatttgaaacaaatacttttgaaaactttttcacctgtcccaaaagctcacaaattataaaaaaaatggctaacaccaaaaatatctcacgatcagagatcagtggtgaccgataaaaagcctttcttttcttaattctttgtcctttcgatttttttaaaattttattcagcaaattaacatatttggacaactgaaggcgaacgatgcaataaaaatatgattttcgattggtggttaatgtatgtatatgtatgtgttgtgtgggtctacaaattagcaaataacaaaatttatttgctcaacagattggaattgataacaaaaaaggaagatggaaacggtaataaaaaaaaagcatttgcgaatacggtagggaaaatacggtagtaacagaacagaatttacagcacattaatttgattcattcctttcttgcttttgtgttgacagtttctgaatgtgaggcgatggattcgaatttcaatttttttaaaataaaattttccatttatttttagtcgaaattcatcgtttttctaacaaaattgtactacctatgtatgttcttatgggaaaataagaaataaacattgggtaaattaagggtaatgtgatataattaattattggtcgtacgttggttgtatactgtatggtatatggtatatttgaagcattactgtgcgtattttggggagctaaatctgttggagattggaagaggtcattttcatcataaaaaaggtggaaaaaattatcggcagaaaggcaatggcatcggacagagaaaaagttccatttttgaggatgtatttaaaaaaacaagtttgaattaaatgtgatgccattcctttaccgttttttaattaaatgcttgtctttgtcggggagggaaatcatttgattgataaaacaaatatttaaatatggtatttatatgagtatgtacacctctttctaattaagctatagaattttgatgattgtgtcgaaaataaggctcatcagaggtgcaatgttttcggaggtggtagacaaaaattttttatatgtttttaacaaaacggcagttgatggaggatggaaatgtgtaaggatggagggaagggatttggaggatacaacgatggtgataatgatagtgatgaagccacaaaaaagcattttcatttgtggtgagtgttttttgcgtggatgagttttggcaacttttgagaatattggatgtgtagaagaaaacaaatgagaaaaatcagtcaatttcatggaaaacccttacaaaatttaaattttgggaatttgcccaatttgtttgttataatggtacaaatgataatgactttgcccgagagaagtgcaaaattcagaggatttatcaacaacaaaaacaatggagaagaaaattcgggcatttccattccttgacaacacaaaacgaaacattacaaaaaacaattgggcgttgggctcccatcaaaaggtaaataatgataataaaaataataatataatatacattcgactgtaataataatatatcaaactgtaacaatatatcaaagactgtcaattttgtcttttccaaatagccgctctctctgtccctccgctctccccatttcacacacactctcgccccttttccctccctgctcctttctcactgatcatcagtaaatgggcggttcggtgggcggtgccaacgacatccaatggtggttgtgcgacgcactcgacgtcatcgtgcaggacccgttgctgctgctgccgttgtttttggcgccgttgttgctgctcccactcggactcacagcaggcgacggcgtgggcgtcgatgcgtcaatgccggaggcaacggacgaagtgccgttgccattgttcatggactgctggtgggtggtcatcggactggagttggtggtcaccttttggaagtacttctccaacttcgctgaaaagtatgaaataagaacactttattatgcacaaatggacataaaaaagataaaaagaccgtactgataatgtgcttcccgtagttgaaacggcgcagtgccggaatgtgtcctttgatggcaaacatcatcttcttgcgatgggtcgagtccgcgacgtccagcattttttgcacgacgtaattggcgaaagggtccttcatcatctccaagaggggtggttggaagaaccgttgctgaaacggagaaaggccaaattaggcattcaaaacagacaaatgacaattgagaaatagagaggaaaactcactccgcacaaacttcgtcgatcagcgcattctttgggtctgtcgtcccgcaaatgagacacttttcgatgacattggaggcgaatttgtgctgtgcatatttcaggatgtctccatgcaaagcgcgcacaatgcgctcccgatcgtcaaacagtccgtgctcaatcacgtgttggatcacgtaattgccgtacttgagaaagggggaaagtgcgacgattgcaacctttttaccaattcgataacttcccccctttcattatgattgatcaaatgtctttttggattgatcatttaaagtccctccacgcttttctcacctgatcggtgaccaaagtgagcacattctcatgcagttgttccagcacaggccgtttttgtccctccgtgcagtgttcaagcacacgttggatgacacgacagccgtacggatggacggagagggaagtgacctgacgaaaaacgaacagattgcaaaagaaaactggccaacggcaaactcaccgagtccgtaaaaccgttgaccatcgtgtcgatgataaactgcagctggtgcggctgaacacgctcgattatctgaaaatggcatttattttttcatacaaaagtggacaatgcatttaaaatgggagcagttcattcccctttttttgggggggggggggactgctccattttgaaagaaccatttaccttttgcacaacatgattcccattctgatctttgatacaccgaaccacttgaggcgacagttcgttgataatctgcaaattgtaacacaaaatcacttcttagttctaccatcagattaaataattatttgattatattgtttaattgcctcccatttgtgacgttttgtccaccgnattcca

SEQ ID NO: 9193 - DNA, 1486 bp, Heterodera glycines
  misc_feature (1349)..(1349): n is a, c, g, or t
  misc_feature (1404)..(1404): n is a, c, g, or t
  misc_feature (1408)..(1409): n is a, c, g, or t
  misc_feature (1414)..(1415): n is a, c, g, or t
  misc_feature (1421)..(1421): n is a, c, g, or t
  misc_feature (1428)..(1428): n is a, c, g, or t
tgcgtatccatggtccacatgcacaggtttttcgtcgctttttcattcaaaattttcgatccaagagtaagcacaattaactcatagttcaatatataactgactgagaaattcaggacattgctgccgcatgtgtttttctggcaggcaaaagtgaggagtgtccacggaaacttgagcacgttgtcgaagcatggttcaaacttaaaaatatgaaggcagaagtccaaccaccattcacagaaacagttaatggatgcgcaattaatttgttttcatttttaattgcttctcaggttcggagagacggcgcagaattaatcgtctttctcgaaagtgttctgcttcagacgataggttttgatctccaggttgagcttcctcatccacttgtccttcatcacatgaattgttacgcgggtggtaggtttttggatttcgtttttctgttttcactcgtcgccgagacactaattccatcgatatttccgttacataaaatattaccaccatttattgagtaaaacatattaatgtatatattttaatctttttgttcagataactcggcgatttcacgctgtgcctattggttcgcatcggagatgatccggttgaaaagcatccgcatttttgtttcaccacctccttcgtaggttaaccaccttcccggtgcggtacagcattcagactattgcttgcctctctatatttttggtctcgctctggtcagatttagaggttttcccattcccgttttctaaaaatgcgtggaaatgccttttttcagattcccgactctaatggtgttccgtggtttaaaagcattgaaccggaaatgacaatggatctgctgaacagttaatagcattcagattaaagcgataataacgggccgctctttgagcactcgccgatgagttcacgctgctttaccacgagtgtgggagcagcgaatgtcgcaaggcggtggatttgcttcagcggttaaaccaatcctccacagctacgtccagcacttctttcatggtccatcagcttcccccgccccctccgccgccaaatttgagtgccgtaaagacaaaccaagcgcaacaacagcagaaaacccctgacaaagtgattaacaacgatcaacaaaggcaacggaacaaaaggccggcacttgcgaggacggggcaaagcgaagagccatcgccagcgaagagaatcccaacagatgctggtcagtcggtctaatggttttataataatacagaaaaagtgtcctatgatttacgccccccgcacccgaaaatttatgggaaaaaagtatttaactgaatattttcgattttccttattctctncaagattaacttcaaaatcgcaatattggctttttggataaaaaccttaccaccnattnncagannattacnggtttanaaaagaaaacaattcttattgaaatatataaacaaaaaaatacagtttttatattttt

SEQ ID NO: 9194 - DNA, 3974 bp, Heterodera glycines
aatcaaatgcaaaagaaatgcactcattccatattccctcgttccatttcctcctcctttgcccaaggcaaagtgccgttagcccatcattgtcagcttcctcctctggcgagggaattcggcggcctttcgcccgctctttcgctctgccaccccccccccccccaagtgcccgtcctcttcaatttctttcccctgcgacttttggctgtgtgccgccgtttctggcggatgttttcctttgcggtcactttttcattccccactaagtcattcattcagtcgctgtgtgggaatgagttttttccttggcccctcatttgcttttcactgcttttaatacacaaaatcgacctcaacccgccgttccttttttggtccttacattttcattttcctccctaacaaataagacagacgaaaaaatccctccggcggcgttttgaatgccacggaaaaatctgccgtttatttatttcttcgatatctcaatttaattttgcttcatttctgctgaaaacaaagaaagggtcgacgtcactttctctttgctttgcctcgtaatttcttttgcccttttccattcccaaattatgctgattatgtcactgctaagcctttgtcaattagtgcgttactcttgtgagtttttttagccaaaaggataaaattaaaggcgaaaattgagggaaaaagaaaagaaaaaaacggggaaattattttaataaaaaatgaatgaatttgaataaaatgctgaaaaatttaatgaagaaaataaaaataagtaaaggcattttagcgaccgattcgaagctgaccgaccttttccattcactgtttcatgaatacaacaaaggtaaaaaatgaatgaatattaaaaaaagaaatgtaataattggcaaagaaaagaatagtgccattgggtacaactgctgatcaagaaataaacggacacataaaaatatatttcgaagcataaattcggttttgaacaaagagtcgaaattcaaactttttcacttttgaattttcagtctaaatgattttttttaaatgtgttaaaaataaaaattattttatttatttatattaaattaaattaaaaatcaaaagttgtttgactccggagttcagggttcgatatgagtcgaaatgaaaaatcaaaatgatattcgaattgggtgttcgtaattagtgaaaatcgatgtccgtgatcagctcccttaataagcccttatgaaaggatatataaagatttggaattaataattatttatcatttaaatcagtgcaataatttctattctctttaaaaatagaaaaaataataggatatatactagtaaaagaatttggaatgtattaagtatttaaattaattaattattatgaattaaattcagtgcaataattcttattctctttaaaaataaaaaaataataaaataatttttgtttttgtttttatttttgtatttttatttttattgtaattcaagaattattacattgatatttgatcataaaaaattttcatttaaatttttaaacgattaaaatcttttttgttggtttcgatttattgcatgacattcttttacattcagaaattcgtcctgttattgaacataatcgaccagtgaacacaaatatatccttttcactaatccaagttgttgacgtggtaattcactcaaaaaatattttaaaatgcttttgaggttttttctgataaatcaaaggaaattcgctgacgaataaatgaaaattatttttcaataaaattttaatcttatataaataaataatttactaatccaaaaaaggacgagcggaatcagctgctcacttccctggcatggattcacttccgctggaacgattggaggatcggtcggtctttatcgttaataaccctccattttcgccacactctctccgtttagcgtgggacccgcggatgaacggagggatcgccaaaatgaaagtgcccgtcgaagttgtcatttctgttgtcgactgaattagcattctcctccattttcagatgatttggaagccggatatcattctgtacaacaacgccgcctcggaatatttgaacgaaatggtaattaattaattgatgggtgactcaccgatcacttaattaattggtcccgcaattctccccaattcagacgacggcgggtgtcacttacgacggaaacattgtaaagacaaaagaggcaaataaaatggtcaatttttaattttacagagtctttccatagccggcattttcaaaagcagttgcgaactcggtaaaaaggacaatctgttcaaaatttgtgcccaattcccacttcgttttgaagatgtccgtttttaccctttcgatttccaaaattgtctgatgaaattcgcttcatgggtaaatctgataattgttataacttttggcaattgtttttctttttttaagtcttatgatggcaccaaaattgacattttttctgagtccaccggtgacacttctaattatatggtctccacggaatggactctgcgcgaagtgcgggccacaaagaattcggtcatttattcgtgctgccctgaaccgtattatggcacctcttttttgtgccattctccgccattcccccaaaggtatccgttcatcgacgtttaccttctcctggaacggaaaccgttgttcttcgtcatcttctcctgccttccgtgtgtgctcatttccgtgttggtgctgctcggcttttatatgccatccgattcgggcgagaaagtcactctcggtgagttttgttggcgttgtgcccactgatcactttttggttgcagggatcacttcgcttctgtccacaaccgttttcctcatgttggtttctgagcatctgcccccaactgcggatgccctccctctaattggtattggtcactttttcgtcatttttcccttaaataataaatcgtttaaggcatttattacggtgtcactatttttatcgtatcccttcaaacggcatttaccgtctttacagtatgcccatttgagtgtcgttttgtctggtggcttttcctcagcttccccacccccctttcccatcagttgaatatccatcacattggcactaatgggccaccggtgccacgcattctgcaaaagcttttgttcggccgcgtctcgcggcttttattgctcaatttggagaagcaataccactcgataaatgaacacgtcaattacttcattggcaaacagaagaaagcggaacagagggagaagaaaggcgagaaaaacggagagaaatgggaaaatggagagggaaaaacaattttaaatggctcagagtttaaagttaataaaatatggacattctttagcttctccgtctccacgggtgagaagggcccattcggcaaattttttcgacgcaaatggcgcagacggcggcgtttttgtcgattccaatgtccattttccaaattcgatctaattttttcatttattattttcctttctaaggttcaatttgttgcggatggctccaactctttgctgaaagcgaaaaagaagcgcgtttccttcaccgatgacttcaacttttattgccaccagcagaagaacggtgcgttaccgtccgcctcggccactaccgtatcacttccgacccatcgctacggcagacgcattctgtcgctcatttcccccgttattccttcacataaacaccacccgaactgtgccaaaatgcgagtggccaccgtgtcgaacattggcaaaaaacgacatcggcataaggaccaaagcagtagcaacatgggaacaatgtctcctcattcatcggcccaccgaagtcggagtccctccgccctctcaacgacgggggaggaagacgtaaagcaaaagggagaagaaaacacggtattctaaagagaattcatcaaagcgattgtgaggcgtcatgaaatga

SEQ ID NO: 9195 - DNA, 1401 bp, Heterodera glycines
  misc_feature (394)..(394): n is a, c, g, or t
  misc_feature (685)..(685): n is a, c, g, or t
atttcgacgattggccaaaaggataagaaataaaaggggaaagccttaagggaatgaacttagactggtggagaagaacagaaggaacgcggagaaaatcggtgagttgaggcaaagaaaaagcgcgtgggggagggaaacgcaacggggggggggcggtggtcagggaaggggtcatgcgttcgggaaggagccgccgaggaaaactttttgattttgtaaaattgttaaggaattttcataaaggaggggtcggcaagtgaccgtggaatttccaaatgaaacttggtgggtgggtagcagggatgttgatcgtttcgtatttcgtgttcgtattttcgtgtttttggggcttttcgtgttcgtgtttcgtattttgtattttggcacgaanacacgttaagcactggtaagaatgggggtctgagtaaaaaattagagatggaaatttatgaatagggagaaatttttaagaaaaattaacttatttatttcttttaaagtgcagtttcatatccttatttggtctagtgaataaactttgtgattttcattatttttcgctcgcttgggttcaattccctaacgagacaaaacttttttatatttactttatattatttcaatttaaatttaattaataaaaattccaaatttatctcactcaaacttttccggcggcgcnctatcggcacctccggacccccccccccaaatgttcctaaaaagtttcttaaaatacagcgccaaaaaaataaagtatgtaagattgttattaaaaacctagaaaattctcaaaaaatttttagtaccgaatcttttggaattttaaaataataggcagttttaacgaaaattgttgaatttattaaaagaaattccagaaactttggcttggctcaaattcgcaaaattttttaatttttttggacaaaatttgttagcaggttggactctaattttgtaaaattttcacggcggcgccttttgcaccgccggaacacctccccaaaagaattttgagaaaatcatgcggcaaaaaaaaaagaaaatttgttagcagactacagtttagttggctatttctaaatttaagaaatagataaaataaaatctgaaaataaattattttgatttatcaagttttgataatgtttttaaatttttgaattttttcagtaaaaaaaaatttagtattttcgtatttcgcatttcgcatttcgtattttattttagtttcgtatttttcgtatttcgcatttcgtattttatttttcgattcgcaacatccctggtgggtagatcaccactaggttctattgtgaaattttaactatttttgccaaatgagcatgagtgccaagttataacgtacctaacttttttaataaacaatcaaat

SEQ ID NO: 9196 - DNA, 212 bp, Heterodera glycines
tatctcgtcacagaagttcataaggaaaaaatggttaaaatttctcgatagaatctaggggagatatacccaccgaccagcctctccccctccctcgtgcttgtgttcggcattttgggcggcggtgccgaaatacgccgtcgggaattttaaaaaattggaatgaaaatctgtacttagaaagaaagcattcccatgccaaactcctttca

SEQ ID NO: 9197 - DNA, 1411 bp, Heterodera glycines
aacaaaaaaaacaacaataatcagggaaagtgatgaaccttggtgcactcgtggaagaggtcataaagcagtcgcagctgttatttgttcccgatgttcaggttcttgaaatttgtttccctaaaaattgcattcggaaatggtttagttcatcaaaaagaacatcgaatcgctgattgacaaatactacctacaacgaacagaccaaaacgacgaatacgaatacatttcttaagtgcaatattgaaagtctaacaagatatttccattatgattgtcctcccttttaacttgtccagccggagattagtccatttcctctaagccaaacaattgctaatgctcaaaatattcgatgatgaagagaaagaaaacccactatttgtttttacttttttaatttgattaaattggttaagggtagaaaattcaaatgtgtactctgtggtgctgtattattttaaaaattagtcgaagcaaacaaatcattaagagccatggtttttcttagatgcacatttgcatgaattattattctatagccaaaattttagaatagttggcgaagtgtcgtcgtgccgggccgtatttttccttgatacgggtttttatcccgtattgatgtcaagcccataacccttaccctagccgtattttcttcaaggccccgaactggaatggaaattatttcctgtggggattcccagtcccatgaccaatacttaaacacactgtccgaaaaaacgagatgtgtaccaataaatagagagtgccagagaaaaacattatctttttttctatgattttttgtctccttttggcgtactatctaatatttttattattaggaaaaacaacatttacttctctccatataactttttttctatccatgtaatttccaccaaattttgcatatcgatagagaaaaaaattttgcatcgaatgttctataaggttttaataattttccatcttattttttattaaaacttattttagattttttgacatttttaattgtttaatggctaaaagaaatttgccacacaagctcaattgcaaaagagcaaggcaaaaaagggagagcaagagagaggagcgacgaacaaaaatggcaaaggcgacggaagccgatgggccaagaaaagtgagttttttcactaattttaattcaaaaatcattttttaaatttcatacatcaaaagccaaaaaacattgtttttcttccccattttgttaaaatattgttacttttaatatttttaatcaaataaacctttcaaacacaaattatcaactaataattatgtttgattagatttgatcagttgggaataaaaagatttttgaatttggcgccttcgtttcaaaactcttttttttataatgataggcatttttattcaa

SEQ ID NO: 9198 - DNA, 2199 bp, Heterodera glycines
tgtttaaattctaattttgtaggtttattgaagccaataacaggggaaaataggcaaataacgctcataggacttccacttaacgtgattacgaaaccaaaaacgctgatgaaatgaatcgccggacgaaacgggtcagttgcgtctggccagttgcgtctggccaattgcgtctggccagttgcgtctggggccagttgcgtcttggccagttgcgtctggccaatttcgtctggccaattgcgtctggccggttgcgtcttagtacttatggggccggttgcgtctcaaacatttggtttggaaaaataattttttttgatttatccgaaggcgcaaatattaataattttttttcttaaaactcatacgtatgaaaaagttacaagcattttttgagaaataaaaaaaaatacggggttaactaattcggagtgaaattgtgcggggtggaaacatagtgcacccatatcagaaaattgtttttgcatttttatacatttcatttgttttaaatcttttaatatagcccgaaaatggaaaacaatcaaataataacgaaacgaaacaacaaaaaactcgaacatgaaggatgcctctatgtcttccatatgttcaatgctgaccgtgacgtaaaattttggcgctgtgaacatcagcgcgatgaattcaaatgccgaggacgaatccacacaacgctaaatgacgtcgtgctgaagaccgttggagaacacacgtgcaaccacagcgcggcaaatgtggtcacacaaaaaatcgtctctggcataaagcggcgtgccgttgagacgatggaaccaccagcggcaatcagggcgcacactcttcagcaaattgccacgccagtaatggcgaaaattccgacaaagaatgccacaaaaaaagtgaaaaatcgaatttttttttttttactttttcacatttttgtttttaagctggtgaagcgagacagcggtgtgttttaaggggagcttttcacatattttttaaatttaagaattctgatttttggccggctttctttcggaaattgggcttccgaaatgaagtacatttatttatttatttataaagaaaagaaaaagtccacaaaagggataaatccacttactttgtggacatatacatacattaatcgtccaaaagtatcggattatacaagcacaaataaaataaaatcgccaagaaaaatataaaatgaggtcaaagtcaaagagatcacaataaccaaatcacttataaaaaaaaattttttttttaaatattctgtagccattttttaagtttttccggtcttattgtcttaatgaacttttaagttttgttttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataaacaattttacgtcattttggcgcggtacttttttgccaattttgtttttcaatcgtttttctcctaatttcagtcgtggaaaatgggtgtttccggttcttcacaacgccctccgcgcaaaacatccacagagctcaatcaacttttgtctcttccacttggtgcgcaacatgaaatctcgcctaacagacgaacaaactcgcgtaagaaaaataaaaatttattgattttgaaatctcaaatttagcgtttcacaaccgacgctgcctttgcacaagctgtcaaaatgatcacttcgctggcgtttgtgctgcttgaggacattacaccggcgctggcagcgctcgaagatcatcttccggatgagcttgagggcgttctcgattggttgtttgagtttaattttttttttcaatttcattagtcattttaaaggtttgtaatcaactatgttgggcgacttcgcaacaacggcacacgcactcgctccgccgcataaagcaaagcgttaccgtgaagcagacagacgaattttgaggatcctggagcgctacaatcaagaaaaagagcggccgcaaatcgaaaatgatcaccaatattgccaaaaccaaattaatccgaatttgattaatgaaatgcttaggggaattccagcaaattaccaaa

SEQ ID NO: 9199 - DNA, 675 bp, Heterodera glycines
tctagagcatttgtggccctattcatcccataatttccttccgcaaatgtccatttgcgccaaaatggccaatggtttaagccaacgaatggccaaagggccacggctaattgcgaatgtgccaatgcctttctctgctgaggatgaatcagtgtgttctgtgtggctctctttcgtcctctgctaattggcctaattgggaggcgaagagaaaatgaaacacttaacgaaagggcaaatgaaatgaaattaaagagggggcctttgtaatttgctaattttgttttgaatgttttgggtatttggcgcgaaaactaaagatgtttccgcaacattcaaaagaattgcctttttttgtccctccgtccgttttcctttttcataaaaatttccatcccaaaacgatgaatatgaatggacggacggaccattcttccgaaaagcgaatgaatggaaagggacggacagaccaaagaatgaaaacggagggacagacgcaaagcaaaggaaaagcgacgaaaattcaaagggaaacgccgctgccgccctttgcccgtctcaataaaagggcgattaaatcggaggaaatttgggcgggggagggagaaggcgcgaaaatggacgaattggggggggggaggacaataatggacgatttaagcggggggggggggg

SEQ ID NO: 9200 - DNA, 1278 bp, Heterodera glycines
  misc_feature (39)..(39): n is a, c, g, or t
  misc_feature (1230)..(1230): n is a, c, g, or t
  misc_feature (1242)..(1242): n is a, c, g, or t
  misc_feature (1255)..(1255): n is a, c, g, or t
ggatttatcatagactttgcgccaaatttctcccttttntaatcatttttattttgccagacatttaccacgagtgctatttgccgtgcggaagtttgtccagcttcggcggatattacagtcgatttgacgaacagcagcagcgaatgggcacggcactgagcggacattcctcggccagaaaagggacgacgaatctgcgatttctaagctgatcagaaactgggaaatgcttattgatcgggccgacatgcgataggtaaatggccatcatttgctgggatttggcgactcaatcggggaggatcttaggtctgatcatctcataataagtgatacgtaactgatcatctccatggtgtatctgatcacttccttatcagtgtaccactggttaattgctgatcgtaacatcgatagatcatatcctgttcagttggtacttctttcctgatcagtgttgatcaatcactctttacctctgatttccttaccatttttgatctccaatggaagtgatcagatcagtgttcctgccatggtaatccttctgctgctgtctgtcctttgctggtcattccttggtctgaatcggtctgtcccgtccggtgaaaatgtgtgctaattaatggccaatcaaagcagctgttgagcaaatttgctcaaacattcattcatttataatttcttcgatctcacagaatttattataaatttcccattttattttccttcaaaattcgccttttccatcgatcgctttcatggcattttttattcgaactttttttgtttaaattgttcaaatttctattttgtgcaagaaaatgaattttttatcacatggcaaaattttggccgaaaaacaaacaaaaaaagtgacaaagagatttttggacggattttcccggcttttcctctcatgcgccgacggagcacagcttccaaaatgccttcagctgatggaccctttccgaggcggagacaacggcagagcaaacggcttggatggcgggcacagtgtgcgcctgaggggcatttgaatttggaccaaatttagcagtgggaagagcaatttcgcgatcagaaaatccgaaaatgattgattttcatacaaatacgcgactgaatctttcaaaatgcttggatgatcagagagcagaaatttcaatgaaatatcaaaccaaaaaccttgctggtaccgattgattgattatcgattggcgactntgattagctatntattgcttatcgnatattcactcattcgcccctctg

SEQ ID NO: 9201 - DNA, 3904 bp, Heterodera glycines
cacaaaaaatcgtgattatcgcatgaaggggctaaaattgtagctagagcaggttttgtgcggaggcacgaaattaaaagaattgagttcgaggggcaggatattgtaggggtaggggtacgtacccctgtatgcccccccccccttgggactgtcccttcttacggccagcctcgtctgcacatcattgcccgccgcctcgctgagcaccgactgcaggtcgtcctcctccatcaccatgtccccgtccaagtcgaccaccttttgcttctcgcccatcggcggcgattgccttttgtccggcgaatggcgtcgaatttcgtcaccactgcttcttcctcctccccctccacccgtccgttcttctgccgtcaaaattgaactggtcgagctggtcgactccccgccgtccatcacatcgtttgccaatgctccaccattttgtggatgccattgttgttgttcgacaaacattctgccaccctaaagtcacaaatcatcgttgatcatttcggctttcactgatcactctgtcttccacctttgcctgccctccgtgccgatccgtcaatgagccattcattggcacagttgcccaatttctgaagctgtcttcgttgttgttattttgttcatcttcgatggactcggatgaataatagttgagcagagaagagcttggggaggagggtcgttgttgggggaacggcgccggagggggcggcggaggatgcattttggcatggaaagggacggtgccggacgacgggggcagaaacacggaagtggcaccgccgcggggcaagtcacgccacacggacagcgaatacacccattggaccaacttgtagcagtctttgggcagctgaaaaaggcataaattgaccatgaccgctgctttgggccatttgctggttgcttgcctggggcaacatggcaacgaattggtccaacgcgtcttggcccgcgtaagtgccagccgaccgggacaaagtggacagggaccaacccgtggagtccaaagagtggcgaactctgcaaaaatgagggaaacccgtaaattaattagaaaattaattaattaatttgattagtcaatttgcgttaatttagcacaacaccttttcagcatggccaacgtcgttttgacgggacgggcgagctgacggagttggttctgttggcgaacctctctcacgtccagagagatgcgtcccaacgactcgaccaattcgcccaatgcgaattcgacggtgtaactgaaaacgaatgccaaatggaaaaaaggggaaaagacccgaggagtgttttaaataatcaaattgaaatggaaaggagatgatggcccaagctgacacaatgtcgcgaatggcggccaaattgtgccggagaatgtgcgactgtcgccacccgccgtgtccgaggccggcggcaacgaattggctcattttcagtgcgtttgtgtccacgactttggcacaatcggtcagctgagagcagaagaagcgctttcgcagctgtgcctttttggaaaagcacaaattggctaatgaataagaagcaattttaagcgaatggccggtggaattatccaaatttttttttttttgaaattcacttccgcttcaacagcggcggtgttcgcccttttgtccgtattcgccatttcgtcgccatcttcgctgtccgccatacttcccccgccgtcgtccattgcttcgtcgctgtcgctgtaatcgggcggtggtctgaaaaacatttgaaaaacattcatgcactctcacaaatttaaatctgtggtgcatttcattggagctgttaaaattattgaagattagggtcgttgagggaaattgaaattttcggttaaaaagcggcggaatttcacagttaattttgttggatgtcctctcgcagggcacccgaatgcctaacggatgcactgatcagaaagtgctttttgctcgatcatttctttgatcgtgcacatctaataaaacaatggccaaacccgtcacacggcgtgtaaaagtgttggacggtgttgtcgttgaaagtgaccgcccggcggactccgttgtgcgcctgcggcggctgctgggaggcggaaaaggcggaggacgacggactgttcgcccgcggggtccgattaatcgaatccatggactgactgaacgcgggctcgaccagcgaaggtaacaattgctgggaggaggtgagagagccgagggttggcgtagcggagccggaagaagagagggcggaaggaagaagcgacggatggcaggaggagaagagaagctgatcagcggaagagaggccgaacggatgatcagccgaaaagggaagcgacagccgacgctgagagtgggggggggaagggaccatttgccaatcggatgcagaaacaatgcgatgccgggccaggaaaatgtcgagactgtttcgccagagtcaaaaacaatccccgaatcgagtgctgcgagattctttgtatctctccttgcctttccatccccgaaacaatgcctcgccatttctttcggcttttccccgttttacttcgggcagcggagatggcaatgagttggcggagccagtcgggtgcagctgcacaggctcagccctggccaggaacactcgggtcctgatgaatggggagccgcctttgtggttcctctgctgctgttgctgcttcgccgtgccgtcgttgaatttcgtcgtttggtccgttttgtattgttgcgacacaaattcactcgggtcttaattaattggatgaatgacagaatgaataggaggggagagaagccatcgcttaaataggcatggaaaatgagcgatttgtgaggcaaatatattcaaattaatcttgccaaaatcagtgaccgatgaattcgttaacccccgtttttttctttctttttttattgacgattctttttgccaacttaatttttcattgttttattaaaatctaaggcttattaagcattataagctgttacccgtgaagcttttgaatggactgtttttttaaatatagaaaattaaaaatgcaacagaaaacccttggaaaaagggggggggggcgactgcccatgctgaaaagacaatacccaccgaactgctccaaacttcggattgcctcctccacggcatccacctcatattccactttcttcggcacttctttccattgtttttccgcgcgttcgccgccattggacggcacaaattctgtgagtcgcagcgacgaagtgaccgtcggcgactgcgaatttacggctggcgatgcgttgcgattgtctccacgactgccttttccagcaaccgactttggcgcccccgcggagacgcgtcgatggtccgccatcttcaccgcctcactttcctcctccgcttcgctgccactgctgtgccggaaacggacacaggagggcatcataagcaaagaggacgagccggacgaggaggaggaagagccgaccggagagacggtaccgccaacggcacccttttttgtgggtcgaaatcggagcaaactttgccggatggaggaaagacttggcgactttgaccgcgtttgggtggcagacgaagatgacgagcaggagacggagccggacagactgctgcggtcttcgaaatcgccagcgagcggcgagggagaggcggtcgccgttggcactgtgccattccccgccctttcgccgttggcatttttcctcccgttttggccctttcccactccattcgtctccactccgttgttgctcaaagcggcaattacgggctccgaatctctgcgaaacagctgttgctgatggtcactgggaaggactaaagttgtgtgcgtacgacgaagcggagggggcagcgaagaagcgacggcatgaccatg

SEQ ID NO: 9202 - DNA, 5333 bp, Heterodera glycines
agttatgacggatttttctcgaaaaatctgtaaatttggcagtttttacgaaacgaacgacccagcacggcttgttcactcactcaattccttcttccactcgtaaattttgttgcgatatgtgcccaattccttggcaattatttgctcaattttatagcgcttttccttttgccaattgttttgaaatctgtgctttcggatttcctcaaatgttttgagaatttcgagtttttggccctcgtcttttattttggtttgtttttctgctttttgatgccaatttcgcttttccatttgtaaattttgcctcgcgttactcccaatcccttcgcaatttcgtcatcaattttttgataatttattttttcacttttcattttcttttcgtatttttttcttttttcgtcaaatttttcgattatttttttcattttttcctcatctttttcactgtattttttcttctttttctgctgccctttttcttcaaattccctattccattggaaaatttttgcccggtaagtgcccaattccttggcaatttcgcattcttttttgttccgattttcttttttgtaatcactttccattttgaatgcatctctctttttgataaattgattgacaatcatcaatttgacttcgttttcctcattctcagaatcgctttccgactttgccgcctttttccccttgctaattggccaattagtgtcaatttgctcctccgttttccccttgctaattggccaattagtgtcaatttgctcctccgttttccccttgctaattggccaattagtgtcaatttgctactctttttgctcattaaaaaatgtttcaattttgattgttgcttcttgtttttcttccttctcactttgtttaaatggttcatcttttgttttctttaaacttttagttgaaaattctttaattttttcatcattttcattttgctcacattttacaatacttttcctgatcttttggccatcatttttttcataatttatttcttctaaattttttaggttggtaaaaaaagttttttgccaaatttcttcaaataaatctttatcatcactttcttctactccgaaaatttgtacaatattattcagataatgaatgcttagtaaaattttcatcgaaaatattagcaaaccatttttggctaaaattaaaatctctccagtaaaaaaatatcaaatatttattttttatataacatagaaaattggacataaccaaatctaacgaatttaaaaaatatatatgaaaacaggaaatctggttggaaatttacataaaaaacacctgttttgatttattgcgtaaaagtgtgaattatttaagtttggcattgtatcttatatgtcattttgagttccagtcccgcagcgggatccgcaaatttgaaatttccggtctctaatgaggatgcaattttcaggttctaaaaccgccaaaataggtaggctttaggtcccctaaaattccccaaaaaataggctctaaaaacgggaaaacaggcaccaaaaacctcaaatttagggggggggtgtaaaatgacaaaatttattcaagccaaatcagtattgagacaaataatttttaaaatcacaaattcctgtcaagaaaataaataaataaattttgtggatgagtttttgagaaaatttcaggccaccgggagctcaggaaaaaaataggcaaaaacgtaaaaattgcatccctaattataatttgtttgtgaacggtactttgctactaaatgttcatatatgaaaaaaaagttaaatgaacagacgcttagaatttaatagtgttttaaaattgttttattttattttttgtttgtgccaatatttatcggtcaatgcctctaatgttatgccaacattacaactgaagaaaaaccccactcaaaaacatttacttatatttttcttacgtcaaatttaatagacgagacaaaacatctcacaaacgaataataaaaatatgtagcgttactaattacatggacttaaaaaagcaagctgtgcgccaatgtcattcattgagtttctaatttttttgatatgaacgccgattgcgatttctgaagctttgggcatttcgaaagcgaacaaaatacctaaaattaccaaaattacgaaacaattcatttttgggtgtaattttcgcgtttttttaattcctaaaaaatggctgaaaatgggctaaaaacacagaatgatgaaatttggatctattagctatgttcatatagtttgtattacatattactattgctttaatctttgtttttttagtcagaaataaagtttttagaagaacgattaaatgatattgaaaaaaaatctgcatctataataagaaaaataggtgaaaatatctttaaaaaagaaatgatcgagatatatttatggcgaaaatccaaacataatatttttcattttttcatacttctcatgggccacgaaaatttggcaattccaagtcatttagggcggcagttcaggttttcaggtcaccttgaaggagttatctgatcactttggtgcgattgaatttttgatgaacatcaaaattacctaacaaaagtttgaagttgccttattgccttataattttgttgcatactgtaaagaataattcaaatttacaatattatttatttcaatccaccatcaaattgtcatggaatctcacttaaaccctccataatgctattgattggcttaaaggcaaagcaataagaatatttctaataaattataatatctattaaggaaataaatgttttaagtgacaaaaaaaaaccctcaaaacattgcctaaaaattggaaaacgggtctttaaaagtttataatttacaaaatgtacataaaatatgtataataattagggatgatatttttagttttttacctattttttcaaatttaatttcaactattttggttgatcaattttttgaataaattttaacattttacacccctaaatttgaaagtttttaataactattttcccatttttagcaactattttgggttttttagaacctaaaaattaattattttggccgtttttagcaactataaatatcattcctaaaaataattatatattaatgttaacaccagttttttatcaatatataaagaaatcctttctataattatatattaattttaaacaacattttttataaatttatgacagaaattctttttattttttggctaaatatttatgtaattttttttaattaatttaattttgccttaagccctcacatcattggatcaatttgtccgcatgttttatattataatattatctaatttactttgtctgaatttcaatttaattttctgcacaaaagaaaatggaaacgatttgtttagcgaattatggaaaaatgattttgccgatgctcaacaaaaaatggggaaaagctttataaaaagcgaacaaagcattggaaatgaaaaggaaatgaccaaattttcattggatgttcaaatcaaagaggagataaaaaatgaagtgaaactcgagagattagtgaaagaaatcaaaaacgaacaatcggaacaaatggacgaaattgggggaaaaaagcgcaaaaaagatgaagaagaaacggaaacggaacaggacagcagcagcagcagcaggtcaaaattatttaagtgaatagggacgaaatttatgtaaaaaaaactaaaattcgtggaataatataaataaatatatttattaaaaaaaataatgaatatgtacaataaaatggcagaaaataacttaaattatacaatgcttacaagggaacctcgtgaactgtaactcggaaaacgtaaataaatttggtaattgtgaatttttaattttacgggacaatagcaaaaaaaaaaagagttatggcgcctcaaaaatgggagttttagtgccaaagatctgtcccattcacagctttattcactttttttttattaattcccctaacatttacaactgagtgatttttgcttattgtcattaaagaaaaatcaacatacatattttttcataaaaaaaagttctaaatgtttagtccttttataaattaattaaaatttattcagttttatgttggatttgaacctggacctcctaaagtgcgaatttaaccattatttttgttgttaattttctcgttttaagggtttctttttttaaattctcactatttataaaaatcaaaaattttgaaaatgctttttccataattttattttaataattcggaatttttcatgaatataatacatatagtgatgaaacagcagaagcagacgaatttgataatgacgaacagaaacgcaaattgatgattttaaaagaatatgacatacggagaaaagaatggaaattgaaaaatggaatcaaaaaagaaaaccgttacaaaattgaagcggaaattgccaatggattgggcacaaatcgggacaaaatttaccaatggaaaagggaaaatgtgccaacctacaggaagagaagtgatgaagcgaaacggaaaacaattgaagaatttgaaaaaatgaaaatcgaatccaaaaacaaatgggaaaaagagaaggcaaaagttggagggcaaatcgccaaggaaatggaaagaaaaattcaaaaatggaaaagagaaatgcaaaacggagaaatgaaattggaaatggccaaggaatttggaaaaaggaaaagagcgcttgagcagaagaaatacaacgaatttgagcaagaaattgcaaagaaattgggcacgaatcggtgcagcatttaccaatggaagagggagcttaagcttggcaatgtgcttcaaatgagcagtgagtggggggacccaaaaggggggtcagtccaagggaaaggccaagggatgtgccgagggttgggccaagggtttagtgaagggaatggcaaagggatgaaccaagggaatggcaagggatgtgccgagggagtggacaagggcgtggccaaggggatggcccagggcgtggcaaagggatgtgccaatggtttagcgaacggaatggcaaagggagtggccaaggggcggctgagtaatgagtgagcaatgccccggtgatgctagagagccaagattcgaacaggtctcgagtttggtcctgcgataatcactagggcttcctattttatgtaaatacatattttttttcctggattttccaacttctttttgtgtttgcgaacaaaagttaggactgggtggggcatatttttacatgttttggggtgttttagctgagat

SEQ ID NO: 9203 - DNA, 2363 bp, Heterodera glycines
  misc_feature (2332)..(2332): n is a, c, g, or t
gagttaataaaatattcttttttcttgttatttttccctaaataaagaacaaaacatttttcagtagaatttctaatccatttatttttgatcttttttccaaagcctcaatcattgatttttcttctttcttctaatttgtgtaaatcagtgatttttagtctttccttatattttttgtacaaaaaaccacattttctaaatgcttttcttgtgaaaaatttttgaacccgttcaattttgtcaatgtctttttttaaatttgggttccacacttcggtagcgtattctaattgaggtcggacaaaagttttataagctgttgttagagtctttatttccctggtttttaagactcttaaaatctggaaaactctaagataagcgtttcgtacaattttgttaatatgtcctgaaaaatgcagtttcgagtcaattataatgcctaggtcacgaacattatccgattctgaaatcttttttgagttaattaaataatcttttttcatattatttttccctaaataaagaacaaaacatttcccagttgaaatttctaacccatttatttttgaccatttttccaaagcttcaattgctttatctaaatgatttgttttatcatcattttcatgggcataatataatttaacatcatcggcatacatttttatgccaactgatgatgcttcatttgcaataaaggacggcagatcatttataaaaattaaaaagagtaatggccctaagacacttccctggggcactcccgaaaatatgctgaaactttctgacaatacttcgccgattttaaccttaaaactccgattttttaaaaagttagttaaaaatttataaatttttccttcaattccaatctttttgattttttgaagtaataaatcaattggaactgaatcaaacgccttgacaaaatcaatatagataatgtcaatttgttgatccttttgtagagaattatatatatcgtccattgtttttaatatttgggttgtagtcgacctattttttaaaaacccaaattgttctttatcaaaaaatcttataccgttcagaaattctaaaattttgctacttaaaattcgttcaaaaactctacagacagtgctggttaatgacaccggcctgtaatttaatggatcagttttttcgccttttttgaaaattggtaccactaatgatgttcgccatatttccggaatttgaccggaatccaaagcaagtcgaaatatgtcagctaatatttttgtaattggctcagcacaattttttaataaaatgtaaggaatgttatccggtgaagtggaatttcgcctggggagctttcttaatatattccaaattatgccagcatttaattcaatatccgaaagtttagtcttattctgtgctgattgagtcagtgaaccattaacaactgaattttctaaaaaagatttttgaaatatttttgctaatatttcgaatttttgctcattactggaaaacatatttccagcactatcaattaacgtaggaatttcattaacttttgataatttatttctaataaatttgttaactgaattttgcccctgggaaataattttgactcttgttcatttcttaatttgtgcaattgttttcatttccctagaaataatttgtaatttaaaatgatttcacttttttcaggaaattttcttacaagcttatgtaaccgtaatttctctgaaaataaatctcttattttttgaggatacgattgttttattatcgattttagaggtctatttggtataaaagtaccatataacttcagtactttatttaagaattctttatatttttgatcagcggtgtacactgagtttattgataaatcaattcgattttcaagtatcgcctgacttaatttcgaaaaattaatatttttaaaatctcttctataaacactgggattattacgacggaatttttcttttattttaaatccggccattttatgatcggaagttgaaaaatgttccaatacaattaattcattaattaattctgattcactagtcattactaagtctaaaatcgtattttctctggtcggttctttaacatgctgtttcaattgtttttggttcataaactcaatcagcatatttgacataggatcattttacaattcggtggacgatatatatttataatttgaattggttttttaaaaagtaatttaatgtgtataatttcgcattggaattttgtcccaaagaaaagtgtctgataagggatcaatgtttttaataaaattgccgatcctccgcccttttttctngtcggtttgcataaacaattttggtattgac

SEQ ID NO: 9204 - DNA, 1479 bp, Heterodera glycines
ttttaagtaaaaaaatatatatatttaagtttaaattcttttggatgccgccctcccccgtgtccatttttcgttctttgttctcatttgatggtctccatcacttcttaatcgccttaatccagccaacatcacgggaatcggagctgattgaataatagtcggctggcaccaatttcaattgaaaattgtttttctatatttgtctggcccattttttgtatttttatgtcaaataaataattctttaatggatgaaacattttcattttaatgatttctccctctcatttgttgcccattagaaatggcaagaagccgattgatcaaaggcaatttcaaaaattttgtaccattttttggaaacgcaaattccaaggtcataagaagggagtgccgttttttagtaaacgaaaaatcccataaatactaaaagtaatgaaaatggcaaaaaaaaaatgatgaaaataatggaaaataatgagcaaaaaaaacgtttaaatacaaaaacattctctttgtttttttcaaaacagttattagaatttttgccaaaaaacccaagaaaatttcaaaattttttcttttagggacaattttgattttttttaaattgcagttttaacaaatttcacatccaaaatataactgtttcttatcaaaataaggctaaagaaaataagaattttaaataacttaaaaaaccgagcccaactcaacgaattttttcgagaatggagaagcaagccattccaacttaaactgtaaaacagtgatgtcattatttttttcggcgagttattgccagtcgcccccttctctctcactttctcaccctctttcaccctcgtatttcttaatacattttttccactctctctctctctctctatctctctcctctccctctctctctccactctctctccctttctctctctctctctctctcctttttgtcttccctcccctcccaccactctctcacttcacaacagtctatcatcccctctcatccttcctgctcttgttgtttaataactttaaatacaataataatcggggcccgagaatgggtgtgaaaattggaaaatcaatttgtcccctcccaaaattggtcgattcgacggctgaacgaacaacgaacgaatcggacggacggacagccaccgtcgatcgtcgatcgctcgcgcaaagaaaacaaatgagcggacgagaaggggagggggaggagtgggcaattattataaaaaaaaatttcttcgtcgcacaccgtccgcccccccccccccactatctcacagcaattgagcaattgcctattacctcctccgttccgttatccatcaattatcattaatcattcattagttcgttcgtcgtcatccatcggacggtgtgtttgtgataaaatgtcccccctctcgaccccccaccccaatttccccaccatttttgcgtcgtttcggtaacaaattg

SEQ ID NO: 9205 - DNA, 3505 bp, Heterodera glycines
ccccccgccccctgggactgtccctggggatgtcccggaaaatttcgaccgaaaaaaatgactgatttttgattcgagacttttctcgactccataaggtcccgtctcggctgaccatcattaaatctggtctgatcacaataagccccatataatctctctgtttttgcttgtattaagcattaataataattcatgtaaatttacacacgcaaatcatcaaaaaaaaagtgggccgattatacaacaacagaacccaatcagcagcaatctttgggaaaaatggccacttcaagtgaaaaaaagggtccgttatttatttatttaaatgtgtcatttgcgaaaaaaatgattaaatttgggcatttttaactaactaaaaatatttaaaattaaaataatttttatgaattcatttattttaaaattaaaaagtttttatgaattaattttataagtgttttgccatcccataaaaaggttagcgccccaaccctcgggaagagaaaagtcggggatctggtaggaaatttctcagcaaaatttgtcggggaacaacaccaccttcttcggggagtaaattgccaacaaatgggaaatttgtaacggcgtttaagcccaaataaaattgaagaaaatattttaaattaaaagtttgcgaactgcttgaaaaccgagaagacccaattatagcaaatttagtctttatttcaaggaaggctttgtccttaaataaattcttgaaattatcattcattggattttaaacaaaaaaaaatgcttcagactttggcagcgaaacgcggtgtgccgtctgtggtgaggagaatgccaagatgcattatggcgtgttggcctgcctgggatgcaaagtttggtgattagtctaattaatggaattgtgccatttgcgttttcccaaagtttcgtgctggggatatatatattttttaacatttttcttgctactgactgaacatatacttttgatcagaataagtgatcagaaatacccaaattggttggatggatcgagatcattagccggttctgattgattatttccgtttcttttttgagaattgagagaccaccgattccaaatgttcgtggtactactgatcaatcacatctactgattagaatgaatgcataaaatcaccttaatttgatcaggatcattcacattgattattgccccaaccattttttgtagggctttttccgacgtgcgctgaaaaaggtgaacgaatatgaatgcttgcgggacaacaactgtgtcatcgataaacgcgcgtgattctatttattataaatgaatgaaaaatctttaaaaattcgttttggataattttgatcatgctgatcagtgccattttcagaggagcgcaattcatgccgtttctgtcgcttacagaaatgcctggaggtcggcatggacccggcgggtaaaaattcgggagtggcacacacatatgtatttgcacctctaacaatagttggagttggcattttgggcataggcatttaaattttcgagggtgagttcccccccccccgcgaaaaattgaaaatttcaaacaatttccaaaaaaatcttagaaaatttttttaaaaatttcaagaatttaaacttttgtaaaaatttcagctattttgtcggaaaatttttgaaaaaacagtaattcatcttaatgctttgaaaaaatcgttaaaaatttttcgaaacttttttttattgaaatttataaaaaatttctaagatatttttgaaaaaattttctaagttttggttttttaaatttttctgcggaaaacgatacggagatgcggcgggggaagaactcgtcctgttttcgaaatgccattgctgtccctgcgttatttcatttttacataattttagcggtacgcccggacagagacttttcgggccaacagcagctgttgacgcgtcgcctgtcactttcggcgggtggcggcacaacaacagcaataacaccaacgacaagcagtagcagcaacacaaccaacaataataacaacaccagaaatgccactggggccggcggcacaaatcgacgggaaaagcgccgggtgcggcaaacaacagcattgggcaacaatggtggtgccggcggtaacaaagcggcgccgggggaagatggccgaaatgggcaacgaatgcccgtcgaaatgcgcactatgctaatgacggtgggtggagagggccaatcaaatcccgctaatccagcgggatcccgaaaaaacccagggatttggacggaatcctgacatcgggatccgtccagagccgtttttcaaaaatcatcaggattggtcggggatttcttcgtgattccgagttgggatctctccgacccaattgtctgtctctacttcgtttgtgcgcaaaactgacaattcccgagactcgggatggccgaggagtttcgaccaccattaaatggggttggcattccgtcccaccccctgaagaaataaaaaactaaacatttttaaggaaaatgaatgcataaatttctttaaaatatgcataaaattttccccagtggcgcctctcggcagcgcctctgacgacaaaattgccttaaattcttcaaaatttgaccccaaaatgaatgaatgtgtgggcaatgtttccccccccccctaaatgccaataacatcttcctgaatttcagctccagaacattgaggcaaaggtaagcaagcggaagtgagtggttgccccgagggcgtccaatcggttttatgggtccaatcaatgggccgggccatcactcagtttcttaggccataacttttttcttacttgatcaatgcccacatttaccaagccaagaatctatgccttggctaaataagaaaaaaatgatggcctaagaaactgaggaaatgggccataaagtgcaatggagccaattttgatcactcttgagaggcacagcacattttgccaaatttaaatttccaaatttttcgggtggtccgtggtgacactgtaaaggatgcgtccgaaatttatccacttcacatcaacaccatccgtgaggtgatcaatgatccggcaaagttgcgcggactaagaacaacggtgggacgggcattcaaatttaaattttaaattaaaaaagtgatcagattcgctatgagccctatcggatggcacgcaacgaggagttgtgcgtgattgtctaccggcgtctaatcgccgccatcgattgggttgaactgttggccgaacgaatgggcggtctgagcactgaggatcgaatagcattggtcaatcaatcaattattgagtatttctgatcacagtgatcagaaaaagtttgatttttgatcagcaatattttttgggcaggttaaagcctgttttggtccattgacactgttcaagtgttcagcacgcacagccagtgtgacagaaaatgaaaatataagtgggcgagggaattgatcactttactgatcagaggag

SEQ ID NO: 9206 - DNA, 1430 bp, Heterodera glycines
tcaaatgcttagacttagtcatagatcaatgaacttgggtgttttctttttgattgtttcaaaaaaacaaacagagtttgtgcactgatcgatttagataattgtaaaatatgggtgatcattgatcaaataccccgactgatcaaaattggccagaaatccgccattaatcaattctgtcttttttgtcctattttgcagatgctttgcctgtgcaactttgcctatgtgccgcgtgagatcagcaaagcttactccgatgcttagtccgtgaatttttatgacaaaaattcatcgtcccaatttagtcatttggacaatgggttggtcgaacggttgctaaacgatttggttggcccattcagacgcattcatcttacagaggaagaggtgacagacagcattaaagtgctgataaaatcagctgatcgagcattaatattgattgattagagtgtggcaaggagattcttggaaatcccgatcaattagagaacatgataatctagatcaatagtgatcaatcagttaacaaatgattaggagcatttggccaaaacgtaaatcaagtataattgtgaaaaattacattgattagggtataggcagcgaagatcaaacggaatcccgggaaaagcataaaaatatgatgccaaaaagaagcggagtgtgggacaaagtgagacaatggacatgtgagaacctgtaaggggatggcgcccatattagctcagtcggttagagcattgcacggcatggaaaggccgttggttcgagtcccaccggatgcattatctttatgttctgcaacagattacttagaaagttcttcaatgggaccctcatcaattgattttcttggcaaaattcagtgatcactttaaaaatattaaattggagattttaggtgatttgtttgtcggctatcattgtactaaatccgatggcacgagacctaagtgaacatgacagcagaactgtgctttcagctgaggaatagaatttgcgcatcgctgtatcacattgtgaaggtggaggaacactgtctcctagaaataaaaatttaaaaattttatcaccagacgcttttttgtcctcgctgatcccttaattcctttgaattaaaaattgataaatgaaaaaatgaaattttttggaataatagaaataaaaggaaaaatattaaatattttgtcaaataatatattaaaaaaaattttctcacgagatatataaattttggaaaattacgcaggagaaataagaatttattgatgtgtgaagagcgaataaaaaacagagcaggtcgtttttcaaacagaagttttccaaaaaaaattgtcagctattttttctaaatgttatgatgaaataaatattcgggcccacttgagagcaataactatttgtatcctgagaaaaattctcga

SEQ ID NO: 9207 - DNA, 2101 bp, Heterodera glycines
aaacaacaataattctcaaaaatattagcttttggaaataaattagtcttaattgccttgcggcgctcaatggctccgcttacatataagattttaaaaattttaatggttacaattccaagctaaaaatggaaattagaaagcaattacaaacactagaaagggtaataatttgccacgaaatttgtaactcacatgcgacaaatttcacccggtcgattactccgtcgatgggcctttgcgtgtctttgaattccacgtgttccatcatgaaagtccacacgttgtcacagaagcgataggctcgcaatttttccgcctcaaatggattaattatttcatccgattaacaaaatccctccatattctcctctatcaggaaaaccgaccttgaagctggttttgttcctcacccgctcggacaatgccttatttatgcacttgtcgaaggtggtcatcaccgtgccggccaattgctgcgaaatcattccatccgcaattagttcgtccaacgaacctttgaaagggaagacaaatgtttttggcaaagttaataaagcactgaaaatcgcactttgtaaagcggtgcccaaagtggtggaacggtacatttgataagtcattgtggccgaaaaagagaacactgttgagaaaatcaacaacagataaataaacaaactaaggagaaataaaaaattaaaacgaaaaacaaataaaacaaaacataaaatgggatgggattttccaataaaccgaaaaaatgcttaaaatttaaaaatttaacaaaaataatcgcgacaaaataattcgaggggacgccgtgttaactctccgcccgcgtcaattcattggccgtcagtcgaaatattcgaactgtgccattggcacacgcggaaaagagaaaaatgcgcccatcgccgtccttagccacacacaaatagtaaatttcctcctctgctccgagaagtaactaaaatttaccacataattcgtggttttcgttttgttcgaattgtctaccgccaaaggctcgccactttttgcgtcccaaattctaatggctccgtcgatacacgcggaaattagcgaaacggaacggtcagtgccaaaaagccaagcacaactcacaacggactcacctgaaagttgcattttcttagaaaaggatgctaatggattggtcacccacttaccgtcgtgttcacattcatgtctgctgctacacttttcccagtcgaaaatactgagatggcccgcggatgtgccaactgccagccaattcagtccgtcgggggcaaaacggacaaactcaacactttcgtcggttgatccattgtcgtcagttcgacccttgaacaataatatttacttaatgcgtcttacatttaatgttttttttcggtttttaattatttatcttattttatgataatcgtttccactttatgcgccttcttttcttacttttgcttggaatgtgtgcaaatgtcgtgcgtttttttgtgttgtgtttatcagtgccgtaaatccatttttacagccaatcgctgccaaattggcgccaaagttcgcatcgattgccccgctgctgggcccaggcaaagaaatttcaacggaattcgcttcttttaagtcccaaattcgcgcaacagaattttcataggctgccaataaaaatttggcatcggaaagtaaaagtgcggccaaacaaggggaagacgaattggtggtgaaaatctaaaaagggtttcatgtgaggtgatttaacgtaagttatggcacagaatcactttcgattgatggacggcaaaaacattttgactttccctttggtcgatcagccacatccaaagggatccgtcgttacatcccgcaaaaagaatgccctcgacagtcgagtgccaaaacagccagccaatttgctcagggtcagagccttggccttcctcgtcctccccgttgtcgtcgtctctccgtgaaggttcgacgaagcaatcgtcgatctgtcaaagtttgccatttgtaatagtaaaggatgaatgggcttactgaaagtgacgccggttgtgtggcttcatcgccccgccccttttgtgcaaat

SEQ ID NO: 9208 - DNA, 1527 bp, Heterodera glycines
  misc_feature (1511)..(1511): n is a, c, g, or t
aagagttgctctgtgcggatggaaagggccctcttttggagggcgaagaacgcattttcccatgcgccggcgaatgtccgggagggttcgactgcgaattttcccctcgggatggaaaagggcggaatttgctgtccgaatttgtccgaactttaccggttatcctcgaaggacccttcttcaggcttttctcgttttttcagattgtacaaagaaaaaagtgaggagcttgaggaggaaggggctgagagagaggagggagacgaaggacaaaagacacccaaaagggggacgaagccgcgcaaagagggaaagaaaaggacgaagccaaaggaaatgggcggcgtggatgccatggcattgttggaaaagcactacggggagggcattgcggtgagtgcgagtcaacgggccaaaggccaactcggactgattgtgcttcggtgtcagaggcttcgtcccaccgcttttccccccgccgcccaatcgccgccgcctccgtcccccgaggcgaccaatcttttggtcagttcacgaacagttgaaattcgtcgaagtcagcccaagcaacgtcatcagcagaaaacccagcaaggttttaatgttgaaatgacagctaaaaaagaaaagcgacaattggcacagattttgtgctccgtccgcggaacgcgcaatacgcggcaaaagcattgccaacacaaaacaaagcacggaacacgaacatcagcggcgaggagtacagctgcagaagacaaaagttggaactgttctgtgaagaccggcgacggcaaactcagtttgtgttgcgatggtacgccaaaggtacggacggagtgccaaaagggcagtcaaagccgacggattggcattttatttcagacagagtttgtgtctcctatccgtggggatattgcgcaggtcagtgaagaaagcgacgaaggacaaagccacttaaggcaaaccagttgcctctgatccgaccattcgaactcgggaagaatgcgaaatgttatgctcggcggaccgattggacaaaggcaacaaaaaattacacttttgggaggagagaaaacgaagcgatgggagtgggacagagaaaaacaatgccgaaggcagcgaaaatggggtgagaagggcacgggggcggtgaagggtgtacaattaggtacctttgacaaatgccattgtcagagatgaccttgacaaatgccattgtcacgcaatacctttggcaaatgccacattgtcagagatgcccttggcaaattccattgtcacgcaatacctttggcaaatgccacattgtcagagatgcccttggcaaattccattgtcacggaatacctttggcaaatgtcattgtcacggaatacctttggcaaatgccattgtcacggaatacctttggcaaatgccattgtcagagatgcccttggcaaatgccattgtcacgcaatacctttggcaaatgccacattgtcagagatgcccttggcaaattccattgtcancgaatacctttggcaa

SEQ ID NO: 9209 - DNA, 2606 bp, Heterodera glycines
  misc_feature (80)..(80): n is a, c, g, or t
tttgtgttgcgatggtacgccaaagggtacggacggagtgccaaaaggggcagtcaaagccgacggattggcatttattncagacagagtttgtgtctcctatccgtggggatattgcgcaggtcagtgaagaaagcgacgaaggacaaagccacttaaggcaaaccagttgcctctgatccgaccattcgaactcgggaagaatgcgaaatgttatgctcggcggaccgattggacaaaggcaacaaaaaattacacttttgggaggagagaaaacgaagcgatgggagtgggacagagaaaaacaatgccgaaggcagcgaaaatggggtgagaagggcacggggggcggtgaagggtgtacaattaggtacctttgacaaatgccattgtcagagatgaccttgacaaatgccattgtcacggaatacctttggcaaatgacattgtcagagatgcccttggcaaatgccattgtcacggaatacctttggcaaatgccattgtcacggaatacctttggcaaaggccattgtcagagatgaccttgacaaatgccattgtcacggaatacctttggcaaatgacattgtcagagatgcccttggcaaaagccattgtcacggaatacctttggcaaatgccattgtcacggaatacctttggcaaatgccattgtcagagatgcccttggcaagtgccattgtcacggaatacctttggcaaatgccacattgtcagaaatgcccttggcaaatgccattgtcacggaatacctttgccgttggctcacttctccgcttttaaggagtcccatttggatttgactaaagccgatgaaacactcgaagctgtccccagtggattggcagaaggaaaatctggggaaagcttccgaggcgaaggcgaagaaatgcctttcgcaatttcgtcgggtgcgcaaaacgcggaggaatcggcgcgcgaaacgaatccaacggcgtcgtccgccgaattcagcgactttctcctcaatgaccagcgacgacaccgtttgacttcctattcattctctgataccaaaatttgttttgttttcctaagctaaaaagcgctgtttgaaagtgtctccgtttcgatcgatgtgtcccgacggaatgccatcccaagtaaattttgagggcgccaattccgaccatcgttcactccctttggcgtcagttcactttacgttggcatttccgtgacggcgtctgtttcgcctatccctacggatattgccatgtttgtgggcggggggggggagggcggtcagatcaattgggaccgattattggctgatcagggcgaatcggtgatgacggaggatccgatcaaaacggagaaggattgcctgaaaatatgtaccacgagaggacagaagcaaaagacggacgaggagggggaggagagagaagaggacgggaaaagggagagagaggaggaggggaagagagagagggaagcggagggaatgagagagagggaagagccgattttgggaagacagcggaagtaaacggaaaagaaacgaccgacggaagaaagcgaaggacagaaggccaaactcattttcggctggccaatggaatgggtgttctgctgctgctgttgtcctcttctgtcgctgctttttcttattatttttccccttttttaatttaatttttattttccaaataaaaaatatttaaaatgcgaaaaacaaataggcaaatttgggctgaatcagtttgagatcactcgtacatacaataaaatttaaattaaaactcgcgaattgatgacggtggtctgagaagttgtgagcacgcagaaagtttgggacggtgaatggccggcggcggatgcgaatcgcggatcatccaccgatagattggggttgatctgcaggagcaagcgatttgtcattagatatttattttgggatttccttattttcttcctttcctcttaattttcttcatctctttctcgcccctttcactctttctacactttccttccttctctctaatcactcccttctctcttttttctctctgattactttcctctctgtctctctctctcagtctcagatcatttcccctcttctctctctctctctctttctctctaattgcttctctcttttttctctctgattactttcatttcttcttcttctgatcactcccttctctcagatcacctaccctctcctttctctccatttggattattatttgtctctctgtcactttcttttcctctcctcttttttctctcttttcccctcttctctctcttttcttctctctctctctctctgctcttctctctctctctctgatcactttctttcccatctctaattattatattccaactcgcctccttcttctcatttcgctcatttgtactgctgttccccctttgttcccgattccttccgatgcgaaatttggcaccatttgaatgggctgatgatgggcagaagtaatgcatctgttggaggaagaaaagtacgttgtaatggcggtggatgaaaagggaccgtttaaagccaacaattggcgaaaggagcgaacagaacgttggcgata

SEQ ID NO: 9210 - DNA, 5862 bp, Heterodera glycines
ttgtaaaatttttcaaaaaaattatccctaaatttaatatttttttcttaataaaaattttttggtttaaaaatttgttcatattcgaaaaaaaactttaaaacatttaataatttcatttacaattgaaatatttaaagttttaacgtgtttcgctacctaaaaagcgttaataaaaaattttatttgcctatttttgtgcctatttaatgcctattttgcgatttttttctgcctttttaggtgcctatttcgcgattttttgtgcctaaaaatcgcatccctactaatcaataattatctctaactctaacaaaaatattttttcaattaatttgccataattttatatttacaaattcttatttttcttcagtgatcggtattatttttttggagttatgttttttattcactttatcatttaaatttattaaaatattttatttaactttattcaatctaaatttgaatttgtttaataaattctcgatctgtattttgattttgtttaatttttttcgcgcagtacggatgagcgagacggaccacgaaacgtcggaggaggaacggagcggtaatctgtgccgactcgtccaaactcaaagccacgattttggttgtttatttgtcggatctggctatattaaattttgatctgtagaaaaactattatcgtgtagcttttttggtttttattattttttcattttaaaatgttattttaatgtttttcacaattaattaccaattgaattttttacattaaaaattttttaaggctgcacaacatgatgaagcatatttataaataaaaatagtaatttattgcaagataattagaataaatgtgctgtttttaaatgttaatataatcagttatttatatatttaaatagaatagcaaatattaaatgtaaattatttattatttaaatatttatattttggctcaaagtttccagcaaatatttttatgagtttgtttttaatggcatgtcattttaattatgaatttttgttcttataatcaaatagtagttagtatttcattatgtagacatacttatttaaactaaatcatgcgacatttgcggagcagataaaaaatgaattatttgagaataatggtttatttgaaaattcaaaccccagttggccgaggtccggcttttctggtctcggctgagaagccatatttgctttattttaatttacgtaagaaagttgaactgtttagtaattattcaatgattttttttgaacaatgttagtatttgtcttataaaatggtaacattaaattttgggcatctaatataattatcttattcatttgtagtaattacggtgctaggtcgatccacaaaaaaactcagtgtgggcgatccacaaaaaatctcagtgtgggcgatccacaaaaaactcagtgatcgataaaattaaataaataaatttaattattcaattcacaaaacacggtgccgtccggttaatactaatgtacggcgggacgcaagtcattttcaaattttttaaatttttcaatttttgacatcacttctcgccaattttctccatttgtagtagacatctttatttttgtcttataactcttttagctcttttaatttttatcaattttcaatttcgaaattttttatgtgtaattaaattaaattaaagaaaatttgtttatctacataatataaaataatggacctatcttttatttctttttcttgttttaatctcattatcatggctcttttgtttgcatccaaataccgtatttgctctaattatagcccatgggggattatttttcaacctcctcagaatacaggggataattagagactgcgtgattaatagagactgtgggattatttttcgactgatttgtttagtgaaaaattttttgaattttttcgaacatgtcgccaaaaattcagcccggcaaaaaataattatttataatgcatttttgttacagaatttctgtattttacatgaaaaatttgaaaaattccatatatttagcaatggagtctttttgctgtgtttgtaaagcaatttatggaggaagccacagctgttccgtctgcaaattgccgtgccatacattctgtggcgattctggtgggttgaaaacgaaggcttcggcggaaaggtcgtgtgtcacaactgcgtaaacgaggaaggaaatgcaccgatagcagaatactcagaaaatgatgaatacgaactgaaaacaaagagaatgaaggcacgccggcaaaagacaagaagcgcaacaggaacaacgactcagtgaaaaaactggaggctgtcgagtgtgcgcgaaagaactccatacgtgcagcagcaacgaagtcaaagtggacaggaaacagatcaatgactggatgacacatgaagacaaactgagaaaacagatgtacttaatattttaacatttttttgaccaaaatttagcatgacaccaaatggggggaagcgcatgagacttgagggagcgggtcgaccagttcaacatccggaaatcgacattgcattggctgaatagatcgccgagaaacgaaaaaataaacagcttgtgtcaaggaatatcattcgccgaagggcggcttcactgttcatagacattgacatcaaggtgagaaaactgctacctatactactagtcagaaaccgccgtccaactatgcagaagctgtggcaaaattcatcaattttgttgaacaaagacgaaaggcgaaaaacaattttcccggcggcatctttgcgatggacgagacggccgtttggttcgattgcccggacaaccgatgcatagacatgaaaggcgcaaaagatgtaataagtttttgaaaactatttagagctatttcctcaaattaggtgacagtggtggccaccggccatgaaaaaatgcgagtgacagtgtgcctaacagcccgcagcagacataagctcaagccctatgtgttggtaaacagaaagcgaccggtgccgcaaattatcaaccaatttgctggaaaattggtgatcaatttcgatggctctgtgtggatgaacgatgacacaacggaggactacctgcacaaataatcggggcaaagctgttcgttggcgaacgcctcttgatttgggatgcgtttggcagccacaagagcgagaaaacgacgaaggtggtgaaaggattgggagtggaaacggtttttgtccctggcggttgcatcaaattcatccaggtaccaaagcatccttctcaatgaaattcacttttcttccctaggctcccgatgtctttcacatggtacttgactggatccaccgatcgtggcaggaaatctccaaagaagtgatcatcaaatcatttgagggtcagttaaaaaatgaatacaggaaaaatgcttatatatttaagtctgtgggctgacaacgccattggacggaactgaagacgaaaaaattgcttgtttcaagccggaaggagcaattggaccaatagggatcaaatttttgcgcgagtttagaggaaatcaaacaatgagagatggaggaaatgttcaggaggaagccgcctatctgatgatgatgtagagctggatggagtgggagatgacgatgaattgctcatttgttagaatttttactagtgttttttgaaaataaatggtgttgataaaaattccatttatcccccgggggataaattgagcagggggattatttttcaaagccctcagaaaggggggggggataattggagccagcgggattaatggaaacggagggataaaaagagaaaacacggtaagtagttttttttctccgtactagtttcgatatattaagcataaataacacatttttcacttggtttgaggcttttattgggttgatgaaaaattgaccctttaagcacttcaacattaaacaatttttatttcacaaaaaacaaatgttcaatcaatgatgtactcaccattttgatcaatgatcctcccccatcgttcgggcaacatttcaatcccctttttataaaactgatcatttttcgatccaaaaaagtcatccaatgcattttcgacctcgttttgatcagcaaattctttccctctcaagaagtgctccatagatcgaaacagatagtagtcacacgggctgatgtctgggctgtatggtggatgaggaagaaccgcccatcgaagtttttcaattttttgttgcgttgagaacgcaacatgtgggcgtgcattgtcatgaaggagtacgccgccgcggaattttgcagaaaatggaggacgacgaatttggtcatgaacccgctgcagttgttgctggtagatgtcggcgttgatggtttgcccagccggaacaagttcatagcggaccaaccctgatgaacaccaccagatgcacagcaataccttcggtgcatgttgaagacgcctgggggtcggctcgcccaattcgtttggcttcagccattgttttatgccgttttgttgttgagataaacccacttctcatcacacgtgatcagctgggaaagctgcattccagcactcaaacgggcgagaagttcagtgcaggtgaccactcgctgatgcttttgttgttgggtcagtgcatggggaacttcggcaccctttttgttgatgaagccgagctgatggaggtaattgagcactgttgtctgatggaccccgaactctgctgcaagttggcgcgaactagaacacggatgctgctgaacgtgctgctccaagtcgtccgaatcgagagcaggtggtcgtccggagcggggttcatcttcgagctgctcattgccttcacgaaattttgtgaaccatcgcttaactgtagaaagagagagtgcatcattgccctcactttcacaaatatttcgaagagcttgggttggggtagaattttttcggaattcgaaaagtaacagttgtcttaggcgaattttgtccattttttgaaaatcgttcgattttgcaaaagtaatggctatacaacaaatgcaaatggcaaaaagatggccaaccgtccgctgattaatccaattgcttgcctccctttttcaatctctttagaattaaatatcattttttgcataatttgttttttcagagggtcagaactttttcaaacccaatatatcgaaacaggtgcgcagaaaaaaaagcaatgcctcaaaatgcgagctctatattttatatatatcattatgtaaatatcagactttctgagtatatttcttactatttttaggtggtatattttatattgaaatgataaagtgaattaataaattatttcttgtccacaatctggtgtgcgtactactctgggcagtctgtattcagttttattgcgtaaaaataatttcatgtaaatcaaaaataaaatagttttgcatcacacattcatttttattttcgaatacattttttgtttattttattttgatggtggaaataccaatcgttttttcaatgctccaaccgtgatattatagtttttaattttttttttagtttcgactgctaaataaatgttttctttttattttaaatcgaatgcatttttatagttgtatttgaagttttcattaatttttaagaaattattatgcgttttaagaagagttgcgattgaaatttccaaaaaatattatttttcttgtttttaaaaaagcccggtaaaaaataatttacgggagcggaagttcaaatttttccgggagcgggaatcccgtaaaactcccgctcccgtaaaaaatcccgttcaccgaaaaaagcgggagtcgggagtgggactcccgctcccgccgggctctagt

SEQ ID NO: 9211 - DNA, 5994 bp, Heterodera glycines
gttaacaatttacattaaaaattacaaaatttttcccggcggcgcatatcggcaccgccggacccttccttccccacagtttctcaaattctctttggataaagcgcgccgcaaaaaaagggtgtaactttcccaaaaaaaaaatccaaaataatgtaaaattacttaaaatattttgatctttttaaaaaatatagaaataaactaaaaacagtttgttttacatggttaaaaatttaaaaatttagcctattaaatattttttaaaaaatttattatatttttttttgaaaaattccgagttccgacatttttggggtcggaattccgacttccgaaaatttttggggcatcggaattccgacttccgaaaatttttagtgcctctgaactccatccctgggacaaaccatataagagccgaaacatatcctcaatcccgcaataaaagattaattaagccgtttctgaatcaaaatgctaaatttgaactttcgactttttattcaaatttgggccgggattcggaatgttttcttaggtcggctccgtcgttttgttttccctccttttccttttcaccattttttcttctatccccccccccccccccctcccgatgaaattcgccggcaatggcaaatgccatggcgccgacgacggtcacgtcactgtgccggcgttgcgcggcgaaaatgagcacattgcggctagcattgaactgtgaactctgggcatttcttctttgttgtttttaggattgtgaaattataaaataaaatgacaacggcacttttgtgggatttttacatggaaaagcgggaggccctcgccagcattcagcagtttgactacgacaccaacaaattgggcatacggctcggccttgtgtcgacgagcgatgtcgcaatggacgaagacagtgacggggacgatggccggccgacggagagggtaagggagacgaatggtgccattctatggcatcgtttcctcattgtcagaccccctcccccgcctactttcactaattaccaaagttttgagttttatatgaggagttgctacaatctgccgatgatactaataataattgttgcccaacccccattttacagaaaaaaacggaattttaaaagtcgagaaaatacgatcagttgttactaatggacaaaccccaaaatataaccatgtttaattattgtaattcatcttcatctaacaataagttattgtcagtgcgtcactaaacgggggtcaaaaggcgtcgtcccttccattgatttcccaatttgattttacattcatttattggctcccccttctgaagggtgccttcgctcggattcgcgcgacggcacagcgatggaagcgacgcatttgcacacgccggggccgcgagcagctgaaggcacagctcaaacggctgaaggacagacggcccaaagacaaaaggtgcgcgacgcgatgaattggcattacgaccgggaaataatgggacagtaattcgaaattttcttttggaattttaatttcaaatttcagggcaccctaacaacagaatatgcgaatatttatgggcatggaattcctttttccaacttttttcaggcctctgaataaaattaccttgaaaattcagcatttttcaaaaatctttgcttttgttttgtgtcatacttttgtcattgcatttgcttccttttcagaatgcgcacttttctcttccttttcggcttgttcatgcttatgcaagtgctcggcactctgtactattttatcattgcgctcaaatatcccaactttgccaaatcgtaagcatttttcagttttggtaaatgatttttactgaaaaatcggaaattttgatgttttttcagagaatacgcaataaattattaaaaatttgaaattttttaaatttctcttttaaattcatttttttgctcttttggcagcaccggcacttacgtcggtatcgttgtccattcgattctctttttgctcatcgctttccgtccgttgcgtttccttctgttcgttgcgctgcccaaactgatgacgggcaaactccggaacatcatcgtcctaatgatgctcatttggggcttccaagtgcgtaaagatgaaaatcttttgagacaatcgccgtcagacaaacttttttgtttttaaaaatgggaaagtttttgatagtggcatcgtttttatggcaaaaaaaggtggctgcgatttaatgcctttttaattactttttggatttcaattaatcattcacctacattcgtccgttgattaccccccccccccacaaagtatccggcacaaaatgccaccggaaacatcgaaacggtgatcgaaggcgtcgcgtgcgttgcgtttcacatcaaagaggcggcgcaagagatgaaagacttggcaaacacacatttgtacaaggaaccgttggaaaaaatgcgcgagtttttgcgcgaacagagcaaacccttcgacggcatccgacaaacactgcgccaaatggacgaatcgttgacaaagtgggttttgcactgtgttgggtggtcacaaaggaggtgcactcaaaaatggccaaaaaataatttaaaaaattacccacgccctgaacttgcgcggggaggtaccgtaccgcattgtaaaaatggtcgaatttggatggattttttaattttatattcgggatttcttcgttttttagaatgttagcatggcagcgtgcgctgacttctcgtatcaaagggctgatgaccaattgcacggacattgcacagcttcccttcagagcggtaaaattgtgccatttcataatttaaaaaatgctaaatttgtccaattttgacgccattacttttcatttaatttcccacttttctcagtgcgtcggttggctgtccgaacggcacacggattgtctgaaccgtttcctcgagttcctttgcatgcccatcgactgggccaagcatttgtgttacatcaccaaaatgttgcaattccattgcatatggccctccaaagtgaagggggcggtgaaggagggcgtcggttattttgtgaaaggcgccaaacaacgaatcaccgactacgcccgggagacgttcatgtacgacatgtgagttgttggcacggattggtcgattggttcggttcacctccaggacacctaaaaaattgtttcgattactttgcttcgtaatttcctattcatattctgaaattttcattcttttcttttcagtgactcaattatattttcaggtacaataaaacggtacgcgacagtaagcgatgttaatgtgacgagaaatgacagaatcatcggcgatattttaaaatgaataaaatatttcccctaaaaattgtcaggttgagcatgggaaattgacttttgaaactgctggacgattgtggtggaccacgagcaaaatttgacggggggtttcgccatggaaaaggaccgagtgcaaattgagctgaaggagcagatcaaaggcttcaacaagtgaacaaatgggatgaatgaccatgccaaatgagaagggcgggaagggaatctcgagggaaaaaggcgggattcccgaacgcgtatatacaaactcaattaaacgcgcaaaacaaacaccgttgcacttgagcatttgcaatttgaactaattttcacattattttttttttttcaaacactttaattctccgtttagcttaatggatgccatcgttttgctgctgaacattctgatgattttcttcgccatttggccatttctctccgtaaaacattccatctttttttaattctaaattgcctaattaatttcccaaggcttttctgtacattcgcgcgtttatgcgcagcgacaaggcggacaaccgtttcattggcaaggactttataaaaattgacgaggcacgtgcgctgaccaatcagcccaccgttttgccactgatgcaaaaggagcggaaacacgtttgttcatttgtctccgattctcctccccttttttaaattccccaaaattctttctcttccaaaataatgtaaattccccccccctcttttacagcccccccccccctcttttacagccccccccctcttttacagtaccttcgtatcacttccatgagaatgacccgtcgggagaacatttcgtggtggatccaaaacattttcctcggctacagtttggtgccggtggtggtattcgtcgccatcgatgtgttcatctaccgggtcatcaaacgggcgttcgtctttttccatggcaacaccaccgttttcccaacccccagcatttacaaagtgaaggtgatgatggccgagggggcgtattttgaagaattcaaataacaaaaaattgtaaagaggaaaaattattaataaataatttataaaagggacaaagttggatggaggaaatgccgcttctctgtgctgaatttttgtgcattgttggtgattaaaatgaaaatttgcagttttttaagcaaattttgcccaaaatgaccatttaaaaaaaattaagaatttctgggtttttcctttaaaacggttcacaattttttaggaaatgttgtgcgataaatatttccatttttttagtttcggtttctcacttttttcaggtgtccggtgatggttttctgaaccaattgttggccggaattttgcggacgttcgttcgttttaaataatttatttttttatcactttttaacaatgattttactattggtgtatttattgcatacagttttgaaccaattgcggattccgaccggcgcgatcggatgtggcgcacttgtttcaaggaaccatcgcgcccgaattatgagtaaaaataaattaattaaaaagtataaatcagatttcgatatatatttttagtataatttcccaatgtcccagccttttccccaacttttacgtccccttttaccaataggctgttccaaatctgcatcatcctctacctgttctgcattttgcttatcactgctggggttggtttttgtcttttttcgcaatttttaaaatccaaatgaattaatcgccacagatttatctgtcacgcgttcgccatttggtggccctgcactatttgcccgagcgtgcgcacccgcgagcaatgcatttgtacaacaaaatcatggccaaccgagaggacatgtgagtgctgacagtgaatggtgatgatgaaaatggcaaacaaacagtgtagcagtgcattaggaggacaaaaaagcgaaagcattgggcaaaaaacaactgaatgggcttttgtttggcatggacgttttaatttttacaaaagattttttggaaatgactccaaaaattcaaaattaaatcgctcactaaatttttatttagccgacccatttccgacccttgcccaattcctcttaaactcttcacttttaaaaatattttagacacaattaactccactcctacccaattttacttttttttgtcttaataaatttcaaaaaaacattgataaacagggattaactcttcaatttctttccttaaaactcccaaatttttcgtcaggatggaacggatggtacgcgtcaagaagaaggacgaagacattggggagcaggagagacagatgattctgaaggggctggcggtgctctccgaggagaaattgcgctgtcaccgctgctcacgcgtcgatttgagtgttgcggaggcatcgtacggaaggacggggcggggggggggaggcatttggggagggaatacatgaaaaggtgtccaaaatggttttgcaaaattaatataatttcgaatagtatccaagaatttttaatttggttgaaaaggtgaatacgaattcgtacggcgacgttttgtccttttcggccgacaaatgcgtcataaatatttaacgagattttttaatgtaatttggaagagttttgtaatttgccatatttttcttcatccagcaaaattcggctttg

SEQ ID NO: 9212 - DNA, 4507 bp, Heterodera glycines
  misc_feature (9)..(9): n is a, c, g, or t
attaaatantggactaaaaaagcccgaaatatggactaaaaaggccaaaaatggccaaatatggaccaaaatatggataaaaaatgccaaaatatatgttgtaaaccccccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaatgcagaaatgctatttttaagcccctttcttcatagcatatgcgcagaaaaaatatgttaatccatataatttacaaccctacaaatgaggcttttttgcttgccgaatgaggcttttgaaaattttcatctgcgagccctggtttattcctatttaaatttattttcagcaatttacttcgtctgtcatgaacaaagtcagctttaaattcaccccttctcaggtttgttcttctcttaatccattcatttcggctctattgcagttttacacgaccagaaaaaaaggttgaaaaaattcacaaaagtttcaaaaattaagataaacaaaaagtgcaaaaacgaattttctatttgtttataatttttctgaaaccaaatgaatcttaaaattttttaaactgcaatagatctttcatttcttggtcgtaattcatcttcattatttttttaaattcattattctcttttataatgttttgatttgtaaaagtttaggtcaaaccttccgaccgatttggcagcaaaccgtcgaaagatcagctgaatgaatgtacacgaattgcggaagaaaataaccaatttttggatgatagggccgcgcttgtctttctcctggccttgtttattctccttcagatttgcttttctgtcgccaattattcgggtcttttcttgcttacttcatagcttttgcggagaaatccaataattatttatcgtatctttaatctttgataccaattgccgttttgagtgcgtccctttaactttggtcgttttaggccaccaaagtccgccaatgttcggtgattttgaagcacagcgacattggatggaagttactgtaaatttgtctccctccgaatggttttccatctttcattggtctgattttctaacatttcttaatttaggtatgtcaattcgactacaaatgatttaaattattgggggcttgactgtaagtgcaaaacacacattaaattgctaattttctttaaagaccctccgttgaccgcttaccattcttggctgcttggacaaatgtgaatttattttggtttgactcccaccgtctatcatttcatcattatatccaattgctttttgaagtgctctttttgtcgacccaaattgggtccgtcttggccattcgcgcggtttggaagagccccgtctcaaattgttcatgcgcctttccgtcatccttacaatggtcgctttgtttgcgcctgcgcttatacatttggtattgggtcaacaacgaacggaggaagccaaagggaacaaaaaaggcattgtcatggccaacccgacaaaggttgggtcggatttactaaaaaattaccgaatcggatggcctttgtttttgaaggtcctccgtttggtcggtgctcctctgctgttccccggccttttgttcgtggactgtgcccactttcagtacaatcactgctccctcggcctctttctgtgggcgctctcttttctcgagaagggccgtctccgcaccggtgcttttttctttgtgttggcccttaaccacaagcaaatggaactttaccacgctttgcccattgccgtttttctgttcgcccgttcattcgttcacacaaatcgaattcgttcattgttttcggcaattggacaaaggcaggacattcgatgaaattccctcattttctattcatatttgacttttttcagtgtctttaatttgtttcaattggctctggcggtgctgctcacttttctcattctttggtctccattcctttggcctgagccttcattggccctccaattgcttcgacggattttccctttccatcgtggccttttcgaggttttaattgtcttagtttctaataattattaaattgtccaaggataaggtggccaatttctggtgttgtgcttctgtgctggtcaaattcaaacaaatgttctccataaatgtcctcgtcaaggccaggcaaaatgctcatttctttttctttgcaattttcttgtgattttacctttttccgttcttttcagtgcctttttggtgtttttcgcttgcgttccttcgcttttttgccttttttatcggccaaactcttccaatttgcgcgtcgcattaactgtcaacgcattggccttttttctgttctccttccaagtgcacgagaagtccgtccttttggcggccatgtgagtgattcaaaaaatgagcaaaaggcaaaatgtatgcgatttgtctgtaatatttttcttcgcatgggcaaaagggttttactcttcttcatggaagtgggatttttgatgattggtgcccctggaaataaactgccaattaaaactcattctccaatagacctgcgcttcttttactgaacgacgaatcattgcaaaggccgacttctctctttttggtcgcctctttgttcaggtgattaactgcggacaaatctctcttggaaacatcaaatcccccgcctcccatccgtttccctttttcatttcattttccttttcagtcttttcccattgtgtctaaaggacggtgttgccgaggttcttccgctgtttttggcctactcttttctcctttggctccaattcttccgtttttccaatggccgacctttcccttcggtttgtccctcctttttttgtttccttattttcccatttaagctttacaactttctgttttgctttgttttggggccatccttcgcaatttgtgtctttcaacttttgctctctccgcccgtccgttttccccatttgttcccattgcttaacgcactgttcaactttggcatatttacagtcttttggctacatttaaattttgtgatagttcgccaaaatttggccgtgttcaccgagcagagaaatcgagaggcagtgaaaaggaacagtgcaaagcgcaaacaacaataaatgtgttgcgatggactcgcgtttttggatttctaaataacaacaacagtcgctccttttccgctttcattttggtctcaattttcatctgttatttcatttcttttcacctctataaatttctgttggaacatttgcgcgttcatttttatacacagttacaattaaaaacaaacaatgaattatacaaaattaaaatgaggactaataatacttgagtatacgtgcaggaaacagaattgtaatatcagtgaatcctcagaatcacaaaattcgaatgggcaaaatgaattgagagaattgcaaaaaaaaaaaattggaaaaatactaaaatgagagaagagattatacaagagggaagcattgaaattaaaaggatttggaaatgccttcagagtttgggttaaaattcggcagaaggactatcatttctcataacgctgtggaaatgaccgaagcgaggccgtggacgagcaaagtcgggggtaaagcatcagtcagcagtcgcagtttggacaagtactgctccgacttgttgctgtttgtcggaggtggaagtggcaagttcaggaagcacatggctgcgctgctactattgcgctgaatggtttcgttgaccgccctgacaaacttttcggagtaatcggtgatgtcccttaaatgagaggacacagaatagagcaaattatggaaaagccaagaggcggcgacttacgctgcgctgcttcccccagaggatttcgttggtttgtcgaggtgttgaaccacgtgatcccacgggaccatcaccgacttggctttgatgcgcaactgctcgagcatggccttcaactgcagctcctgatggtgcatgtccttaacgattagtgcagtttcaacgccattggttagttgtgagctttgtgtcgctcacctgcaaactgttgacgcaaatgtgcactcggaggatggcactgcgccatttgaagagcattgaaagaatacacgccaatggagcacgaacag

SEQ ID NO: 9213 - DNA, 1997 bp, Heterodera glycines
tccccggcgccgttggcattccgtcttcattcgttttgccatcatcgctctgtttgaacaaatgcgagggccaaacatcgatgaaacgacgctcagactgtctgaaatggaaatgaagaaattgcttacggtggtacaaaaggttaccttagtacaaattcacgctcaaaaggcccaaagtgacgggccacacacaaatttttatttagattaacaacatcgttcagtatttgcacgtattccacaccatccaatcgctgtttcgccttcagtgcgttttcagtgtacgaaattccattctgagtgaattacaacactttaaaaatggattttttctttacatcgttcgtgttaaaatattccaccacttccgcacgaccaatcttcgagaatttgaggtccttcaacagatgcgcttcggtcagtgccgtttccgatgagtccaattcgtgaaaagccaacaccaccgtattcggcttcatcgcgcccagcccactgagacggatcaactgaaaaacggagggattttttgaaaagaagacatcaagcaacgagaaaggcacctgctgaatgccattgcgcacattttctgccaaagtcagctcaacgaacgccttcagtttgagatagtccatcagagaaagccaataggggtaaacctttgggttttaattgtttttaaaatcgtttaaatttatttgtttcccacttgttgcagagggtccatcgttgtcccttcagcgtccatttgccctttttggacgtgtccgaccacataaagtccactcttcttcaagtcgttgacgaagtccatcaatgaacagcaagtggccggccgattgaccagcagaagaacttggggacgccaaaatctgaaaaattaaaacattattgcattttatttatttaatttcttattttcccatcattttttggtgtattattaaattggtgttcacttgacgtgctccttgcgcacatccaacagcagcaaatacttgcgcacttggtgataaatgagtgcctgcgaaatggagccccaagagccaatcggagccttgaaaattgagcgaattataataaaaaataaaagtttgattttgcctgataatgaaggatcataatcagcaacatcagaatgaccaccgcaacagcagacattgacgcatcaatgatcaacatcattacgaccttaacacaaaatactaatgagaaaaaggggagaaacgaacagtcgaaatggcacccaacgcacagctgtgccaagaaaaatatttgaaatttgggcggaaattcggtgccgaagtcagttcaagcgcgagctaaacaatgtcaacatttgtgcaagaaatggggaaggaaactgtaaaaatatggtaacgaatattgagagacggaaaaggcgtacaatgaaaatggagaaatgcgggaaaatttgctgagaaaaagttactgtggcaatgttgacgcccatgtaagagagcagaaagaggatggaagtgatttttgcgattcgattcatcgctccgatcatcaaaaccatctgaaaagaaaattgacaacaaatgcaaaaacaaacaaacaaaaaagcttaccacgacacaaatccacgagataatgacggaaatgatgggattccgtttggagcccacttcgatggtcgccggtctgagcaaagcgccgaaaagtttgtcctaattggaaaataaaagtatttttgacttcatccctccatttgtccaactttgaaaaaaacaatgctttattaattcaaattaatttttgaaattacaaaacaaaaattacctgtgcaaatcgagtgagtacgcgcgaggcgccgattaaattgctcatcgatgaaaagaaagtggcaacgaaaatgccgagcattatcaaggagggcacactgctgatatcgaccatggcctaaaaatgagaggaattttgtggcatttgctttttaactttcaatttaatcctcaaaagaaaagtttttt

SEQ ID NO: 9214 - DNA, 2094 bp, Heterodera glycines
  misc_feature (26)..(27): n is a, c, g, or t
ggaatttaaaacaattagcatttaanntttttatttttctatacaacaatttaattgaattttataaatcatttcggagacatttgaaatggcgttgatgatgaggagaaaaaggaagaggaagaaggcgaaaacgatgacccaactgctgaggatgaagccgaagcgcaacagaacgggacgagaagttgcggcgacggatgggccggcgaaagcgccgcggggggcggaagaggcgaaggaaaatgtgtaaaaaaacaaaataaaattgaaattaatattgtaaaagtattttgaatatttttttagcacagcaattacaataccgattcttttgccgactttttagcatttttcctgccaaaacggcgaatgattttcactaattgccccaatttgctcactgtgtcgtcatcattttgctgctgctccctccttcttttggcttcacagacgacgaaattgagcacaaaaatttcacgtcatttcgctttttcttttctttgtaccgtttgttttggaaccaaattttgacctttaaagcgggaacaattcgaatttggcccgggattggctgaaaatcaatgaatgttcgctttgcctggtcggggcgaagtccgcaacgccgggccaatgcgtttcgatggtcgcgattgatgtgggtgttttctggagagaaggggtgggggggacggcatcaggacaaaattcggatggaattcattgcattttgcattatatgggtgggagaggaaccgcagctcaaaaaaaaagttatttatggcgaaaaaagtgccagaatgtggtcccccaccccaaatgcactaatgattgacatgaatctaactggaattgtggtgcgaaatttactatctagaatgttcggcggatttcatttgtaaatatttttaatatgtttcagtgatcaaattggttcattcgacagtatcagttttgaagcattttgaaattcaaaaatcaataaaagggaaaaaccaaaatcttatacggtatatgcttttaccgtaccttacttcagagttttccttagccccatttccccccacccctttccccacctttgtatctgcgttccaattgcgccacttgatcagcagtaaacaacactcgctttcggatgctttttgctccgtcttcggcaccgttttcctctacacttccctgctggtcggcattcatcccattgtcatgccgaaatgggaagtgttgttgcgcttggtgcagttgctggtgcgcttggtttggctgtgctggcgttagcgcaaattgtggcggagctaagaaaaaaaagcaaattgaatttaaacaatgaatatttaaatcgaaaattttaacattaaaacacatttaattgcattgcatccaaaaattcgaaccaatgaattcggcagaattttgcggttgaaagaaggtggccgtcggaccatggtactgaaacggcgccgaaaaagtggcggaagaaaagtcaaagggcgcgggaaaagaagtgaaatgaggcggaaatgccaaagaagggatttggacaaaagtgttattattattagtattattgatattgtgaacattggccggaggattagaagacatagtcaagcctctaaacataagttgggaagagaaacatggaaattttttttgttaaatttccgaattttttttcttgctttttgtcagtcgctaacgccataaagaaaaagaaaattttcctgaatttacctaataaaaagtagttctaaatcaaatttaaaatattttttaaatttcagttttcaaatttccagaggctctaccggcaacagcagactcactcatatattttgttttttaaagttacattcttgccgcgccaacttggttccaacaaaaggtgctgataattgataaatttttgagcattttaaacctcttgagaaaatttcactgaattttggcctggaataccgtgacgcaaatatgcatttcactttctctcgaaataatagatggcccagcacgttttttggtcccggcatttccataatcccttttttcgcaaagtcctcgatttaatgccacacaaattaaatattacag

SEQ ID NO: 9215 - DNA, 2631 bp, Heterodera glycines
  misc_feature (37)..(37): n is a, c, g, or t
ggcaaagtgacaaatgttgccgcagggacaccgcccncggtacagtctcaccggcggacgggcacaaatttggcaaacagcggattttttatgcatttggtgccattagcagcagcagtgttgggccgattttaatgagtgaaatacctatttaatagtattaagacgttttttatcattaagaatttgggtgtttacaaaagtttagtctgctaaattggcatgtttgatcggcacggctcggcatgtctgctggagtccattttgagtttgagtgattgagtgtgccgtgccgtaagtgagcaaacaaaccataatttgcatatcttttccattttgcataaaatgaatattttatattaaaaaaataaattaggtacaattatattaatttttctgagtatttataaaattcaatggaattgtaggcatacattttaaatattttaattaaaacagactacttcatggttttatcattaattagcattttatagattctgagcacattaatcaacttttaatctgcgactgcgaccagaaaaaattattaatggaatttgcttttttttgaactgtaaattttggttttgccgaaagacgccaaaacgagaaaaaaattggaaaataagttgagactttttctttgttgtgacaaaaaaaaacagtttttagtatttcacgtataaccatttttttcaaaaatagagtaaaaatctacaattccgtatttaaaaatgtgttgaagttgcaacccataaagtaatttattttttcttttcttattgttcttcttaaaaactccaagaatttttatgtttatttcaattttgtattagattaaaaaattagaaaatagtcaaatattaattctacgattccgattcatttgtttaaattaatacaaacccctattttgatatgattcaaagaatttccattttttaaattggataatatatgaaaaagattacaatgatgcatgattaccacccaaagatttctgatcatccgctcatcagttcattactgatcactgatcgccttcttcgcaataattcatgaatgagtgagtaatcatgttttccgatcactttggtgctgacgagtgatcaatcaatcgcattttgtgcatccgctttttctctcctcgccccctgctcccgctccctaaattttttcggcacttttggttgactaattaattaactggcgaataatgcgttggtcagctgtttctgattttcgcggatcaccgacggacgagagcagcggagaagaatggaaatgctttagcaatatcatttgttagcgtttgcatcataataaataattgcgcttctgcaagcgattcgcgagaggaatcaacgggaaaagcgaagaaaacaaaactcgtcccatcggacgaacattggacagtgattataaaagtaattgagcataatcagtggcagaactttattatgggcaataataattaagaagatgaggctaattacggtccccattaaaaagcgcataagtgcattttaatttgataatttaatttaccattaaaaagtcattcttatttatgttcatcactctaaatttattatttccaatttttctttaattttacaaatcctttgtccattttaattgacattttaccgtcatattttacatcttcggcatctattatccttaacttatcgctgttttagcttctccaattcaatgtcattcgacacggaccaaaaattgccggttaaatcgccggccgaccagcgccgcgaggcaaatgccattcgcacattggcattcgtcggcgtttgtctgtccaccgtgtccacaatgatttgtgtggtgtccgttccgttggcttaccagcatttccagcagatgggcaccaacatgttgagcgaaattgacttctgcaagtcacgctcgggcaacatttggaacgaggcaattaaaagcgaaaattaaattggaggagaaaaaaacgctaaaattaaatatttgtttataataattaaagaaaattttcaaaaattgcttttattggcttaggttactcgtacccaagttctgtcgcaagtgtacggcaaaggcggcgcttttcgcgcagttcgccaagccgatggttacggtggcggaggaggaggtgccagcggcggaggagctgcctcttcacaacctcctgcagctggaggttacggcgcgggaggaggagctgcaggaggtgctgcgccacagggaggagctgcaggaggtactgcgccacagggagaagctgcaggaggtgctgcaccacatggaggagctgcagaaggcgctgcaccacagggaggagctgcaggaggcgctgcaccacagggaggagctgcaggaggcgctgccccccaaggaggtgctgctggaggtgctgcaccacagggaggagctggaggaagtgctgcgcctcagggtgcagctgcaggaggtactgcaccacagggaggagttgcaggaggcgcagcgcctcagggaggagctgcagggggagctgcaggaggcgctgccccacagggaggagctgcaggaggcgctgccccccaaggaggtgaagaggaggtgctgcaccacagggaggagctggaggaagtg

SEQ ID NO: 9216 - DNA, 1827 bp, Heterodera glycines
tgcagggagagctgcaggaggcgctgcgccgcaaggaggagctgcaggaggacctactggaagttacgctgcgtctggccccgttagctcttctgtttcgggaggtgcaggtgaacccacgagaacaagctgtgttcactttcattcggattgtatgttcaggaggtgcttgctgcggctgtggcgtgtctgcgcccggtcctcccggccctcctgggccgcccggactcgaaggccaccccggactgccagggaaccctggggaccggggccaagacggtaaggcagtcataaaatcaattaaatggtgccgaattcgttgcttcttttagctatatcgccaccaccgaaggcacaacaaaaagaagcgtgccaagagtgcgaacagccgcaggtgggaaattgttaattactctaatggctttttaattgccagaatggtcttcccggcccccctggtctgcctggtccccccggaaatgccggtgggcccgggcagccagcgcaagggggtggtgccggcgcaccgggaccgatcgggccgccaggacccgagggtcagcccggagcacccggaaacccgggagagcaagggcagcctggcaagctcgaagaatcgggtgggtttttcgagccaattaatgcgatttgtttttttatttaaggtcaaacgcagggtccgccggtcagttttcagggcatattgttaatctgtgggtattttggtcattcattcccgtgctggtcgtttcctaaaaatcgcaaagaagtgggaaaacaaaaaatgtcaacatatagattcataacttggttcaatttcaaccaaattaataatatttcatcgtatccaaggtgttctctacaagaaaattaatttagaattttttttttacaaaattgtaaaaaagttatggtcataatttttgagtcaaaattattttaccagaacttttttaaaactgatgaaattttttgaaattttaaacataaatagagaattcttttgaattatcgaatacatagaattcattttgacttaatttttaatgactttaaattttaaatgtttataattatatttgcataaccatgccaaaaaaacatagctgttcaatgctatataactttttttcaaaagcaattagattaaattttctttttagaatttcaaatactctatttaatctcttttctttaaaatttcaaaaaatttcattgagttttaaaaaagttcttgacaaaaatttccgacttaagattttattatatgttaaaaaattttgaaaattaacattctcatataaaacaactagagctattgaaagataccatgaatattaattttgttgaaattaaaccaagttatgaatttatatgttatacattttttgtttttctaccctttggcagtttttaggaaaaacctatcaacattcattcccattttaattgcttagggtccgtccggccctcctggccaacccggcggcaatggcaatcccggcccacccggccccaacggcgagcccgggccccaaggccccccgggcgacgaaggacccgcgggaacgccgggacagcccggaaacgcgggagagcaaggaaaattgggcgagggaggaaagtcgggggtgtgcgatcactgctcaacgccgaggacggcgccgggctattagagggaggaggaaaaggaaaaggcgaaggaaatgccaaaaaatgcaaattgtatttttaagattatttgaagaatttattattaataaatttctattgaatatgcacaaatgctgaatatctcggcaataatacctctgattaatgttttgc

SEQ ID NO: 9217 - DNA, 4096 bp, Heterodera glycines
tataacttttttctttgtcaaccaaatttaaccatctttacatcattcgaaagcccttcacgtgctctattttagccttacaaaaagcaaaaagattttctagcctaaaaaatgtattaaaaaaaacttccaaaattttggttttttgtaagttcatgttataacttttttggtaattgtctaatcgcgaaacaatagcttagaaatagcttctaaacatgttaagctttcgaataataccaagattgttagatttggttaacaacaaaaaaagttatagtccgaaaaattgggctggcgccaaaacgtcggcgccaaaacgaccccgaccctgccctcaccagcggtggcattcggttggagtcggtttgagagctaatcaccaatttttttttaacttgtccgctaaatcattttaaaatatacttgaatttttttactttttttttatctaattttatttatccttttgaaaatgcaaattgcctttctggcaaacaatttggttgaatgttagaagtaattttacatgttttctcaatattaattctttaaactttcaaaaaaaaacgattatttttagaaatttattttttgtttcgggtaggtaattcagttaccatttttctcaactcttttttttgttcattttgcacattttctataaattttttgcttatttaatttttgggttttcttcactaaaaaaccccattattctttgttacttattctcttcttatgctcattattttacttttatgaatattggatacttttttgtgctcttagaaaagcgactcttttcggcctttggcgtttcttttaattataattaattcttttttcttctaattataattaattctttttttaaattttatattttacctcctcgtccgcctatgcgagcaaatttaactattttttttttgttttccttttaatatttataaaataatttgggttccctcttccctcttcaaaatatgtgtgaaaatttatggaaatatgagctttacatatcctaattaagaatctcgaactccaggcatggtagactgcgcctttaaattattattagtaaaatataactcatttttctttaatatttatgtcaaaaaattccaaagctttgccctaatagagaaagaaagcccaattccgattcccgaaaagtttttaaagccgtgaaagtccaattgcttttcttttaaagatatttataaattttttgtattttttttacgttatgcattcataactcgaaactattaaaaactaacgaataaatgataaaaaaatattcaagaaaatttttttgatgaaaagaatttctgagaaaaataaaattttctaatgctcgcccgcatgcgcagtcgccaagccgacgcccatgtggcgctgcggcgattgtattcggttggagacggcttgagcgtgaaatcgtcaatttttttcacttctgcgattatccttttttaaagccacccccccccccccctgaaacccaaaaaggtaaaaaatttcaagaacaaagtgtatgtttttgaaaaaaagatctcaaaatggcaaaaaaaaatattatttgaggcgaaaaccggtctcaaaaaaaaatttttttttttcaaaaacctgggatcttaagatctcagcaaaaagaatcccccaaggatgtacttggcattcaaacagcaccttctatttggcattcataaagaaagcgtcggggatgccaacaggcgcagcagggagcctaattaaggggttggttggtcgtccccgagcctgctgccccggtcccgatccacgaactgatatatttttaatatatttctttctacaaaaataaattaaaattcgtgccaataaattttttcacaatagtttccccattcaatttataaaaatttcctctaataaaaaatcataacattttttgccgatttttgagtttttgaaattaaaattttcgtaaaaatgaaatcatgtgaaatcaaacaaaatctgctgtacataaattaaccattgctatgttatttccaaatggataagtaaataatacgctttgatggcggactaaaaacgcaaaatatttgcataaatttcatgaattttcgcataaaattaacttttctggaaaatgcgatgaaaaataatataatcgtatccacccacattcattcattcatttttggtaatctcagaaaatataatttgagaattgctgaggaattaaatttttttaatttatttttttctatatttttaactccattttgggcccaattctttgccagttcttttataccccaaaaaccgggctggcgcccagttggcgatttatatgcacatgtataacacaaaatgaattatcgtcaacgatttactcggtgggagacgacaatggggcgccggcccgataaattttcatttccgaaaaatttactataatttaatccatttttaactttttaaaaatcatcattgtgtgaaattcaattttttaagttcagagaaattgtttttttttcttaaataaaatatcaagtcccctccccctgacaatgagcaataataataataataataatgcataattgtgagattttttcggcacttcccattttgagtgcaaaccttcatgcaaaatgcaattaatttaaattttcaattgaacaaatgaatttttcccagtgaccttatccagttataaagaaattttttccggaaaattccaacacaaagaaagaaacaaataacataagcagccagcagtgggagaaatagtacaccaatctttgctttattcattggaaaagaaacgagcgcagggaaatagtgcataacagtgcgccccgctgtcactcattcctcgccccttttatatcccagcaaaaaatagagcatttatttttcgtcatatatattaaagacgagcagctgttgacgctgtgcgattgctcgctgacgccgtttcccgctgctcgcggttggtcctcgtggccggctgcgtttgttcgctcagcaatactgctggcgagcagcgacaatggcaacgcatttccccatatggggctgctaagccaaatttggcgacgcgtctatatagatagacgtggagccgaaatagtcgctatggccaataagcgccagcggcaaatttgtccttgtgtctttatagacataagtgcaaatgtgggcccatgacgacccttaagggctcatggtcccaaaaatgggcattggcctggcaatggccaagccctcatgtgcaatcgctaattgcgatcgccatgccccctgccagcggttgtattcggttggagtcggcttgagcgctaatcgccaatttttttttcaattcgtttcgttgttttaaaataaattagcagggctcgaattttctacctttttaggccagttttaaaagactatttttttgttcattttgcttttctatatgaatttttcgtgagtttttcaggtcacggggagctcaggaaaaaataggcttttgcctaaaaatgtgagccctactcattattatttgttccttattctcttacttatgctcattgttttactttatgaatattggttacttttctgtgctcatgaaaagcgactctttttgatctttggcgtttcttttaattttaattaattctttttttattttaattaaatggcaataaattttttacccgtaagagagaaagaatgtcatttgtaactaacttttttttaaatactctcaaaaattttttacctttgaaaagctactcttaagggtttattttgatttcctctttttttaaaatccaaaatttatttttaatttgcgcattcttttgtattttgagtcactaagtagtacttccgattttgctacccccccccccccctcgctcccctcaaaaattttaattttcgaattttcagttttgtcccaatcttaatttttcattttttaaaaaaatttgtaatccattttttaataaatgatttgccactagtaaaatattttccgcaataaaaaaactaagtgtaaaaacatataatcaggggcttttgttcatggagaaattgaaaa

SEQ ID NO: 9218 - DNA, 1740 bp, Heterodera glycines
tttttgattctgtttaaaaagtcttctaattaaaaaatattcattagcataagaattagtcaaaattaaaagtcattcattgggaaatcttttttttaaccagccaagtttcaaaaaaatatattgtcgaggagacattgggcgaccgcgggaaaatttttaaaatttaggtccagtttgttagagtttttccaaaaagataagttatttagcagtttttggatcatttaaaaaacttactaattgatagtcccggcggttatgctgctacattcgttttaaatccaacaagggagcattaaaggacaaaggaaaacaagaaggggagaaatagtacataaaccagtgatcgacaaagaaacgagagcaactggggaaatagtgcatggatttgcgcccctctgctacacattcctcgccccctttacaccccacccagaaatacaaacaattatttacccatcatatataataaaatacagttcactgtgtcgccgtgcgattgctcgccgacgccgtttcgcgccgcccgccatctgtcgtcgcggttacggtcacaagaccggcagcgcgagccatatgccacgcagcgccgctcagacagtgggcagaagtttgtccccatgtggtggtaccgccacggacacacgccttgtgagagggttctccacttggctttggcttggtgatggcctcgcccgcatgcgcagtcgctggacgataccatgtggcactgcggcgcttgcattcggttggagtcggcttgagcaaatcgccaatttttttcacttttgcggttaatccctttttaagcccccccccaccccccgaaacctaaaaaaggaagaaatggtcaatttttttgaaaatttttatccaattttcctcttaacaaattatattaaaatttccaaaaaaaatttcccggtggaattctatcagcacagctggacctctcctcccattatagcatatttttgaaaaataaataaattttggcgcaaaacagctacaaatttctgtaaatcacagtttctattttgggattttttgaaaaaagaagaaaaatgcattccctaaaaatcggtttttgaattcttttcatttccgaaaaatttcctaaaatgaatatttttaaatttataaggcaaaaaagctctttgaatttagcgccgcagcaaaaatatatatttttccctaattactttttcaattaatcgttttgaaattcgattaatgttaaagtgcagagaaatcgttttatgttcataaatagaatattgagcgcccctccagcaaaaataatgaataatttaaatttttttcggcactttcccaaatttgagtgccgtcatacaaaaaagtgaaatgtatttttaaattttcaattaaccaaataagtttttcccaaattgcctttcataaacaaattattcctttttcggtaagtttcaaattaccattttttctcaactcttttttcgttcattttgcacttttttatatgaatttagttgattaattttacgtttttcgccactaaaaactcattattctttgttacttatgaatattggatacttttttgtgctcttagaaaagcgactcttttcggcctttggcgtttcttttaattttaattaattcttttttcttctaattataattaattctttttttttaatttttatattaaacttcctcgtccgccaatgtgaacacaatttaatattatttttt

SEQ ID NO: 9219 - DNA, 2643 bp, Heterodera glycines
  misc_feature (376)..(376): n is a, c, g, or t
tgggagggtgacaaattggtttggttttttttgtctgcgaagccctccgccatgtccgttgccggtgccgtcgtcgttgttttgtcgtgccgttgtttgggctaaaccaacaacgcattgaacagcgaacgtctcagcgcctcatcttggcgcagatcagaggtcgatttgactttgcgcaccgtttgaccgctgttttgctgtggtggaggcgtcggcaccatctgcttgggctgttgttgctgctggtcgtccatcaccatattttgatcactgaaaatcacatcaatgatgaaaaatgatgggtttttgccgtaatttgttttttcgaaaaaaagagagagaaaaaatgtcatcaattcaaatggaggagggngggggggggacgtaaaattttgaaatcagcattttgtaattttctcaaaatagcattagcatcaggcatcaattgtttatgtttttcatcccgtacaatggcactccacaactcttccgttcgtcgctgctcgtctccacttttggcggtgccggcggttgctgctgttgtcattgtttgggctgcaccatcaacgcatcgaacagctcacatctcagcgcttcatcagggcgcagatcaaaggtcgatttgactttgcgcaccgtttgtccgctgttttgctgtggagaaggcggtggcaccatccatctgctgtttgtgctggtcgttcacggcaattgggtcactgaaaagcaggtgaaaatctttgctgaaattactgttttcttgaaaaagtgagagaatgccacgaattcaaagtgaggagggccaaactctgaaattattggaacgaaaactttagaaaaaatttcgctaaaacgtcggttagggtttctgattagaatctgcagaaaacaatttgggactttctacaaatggcattatcatcacggcatcctctccccctcccccctccattggcaccaaaaactctaccgtttgttgttgttgctgctcgtctccactgttggcgctggcggttgttgcggtgttatcgaattggcggtcggtcgcttgtggcggttgctgtttgttgttgcttcggctgatgttgcaaaccgttgctgctgctgcttctgctggtgctgttgcgattcttcgtccgccgtttgttggtccgtctgtgttgcgatgtcttggcgcaggatgggcacgtgttgcgtcggttgttgttgttgcggctgttgctgctgctggtggtggttgctgttagcggcggcagcgaccggcggcgaacacaacttgggcagagaatggcggggaataaaaaagattgaaaataagaaatttgttgcaagtgatggaattcgtgaaaaattgtccttttatagactttcgtttcctcctccccacattaaaaaattgcctacatttgctaacatgccccgccccctttttcatgtttgtctccgttataaaaagcgcctaaaggctcacccaatttttgtgcattaacattcatttacatttctgctactatgtcctccgctgtccttcaaaatgccctccgtctgttgttcatcactctgctgatcatttttcatcactctgctgatcatttttcatcactctgctgatcatttttcatcactctgctgatcatttttcatcactctgctgatcatttttcatcactctgctgatcatttttcatcactctgctgatcatttttcatcactctgctgatcattttcaactgttgccatgggtaaacaaaaagcacagccctaacagtggatgttctattgcattttcacgacccggaaaaaatgatcaaaccttaaaaaatttacaggaccttaaaaattaatagaaccataaaaaatcatgatgacttaaaaacccaactttcttgatatcttccggtagacctatgagttcaacaccggggttttaacaagattaaaaaaaaattccaacaaacaaatgtgaaaaactgggtttttgaattttttttttctttttcagtacgccacgcataagcccaagaaaccaaccgatgagaagactcttcgacaaatgaaattgctggtctcagtctcaagctatggatcatcattggcgtctatgttttgctcgcgtgagttttccacggcttttcttttgccaatgccacccaccatcatcaatcacaatcattctatcgttttcccctctttttcagcttcgttgttgtgtgtgccattgttgtgatttgctgtctgtgccgtaaacgccgtgccggtcagcaggacaacgatgagctttcgacagcattgccaagcagttactacaaatcgcggcagggaccaacggattcgatggactggccgccaacctcaactgctgggcatggccatggtcgtggaggacgaggcggtggtggtgcgatcacggcggtgccgagcggaacaaaacaggaggaggagaccaaacaaaattgaaggcgtcgacagtgccgtcgggaggagaacattacacaacgtggtgatgcgcaatgaatgaacgcgaccgacggacggtgatggcattcgataataatggacgaagaatttcacatttaattgtctgtcgcgtgatatttgtgtccgccatttttgatgtgttcattcaatcatttcctgtg

SEQ ID NO: 9220 - DNA, 2636 bp, Heterodera glycines
  misc_feature (565)..(565): n is a, c, g, or t
  misc_feature (567)..(567): n is a, c, g, or t
ctctctctctcttcctcttttatcaattctaaatctttagataaaatgattccaaccacaattctccatcgatttaacacgctgttgttgaacagaagcaccaccaagccgtacaaggacacttttgtgctgtggacaatcgctctgctgatttgggacattgaagagcagaaaatgctggccttactccaattgaacagcgtagccaaagtgcatggacttaacagcttttgggatcaaataaaatcgctgatcagcgaaaccctccgaaacccaaaatcggagcaaaatgcatgtgtactgatcaagctgagcgaactttttcttattccaaaaaaagcattgccaaatattgcgagaatggcgtctaaatggcgcaaagagtgcgaagagaaaactgagcgcgagactgcgctgcggcgctttgttggcagcgcaaacggcgtactgtacaagaattgggtgagtatcgtattccaagtgtgcgaaaagacgaaagttggcgcgaccgtggcacttatgcaaaagcctggggccaaaacgcgcctcaaaaaagtgatgggcnancgaacaccggcggaagaactcttgacggaaaacaatttggcacacatttacgaaaatgacggtaagtcatccgttaatttgagaattgttttcaattggcattagtcttccctattttaaaattaaaaaataaaatgttcattttttggttctctgaatgccttccgatagattccttgggatatggcacaaatattcaaaaaaattttagtgttttttgacaatgaccgccttttggagcactacacttttggcatggaaaaagacgttcctctgatcgaacgcaaaagtcacaaattgggcgccgatgtcgtcgtttttatgcgatggtttgaacgtaaaagcgaacgccacattggcacggaaaagctccaactgatcataaaatatatggacaatcaaatttatgatccgatttttgatcaggacgaacaacagttggacaaattgggaacattcctcaaaacattatttatcgacgcgaaaacatttgcggaaaaaattgagggcaaaaacagtggagaagagaaacaaaaagtgcagaaaaacattttcaaaaaatggaaattaatggtggaaaatgccgataaaaatgagcaaggaaatggtgacgataaaaacggagaaatgaaagaatggatttgtgaattgcacgccaatgaatttttaaatttgatggaaaatgaggaaaagcaccgaagcttaaaaaacagtaattgaatttaattttttttttaatgttcaaatttgcaatgcgacaaaatcataatgtaaaaaaaactcagtaatgctaagtgaatttataaatgaataaattaaacattttacttattagcggtagaaaaactaaaaagttttgacatttctcagaaaatacagtaattcacagaatttgcaattttgaaattttttaaataaatatgattttgatatgcaacagggctggccgtgatcatggatcacgggaatcacgggggttttggggtgcagtgatcacggatcacggatcacgtgaatcacggcgtttttggggtgccgtgatcacggttcacggatttttttggaagccccgtgatcacggctcacggatttccgtgattggaaattcaatcatggccagccctgatatgcaacaacgtctcctgcaaaatcctgcgcggaacttttcctgtccggcctcttaacaatccgaatttttcgaaattttccaaaaaaaaagacaaaagcgcttaaattttccattttcaagctctcaacttacccaatcctggtcttgcatccgtggaataaaaatgaatatttttctattttcagttctaattcggcatggacctaaaaaggttcgcgaaaatttgctcgattttgttaatgaaaatgttgcaacgaatattttaaacaaattgaacacttttgaaatggtaaaaggaaataaaccgaaattaattttaaaattgcgccaaaatggaggagaattgaacaagcaaaaggaagaaaaggaaaaagaggaaacagagaatgatcaaaaaaaggaagaacaggaaaaagtagcggatgatgagcaaagggagggaaaaagggaggaaaattgggaaaatgcgaataaattccattggagaataattggagatgaggatgatgaatttacactggaaaaggaaggcattgagcaaaagcaaaaagtaagtgggcctgggtttttgaaattgttttaaaaagtaattaaagatataaaaaattctgttaaactttaattgaccataactattctttttttatccattaagctattttaagctgacctcatagcaaatagagaaaaggatttaaaaataattttattttttatggtctgtaaagtgcattagtacccaaaagtggccccgccggaaaagttttgaatttggcagcaaaaatagaaataaaaatgaattttgaaaagactttactaaatacttagataatttaaaataaatttggtgtgaaatttcgtaccaggtattttcgacagtgattgatttcgacagtactttttaattagttttatacaaatttattgtacatacatatga

SEQ ID NO: 9221 - DNA, 1493 bp, Heterodera glycines
ggtaattaataatattggtttctcaattaattctctaaatgtttgattttaaattttctatttcctccaaataaatgcctttttttataaatattgatcaaatataagtttatatattaaatataattatatttattatttattaaaatttcgtatttgagaaattttatagaatgggtattggtttattacaattttttatattattgattgttgttctcactaatttggcctttttgtcatttaagcatttgctgtttaatattttgcaagtatgctatataatattatttattttgccctgttctcgtccgtgctgagtcgttccacaaaaaagctcagtgattgataaaataaaataaattttaaaatattaattattgaacggcaagtgtaattctgatttaaattctattagatgtgttataaaaaagaatttataatatttattacatagctaaaaaaggaaaattcgcaaattaattgaagacaattgataaggtgctaattttcattgcatttcatgtaaagatttcataatttcattcccgaaacagtgaattaattgataacataagaatggatagtaaaattttgagtatttaagctaatttttattaatctataaatcacaaatttaaacaaataatcactctcacaatcgctgcaatgcatccaatcaaaaaatttaacaattttttaacgaaatatttttaatgggtaagattttttcaagtactgatatagcctaaacagcattagataagtgataaaaagtgattgtgtctgataatttgatttagtaaattttgaaaaaatcttcaattattaaacaacagaatttatttcaaataaacaagaaaaactgtttttcttaattttaattctgtttcggctataagaactcactttgaatacgcgtttggggccgtaaaagtcgggcattttccacttggtttgaagtttctccattgacttttattatgcctttttttgccttttttgagaaattattaataaaattggacaatttaacggccttcataaatcttcttgaccaggtgaccgtcattgatttaattttgtgaatttgtttttattcgtttgattaaaccagggatgggatcgcccaatgtcggtttccaaggacgggtatgccgatttgcaaggacatagtggggaaaattcatgaaatccaaggacatttaaaatttttattttatgcaatgaaaaatggttaaaatttattcaaatggcttgtatttttcaccggaatgaattttttccaatttttttgttttcactacggtgggtcgggaccgggtctgggcgagaattaccggtcacggtttttcccaaaattcccggtcctgtaccactctagttttcactgatcattttcctaatttgcgactcctttttttctgctttaaaaacgctttttttgcggagcgctttttccaaaaatgttgtggaacagggggggggggggg

SEQ ID NO: 9222 - DNA, 2060 bp, Heterodera glycines
aatttactacggacgacttggtacatgaatgggctatcgtcaggcatttccaaatttgagagttgctggcacactcgttccaatgtctccagaaaatgctggagtgatcggacatcgtcatccactggccgtagattcatcaactctgattggagcgcttcggcaattttccatggatcaccgaaaagtcgtttgagagcagcaacggcatgggcataattctctccgccacgataggaggttacggcacgagctgcttttcctcgtaggcatccatgcaagtaattgaacttgtcaaccggttcgagtggtaggcggtcaacagcactctcgaaactctgccaaaatgcgggccactcaagagggtctccatcaaagttcggaagacttagttgaggaagcctagctgcaaaggctggcagcgcgccaaactgattcagggctggaggtggtgggacatttacgactccttgtgcattagcggctatgactggctgaaattgctggttggccgcaggcaacggaatatgtgcatttgcaactgctcctggcagttgtcctcccccggccaaatgtgcttatgcggcgacgggcggaccattgagctcgtcttcaatatgcaccagcattgtgggacagagggggggggggaggtccggcggcgccgataggcgccgctgggaaaaatttgtaatttttaatgcgatttgtttacaggtttttgtccaaaaatgaccaaaatttgcgattttgggctaattttttaagaaaaaagtgactttatgcaataaaatttcaaaaaattctcaatcatgagaaaaaaattacattttattcacgaaagattcctaataccatattaataatcttatataataaagttgagtgtttgtgctatgtatgtatgtaacattgtttgaatgtggcgttttgtatttgctgtgaggagagattgaaaagaaaaagagatgaaaagaaatagttttgaaaaagaagaaggtaaaagaaatagtataggaaaagaaaaaagcaaaagaaatagttaaagcaaaaagatttctcttggaatgccggagatttgagtcccagagattgaaatgctggtgggttgagttccagagattggaatgtcattgaaagttggtgggttgagtcccaatgtttagaatgccggagatttgagtccattgtttggaatgccggagatttgagtcccagagattggagaaaaagcccagtctattttatcattcttaattctataacacaatcgtactgcctacggaacgggccaactccgtctgagccaactttgagtcaatataactcttgaagttattgaccgaatcaaacaatcttgatatcattcgaaagctcttcacaggctctattagcctactaaaaattacagaaaatttcgaactataaaaaaagatagaaataaaaaactttgaaaattctgccttttttgcggttttcaactgacaacttttttgagagctgactaatcactgagaaatagcttataaatatcttctaaacatctagggctttcgaatgataccatgattgtgaagtttggccaccaaagaaaaaagttatagctttttgaacattgctgagacggagttggccagacggagttgacccctaccgtactgcctagcggaggatgcgccgaaggcgcttctgatcactgccgatcaccctgatggagtgatccttggagccaattccatgaaaaaattcataattttttaatccgagcccaaattatcattataatttttatttttcatgttttttaatgttgactttctatcactttacttttacttttaaattttagtttaggtacgtttttagttgcaattaacattgattcattataaatatttagttttttacattacatattagaattgttcttagcttataaattatattcattatattttttgtgttgtgtcatgaatgctctttgaacgaaatgccaataataatgtaataatcaataaaaagcaaatgtataaaatataaaataaactccattcattcat

SEQ ID NO: 9223 - DNA, 1437 bp, Heterodera glycines
  misc_feature (1425)..(1425): n is a, c, g, or t
attaattttttgtttttgtaatggatccttttcttctttatctatttattatgtatatgtttaaaaaacttggaataaaatttaatttccgttgtaatataattcctggttgaataccatttttgcttcaaaaaagcattaaaagattaaaaaatacaggatgctagatcaaacaaaaaagagttttcacaaatcctttatctttacaatttccaaacaactaatgaattataaatttttgcagctgattatttaacataaataattgatttagcctttttaaaaaataaagttttgctgaattttattactgtttttgtttgaatttttactaataaagttactgttttttttttgttttttatgttttttatgttgtttcttttgtttggttacattcacaaatattagaaaggtttaataaaaaaagactttttttttgttattgttctgctatttttttaaatttgaattttgactcatttattaacacattttcaatcaaaaatgcttaaacaatggctaatagcgcaaaacattttcttattttaaatttgttcatgtaaactgtgatttttaatttttttttattataattgcaaataaaaaataataatttacattatatttacgtttatttttaattttgtcaattatattgattttcaacatatcctaaaaaatattccaattattttttaatttaatttaaagttagattttaagatattaattttatgatattttaaatttctacaaaaaaaaattattttatataaaattgttgttcttaaatagttaattaattataataatgtcaagtcgatctgattatctctttcgtcctatttatgtttattaaattttctattatcatgccatatttaatattttgcattttttaaattctttttcagtattataaactgtaagattaaaagaatagctgctttttcgataaaataaataaaaattgtttctttcttattttatcatcgtttgcaatatttaaattttttttcttgaagtaaactgtttttaagtaggactattgacttcctctccaattacaattttatggtttcgctaatatatgtatttaattttgtcttatgatatttaaaaaaacaaaattctattcttagatttattttctttgatggtttgttgtactctcttataatggaatgccaattaaattagaaattgtaattgctaaatttaaagagaatttattacaatagtccagtttcatgtttcacgttttacggttcgaatatgttggttgctactataaatatgcttaaataatttaattgtattttaagcggataattgaaaaacctattaaattatttgttttgaatatttttatttatttgatcagatatttgttgctttaagttggtattttcggttccgaantaaaacccatgg

SEQ ID NO: 9224 - DNA, 1419 bp, Heterodera glycines
  misc_feature (1334)..(1334): n is a, c, g, or t
  misc_feature (1354)..(1354): n is a, c, g, or t
  misc_feature (1389)..(1389): n is a, c, g, or t
ttttttaaaaaaatattaaaatttgaaaaaaatgttaccaaaaaggggaccaaaacaaaattagtaccaaagatgaaaaagaagggacagagaaaattagggggaaaattcctcataaaaagacaaattgccgataaattttagccaactgataaagcacgcacccatcgtttgtttcccctttcctggcattccgtttacctgccgtttcctccgcctcctcccccacacttttgccgttttgtgtcgccacaaccgccgccgccactgctgcgcaactgacacgcgaagtgtgccgtctcataatgggttggaaccgtcccttgcccattgttttcttcgccactccgccatggcaccactcggacaacgcctggtgtacggcttcctgacgaatttctgtccgagggaagggacaaacgaaatttaagaaagaattggaaaaaggtttttaaaaaacaaacaaaccagaatggtatctgagctggtctcgtgcccctcggcgatgccttttcctctcaattgtgccaacatttcgtgggttcgctggaaaaaataggaaattaaattgaacacgcaaaatggggcaaggaaatgcatgctgttgtaaaacgatgtagaaaagaagaaaagtaccaaattaccataaaaatgagggttcacaaaaccacattttaagttagaaaaaattatttgaaaattgaatgggggggcaaaaaccgaacattggaaaataaagtatttgtattttgaaactcagaatttggctttgttttagcaaatatgccttggctttcgtaattgcgaccattaaaaatttaaccttcgctcgccgatgattgtgccattcgattgttttgctgtcgctccaaaattggcttaagcaaaagttgtcttcgcttttcgtagcccttttctgtgagatcgccttcaaagggaaggaaatttaggaaaagataagcaaaaaataagaggaaaacaccttcagacagctccaaatccaattgggccaatttcacccgaatttcatcgggcaattggcacacatcgacctccttcgacgagggcatcaaagcacaaacagtggctgatgtttgtgatgtttctgctgagacttgctttcaaataatatgtatgaataaataaacaccttaaactgggattacctaatcgtattttgtatggttttattcttttattgggtgacgggagaaagcttgtcaaaatgttttttcacggcattgattttaaggcataattttaatttaaaacataagattcatatcaaattaaatttgaaccaggtaatggtattaacattttcggaaattggnttaattttttaatatactanaaatgcgtcacaatcacagcgaagcacaaaataanatggagaggagaaaaaaggcggcgagcgaa

SEQ ID NO: 9225 - DNA, 2113 bp, Heterodera glycines
cccccccccccctcctagcccaacaacaaccacttcaatcgatgatctgctgcactatagcggaaaagaagggaaatgagcggacggggaattgttggacggccatcgaaaggtcgcaattaacgcccgcctcccctccccccccccccccctccatttggattcagtcagtccctttcaaacacaacagcaccccctcctagctaaatccatttttcaattaagctcctctgagcggattaccgcccgagggggcagagggcagcagtcatatcggcttcttctttagtcgctgctgaccaacaactctatttgtgaagggaattggaaggggaaaatggacggaaatgtcccactgccgcctcctccaaccacacacattgatggagcccgccttcttaatgctcctttttctcccatcgcccgaagacacccccgccgccggtggggtcagcggagggcgggcgatggccctcccccactcattccacctcaatgagcttttggggggagggggccttactggcactattctttccctctgttttctttccatttttatgatgttttgtgcgtgcattggacgaaccaaaattaatagaggaagaaaaagttcactcgaattatacacatcataaaacaacggagatgaaagagagatgattcattgttttcaaagtaaaattgtgagagtgttcgagggataaaacaacaaatttgccactgcttcgttcactagaaaaaaaagaatttatggcaaaataactcctctcccctggcagggagtcacgacatattgaaaatttgtaatcactatctgattttggcatgatcatgcaaagttttttggtatgtaattcttttatttgccaactttcgggtgccattcgggggtggctctcccgttttctcgaatcctgcccatctctgaccagtgtcattccccgtttgggcctttctgtggacgttccaccccattttccgatttccgtcaccaaaaaactggaaacatgaaaattggaatggaaatttatcattccaacaattacccatttatgctaattgttagctttgtccgccattctccgacgacaatttcggcggggggggggaggataaagtgaccaataaaaattaacccattaaaaaaatattggatgatggaaacaattagtgagtcatcgatggaagcgaaagaaagaaactaaagcagcagaacaagtcagcctcgttgaacgtcaagaacacgcttttggaaaatcggaatttcaattcattttcttattgctgatttttctggctttttcaccgaatttccgtcagttttggccgttgtttccgtcgcgtatatttttagtctctgccaatgatgtattcgcctttggcactttagcggaattcagagttttttccactatgcaatttactccccgcccctcaaatttccccgttaatttactttccaaattctatgcacgatttagacatgaataaattcccaccgccaatgttcaacaaattattccattcctcaatcacatcattcccattttcactctgcttctcctttattttttgtcctcacttctctcaaaaatatcgaaatgttctcttttcggcttccttttatcctttcgttgtttttgttggtaatttttgcggaaaatgtgcatggaaatggcaccgcagctgaggtgatcaatcaacataactaattaatataattacctgcgtcttcttaaattatttcttcacagccggcttctccttcttccttatcgcaggaagatcttttggcatttcaaatgcttcggggcgccgcttctaacagcacagatggcaaaaacgatgtggcagcaaacgacgtggagggcctggcgaagacgatcatgcacattttggtcagctccgtcgatgcggtgggttttatccgaagaatgggagacaaaacaaaactgtggccattcaatggacaggtgatgcgctttttcggcgatatcatctcaaaggtcactcgctctcttgatgatcaagtgccgcacaaaataattttgacgaatgagacggaagaaaattggccacaatcgtgacggacggattcgtagaggctaat

SEQ ID NO: 9226 - DNA, 1942 bp, Heterodera glycines
caatcttttgtttttaaagtgccaactttagctacatatttctggtttttttaaatattttcatttccataccaatttgtgtgctttgtccccctcccccctcccctccatcggcacatccaatgatcagctgatcaatgctttgtccgctctgtttgggccgcttcgccctccgtcctctcacctgcggtcactttctctgctcccattgcattctctccgccccttttcgccaatgcattccaacggatgccgaagaattaacgcaatgcgttaactgccaccaaaagattggctttcggcatatcccaacgacgatggcattcgctcgaaattgtgcgtttgtttaggagttaattgaattcaccgtcaaaaattgtcagcaaaagtcggcacaaatggaaaaattggctcaattcatccgtcaacacctccgctttactctttaacatttgcacgacttggccgccccagaaacagaagtgatgctggggaacatcagcaacggaccacggcactcggaatgcgcactttgcgccgaagtcgaattttcccaacgatggaaaaaaggacaaatggcagcgcaacagtgaaacaattgtgcacggcgggaagtcggtgatccgaaggggcggggaagtgttacggtggtgacacatgggttacggtggggggggggcggtgttacggtaagggagtgcatttattggcgtggcatatttttttgtttgctaatttcaataaccaacagaaggcactgatcagtcagcaaccacagcagcagcacggcacacaaattgcacaattcgaagagtcggccctttctcagcgccaattcattcgctccaccaaaaaaattcggtagataaactttttgcccaatggcattgacatttttttgctgaattaagtggagcgatgacgagcgaggagagttcgacaagggcagggcgttctttgctgcgcttgtcggtcgctttgacgcggctttaaattcgctctccgccgccgctcagccgaagggcacaaatgaaagaaaaagtgtggatttgcttctaagcgcgaaagaagtgagtgataaacaaatggccaattgatgaaggcaattttataagagtctttgcaaaagcgaacgacgaatttggagggagcgaactcagccgacaaatggtcgcccatcgactgatcggtgccatcgccgcggttttgatcagagaaacaaagacagatcagctgatcgggagattgccgttgttagaacaatgcgcgagttggtggtttccatggaggtttcagttttgaaggattttgctaagaaaggcattgtttgatatggcacgaataaacctatttgataatgtagtaagggcgccaatttaggagtacaatcgacgcgagtgctgccaccaaatggacgggcaaagtgccaatgtttggaacagaaaggccggacttgccacgattcagatgctggcactttcagtgctattgatttccagcagtggcatctgcgaaaagcatttggttctcctgaagcggcacatttccctcgtgggcatgcgaatgaacggaagagaaaaagaacaaaaagcggaagaagtgctggacgcattgctaatgtgcagcggacaaatcaacgccattttggggcgaaggtgcgcgaagaccccatggaaacatttaagtcaatgctcgagagtctcgagttgagaaaaaaaccgcgggtccccctgtgtttttgtctgatttgtgattaacaatttttgtgatctcttttgaaatggaattttaccaccacagcagggaaatgcgttttccgtcgcatttgatcagcacaattgcccatgtccaattcgttctattcgaagcgatggatcaaatcacccaacagcaaattttggaacgtaaaaccgagaaacggaagaaggtggggactaatgaa

SEQ ID NO: 9227 - DNA, 1283 bp, Heterodera glycines
acccccggaaactgatttgagcagaaattttaaaaaatttaaatgaaaccccattcttcaggattgccataaattatttatctcaatactgattttttgtcgaaaagtccggcgcccgttccatttcagtgattttttccaaaatttttgacaattgatccgattgatcaacagtagcttaaaaattgaattgctttttaaatttaaatgtaagctttaaaaatagtaattttgttttcgttttattttcttctcctcgccttttgtctgttctttttgctgcttttccaaattttagcacccccagggaagtttggtctggtctatcaattgtccaacattgtaaaaataaaactgcaggctgaaaagtttttgcggaataaaatttcgattttaaattgcttttatttaaaaaattcaaaaaaccaaaacattgaagaagaaaagcataaaaagtattaagaagaaacaaattgatcaactttagtgtatttcttcctcagagacttttcaaatcgaatttgaaattgggcccaaaattcgcctcaatttggtcatcagaattgaataaagtaacgaatggatgaaaagaatcatcagcaaaagattgagcaacgaaaaattcagaggaatctgtgaaaaagttatgggatttcgataatttaaatacaaaaattaattaaataaaaattatatttaagattcttaaattaattatttatttaccaacccaaacgaagtccatttttagtgaaaaagatctgtcgagtggccgaattaacaccaattcctacggtatcgccaacaccgtaggaatatttgccatttcttccctttccttctccgttaatgcatatatcgccaccattataatatgcataagtgcccttgtggctaagaattgttccatcgaatttgttctgctgtttaacagcgaatccgaagatcaaataactgaaattaaaataaaggaataacaattaacaataattgaattttaatatttataataaatctaatattcaaataataaataattctcttaccatctcttatttccaattgaaatttcgtagtaaaaaatgtcgaacgaattattgttcagaaaaatcggatgtttagcaaagacggaacaccaatcttttaaagataaatacataaataagtaaaatagggaaaaataccaatatcatttcccttaaaatggacagttagacttttgtcgccaatgatttcgagtttctcatgacaagcattggcatcccaataattctgtcggaaat

SEQ ID NO: 9228 - DNA, 2867 bp, Heterodera glycines
atttcttttttaaattccccaacagctatcggatctcggtcatcgtcaccagcagaaaaagcctgagtgcgtttctcgcgaactgagggtccactgggagggattttccttcgagcaggattcgtgggaggacgaggcggccatccgcgcggtaagaaatcattaataatttaattattatataaataaataaaaacaaaataaattccagcaagcgccattgatatatgtggcgtgggaggcggcccacgacgccaccgtatacatgtctcagccccgcgaggggaagattgccatgtgcttatatgctggcactgtggggatggactttggatatgatgaggggcaatgacggaacacaccaaagggaataagagaaatggatggcatatgccacagaggcgaagaggaagaaatgactggataaccttggaaatgagagggataggattgatttgcgatgggatgaacagatggataagtttacgacgggattgggcggtagatagcaggtcaatgtacattatgcacgatatatgaaattttaaatgctgcggatacagcatttctctcctcctcgaaaaaaagcctcctggcttttgcctcatctcatcacttctgatcagcttctcgcgtccatcgttctgatcagccttcgggcgcccattgatgaacatcatcatccgctgccgttcagttgaacaagcttcccatttgcttcattcacttatgtcattttctcttgacacccatctcgggttatttcactttcacgttaatggcaaattttgcttttcctttcttcaaaacagtctccggttttttaatttttaatcttcatttcatagaagaaaatattcgcttacttcttacttttctttttatcaattttatctttgcatcaattttctcaaaatgtgctgctttaccttttcgaaggttttttattccaaaatattcactttttttttgaccctttacttttccttttttaattacatcatcctttcaattttaattaaagtgcttcaattacatcttttttctgccttttctctgattttcacacattcattccttttttttggcttctcccaaagcttattttctgcatttccattaaaatttcatcgaattatgcattgtcatttattcagtaaaaccaattttggcattaaaaacggttcaacatttaaccagttaggcatcacataatacaaacaataacaaaaaatcacacaatggctttatgccttcaaattcacaattcatttttggcactaagcccttggcacatagtcattttaagcacacagcgttacctgccattttcgcttgacactaggagcacacagcttcgactagtccatggcttacgctcatttcacccattaattggtctcttttctgggagcacacagcttcgaccagtctcgtggcacacagccacaacggcactcagcccagctaggagcacacagctgcgactagcttttatcttttcatgctcaaaacctttgcacttatcctttcgaaaacagccaaaatcacaaaaattaacatattatcacattaaaacacagcgcattgatcaatcaatgatcacaaaatatgccataaggtttttgtattaccgtactcagccatattagccacagaaaatttgccaaatttctttcgcaagacaatgcatttttgttggttcatttacgttttactgaaaaatagcaatttcccattgctttagtccttttttttttgttgccaaaacgtactttaatttactcttcctatctccaacaaggaattaaaatttaaccagattaaaactgcttttgggtctgcgtccctttttaagtctgcattgttcaaattagcctttaatggcctcagacactttttgtctggaatgctctggaattttaattctctctctctctgtttaacaaaaaaattttacacaccgggtcgtggcaccaaaaaggtgttgtgtccccgggtttaaggcttcaagccatttcaaattaccacttttaggagagaggaatttattataaggaaaagcattgacaaataattatgaattgaaaaccgggaatatgtttggctcaacaacaacctcagagcattttgggtgggtcagtgcaattggttatttgggaaaggattgccaaaggcaagaaatggcacagactgacccaccgcagacatctcgcagccccccgagggggaaattggatggacttatatactggcacaatggggatggactttggataggatgaggggtaatgacggaaaaacacaaaagggaataagagaaatggatggcatatgcaacagaggtgaataggaagaaatggcacgataacattggaaatgagagggataggattggcttgggatgggatgaacagatggataagtttacgacgggattgggtcgggagaaagtagggcaatgtacattatgcacaaaatatgaaattttaaatgctgcggatacagcaaataattaatataaaataaataaaaaatactaaaacatatgctttgttttaccccttacaaattaattcacctttctctgcttctgttctttctccaattcactgattttctccaaaagaatcttctgatcattttgcatttttaaaaattgttcaactaaaattaatttttaaaattaaaaaatggacgatttaactaaataaaacattcttaattcatataataaatttgttcttagcttaaaattcactcgcctttggtcgtgatttcttcgtgctgctctttttgctgcttttccaattcactgattttttccaaaaatttcttctgttcattttgcaattgtgagaatcctt

SEQ ID NO: 9229 - DNA, 1719 bp, Heterodera glycines
agagggagagagagagcgagagagagcgagagagagagaaagagagagagagagcgagagagagagagagaaagaaggaaagagagagaattaaagataatcatgggaagagaaatgagactgggaaggagaataaaaggagaggcctaaggtattcatggagttttgggataaaatttgttgggcaaaaatggttcacataacaaaccggggtcaagctaagaataagcacccagaaagggtataaatagaacccgaagatgaaaattttcaaaagcagaattttagaatcaaaagcctcattaaaagattttattccaattacaaaaaatcaaaaacaatgttatgttttgtttttcattgtatcttattgtaagttttattttgcaaggaaaaattgcattaattttgacccgggctaatgacttcactatttccaccattatttttggtcatgttatttcaaaacaaatttctcaaggatagatagggccggtggtcatttagacgccgccggggaaactttttcaaattaaggtgaattttgcaacagattttgaccataaatgacctttttaagtgttttctccaaaaaaaacatcacaaaagcctcatttttacgaattaataaaaaaattaatatttaatatttgtttttctaaaatttatacaaattattctagttttacgaaaatgattatttttcattgtttaaaaaccagggtcgaaaaatcaaaatataattcgtgtgaaccgaagcgaaaaaagtatgagtgcgggtgatcggaaggggcgggtcatttcagtacggaagagttattcgaatgattaattaattatttaaatttataattgaatattaatctaataataaataaggctgtcaaaaatatgtacagaaagtggtccaaatatgtacataaatgtgtatgaaaaatcccaaaatatgtacaaaaacccaaatatgtaaataaaattttttttaaatggttattttttgggaaaaaaatcctcgtaaagtatgaaataggcacaaaatgtcataaaaattacttaaatagtcttagaatcacttttaatattttaaaattccttttttggtatttttcgtggctattttttcactataaatattcaaaatttcttaaaatatgtaaaaaaatttgccgaaattttgaatttttttttgaatatttccaaaaattttcgtaaaaaatcctcaaaatatgtaaaaaaatgaaaatatgtaagaaaaaatacaaaatatgtaccaaatatttataaaatcttgaaatatgtaaaatatgtataaaaccccgcaatatgtaaaaatatgtaaataaaagtcccgatttttttcgcaaacacaaaaaagaaagtgttttcctactatttagagcattggagaagccaggaaaaaaatatgtatttacataaaattgacagccctaataataaaagtatatttggctctatttaagttaacacgaccacaaaaaaagacacgaccatagaataatttgacaaatttaaggcactgtaactttttcaagaagcatcctaattaaacattcttgatatcatttgatatccctaagtgtcctttaattgcctttaaaatttcagaaaatttgcttgagtttcaaaaaaattctggtcaaaaaggtttaccaaatcaatttttgaaatttacaagccacaacttttttgaaacacaac

SEQ ID NO: 9230 - DNA, 1159 bp, Heterodera glycines
  misc_feature (40)..(40): n is a, c, g, or t
  misc_feature (65)..(65): n is a, c, g, or t
  misc_feature (89)..(89): n is a, c, g, or t
gtaaggtgtggctgcaatggggccaaattcagcggcgaanattggcgctaaatttttccattttntaaaaaaattttatgagaaatatntaattgtttagcaattaaaatgaaaaaaatttccaattattttaattactttcaagcccaggtattgctggtggtagaataatagtctcttcttcgtcaagtatgacttccttaatgagttattaaacgaaatatgttttttttctaattaaataatttgtcgaattttggggtgttaataattaataatatttgggtaataaataaataaataaattaattaccctcgcttttttgtcatatcgatacagctgttcacaaatctttttcaatgttttgttcggtgcattctcacaattctcatggccaaaggcaatgggaaaaattttcaccaaaatggaaaatgaaagaaaaatttttattttcaccatttttatacacctgaaattgcattaaatttgattatttaagtatattaattgaaacaacagttgatggaatatacagtgttgaaattacggtaccggcagtggattaacagaatcgccgaaattttcttttttttctttttaatgtgtaaaacagttgaatttttgtatttgggaccaactggcagtccccatgtgtgcttttttaaaaatttgtgcgctggtttaagatggccatttaattcagaaaatcttaaattttttgcggcgcctttcggcaccactgggcacttccttccccagaaaatctgagtttttaggccccaaggccatttgtgctgaatttgaaaaaaggaaaaacttcgtagctctggcataactggaaccttgcgcatattaatatagccgtggtgtcataataagggtatacagtagttggggcttccaaatacggtacaaattttgggaaaatcctttccaaacatgccaaaaaaataaattgcatacaatttcgggccttgaaagatgaggacggcaaaacgcgtgaatcactaaaacagaacaaaggcattgcgccaccacttaccatccatcatcaagcagaacaacccatttttaggaggtgaggggggggggggaagatgacgaacgaccgcttttcgacacaaacaaggtcaggacgaccaggacaggacaatagtt

SEQ ID NO: 9231 - DNA, 2703 bp, Heterodera glycines
  misc_feature (2503)..(2503): n is a, c, g, or t
  misc_feature (2614)..(2614): n is a, c, g, or t
taaaaattggtacaattaaaaaaattatcaagaaagcaaagtttcatttaaaaatacgataaattttcaaaaaatgtgtgccttttattctcaaaaattgctggacaaaaaatgagagtgtgaacacacaaatcgaaataacacaaaatggtggtgtggtggggggggggggggaagcgcaaaaaaaaataaattagcgcatacaaacatatggccaattttggcgctaattcgaatttgcgtacgcttttcgctgctttttgttgggttggccatttttgtaatgttctgttgttgtgttgtgtttgttgtgtgatgatgtgatggtggaagaatttatttaggctgttcatttggctgctgctgttccagcggtacaacacaaaattagggaacaaaaaatgtgacaaaaattactgataatttttacaacaaaaaaattggaaattttttgggatggaaagggcgcacgcaaacagtacataataccataaaagtgcaattttaaatttaaagaatacgacaaaaccattccaaacaaaatttttctttataaaacgaataaagaaaggcaaagggagttaattttataattgtctttagttattaaatctaattatcgcatgttttaaagtgaaattaattttattttattattccaaggtaattaggtgttatggttactgctaattaatattttaattactttcagaaattataaaaatattttaaaccttgttcatgattcaattattggattaaattaattaagtcttaaattatttggatttatttcgagcacttttccacaaaaatgctaattaattatgcattttaataagggaaatgcattcacatttaattttatgcaacacatttaaatttatattaacaattaccaaccgaacaaaagtgaatattttgttgttttttctgtcaattaccattaattaattgatagggtaataggcaacaattggtagtcggtaattaacaccataattaggtaaattagtcattgtttgtttttcccgcgctttctcagcacattccgtcatcaccatttttctgtttgcttctcattgaaattggcgcagcaaaaatgccggtgccaatgcgatcagtgaaatggccaattcacttgggcatccgattgcgatgccaaagtttgcgtgatgctccgtgtgtccctcatgctgttgtgcggcggaggccttttatgtggcatagtttttgcaaaatgtttctaataaatgaaatttaaataaaaaactttgagttttttaaaactaaaattgtataattttatataaaagtcatttataagtgcactaaattcaatttatttatttattttttgattagcaaaggtagagctgtatgagggtttcggatgacggtattatggcaatattaagaaaagttactgcgtattgtgaaagatgatggctatttggggagctaagcttacgatttattaaaaagcctcataaaaagcaaatcatttattccatttcagtacaaagcttcttaaaaagaaaggtataataaagaatattaattgaaattttttttatttttataaataaattgaaattattaaaacgaattttttaaaaataattaaattgaatttaaatttattaatatttaaaaagaaattattattactctttgcagtttggcttttctctgcagctgttcacaatatttacgggcctaaaaaaatttaaaaataaatttatttgaatttattcttattttaccgtaggcgatggagcatcggcacattcgtcgtcctcagcaattgtgccaatgatcaaaattgccaatatgacgagcaaaaagaatttgtgaaccatcgaaaattaaatttaataaagtattaaagtttaattatttatttaaataaattttggttcctttgatcaatttaaatcaatttaaataaagccacaaatgttttaaaaagaagaaaacatacaaagcgaattaagtcatttaaattattcaaaagtaattttttaacattttgccgcacatctttttttgaagctcgtaaattttttgtaattttttttagttgaaagagaatttttgggatgaaggaatggaatcattattttaaaattttattcataaaacttaagtaaaacataaaaaaatagttgaaaatttattttattccacaaataaatatggttaattaaatacatagtaaaaagaaatacataatgttcatttcccttttatttatttaattttttacaaaaatttagggcacagaaattttttgcagaaaaataaattggggtgggagaacaaccgaacgaataaacgaatgaatgaaaggacggatgaatggtggtgaagcgatttttggcgcggaacggacactttttgatgcgatttgcacgcccattttatagcgccgcgttttttggggggtggcgcgggcgcaggccgacctttggtcacgggacaaccgccgaaggcggaaggngaaggcggaacagaacgacgaaaatggggaaccggataagaggaggaggaggaggaggatgaaaataaggaagagagaacgggagagaggaggagggagaagaaaagtggngaagatggagatgaaaaagtagagggagagagaaaaagagcaaaatggagagagagagagaggggaagagcaagagagagaagggggaa

SEQ ID NO: 9232 - DNA, 2138 bp, Heterodera glycines
  misc_feature (903)..(903): n is a, c, g, or t
ctcccggatttttcgacagtaagacaaaaaataatagacttttcgacagtaaacataaaaacaaataattcttattaaaataaattatattgcttgtcgtttttctaaatttcttttaaattaacatactaatatgtattgctaaatcagaattactaaagatacgtttttacgtttttttacctaggaaaaattttagaaaaatacacccttaagaaccggtccttaaaattttcaaaaatacactcctaagaagaatgaaaaaattttcacaaaaattcatctccaaattttttatttatttcttggtaaagaattttagattttaaaaatgaaatatttcaatgctggtttggcttcattttgttgttttggagaaaattttacgcttttacaccattatatttgaaatttaattactctttactgtcgaaaagtcccctcctcaaatttataatatttctgtcgaaaagtccggcgcccttcctttttccctataaattaaaaaaatccaaaatattatttttaattaaaatttaaatatattttaaaatgaattaatacataacattgtttttctttataaattcattgattatacttaaactgtatttggtatttatttttggataaatgttttctcgtttttaacaataaattaaaaaaaatcaaaatattaatttaaattaaagttaaaattataatatatttttattgaaaataatatacacagagtttttaaataaaaagcattgttacatcccattgtttttctgttctaaattaattaattacttctttctgcttaaactgtttttggtatttatttttgtgccaaatgtcctcctttttccccaattgtgcttccctttgtatgggttggcttcatttgccccccccccncaattaattgtggtctttgccgtccaattttggcatttttgttttggtgccaacaaatctggcacaaaactctttcctaattaccatggaggtgcttcgcttcattcatcgcaaaaaccagaaagagttttgttttattttgtgtgtgggttgtgcgcgggtgggtgcccttttgcggaagcttaaatttggcacatcattacgccattttccccaattctaacatttttggaaaaaattttttttggcgccatggaataaaaaagattttacttagaatgtaacataagtttccgcacaattttgtctgcctaattcaaaaattcataactccgtaatagcaaactcattatcaataataatggcgtgtatttcgaatcattattattgctttgttgaaaaatttctttaaaaaacttgtgcggaaacttatgttacaccttaagtatttatgcagaaattttttgctttatgccgttaagtcatcctaatttttgaagcattttttgaaaaaatagaaggtttcaaaaaataaataaaagaaatttttgcaaatattttttgctaatttttcgttttaaaaacccaatattttattgtaaattaaaaatgtttaagtacaagttttctctgttatacgaagctctctctatgcgtgtccaaaagttaaaaattcttttttttatattaaaaaataattttttgtccatagtccctcgaaaatgggtgcaacatttgggaaaaattaaatccaaatttcaataaaaaaattatatttattgtacatttttccattgttccggtgcgaaattttctgccttatctcatattgttattaaataagaattttcattttttcctaaaaaattcttccatttttctaaaaattcttccattttttcgaaaattccccaaccccctcaccgatttttttcatttttctccgccttttcttcttccgttttgtgccacccatactttttgtttgctcaacaatcagccgcgccctcttcactctctgtgtgctgctgctgtctgtcggtgatcatccgacggaggcggcgaatgagtggcggcgggcgccaaattcttccgcatcggtcggacgcggcggacgggcggcggaggacacggcctgccaccgccaccgccggcgccacagcgccgcgcacactccccccgcggcgcctattgtatttgtgtatgttgtgtgtcctattcttttaaggccaaca

SEQ ID NO: 9233 - DNA, 2306 bp, Heterodera glycines
ttatggttcgggttaaagaattcagaattggtcaaaattggtgtcagattcgtgatcactgatcactgatcagatacctctaaaaatcaccagtcttatttttaagtagcgccggcaactgtcacaaattttccgagttacgctcatcgctggggactcaaatacaatttaaataaattcttttttgacaaatgaaacctcaaaaaaaaatttctcccaccctcttcctccctcttccttctctctctctctttctttctctctctctctccctctctctcaatctcgctctctcatttcctttctctccctctcttaatctctctcttttcatactctctaaagactttcactctctccccctctctctcaatctcgctctctcattccctttctctccctctcttaatctctctctttgcatactctctaaatactttcactctctctctttctctctccctctctctctcatttcctttctctccttctcatctctctcataatcttttcacactctctaaatactttcactctctctctctttctttctcgctcaaatttctctgtctctctctattttttctttcactctctttttatctcttttccttacctctctctttcctccccctcctttctatcaagctctctatcgttcactttccctctctctcttaatttctgtcaaatccctctctctctctctcacttcattcttcctttccctttctcttaatctctctctcatttcctttttctccctctctcctttcttcgttctctcgctttttaaccttcactcgcatttattttttaaacaaacataatgacaaaacaatgccaattcaatcaatgaaaaatgcaaaaggtctcgcttagtatatagttaagggatttccgattttcatcttacaaaatttagttttctttatttgaacaatggaggttgacgtgtcttcttcatctgactcggccacaaatgttttgttcagtttacgtgccgatcggagtctgttggacccgacttttgaccggtacattttgcgtacagaaaaactggcaatgttcaagcggagaatggacgacaaaagtacgacattaatttaaatttaatttgaaactcaaatttggcaatcttaggcagttttattgaaaatatccagaaatactcattttgaaattctctttttcggtttaacaattataaatttgtttataaatatcaaaatgttcattttcagttcgtttcaaattgccctccgacagccaatggggctaccaacaaattcgggcccacactttggcctcccatcttttcttcgaccatttcgcttcctccgttgaccagcaattatttttcgcatttctcgacgatctccgtctgatttcttttacatttgatcgaacagttcgttgttttgttttcccattttaattggtgcgtttgactcactttcgctctttcagtccaaccgttggtccgtccccgtccaagtcgcggacattggcacttcctccgtggcattgtccccctcatttgtctttgtgtccgaggacgacgcttcttcccagtcgttccccgagagtttacactttgtcgactcgcgcacggcgatcactgcgcgcggactgaacactttcagtgtgtgggatacgggcgagcgacgcccgaccgatgggacgacacaaaaatggagggtcagtgaatgtgtaaagaaatgctgcggtgaaatgtttgcagggacattttgaaaaaataaaacgatgagatattaaattattcaaaataaactaggtagtaaattaaaaaaatattttttttagtggggccgatgaacaatgccagggaattatttgatgggggggggggggcgggggaaatgagggtcaaatggtgcggtgccgaaatgcgccactttttggagaagtttttcttttttgtttggtgaaaaataaaagggtttgggcatcgacgggaggggaaaggggaggctataaaattcaatgcaaaaatatttaaacaaatgaaaaaattaaaagcaatttgtttgtttgttttgtttcaggaaatgtttcactacgaattgccgccactgcgccagttaaacgatgacggccaaaagagcggcgttggcgccgcggacggaggcacccgcgctggcacagtctccgtttatccgtcactgattttggacgcgcgtcgcgcaccgacgaaaggtggcaccgacgccgaaaggggcggcaattccgccattgacatactgttgttcaccgtcgaaccgaccgcagagaaaaaagacgaa

SEQ ID NO: 9234 - DNA, 1259 bp, Heterodera glycines
  misc_feature (16)..(16): n is a, c, g, or t
ttgtgcatatgcacanagttaaagtaatgtgccatttcagactctccgcaatttgttgtgccgcgcattcgacaaatcctttgtaatgggaaggtggagtttgcctgtttcgacgcctccctcccgcgccgtttggtcgtttttggggtcggccgacagccccaatttgtgtgggacagtgcgaagtcttcgccgcctcttccgacactgttccccagcgaaacgatggaagttgttccccaacaaccggcggatgtggcggaggagcacaaaggtggtgccttccctttcaattgccaaaccgaatccgaaatctgatttgttttctacataaattgtctttcctgaaattggtatacgctcacaacggggcaaaaaacggataaaaaaccaataaaaacgtaaaattaccaattaaaaatttaccaattacctattttcacgcttttaacccgttggttgtatggtaaagtaagcacaaaaccggattcctgtgtctaaaaaaccgttttcaaatgtttgttttattttagccattggcggtgctgaggaaattgcggtgaacgatgtttgtttgttggccctttggcgttgtgttattcattgtcctccactccttcttaggttcagccctccgctgccggggacgcgcagcagcagttcaattccgagcagttggaggagtgcgatcggccgcccgacgctgaggacgacgtcagcgccttttgggtggacggcgactcgcacgaattggtcgcgatggtgggttcgagattggactttggttaagggttttagttaggatttgttttggttttttgagcgtctccgcttttttgagtaatttacgaaaaaaaactgactaattgagttttttaatagaataacttttcttcgttgtccaatgttttgctccctcccctttagacaattgtcaatgagttgcttttcacgcagaaaatttcgcctggagtagcgcctgtttttgccacaaggttttcttcattttaatttgattttaaaaaacctaaaattgtcacgggtaatatatcaattaaggctgaatacattcttcccccaataccaaagttaaaaaattgctctgaatcaacactttcccctccccccccaaaaaaaattccaagtcctggacactttcctgcccccctcccatttgataattcatttcgccatttgttcacttaaggtatgacgtggggagaattgtttggcagctcgacccaaacgtctcgccaagt

SEQ ID NO: 9235 - DNA, 1160 bp, Heterodera glycines
atttatatgctatttaaattgaaaaacattaatttcaagccttgggcatcggcgcaaaatttggcacacaatttgttattttcttcaggcaggtcaccaggacaaacgctttttgggctgttctcccgacgggcgctatgccgcactgatcaatcggaccaaccattgcttcctctactttcaaaattcggccatttcgagcggttcgttttcctctgcaaattgtcaaccaatttctggcacttttgaattgcatcgtctttcttaagagcacgaactgaagaatcgtcggacgggcaaacgagcggaacacatcgccaaacaattggtgctttcgatgtccgacttggacaaggagttcgacccgaacgattcgtccaacgaattcatcgcatttcatgcgacggcggaaaccctctttctgcttactcgctgcgcaatttatgccgtggaaatgccaaaatgattttgcgtcgttttggccgacactttgactcactccgatgcacaaattgcactgaatggcttttgccgtaatgaccaaataaaataaaccttaataatatatatttatgaattgcatttatttgtttccaccattacaaattgtgcccttttcaattatttcttttacaacaaatttaattgactcatttaaattcttttttaaacttttatttatttgtttttgttttcgacaaaagattcaattcctccgtaataatttattttcatgctgcaatattgccgtatcatttgattttcaattaagggttttccttatttttcggaatttcctcccattacgtgcccacttttatttgtccatttttgccgtgtcgcgtcaatgtctccggcactttctccggccaatggcttttcgccttgtttggccgccgctgctgcggaggggtcgggggaggaggaccgaatttcgaccagccgagtgggcaaattgccggcctccgaacgtgtctcacttggcttggcgctggtcgaggggcagcaggggtccgtccatttaattatgcatatatttcgatgagtattttaataaatacggcgagccgggagtgagggtactgtgtcaagagccttaggaatggatccgattttccaaattatgttccgaatatttttaaattttttgcagtaaatgg

SEQ ID NO: 9236 - DNA, 2261 bp, Heterodera glycines
  misc_feature (2100)..(2100): n is a, c, g, or t
  misc_feature (2191)..(2191): n is a, c, g, or t
ttttcatcgccgcttcatacgtcccttcgtacaattggcggtgtgccaacataaaaaagtgaaaggcttccgcgccgcgccttcggcaaaaattctttggaatgaaacgcaaattcatcactgaccaggcggtgtcaatcattcgggcttcctccatgctcagagtctgatcctccgctaacattcccctcaaagcgatcgatgcctggcaagaggcgaatcggagtcggactttggggtttttcggatttcgaatgctttacccgcctctcggcttcgaatttctcccccccccccctagacatgcttttccttaattagcttttcccggtgcccttttttgtcccttccgcccttctcacatcgcttgccccctcctctctccgtttggccaatttctcccgattttgctcgtggtattcctccactaacaatgcccccatcacataaagcttcttcagcctttgaggtggcacctgcttctcgtgctccgccttggccacctgaattagcaatttctttgcttcttttcaagcagattctgatcaatttggattaattcgttattccgatttgggttatctgatcgtttataaccattcgatcagtcttaacacattctttgatcactctgtttcccctgatcactcccctttcccattgactgatcacttttcacctcgtagacaatttttgccgcttgaataaatttggcggcctttcggtagagttgtgccatggccaagtttttggttttgttgcccaccatttggaaggcgtattggctcagcaattgctcaacatttgccaagtgaaatttgtccgataattccgtcgctttgtcccatttgttcagttttatgcacatttcaaatgcttcactgattctgtcgcactgattaattgaatttctgtgctttgctttttctttgattttttcaccttcaaaaaacaattcaccgattgttcacaaaggccgtaattcgaaaatgtttccgccaattgcttaaattcaaaaaatattatcaattatcaacaatggatttgttttaaagctatggaatttcataataaagtgcgaactaatgcctcttaattagctgtttaatccctcactaattagtcctttaattgtcgcttttccctgactaaccaaaagaacttcatgtccttcaggcaattctctgcttagtatttccatgcgacaaaagtcatccaacatcaaataacacttcgccaactgagcataacttttcgacatttcataataatgggccgcgttttgcctttggagtcatttagcattacattattaagtaattaacgaattaattttctcaattttattcgtttattgttccaataattccccccccccccaattttccaccatttttgtctttcggcataaaagtcgcccacatggtgccatgtttgttgtgccaaaatgtcgtcgccaggtccactcgaagtttggatgagctgcgtaatgcgacaccaatcattcatcttcttcagcatgtcaatggccaagtccctgaaatcattcctttttccgtgccgtcccttcctatgccattccttttcccgtgccgtcccttcctatgccattccttttcccgtgccgtcccttcctatgccattccttttcccgtgccgtcccttcctatgccattccttttcccgtgccgtcccttcctatgccattccttttcccgtgccgtcccttcacctccgatcattttcaaaataaattttctccgccgtttccaaatcgcccaaaaatgcgcacacttccgcctttttcaacccgtccgaatgaatgttctgcagtctcttcaggaactgaatgcccccgtagtcttccaacttcacaaatgcgtgttccgccgtttgaaagtccaatcgtttcagtgccgcagtcgccaaaatgttcctaaattggcccatttaaagggccaaagcaaagcgaacgaaccaaagttttgggtgagtgttccgctcaatcaaaacaatcgcttcagagattttgtctgcaccgagcagatctttgacggatttgagcatctaattgaaatgcacttacttctaatcccgctncaatcttttgccttacaaatgaaacggacaaatccgaaccgtttttttgggatttttcccattttaaaaagattaacattgactgatcagntgatcagttcaatcacacggcttcctacatgcccttcccttcccagagacggtcgagggggggggggggg

SEQ ID NO: 9237 - DNA, 1730 bp, Heterodera glycines
gggcaaccgaccaaaagaaaagcgttcacctccatccctctgatcacaagcaaacgctgcttttccatgatggccaaagtgtcgtccttctcctgaataattaatcacttttcagaaagtgtctcaaatttctttgctcgctcactccgtcccattcgatcgcccaaacttctttccgttcaaatccgacaacgggtgaaaaagcattctgatcggacaaagtgaagaagcgcagtgtgttgtgctttccgactatggcaaggcgatttccgacgcaatttaatgccatcaatttgggcatttgaatgttcgaccgatgggcccaccgaagggaaagatcgggcagagaatagcgatggatcagtcccgactcccgcgcctggcaaaattgaggggggggggggatatagaacaagaaaaatgcttacgatcagaaagaagtctttggcggcagcaacagcacagatctgaagcgtttgccgcccattgtttggtccgtgccgccctttcccttttactctgtccgctgttatgccttcgtttgactttttctgcgactcttccccccggtgttcgtccacataatgcactctgtcgggaaggattagatcagtctgattgctgtctgatcaatctgtcacttgtcagtttgactctctgatccgattcggctgcgactgtcgccgcccgtcgcgacattttgccgtggcacggagtaatgccaaacaacgaaacagtcggccgaagcgatcagaaccttcgatgcgatcagttaaagaattcaaaggcgttgatcagcagagttttgccaaccatggtcccattgatcgccacaaagtccggctgaacattggtcgtgtgagtgtccaccggcgttccgatactgtcgcacagttgcattgagtactgtggacaaaacggttacagtaatctctccttactacggttaccattacatttttcaattaattaaataattttctcttttttaccgctcctcgcaattcttcggttcggaaaatggccacgcaataatcgccaaaagaacgaagggcacacaaattgtgcacaaatcgtttcgttttcacttccattttcgtttcataaaataccaaaaccttcgaacagagaataaattggcataaaatcccccaaaaatatgccaaatgaatgcctcgtgcagagacgcggccgatttataggcgaagacgagggtttggccacaaaaagtccactgataggtcaatttcatcaccaccttcatcaacaatcagtggccatcattgaaccccttcaaacaccgaccaaataaatattcgtgtcgatcagtgcgccgattcggtagcccgacgcttcccaagcgattccggagagatggccggcagccaagcgaatggtttggagtttctgatcaagcggaaacgatcaaaatggaaaaagtcagacggatcagcagaaggagaagaaaagggaccaccgattgattgtcggcacattcaatcgatttgattttcattgcccaatttgaaattgccaaattaaatcacttcgccataagctgagatgaagtgcattacgttccgttcgctctccggcaaatccatctgaaggcccgcgaccgcaaacatcgaaccgtccggggaccaatgggcggtgacaattaaagtggaggggagacggacgattctgacattctctggcaattgggaaagcccagtgagtaatgagag

SEQ ID NO: 9238 - DNA, 2377 bp, Heterodera glycines
  misc_feature (18)..(18): n is a, c, g, or t
  misc_feature (51)..(51): n is a, c, g, or t
aggccgcgttggtacganccatttccatgggagacgatcacgtcgcgcttnaaggtcctctgagaagggaggatgaaaatgatcaatgacagtgatcagatggatgtaaatgatcaatgagattgattaaacggatgaaaaataatggtcaaatgtactgactcagtgccgtttccatttcgacattttccacacaaagcatttgtattttcatgcaaaaattgccgttctgatcgtacgcgtgcacttctccgtcggtgaaccctttcatgaactgatctgttggtttggcattttcccagtgccaatttaccgatcagaagtaaagtgtcgtcggaattccactgccaaatgagagcagaaattagcccaaccgccgtttcagccctaccgccaatttgaccagcgacgctccgatgtccttattccaaagtctgttcccgtccaccgagcccaaaataatttgtccttaatcggaagagatgaaaatgagttcattcctctgattaccatcttcgtaagcgattgcaatgcgcgacccgtcgttggaccatttcaacgaggcaacggtggacctttgacggttgttgatcatctcctcgaaccacgactcatccgcactaaacacgaaaacatcagtagccgaagggactgacaaagattgatcaattcgcaaggtcgattggccgataaatcgattgcttgatcaaccctttggtcgattggtcgactaatctttgattgatttgtcggttagcggaccgattggacattgcttttccgccctttcacttgcccgtggctcatccaaacgatgatcagtccggcatcgtcgcttgacgccaatttttggtgaatttcattccaacacaaaaggcgaactgaaaccaattagggagatggataaatttaaaaaaagacaatgaccactggcggaatggccttcgagttgttgggaggacagccagggactgagggaggcggaggaagggccggcacttttgtctggaagggaaatgccgttaaaatgggacctcaagaattgcatttgacccccccccccccaaagtttgccctggtccaaattcagcagcatcactctcagggccccgtcactgccgcccaccgccacataaccccggttgagcatccacgcgatggttgtgaaggtggcggagccgggggtttggatttgaaactgaaatgggcgggggaaatgaaaaataaaaatggccaaaggacggcacttttctcgccgggaacacgtacatattgttctgcattctgtccgtttatttctaaaattgggaattgggtcagaaaatggcacaatttgagcattgactgtttcgtttgtgcctttttaattttttttctttgccatagcaacggaaaatgaaaatattttgggaagggacacaaaaaaataaaaattaaaattaaggaaaagcatttcaaattttaaggctttttgcgatcgctcgccgattcagtcgaacattttgaactgaagagaatttccattttggagaatcgaaaggggaagaacagaagaacaaagaacagattcagcagcaattaaatcagggttacccttgaaaatttcccgaaataagaacatcgctggtcaaaaataagattttagggtcaaaaataaggacattttttaaacacgcttccaaaactttaaatgcatttttattcaacaaaaccaagcattactcaccgccaactatttttctgcgcaactccggcttagaaatgagaaatttatacatttccgaaaatcaattttaatttttttaattttttgggtataggtgagggaagagtgtccggcggtgtcgataggcgccgcggggaaattttttgaaaatttaatgcaattttttaacaagttctgtccaaaaaatgaccaaaatttgcgatcttgggctaattttaagaaaaaaaaataggagttttggggggccggcggtgccgataggcgccgcagggggaaaattattttaatgaattttgttaggaattagccaaatttttcagaaatttcctcttttaaatgaaaataagacacttccccaaatcagaacatttcttagaaataataacagatacacccctgctctaatagacgctgccggaagagaaaaatttgaatattaactgaatcttgttaagattttgcatattaattcgcttcaaaaaacatttctttcaaaaattatcattaaaaactaaatttctccctaaatccaaaaaataagacgaaaataaggacaaagagcttaaataaggacaaatcttacaaataaggacatttaaaatttgtaagatttggaccctcaaaataaggacaaagggtaaccctgaacta

SEQ ID NO: 9239 - DNA, 2289 bp, Heterodera glycines
aaataagagaaaaaaacaaaaatttttgagaaaactcaaaagattgatttttttcgatttttaagtgtgtaagaaaaaatttttgaaaaaagtctcgggtttttttggtctcggtctcggggttttgggtctcggtctcgagtctcgggaaatttttggtctcgagcatcactaccaagcatacctcccccataaatattagtgatctgatcactttggtgcaattgacttttttgatcagcacaaaaagttataatagtatgagttttttcagattttttcatgccctctaaaataagttaaatgtcttcagttttgagtttttaatttcgttacgtcaaatttgggaccattttcagaaattcataaaaaaaattttcttttacactttccgatttttttgcgtgcttcttaatatttatggggaggtatgcttggcaaaaatttcatccacgggaaatagctggtggtaaaaaaattcttgtttataattttgttacagagcatatttgttttaaatacgttattcatttcattcgcccaaaagatttttttctgatcattaaacaatttatattttatatgtacatttgatgaaaatgagtattgtttgtttcaataaaatatgtaaatgtgctttgttatgaattcattcaaacaaattggtaatgaattgtaagaataattgagctgaataaaaggttcaaaatgatgtatagcaaagggcaagccgaaacaatacaaaaatacaaatgttgaaaaaattggaaataaatgaaaagaacaaatttagaaagaaggaatgtgaaattcgattttgaaagcaaaaacttggcaccaatcataagaagcccttgggccattcactccccaatttttcccatttgaatgccgtcctcgtcaatcttttcttctcggttttcctgccgttcttcactctttggtctgcgtttttgataatgatgacgacggtgatatccctttaagataatgttagtgtaagaataatcaaaaaatgttgggctttaaagtgacccactcatacgacccaccggttttggttgctgatgccctttttcgcctcctccattctcttccgccgggcagtccaatgaaacgggtcgcaaaagcactcgaaaatgccgacgtgcacgacgttcactcggcgataaatgggacggagtttcaatgattgtaacgcttttgcaacgccgcgggggcaaaccgacgccgacagtgccattgtcctccgaagttggtgaattggaataatgggcagaactgccgataaacgcgggcacagtgtgagcagcactagtggttgtggtagtcgtgccatactcaacggcagcggctatcgaattgcgcaattctgaagaaatgaaagtgattaaagggagggacaggggagagagaaatagggagtcgaaagaccatccgaccacacaatcggacttgaacgagagtccacccacttttctcgaagtgtttgcgctgtctgtaatgtcggtaactttggcgccatttctccgccacttcggcagtcattgtcggcgcggtggcgcccaatgcgcgacgtcccaagagaaattcgtgcaaattatagcaaacgcggtactgaaatgggagaataacattgcttgttttgtcttgaaatcggttctcaaactttacatgaatgccaataagctcaatgcctcgcagccaaagtgcgcggcctcggctcatcgattgggaggcaaacggcccactgacggaggcaacattttcgggcggttggcgacggtggagatgcaattttaaagcttctaaacatgtaattcgaatgataccaacagtgtttgatttggttgacaaagaaaaaaagttatagtccaaaaactgggctggcgccgaaacgaccgacgccgaaacggcctagtccctcccattttcattgtccattttatgtcagcgtgcgctatttctagtataaaaagacggggtttttcttcatgaaaacattttgtctaatttcaaatttttttttttttgtcatatatctgaaaataataaatttctttacagatgatttacattattccgtgcatcgctcttttggctgcatttattctcattgcccaatgctgcggttgcggcagtgagggagcaacggaaaaggatgaccagcaggctgcaccttctggaaatgctcgacttcaacgagcgaaggacatgatgctgctaccgcaactgaggattcggcgtggacgaatattggtgtgtgcgttcatctaatattttgttaaa

SEQ ID NO: 9240 - DNA, 1523 bp, Heterodera glycines
aacgcgggtccgtcgtttgtgccatcgccggtgacagcgacaattcactggggaaatggataaattaatcgtattaagaaagaagcagttaaagtgatattaaaatgcgaaacgcattctcaaacacattttaccaaccgttgtgtgttcaatttgctgtcaatgatccccttgaccaaagtatatttgtccgccggttgggccctggccaacacgcgcaaacgtggccaaatctgtgaaataattgtcaaaatgttcgttacttgtccacacccattttgaccatgtccagcttcctttgatcaattttgccacgtccgtcccgaattcggtcgttaaactccttcccctccaacaccaaaaagtcctcgtccggtcgaagaatgccacaccgaatggcgatggcgcgtgcagtgtttacattgtcaccagtgacctacagggagacgggcgggcatatgaatgaaagcaatcgcaaaagacacaaaccattcggacggtgatgccggcacggcgacacttttcaattgcgtctggcacttcgtctcttacaataagaaaggaaaagaaatcaataaaaatgaaacccgaacaaaaaagcgcaaaaagtactcacctgaccgggtcttggatgccacaaatggccaacccaacgacgccatccgaaatactctgttcatcgtcccaattgactgctgcttctgaatcgagtggtacctgaaaaaataggcaacaagaaatgagaccggcgattcccgaacctccgttgggccaacagttcgttccccagccaaaacgtagtctttgtacgcgatggttaacgtgcgcagtccgtcctccgccatccgttggatcacttcgtcaattattcgtttccttcgatgctccgtgaattcagtcggtgatccgttggcgtcgagaaaaaaagcgcatttgttcagcagaatttccgaggcacccttcacaaaaacacggaacccaacacggcgaccagccccatttttcaactcgacaacggtcatcatcattttgcgagaggagttgaaggtgtacaccttcagcaagcgaatactgtaaaacgggacatcgtccgttcccgactgactctgtaattgtcttcctccgtgtactctctccgaattttctcataatctcctccgatttgcctgacccagcccaaaagtgcacattccgttttgttgcccaattgttgaatccgttcgcccgcctttttcgtcgcaacaatcatcgaattgtacgcacaattaacggtgattgcctcacttagcaaagtgaccaattctaaaagacaaaagcattctgcattaaattgttgacgatcactccgtttgcctttgcgaaattctcccggttttggctgacttttctcctctccaaaatatcgctcgcacaaaaaggactggacaacctgtagattgaatatattctaattagattaaaatccgaacaaattggtctttggatcccattttccttacggtcatccgattcgttgtcaatgt

SEQ ID NO: 9241 - DNA, 1340 bp, Heterodera glycines
ttttctctctctctctcttctctttcctcttctctctctcctcttctctctctttctctctctctctttctctcactctcctcttctctctctcctcttctctctctttctctctctctcttactctctctccccttcttctcgctctgcttctttgcattttcttcttctctttttctctgctgttactttctacgttctcttttctcttttgtgcgtttaccgcgtgcgatttcctccgtttggtgtcccattgacaaacaaaaacataaaataagcggagggagcgccccctcttcatcatttcttttaacgagtcaggccatattaagctccgttcattgttcgattaattattgctatggcatccaattatgagtattttacctgcatttttttcctgaattatggaaggcctaaaatatacgaaagaaatgttgggtctagtgcactttatgagcccaatcaattaagcatacctgctggatttacatgttcgtacaaaccctatattttggttatcatttaataaatcataaaatctaaagaagctaaatgtataaaacctcagcgtttaggcaattagcaaaaaagatacgtatgattattttaatttgttgattatttcgtttgcaactttctttaaatgttagcattctcttcttttctagtattattgctagtgatgatattttttaagttttggctattttttcatgagctcccaccggcctaaaacgcatggaaataagttatttttgatggttgttaagctacttttcgagtgcctattttctaggtttttatttttagagcctaaaaattttgcctatttttaaatccctaattattatttttcataaaacttatttgaaaatgcatagaaattgccctgagaatttttcgtcgctgaaaaactttttttatttgttttatttatcaatgattgatttgccatttgtggtgattcatcaaaacataactctttctccccccccccccccccaacgtcctttgtgtccattgcaatcgatcgctttccgtttacgcacattttcctgccatccttatttttgatgaaattatggtaaatcgtcacatttatgctttttaagggttgggtcttacaaaatttacgaaaacaaccccaacgcaatttttaattactacggccagaattcttagtttcaaattttcccgcattaaaaaataaaaaattttaaatttttttgaccaaaacaaattaaaaaatttttctttaaatactggatctaaaatgaaaaaataaacccgaaaaatccgaattattttttttttttttgtttttaatccaaaaaaaa

SEQ ID NO: 9242 - DNA, 1040 bp, Heterodera glycines
tgaaaaaaaaatggcaaaaattggccgaatgctatgaatatttataaaatttatacttcgaccttgacctggacccaggcttgggtttttgtcctcagatccaggtcattttctgcaaattagttttttcttgactttgtttttgtccaagtcttgaaatccaggcaaggcatgaaaaaacccgaaaaaaccatgaaaattctgctaataaattacacttaaattttgtaaattttatccggcgacacctttctatacagccgaactcaactctacatattaaatatttttatgaaatgtataaaataaaactgatgagaaaacatgttgttaaatttaattttttaattttattttcaaggtcaaatttttattttataagttcaaaacgagtaaattgattaaaaaacatatttttatatgtctttaaaataaatttaattctaattgtataatttattttaacaactttaaaactccaggcaatgcctggatcgagccatgacaagcctggattttttgggattcgttatttgatcccttcccaaattcgctgcccttttcagttggccgttgtcgctgtgatgagtgctttcccgttcatgcatccgcccatgattgcatttgtgcggcacaatgtcggactttatttgttgggatagtgagttttggcactcaattaattgcccaattaattaattggctgaaatgtccaatttgttgctctgttcagcatcactttcttcgtcgtttacattgcattgatctgttgcgagggcgtccgtcgatcattcccggccaatatcattttgcttggcattttggtacgtttcgtcgtgattatctgacaagggaacacttcgaactgtgagtcggaaaaagcatatacgagtagagtcgatttgtattgtgaatttttaatttttgcgtgcattttgcccacttcaaaaattacagggccccaaaagtcggaattttaatgcctatggattcatttcaacatttttgcactttataacattttcacccctatgcaatga

SEQ ID NO: 9243 - DNA, 1853 bp, Heterodera glycines
ctaacagttcgaacgttcccttgtgagtgagtgctcccattttcctccgccgattcagactttgtccatcggcttcatgaccatgatgatcactgcgcagtacgccgtccattccgtgttcatggctttcgccatcacttccctttcgtgcttcggcgtggcacttttcgccacaatcaccaaaagggacctgaccaggccagtctttctcattcccaaattgggcccatctcatacatggcccattaaatatatttttgcatttaattaccgtaatcccatggcctacagtatgcttggcattgtgttcatcgccacaatgtgtttggcgttgttcggcttggttgtgatcattgtcggaatgttcaccaatgtgcgcattcttttcgttgtttacgccgcgattggggcatttctgttcatgatttggttggccattgacattcaggcaagcaaaatggggcagcagccgaaatttacgaacggagtgacaaaagcgaagccattcgttgaacgtcacaaaaattggcaattttaaattgcaaaaattttttgtcaaactgctcaaaattcgatagccctgcatttaaaaaattaaatttcaaaaagtgtccatgatttgtcttgttaaaatttaatgaatttttaggattttttctttctgtcgaaacgtccgcttggcggatttacaaaaagtatcaaattctctaacaatgttcttatcaaaatcgaggggatagccatgaaaattgtttattttataattttaagaaacaaaatattcaaaatcaatcatcctcctccccccatttgctttttcagatggttatgggcggtcgtacctacgaaatttccccggaagagcacatcttcgcgtcgattactttgtttcttgacatcattcaggtggctttctcatttaatccaaaatataatgtataaatgttttttcagattttctggtttcttcttgcaatttttggagatcggtaaaataaataaaacaaataaaattgaagaatatctgccaattataaattttatgtttatattttattcggtcctactcgatgagagaaatcgaaaaaagctaatttgtcagtataattttaaaagtccggtaaatgcttaattaattgcttctcaacccaataaaatgcggcaacgcagtaaattctcattattagcattaaaatacatttttttagaagtaaagtcgcatttaaaaagttttgaataatttgctcatttttaatgttgcatcccttagaatcaattttttataagcaaaattagaattggtaatattcttcaattttacctaaaatgattttaattaaaaaaagacaaattgtctcctctcagcagaaactgaccttggcatcgcgacatttgcaacacataaacaaatatttgttgatgcttttcagttttacattcttatccgatatttacgcaatttaattgtgatctgaaaatattaatcacttgaaaaatatatttgctttgaatgataaatttgtggaatttttcggcgtcataatttaaaatggattatttcgtatgatctagagcccggaaatttaaatttatggatcccgctgcaggattgagattgacgggattccgtgtgatcaatcttacaaaatcccgcatttaaatttgcgggattagtcccgcaaaacccctgcgtctgggatcaccaaacgcgcgggatccgtcccgcgtcggtctctggtataacgtccaattcgacatgtttttattgtcaatttacccttaaaaatatctaaatcatagccaatcttgggataaactatagtgaacggcctgtgaaaaaagggacaaatgat

SEQ ID NO: 9244 - DNA, 1543 bp, Heterodera glycines
cgtcagactgcttcctccacctttcatctagccacagtacttgctcagtgttcgcatgctcccttatgcgaaagttcgttggtaaaactttttttgttcatcctttatttctttggtactgaagtgtcacttttcactgggactcagtagtccaagtgttcagatggcatcggttcgacttaatttccgatttttagattaagctcgttaagagctttcaaatggtaccaaatttgtcgggattcgatcattaaaaaaagttagagtgccaaatctctaatttttcgagttttgattggcatttccgcaactcgggacatatttttccgtgcttatctccacgagacgaatcaattggtatatcatttgacccattttttcatgggcgttcactatagctcaccccaattttggtttaaacaaaagcttagattcattttcagctgggaaatcccacattttttttcaattttttacttttttcccaatgcttccaaattttgttcaagttttttggtttttacgcatgggccacaaaaagactagaagactcagcatgaatattattctttcattgttcagcttaaatcaaattcacacatattttcatcattaaaacgcaaagcgttatcagctgagccacgaaaagaatgttttaggttatcaaacgtcatataaaaaagtttaatttgcttggtgttcagtaaagttataaacagaaacatatattttaatttatattttttttactaattgaaaaacaaatgttttggtagaaattggagagaaggtaaacaaacaccaataagaaaaagtgttattcaaaggctcaaccagcggaattggaattgtttagcacccccataaaaattgcgttcgttttcatttgatttgtcattcattgcctttgcttcaaaatgaaaagcgttccaaactatcaaaattagtaacaaaaagcgaaagaaagagtaaacaaagggaaaaaattatatttttcaatttcatcgacagttctgaaaaactccaatcacaacattttaagttttcaatattattatattttcgcttttttaacccataaattttcaatttttatttaataattaacgcactcgttttgattattaaatttgtcaatttcctttaaaactcgtcctcccaattgcgtcaacgacggaaaggaacaattacacaatttattattatttacaccattctattgtataaaattgtgatgttccctattttggccgactgtttgatttgtaacgatttctgatcaatggaaaacaatgttatttttaatcattcacaaatttgtatttataatgatgaaaccgacaaaagtatcgctaattgagtgtcaattaagtgcagtctttttttttgattgattttggattttcctttttgttgataaaagaagaaattccttaattattaatttttttcacatttttcatattttaattgagtcttttttcctcgtatcgcttttaattgtttatttcttttcatttttttatttgtaaattttgctatt

SEQ ID NO: 9245 - DNA, 3572 bp, Heterodera glycines
tatccgcgtcatcaaaatgtaaagtaattatatgtaacttttacatctaattatccatacataaataaatttaacaaaaattacttttaaattgacgaaatttacttttttatgctacagtgaacaaatcggagatgtgaattctgagggttatcctcgttttttcattttcggaaaatctctaaaatatgcaaccttttaaggcaattttatgccatatttacaaaaaatataattttatgcctgtgaaaatattaagacctttaattaattaattatcgtttgaatgattttttagttttttcggtttagcaaaggctccggcgccattgggtcaacaaagtgctcctgtcggccattgaaattgtgtcccattgcggcacttgtgccaacaccactgctgacgaattgcgatcgatcagaatctgtgagaatttcaatttttactttttattaatttaaatttcgatggatttattttatttttccactaattaattaattacataataatgcgcaattttttcagctctttgctgccatgtgttgaagagactgcacgaaacaaaatacgtcataattcggtagagaattttgtgctctttctggcagcccaatccaaaaattccaaaaaattttcacagcccgcctaggaatttttttcaaaatttttccaatttcaagccatttttgactttcctgatcaccatgaaggagtgatctgatgaagtttgtgtaaaagacttttttgatcagtatcaaaagataagctagcatgaattatttcaggtttttaaatgaactttaaggtggtttttttcatgtttgagtcaagacctttttccatcactgtatttaacacaaagagacaccgtactgatgagtaggaccgcaacttttagtgaagcgccacgcatttcatagtttcgggaaataccaatgaggaaattcttaatgttttcgggattcacattgacatttgcataattgtgatcattttgggggagaatgttgttattgatatcgttatgacggtggacgagtcggagaatccgtgcgtcggcatctcacatcgccacaatttcttaagcccatctgcgctaaattggtcgaaaacatagagcgcgccgtctgttccaacttaactttgtttcgttttgttttaatttgttgctgctgctggtccatattgtaataatttaaaaagtcttaataaatttatcaaattcacttagttataaaatgaattaaaactcgaaagaaataagagtcaaacaaattttggtaaaatatagtgtgggtaatgcgtgggtaatgaatagggctgtgacttttagtgaccaaaaatctcgaaatagttaactaaaatagtgagcaaaaatgccaaaatagtgaaaaaatagtgtcaaaaagtccaaaatagtgacgaatagtgacataattttcagccaaaaaaagagcaaaaataatttttatccactagttgcagttttttgcacttgtcgcgaaatgacatagcaccgagacttctaggttcaagtgtttcatgttgatttttgctgattttttgattttggtgctttttgtgctgttttgtcattttgaggaattttctaaaatattttcatcgattttcaaaaatttattaacaaaaatacaataaatatgaaaaacactcccctgggaatcgacccgaaaaatttcagaaaaatacaccccccccccccctaagaaatggaaaattttatcaaaaattcatctccgaaatttattttattattttcttgacagaatttttgatttttaaaattatgtatctcattcccattttagcatctattttgtggtttttttagaatcagggggcaaacaaacgtttttttatgctgccttttttcaattttttgtgcctttaattgcttaattttatgcttttttccaattttttgtgctgattttgccttttttgtgcttttttcatgcttattttgggaaaatttggtgctgttttaatcggtgattttttgtgctgaaaattgagcactctactaatgagcaaaattcaagaaaaatttatcaaaagttgtaaaaaaaaaaaattcaaattttgcttggaaatagagaagattgaggagggctttcgaatcatatcaaaatgttttaatttggatgatttaacaaaatttgaggatttctttgtcaaaaaactacatgctggcctaatatgattgggtgttgtcccttttttactttcctaattttgcactgaataattgtcccaattaaatttttgttttatttataaatttttaattggttttaaaaactgaaaatccgtgccctaattattgtattttttcccgatgaatcactctttctttaatcagccattcattaaaaatcgtatattatgtattgtcgttcgtgcaatctcttcaacgcatggcagcaaagagctgaaaaagttgtgcaatattttaattagttcattaatttgtggaaatatggaacaaattttaattaactctttttaatttaattgaataaaaaataaatttacaaattctgaatgatcgcaattcgtcagcagtggtgttggcacaagtgccacaatgggacacaatttcaatggccgacaggagcttaatgggatgaaaattattacatcaacggggtgtactgtaaatctgtctgaagacaagatttttgtaattaaatgcaattttttaggtgtacaaattttaattgcttattgttaacattttgatgattccgaaagcggcggccgaaaagcaataaaaaatatttgttgctgatgcacaatgcgtagtcggacagaactgaaaaattttacattattattatttacattgttgatcaagtccaaaattttcgaattattgaaattaaattactaaaaatttaaatcaaaaaaaaattaaactttattttgtttaattgggtcggggtcactttggcgcgggacattttgacgccataaaatttaaagtattctaacttttttcttatccaaccaaatgaaataatcatgatattatcaataggtctaagtgttctctattagcctgcaaaatagaaaaatatatttgttttaacaaaagacatggcgtgcggcaccaaaatggccagaaaaagtcagtttttgaggttttggccatagctttcttgtatctcaactaaattttttgaaatttttgcaggctattagcgactatcaagcgctttaaaatcacatcaagattttttaatttgaatgaaaaataaaaatgttatagcgtttggcgccaaagtggccggttcccgtttaataactgtactgtcaaagcggattaacgagtaattaattgcgaaaaacaaaaaattttatggatcaaaaagcaaaaaatggtctttgggtcccacccgcccccctctccgagattattttaaaaaattggcatttttatgagtagggctcggatttataggttgctaaaaactgccaaaataattagtttttagtttctaaaaaaccccaaaatagttgctaaaaatggataaatagttgctaa

SEQ ID NO: 9246 - DNA, 1880 bp, Heterodera glycines
ttattggcaccagggctgcacaaaatttcgtgtcgttttcgtatacgaaaatttaattttaaagttttcgtgcagccctgattggcaccaccggctcaccttgttccccaaaaaatgtttggaaaaagcgtcgcaaaaaaagtgatgcgaaaagaagcaaaacaaacaacaacaaaaaaaaaagtcgtcgcccgggggaagccccccaggccgaaatcctggatatgtcctgcccaaccccattaaaataaaattaattaaatttttacattttcccagcaactgcaaatcatcaacagttatgtgtgcccaagtgcagcaaatggacacgctttcagctacaattataagcagctggttgatctgtgtaaatgcggagtgatttatttatacagtacccaaaatgagtccaacttagcatacggtatcctatcaaatttgtcaattgagagaaaattttattaaataaaaacaactacgtaatgatacgaacacctaaaatattttcgagcgctttaattacgtaattagggtcgtctgagttaagcggcaagccaatgagttcaggaaaaatgcgagaacaattggtccaacgtccaatgaagtaaagaaggtcttttatgaggggtaatttggaatttttttaattaattaaatttatttataattaattaaattttatttgaaaattaattaatttttatttcaaattaaaacccttatagaaaatctgtgcttcaaattgtttaattggaattacgttgctaagcagcaaattatcaggaattgttctgatcattttcactatgcttcgcacgagaaacgtacatttggcaatctgccaaaaatttaatgatttgacaaaaaaaaatcaaaaaataatcggccaatggaatttaaaatatttaaagaattttttaaaaattcgtgaaaaattaccctttaaaaactcaccaaatttttgatttgactaagccacgagcccatacgattgaacagaaaatggttaaacacttgggacacatggatttgagcccattttctgtcgaatggaattgcaccgataatttcaaaaagtaattccgtcggaatattttttcgcattttttgtccaagttttttttttggattcttttaggggagaaaatgccaagtgccaatgacctatctgacgatggcatcgtggcggcattcgctttgatctcaaaggcacgcctcacaaataaaaaaccaaatgccacaatggcttatcttactatttatcggcggcattcggtttggtctcaaagattgggctcaaaaaacctatttttttcattttgaaaaaggaatgcgcaaatatcccaaatcagtgaataattaggcctaatctgccgctcccctgcctatccactactaatgctctctctggtcaagccgttgattaaaataaaagttttaatttaaacaaaataaatataaatttttaaatcatattaaaatttattttatttttaaatgtttacatttttacaatgctaaaattaattaatgcggaataagctagtaatctgccggttttccacataattcttcaattaaattttgtaatttttattccctcatttttgttgcgcgtttgtcaaatttcttttcccagtttatccctaaaaaattatgcaaaaatgagggggaagacgatgcactgacaaatgaagttgctaaactattaaccacctaattacttttattcagtcaatgaggataatttctttattcaaatacgatttatatggatattgcataccgtatttgctctttttatataccatggtatattatttttcaaccttctcagaagggggtatataattggagactggcagactaatggagactgg

SEQ ID NO: 9247 - DNA, 6353 bp, Heterodera glycines
cccctttgttcgtagttttttgaaaaactgcgccgcaaaaaaatcaacttcggtttttcatgcttggaatttcacaaaatgcttacatatttctaacaaaaaattgctcaaattgatcattagggccgcaacttttagtgacgaaaaataccgaaatagttaactaaaatagtgagtaaaaatcccaaaatagtgaagaaacagtgacaaaaagtccgaaatagtgacgaatagtgacataattttcagccaaaaattaagcaaaaataatttttattcactggttgcagttgcaaaagagctacattttctttataaaattctcttagcaaatattgacattttttaaatcaaaaattttgtcaagaaaaaaattttgggggagaatttttgaaaaaattttccaattaggggtgtatttttttttaattttttaggtcgattcttaggggtgtattttttgttcttattgcatttttgttaaggaattttccaaaaaatgtcgaatagtgaaaaaatagtgacaaaaccccaaaatagtgatttttaactattttagtgacgaagtcgccaaaatagtgatttttaactattttagtgacgaagtcgccaaaatagtgatttcagtgaccgataatgacatcagaatcgaaaatttttaatgcagaaatgcgttttttgagctcctttcttcaaaacaattgagcaaaaaaaaaagttttttcactaaaagttgtggccctattgatcatggacaatcaaaaatataacatttgaatattttaaacgtattttgaataaatttcgtaaaaatgaggtttttttgcgtgccaaatgaggctttgaaaatttaatctggctaccctgattatgttcggttttctcaaaaaatttttcaatccttaggaatttcttacgaattattgactgcgtaccgctccccctccactctaattgaagtgactcttttaacccctaaagattaaaaaaatttccgtaaattatatttatttaagatttttactcattttttcatttatccaacaatgggttcaagcagttctagcaatgcgggctcgttctcatcagcatttgcgagtagttctggaagtgcgcgctcatcaagtcagggctcttcaaaactgttctgcagtgaagctttctgtgcctgtccccgttctcaccttcgtgccatcgaattcaagaaggtcgccgttgccgttgattcgggtaagagagtataagttttgtaatacaacaagtaactgtagaaatatacgaaaattaatggaatttcatgttgaatggtaaaattccttttctttctacagtaataactttattttggtccatatttggccatttttgagctttttagtccatatttcgggcttttttagtccatattttatgtccatatttgggatttttcagtccatatacttattgtataaccctagtaatgacttatccccacgcggctgttgaagtgctctacatatgcaatgactgtgaccatgaactgcgtgtcacgtacgatcttgtgttcaatttgcaccttctaaggggtcagtcaattaaaggaagagttgaagtcatttaaaagtggctcggtacaaagcagggatgggccaaatcgaaagataaaacgcgaaattacaaaaaaggcgaaattacgaaatgcgaatctcaaaatgttgttattttttgacaaaatctgttaacaaatagcattacaattacaaaaaattttcccggcgccgccggaccttttccaaaattttttttgaaaaaatcgcgccgcaaaaaaatggttttgaaaagcaaaaaaggtcgtcaatttacatggctggaccccttcgcaaaaattttggttgactccttcccctttttcatgtatgatcgcatgaaaaattagacctagaagccaaaaaccagggctgccaactgaaaattttcaaaataagaacttgtggtcaaaaatcatcattttgtacccattccaaatttaaaaaatgaaatttcactaaaaatccaaatttttcctcggtggcgcctactggcaccgcagccctctttcaaatattattcgataaaaaatttattcgtttccgtaggggagaaacgcgaaagatgcggtcactacagaatcagcaccagcaacttctttgctggtcataccttccgccgctactacatgtcttatgaggatattgggcgcatttttgacgggatgtcgaattattacaaccttgtgaccagaaactgtatccattgggctaatcagtttattgtgtgccttgaatattattgttagagtaagttggaagttttattcgctttttaatataataattgtcatgtgcttgttttatttttgaatattaaataagacttgaaaaattttaattgaaaaccttgggttagtcatttccctcatcaaaaacggaaccaccgaaattaaaaatagagagctatgaaagcccaacgaaaactctatttgagccaaaacattaaactcattggaatgaaatttttcatttcttataaaaagataatttaggcaaagcaatttacggaaggacggcgatgatgatgcttaattgttgaccaagctaacatcgaaaatgtatcaaacattgttgcaaattcttttgttttcttttatcctatatgtttaaaacaatttctcaaacaatttacaatttgtagcaattaatggcattcatttctgatttgaaatatttttctacgtttaggcgctaggaaaaaataaaaaatttttgtttaaatcatgcaaaataattttcaaatatgcactcgattaacaactatgatcttttaagcttttgggcaagattagcttctgaagtaaacataaattttcaagctgtcaacaaattctaaagaattttcataaaatttttgggccacgaaacatagattaggaaaaataataattggaagaatttctatattattaaatttacatgaaaaatttgaatcatatccattcttcattaccacaataaaaaatggaattatatttcgaatttaaaaaatttaaataaaactgacttttgtcttatgtttttccaggtttataaatggcgtgtttatagaatttaaaacataaaatttacaaaaagacattttttacaatggttctcccccgttcgataacaagctgtttttctcttcttcaatggtacaaatttgtgctgaatgttttcttggcgaacaatttttgagcaatctgaaaacattttagacaattaaaaatcttgtttattttttgatcacaaaaagtgattggggtcgctttgtctgttgccagcagatggcgcgttgtttgtgataagcacatttaaacttcggcatgatgttctccgggactcgctggtattggcgttggtttgttgctgagtcatcagaagtgccgtgactgcctaattttttttaaattttttaaatattctatggacacaaatgtcctcttatatgaattaatgcttaattccatttttattattctcatttcacagtcatccatttctcatttatcagcaaattttccataaaaaatgaataaaggagacgaaaaaataaagtgacaagccaaaaaactcccagatgatcaaagtatcattttgaaaagttgcaaataaaccaaattttaatgacctgggattttctgcgccgctccaaagacgcgcgaattgtctctttgaattgtgggttgaaaaagctgtagatcaatgggttccataccgctggtttcagattatattattattttcaatttgaattatcatttttacctgatgtcatcgcaacggaatgacatgcagcaaaaatcagagaataccattcgttctaaattctttttcaataaaaaattataataaaaagggaagggttttgatcgaacagatttggcatcatcggagttggcactgttttcgctgttaaaatcccgccaaaggttgatcaaattcattggcaaccaggccaacaccaagccagcaaccttgatcagaaggaaaaaaaggaatttttggtgaaaaaattatgttttcacttctcaaatcttttagaatctttatccgttttattccggtccctgttgggccgggattaatcgggaaagataagcaaagcattcgtgtgatttaaatagtgaatatttaatggacttttgaaattttttcaaaagtttgatcatatttttttacagtattttaccatagtgaccatcatccgatttgtcctgttcttctgacttttcattctgtctttgctttcctgcagcagcacaagttgccgttcctttctcttttgaatttggcgccgaatcagtcgacctttaaaaaataaaaaataaattaacaaataaatcatttaaatatttaaaaaccgatgttccaatagcacagcgaagagattacagtgggcaaaccgaactgaacaatcagcacaagcaaaccgtacagcttacgaatccgacttctccccgtttgttcttccgtgtctggcctatttaattttaaattccgttaaatttaataacaatttaacttaattaattttggcaatttttccccttaacttttttttttaccaattttcttcacaaaatgtgccgcaaaatggtggatattcttgcgttgatgagaaaagaccaaccggcaaggcacaagcgtaacccaatgtccaaacgccaataacaatgcaaattgcggtgcgaaattcaattttctgcaattttaaattatgattattaataaaaaaatatttataaattatattgcctgttttgtcgggtgtttgatgagaatgtaacggtcaacagcaattgcggtcagtgtgaagctggacacaaaaactgtgccgccctgactttttgaaaacattgagaatacaaatgtgtaaattatgattgccaataatttttttttgattaattttcactgcggcacctatcgatgtcctatcgatccggtcttatcgaatgaaaaatacaaattttttaaatccatgaaaaaatgttttaattatgccgaattagcagctcattaatggaggaggacggagatgattaaagcaaactttaaattatcatatttctgtctttttgaataattttcgcggaactgctaatttggtgaaagaaaattcattaaaaaaattaaatattaatgacttggaaaatgcccatcaatttgcaaaatggagaagggaaaacccaatcacgtgtaaagattgaaatggcggtgatcggcaatgaagtgaacgacatgagaatgtcggatgcggccaaactgcagatgaacaccgaacgcaccgatgacaattggaccgaaaatgaaaaagacatatttataattatatttggatttagagagtctattttccgttttacccaggctttttttaaatatcgaactcgaattcgaatatttcccttttattgaattgtaaaaattgggcaaagaaccaattgaaattttaaggcctaaaatattactaacaacccaaaactctaattataagggtgttcgttttatgtacaaaaatgccaatttgcataaaatatgcacgaaaaattaataatatatgccctagaaatatgaaaaggcccaaatatgcactaaaaactgccaaaaatgatttaagccaaaaaatgtaaaacttgtttaaaaatataaaaatgataaaatatcaaaacaattgctaaataattttttttaactttttttttggtaaaaaagtcggcataaaaaatattcttaaaaaatgcgaaatatgcatttattctcgaatccccaaattatgcataataaaactcgcctgttttaagctaaccacataaaggacggaagcattgcccaaaattgcggccaaccaaatgagaaagtacagggcggagaaggacaattgaatgggcaacaggtcgaccaactcgggaaaactggcctaaaataaatgaaacaaataacagttgcagctcttggcacttaaaagactcattgaagaaaaaattgaaataatttagatgtttttaattttaaagaaaaaaaaacgcgaaattttatcggacctttcagaaaactgtttaaagtattttgcctagcgatcgattaatctttttattttgaaaatccatttcaatttttctcaacctgaattggcaaacaaatgttctggcaaaggcactgtgggtgggagcgccacaaaaagttgggccacacatttggctcaaccaatttttgtggccattggtcaggaaacaaaagtggtggaggtgaaaatttattgctaattatgttttctttgttggtgtaattgtcggg

SEQ ID NO: 9248 - DNA, 1766 bp, Heterodera glycines
  misc_feature (1666)..(1666): n is a, c, g, or t
attattatttaaatcccatcataaaagcaataataaattcccccttgaagtgatcattttgcttttggtcgcaatgtgccctattaggatcacatggtaactgcgaacatcgcttcaaattcagttacctctgtaagccaaccctcaccttaccccaaatttctgtgctgatttaagcaattgcaggctaaaatttcagcgaagaaaaacgggttaataatgaagaaaattacacaaattaaggacaaatagaattataatattttgctttacaaaaatattaaaaagttataagggaaaattcaaaattcgccttttgtccaccgtttcagtaaaggcatagattttgtttttgttctttcggagccaaaatttccaggcttttattaaccattgagcgtatttatttcttaagctcggatttggcaaaaaatattgcagtttatgccagggcttacactgtaataatttgttatggttcttttttgttttcacttttctcagatggattatggcaaatgcaaaagggaagtgataagcaaattggcacgagaagcgaaggcggcggggatggcacacctcggaaatgccatttattttcacaatttctatcgaaatcacggaaactcagccaaaataagtgttggaacaaaaataaatgtattcttaagacattataatttaattaaattttatttaaaaataattttcattgcgttaatttttagagggacaaattaaagaaaaggcaaatggcagaataaaatgcaacaattgagcagcagcgatggaacactttttgttgtaattttggccaattcttatcgccttttataataagcaaatgaaaagcgcttcgttctgaagcagctgtcggtcgcaagtcaaaaaaagaaaaattaattggcactttttgccttaatttatgagcatcaaaaaaacagaacatgcgaattaattgggagggagagaagaaattgatgtaattatcagcaaaataaaaatgggaattgacaaagagatgagatcaattggaaatgcactgttctaacataagaaactaatcaatttggagaagcatttcgggaattcaaaaccaattagcaggttatttaatgagcagtataaaccaattaaaaatgaattggtcggttcaaaatcgctgtcccaagtgctgaatggagtcgcggatggtcgcgtcctgcatgcacacctccaagaagcattccttttttattgggccggactgtcgagaagagccggtaaatttctgcaatttaatttttgaataaattgttttttaattttcaaaaatgccttgaacaaagtctgcgcgtgcttctccctctcctcgtcccgcagttttgacccgcggcgccgtcgcgggtccaacagatcatccgtgacgctcagcacgtacaccagccggtgccagctgatgaagccgctgtccagcgggtcgtagaagcggtacagccaaagcagcttctcctctaaagtgccacgcgaaagcaccgaaacattcttcaggaatttctgaaaaaaggcatttaaatgataaaaaaggccaaattagtaaaattaaattggaagaaggaacaaattaagaaatttaattcagatcaatttgactaattttaaaattttaatggtcacattacatcanatgtgattgccccggactgatccgtgtcaaatgtgttgaagatcagatcagcaaagcgttcagtgtcggcacggggggacaattgggtgaaaatggagcg

SEQ ID NO: 9249 - DNA, 4183 bp, Heterodera glycines
tttaattgcttttcgctttttcgttttcatttccaattcttttccaccggccaatgccttggccaagtcctccttgtcaatggcgtccggctgaagtgcttgccgtctttgcaggttgcgcatgccgtttatgctgcccaacggcgcctcgtcgtggcgtccgccggtggcgccgccggccgtgccgccccgcggcgtgggttgggaggagagaaacagtgcggcggtggcgacgggcgtttgctgcttgattagctgctggtggggggcgagaaatattacatggggtgggacacgtggcatatcaatttcacacgctcggagaagcgcttgttggggcggggggttaattgaggagagcgaacagctcaacaaacaatgaaattataatacaaaccgaaaaaaacggggacaaaatgcccgaattatccggaaaagccaaaggtatccgcaaatgtgaactttcgaattttataccaaagattaaatgtctaatgcttaattggatttaaatatatatggatatgaaataattagggaaagattttgtttttgctttgtcaatttgtagtttttctcgttttgacaataattatccaacagaacaagaaaatataaaactaattattattatttttatggcttaaccacaacaaaatgtttggttttttggtgggttggcacttccgccgccaacaccaaagcagcagcagttgtgaacgaattgcgagcggagagaagggagcgagcggatgcgatgtgttaatatttaatttgtgttaatcggcttagttccggaaaggccggcagctgtgagaaaatcgacaaattttcaaattccgtcgccggcggagtccaaaaaaaagcaacagcagccgttgccggggggccattaacttctcagggagagagagaggggggagggaggcaggggaaggcaagcgaaattacacggcccccccggggggtgttttgttttgccaggggaactaacagcgaaagtggggggggggggaatttgtaacatgcgaaatgatgaggaggagaagcattcattaacattagccaacattgggcaggcgaaaagccatcggacgaatgaaaatgaaagaatcaatgaatgattggatgattattattcaccacaaaccaaaagagcaacagaagcaaaaggtaattaattaattaattggaagaaatttgaggatttcgagttgaaagtaaataagtaaattggaaatgcaaacaaaagcataataataatttaaattaaggggtgcaaaaatggccataaaatatagaaaagaaattcccgaaaatgaaaataaaattgaaaagacaaggacaacatatgttttcagattgtaaaattactcaaattcttattaaaagctaaaccaagttcaaaccttatttttcacaaaaaaaaatttggacttgagatgttttaatgaattgcatttcttttatgtatttatagaaaattcaattttcccttctattcgcttatttttattttttcaaaatattttaatgaaaaaatgatttctttttttccaatttttaacaatacaaaagaaatgaaatttgacactgaaataattaatttcatttctctttttaataaaatctaaattattttgttcttcgttctctttttcctcaattgtttgttctgtttccctttttgctgctctccacaatgaacggaatgcatttttccaacaaattgtcactgaaaaagccctcctttttcacattttcgccaattttggtttctttttcattttttcccatttcctcccatcgcttaacaaatgtgtcaatttcttcgacactttcgcttaggaatttgttcattttattccattccatagcaaatggcattggcacttttcgccattcttccaaattgacctctttttgcatttttaaaatcgccgtgtaaagttccgaataaatttttgcactttgaaaaattgtgtcatttttgttgtcatttttgacaatagctttgcgcaataactcagcaaaaacagaagcgacgccataactacaaaaatgcaattaagcaaaatttgttttgtattaaggatttaattcctttatttctaattaattataacaatccaaataaatattaaatcaaaaatttgacaaattaaattttcattaatgcattgttcactccctaattaaccacactaattgtttgttttaaattctcacttttctggtgaatagatgcatttctcgaccatcttgtcaaaatcgaccttctgctgttgctgttgcgcgctaattatgattgggcacaatatgttaaactccaataatttttcagcctcaaaattgttgccggaaagcgccgccagcgtttggcgcgtggcaaattgtgccaggcgcagcacaccccgtgctaagtctgattgctccaagaatcgcattcgcttttcctgatgtaaaataaaatgaatttttattttgcaatgattaaataatttttatttttctggtcactgttatacagtatacgtattttaccatctcttcttgatcaattcttgacgctccaacgatcgcataaaattcttgcgacatttgagccaacactgtgctaaaccaactgagcatccattttctcgttgaagctatgtcgatgaccttaattaaatgacaattaatattcaaaattcactaaattgtgtgtcatttaccagaatgccatcggaggtccaagaaaaaaaggacaaaaatggcaatatttaaaaccaaaacttttggattttggaaaaggggtgttcgaacagagaccgcgagtgtttttttattttaaaaacctgacctgaatatatctttttttttgcacgtttaatgaaaaaacattcccaaactaataaaaggactaaaatgttaatgctgcttctctttaatcatctgcacagatacactactgtatactgtggatgttcttactgtatctttttgactgtaactttggtatggagtctctaattctacgattaattttgtgatgagtcgcgcacaaaaatagagcattaattgttctttgtgttcgtttgtctgctcttcctacaatagcgggagcagggagttgtactcccgtaaaatcccacggtagtcctgatcccgccgcactctattgttaagctattaattcaacttttcgcccacaatagctgatctcttttccaatcacacggtgcgctgggaattgtttcaagaaatgtcctccgaagaaaatgtgataatttttggcattgaaacgtaaaatccccaggtaatctaaaggtaattgtttacatttttgccgcatatactgcaatacgatggatcgtctttggggcggacattcaaacggattcaagaaatgtggacagtacttgaaaagtacttcagatcactgagagaccgtgattgtcccaaatttttgcgtcaaatttttgatgatgaattgacgccaaggtcagaggaatggaaagttgttgtgtgctttatgtgttttgcattcgatcagtttaaccaattgaatgttattagccaggtagtacttagaaaattactagattaattttaaaaaattcagaaaccgacacttccgttttccattttggccaaacaaattaaatcattaaaggtgaagctgtaactttcattgaacgaggagttttatggggaagcgaccagtgaactcttgaaacaacttgaaaatgatggcgctatttatcaaaaaaacaaattaaaggcctgtttctttaataaaatattggttttagttttgttttttcagcaattttacgcggacgcacatgaatatttgggcaattggtcacagcaattctctgagacggatgaaattattggagattgggtcattttcgagtcagagccaactagtgaaaaagttcgaagggcgtataggcatatttctgtggggcatcaactgacgaaatggatgctttgtttggtgagatcgctgagttgaaacaaacattgaaggagctcgagggcgaccggttcaacaggaaaaacgtggacgaaaaatgggcggatattttcaaaaatcctaattttgtcctgctcaaatcactagtctctgcaattctgtcgatattcccttaaaatgcattttgtgaatcagtcttttctgttctgaagaaca

SEQ ID NO: 9250 - DNA, 1927 bp, Heterodera glycines
  misc_feature (1811)..(1811): n is a, c, g, or t
gtgtctcttcaaagaccactacaacctcagcacctgagtccagcgcgaattccacaaaatttccattcattttatagggcattcaatcagccgtttcggttggttcaccgaattgatcagcacacctccaagcttgaggttgccttgcttacgactttgcattttcccttgccttattatccacgattggtgttggttgcactgcgcttccaaatgtcccactttgctgcacttccggcacgcaactttaatgtgcggacatacacttggaaaatgtgagcttcgcccacagcgccagcacacattcagctgctgttgcacttgaccacgtgcttcaaagcctttggttctcactgcacaattttgctttacagccaaaatctgctttggcggggctggctgctgctcgatgcatttagcttcagcaatgccccgtcctaacaagaactctacagtccagctaatggcaatttggctaattatttggacaaatattctgttaagaatcagcgaaaaaacggattaataatgtggagaaattattagacgtcatattcattattagtaaagtaatattttcgaaatttaatctcaaaaaatatccaaaatctaaaaagatgaatttttgggggatttccggtaaaggtctaaatggaaagtaatagaagattattgtccatgattttgtcctctttttgagcatattttagaagttaacagtcaaaattaaataaaattcaacgaattattttatccaattttctgttaaccctcagagaaaaatgcattaataatccatcgaattctattttattaaatattagtcaccataaaaacatatttttggaaattaaagtcaaaaagtaataaaaaatatgaaataaaattcacgatttttaaagcaaccttgacacattggactgttaaattcctaaaatatgccttgagtccatccaaaagcccaagaaataattaatgtcctttttttaacggcatttaccgaacatttcctagtgaatcgttcatcatttttctattttcaagaattgtcatttttcaaattttaaatagtaccacataaaaagatattttaatgaaatgttcggtaaatgccgaaataaaaaggaaataaatctttattcagaaataaggccccttttaaagcctattttagaactctacagtccagctaatggcaatttggctaattatttggacaaatattctgttaagaatcagcgaaaaaacggattaataatgtggagaaattattagacgtcatattcattattagtaaagtaatattttcgaaatttaatctcaaaaaatatccaaaatctaaaaagatgaatttttgggggatttccggtaaaggtctaaatggaaagtaatagaagattattgtccatgattttgtcctctttttgagcatattttagaagttaacagtcaaaattaaataaaattcaacgaattattttatccaattttctgttaaccctcagagaaaaatgcattaataatccatcgaattctattttattaaatattagtcaccataaaaacatatttttggaaattaaagtcaaaaagtaataaaaaatatgaaataaaattcacgatttttaaagcaaccttgacacattggactgttaaattcctaaaatatgccttgagtccatccaaaagcccaagaaataattaatgtcctttttttaacggcatttaccgaacatttcctagtgaatcgttcatcatttttctattttcaagaattgtcatttttcaaatttttaatagtaccacataanaagatattttaatgaaatgttcgggtaatgccgaaataaaaaggaataaatctttattcagaaataagccccttttaaagcctattttagaactctacagtccagctaatggcaat

SEQ ID NO: 9251 - DNA, 687 bp, Heterodera glycines
cccatgacgattagtggctacttagacctgattttcaattggcgatattttgacggtgccgaaacgttcggcttcaaactagtgttggtcgggatcgggaccaaaacacggacaactgagtaccgaagtcccagttttgacaagttttgactgagtccgggaaatttccgggtttttcccagttttccaagccaaaaagtcccggttttgcccaaaattcccggtcccgaccttccctacttcaaactgaccccgatcccggggacctacccctcccccccccccttcccccatcccgcgcaacataaacttgaagacttaggtgttaccgaaaacaaaatttgttgtatttttagaaaaaacgaaaaagaattttttttttcttgaaattttcttaatatttttttctcgaatcaggctagctaacgaaaattattatttttttaaattatttttttaaaattttttgttaatgaattattggcggcccgtcaatctttgctgatgatgatgactctttatttcatttggcattgttttgtttaggcatttctccgtgccaccaccaccaccgattctgcttctgtcagttaccaaattcattttcccgtttatgggccaacgccaattgtgccgtttgagctggtgaatgaacggacccaagaaaagctgacattggaggaagaa

SEQ ID NO: 9252 - DNA, 1820 bp, Heterodera glycines
ggtcaaacgtcaaattcagcggatgtgaattaattaattgagcaatgacagccgatcattttgaatcactaaatgatggatgggaatcgatttgatttgatgctcttttatctctttgaaatgcttaatttttcttgcttatttttctttaaatttgactgattttcattttaattttaactaaatatttcgatatagtttaatttagcttaactttatataatttttatgcgaatttaattcaattttcaatggcatcgcccgccgaaaaaaagaaaaactttcctccgccgaccattgcttaatttcttctgccaaaattgctgaaaatcagcagcaatcgttgtcgggttcatcatttgagacatcatttggaggagaacagaagaagaaaatggaaaatcgaaatttgaagagggaaatgtgagagaaatgataattattaattaaattgaaatttaatttaaatcagtattatggccaaaaacatacatcacaaaaatgggaaaagcggataaaagtcaaaagcattaaaaaaccatgggttttccagtgactgaccaagacccagcgcaggatttcgttgggtcccaccagtccgcgtttttttagaaatcatgggatttgccggagattaatcccgcggtattacgtcccgcaaaaaattgagttccaatacggcagtgatgagatccgcaaattagaaattacctaactcttggcaggttgcctgagggctggtccgtccctggccctcatacgttttaccaatgaccctttaacatatttaaatattttttaattaatgtgaattttcaccgggctaaagcctcgcacattctgatgagaggcccaagccgaagccagaaaaaaatttagcagaggtgaatccgaagattttttttgttgaaaattatgcatgttttgagatttttatttaaatgaaatttacgaatagatttaggtatgtcaaatctgctgacaaattttcacattttaagttggatttgcagagatgtttggatggacattttccctcattttgaccgtccccaaatcggcctcaaattggcacttctctctcctcgttttgatgttttggtggacacacattttgatggcaaaagcgaactgacagtttggagaagtgtcgaaattcgaaaagagacgcagtctaaaaaacctattcttcttgtgcgtatgagtgacggaggatttttgaaatttgcgctgcccgacagtccgctgcccaacaaaatccgttttaggaagctgtatattatgtaatttgaaccttcgaaacccctaattaattctggatacatgaattttcaggtacactgaccattccgtcatcgaatttctccgtgccaatcagcaaatatttggcaattccacccatttggctttgaagatatttccatcagcggcagaaggaaccggtgttgtgaaaatttggccgcccattattgtgccaaacattcgccacttgcgcgcttccgcccgtgctgatcacttggacaacttttgtcgtctcattttgccaacaattctctctgatcttgctcaactgaattcaatcggatccttggtcatgttccccgacgcacttgctgatgatgggccaactgctgcaacttgttcttctggccaagcgttgtccaaatggttgcacacgccgagaaaagatggccaaccgaagagattgcgttgctttggttattattattctccagcagcaagagaatttgagtggatcaacaatttcaaagaggttgcttgctgctcggcgctgaactgaccccgtctccggcggggta

SEQ ID NO: 9253 - DNA, 1444 bp, Heterodera glycines
  misc_feature (1364)..(1364): n is a, c, g, or t
aaggtatcatcaaaagatcatttgcctatcatccgttttttctgctattcgagtatttcacccatttcaatttcggccgcttctttcttcctcctctcaaattgctttcgcagtgatggctttattctgataaagaaaaaactatacctttaaatcacaataaaataagtaggcagaaaaagaagtacaaaatttaaattttaatcctaatttattataatttaaaattaaaataaaataggcaaaaatggtaaatttttaaattttagtccattatgataatttgaagttgtttaaaggaatatgagtttgagcttctcaatgggaccgtatcatctatattagctacggtaaattcacctttcatatggtcgctccttttcgctcaaaatctcttcctgttttctcatgtcttggaaaattacccattcttcatgtgaaacacagccgaccttagttgcaaattccaattcgtcaacgtcaaagatccgacgagccgctggattttcctaacggagaaacagttaatgaagccatgaaatgcaaatttaaatgctaaaacatttccaatatccagagtacctttttcaattgaggcttttttgggtcggggtaagtgtatttgcccgtcttgagtagaaattcatggcgagacatgacttggtccaactcaagagtatgccaatatttgctttctgccaattcgcccggctcaattcccatgtgaaaataaatgtactgcaaaaaatggaaattgatttgaaaggaaattttgtcgcgaagaatagaaataattcgctcacctcataaatttcctcaatttcttcaaaactcatcaaacagatttgaggactgttgaccatcagtttctttaagtcgtttaacgtgaagaaatccaaaatattctcccaaaacatgtccatttgctgaggaacccccatgaaaagtatctccggacatcgcatcacaacacttcgcatttgggcacccgcccgaacgccgcggccaaggaaaatgctcagccgttgctgaacacaatctgccgacaattcttcgagtccgctcgcccatctgagaaaaagcgattattccagcccaaaatgttggcactttcccgacgataaatgacatacttcgcataaaatcgcatggcgtcttcataagtcatttccatacagtcgacaaatacacccaacttttttggtcgtttctcgcccattttttgtcaacgccataaaaagggcgacactttttgaacaagcgtcgatgataaattccaaagcaacgcctaaaaaatagagaaagctttttcaaaacatatgcaaaaaaaacgctacagattacaattagtttagtgaccgaanaagcattgcagtttataaatacaataaatgtctctattttgcccgaatcccggagattgatcactctctgtttcaccctg

SEQ ID NO: 9254 - DNA, 2802 bp, Heterodera glycines
tgtttaagaattacaaacaataatggaagcggtcggaaaaaccacaggacgaactgtcagaagtgttcaaaccaaatacagaggcgtttaaaatgtttcaggtcaccgaattcaatcgtagggaatagtccccgctctgcgtgatgtatcgcacccatggcagtgcctggtagccgcttttctcgatgattttgaggtatcgcacttgaatgcctgatttgatggattattacttacgtggttaagccaaacattggtccactttttgcttcgctcacccgatgtggtgaaatatggaatttcaaagcgcactttgatcggacgcttcgcctcaacttcttcgctgagaacggacggaagtttaaagtgagcgcgcattaaatattccttccctccggggaaatttttgatattccacacaaaagaattgtcctaaaaaggaaaagtgcgaagatcgaatgagaattccttttgctcttccccacttccggttggtaacggcaatttccgatggccgttttgaagcgcggactgtccgaataactgggggccggcacgacaatttcgacattattcgctgtcgaacgtcgcttgaactgacttttggccttcaaacgcaaaagcataaaatattaagtagttaaacaaataatttaaaaaataataattattttttaataataatggtaacaaccttcccatttgaccttactttgaccatatattcaacacgactgtgcgaaaatttctcaattacctgtaaaattaagcaaataacaaacgcaaaaccaaattaattaccgcttcgacccaaatgagtggtttgacaattgtgctcaatcttggaaaattaagaaaatgcaatatcagtgcggggtgtgtgtacctgtaactcatcagttcgaattccccgtcaggcggaataaaacttatcgtacgatcattttcttaattaaattttgtttttttatacttttatttgtcaaattaccaaaacgcgaaagcctcacgcattgatggaattttatgtctttcaattcgacggctttgattctcccccctaaattactaattgggatttatgcttcgttggttttaaattactcccagccgcatcaaattggaccttaattaatttgtattacaaaaagaacaataataaaaataacaattgaattgaattaaaagaaatactttgtcattcaaacccaggcgcaattcgggcattccggtgagaaaaacacgcattttgacggaaccgacaatttcactttgcaacactgtaccggcgccacttgccttaaaaaagcttcttatcgcgaataaaaaatttgttgtcctgaattattaaaaagaaaaaatattaatttcaattaccagaaggttcaatgattcgatcacgtcaaggaatacctttaaaaagaaaaaaacgaataaaatattaaaaaaagaaaaacctcatttttcctatgtctcacaccttcggacctaaaaacgacagccaatgttcagggaattattcaagagttgataatgtccttttccgtcctcatcattgcctttttggcatttgtatgcaaaaccaacctccacgagacggcgttggtcaccgccatcgggggacgcggctgttgcgcggcctccaatttgtgtccttcctgagttatgtacctgaaaaaaatgaagaacagaaaaagacaaatagaaaatactcgcgcaatattcgtccttcggtgatttgcggatagccaaaatccatcatttctttaaaagaacgaaaaatataaattaggaattgggtatttaataccgtccaagagctcgtagatgatcacaaaattgtcacgaattgattcctcctcaacatccttgaaatattcggcaaaaacagcaaccaatttgtataagaatgtttgcactaacgacacgttggtattgcaccgggacacagcaacaacttaattcggtgttcaaaattgacccagaaataaacatttgcttcatgatatgtaccataaatgttattgaaacgaatccaaatcatgtgggtgccactctcaacatcgacgacgggtgcaagttgaccctcttcttccagatcgaccaaaagtgggacgaatttctcgataacaacagtgtcaacatctccccttcaaaatcaagacccaaaaaattgaatgatatttgaatgactggctaaccggtaattgcgtgaaatgagcacctaaaaagtgaaaacacaaaaaatgaaaagctttttcttcaaatggtggggggaactgatccagaggggggggagggggggggggggggacgtacacccttattaactgatggtaaagacagaaatgcatctaaattagataataaatatttagtttccaattttcacgaattatggacaatatattattgtacagtaatcaaagcacaaaatgcattcaaaactccacaaacatcgacaccaatcacaagtaattccctccccgctgattcatgggcacattttttttcttctgatcctttgcaagggcttccttcaactgtttgttttcttcctccaggaatttgacacgctcttccaggaacttctcacgctcacgccgtttgttcctcgactgcttggctgcctcgttgtttctgctgggcctctccaaataccgctgtttttccaattctgcgctaaaccctttgctcgtggcagagttcaacggtggcgtattgtttgaattcaaaatgttgttgaaggggcgacgacgaatgtcaccaccgctctctcgcggactcaaactgtcggcagat

SEQ ID NO: 9255 - DNA, 1590 bp, Heterodera glycines
  misc_feature (22)..(22): n is a, c, g, or t
ataaaaagtagaataatttaanttggaaagtaaaatttcatgctttttatagaaaacaaaatccaagccccacatcgcatggcttttttcgcgaccgatgggatttaaataccgaagccgacaaccaaacttataatccttatttcgtcattattttcgccacttggattttgagaaatttcttaacaaaatgtggtggaaacaaagtttaaattttctgtaaaaacagatataggtgtgagcgaaagtgcaaattggaaaagcagcagcgccgatttgcggggtcgacattttgatggatgttctgctgtttgactttttatcatggccaattatcattagggctgggaatttaagtcaaatgactttttttgatgactctaaatggccttaaaatgacttaaaaagtgttctaaactttgtttgaagcttctaacatgcatttttatgacttttttacactttttgggatttttataacttttttgagttttttttttgcgaattttccgtgattttttttaactttagcctaattttttaggacttttttgcattttatacgtgcttttttggggttttttttattttactttttggctattttttcaggacttttttcaatttttcatgccttttttatgcctttttggcgattttttatgacttttttagtcgactttttaagctttttcgtgccttttttccccagctctttagatgaaatgcaaaaaagaaagggaagcataaaacggtgaaggaaataaaaggacgcacaaatgcacacgtcacaacacactctctgctcactgtccgaggatggcactgacagtgggggagagacactcgtaaaaaggcaaccaaaaacaaactcaaccaaaccaccaaacgcaacagactgaggaggtcaaatcaatgccaagggacaaatgtccccacaaacaatttatgcaatgggagaaaacccatcagatacagtaagacgacgttgttttgatgtacggcaaaaccaaaacaatgtgtactccgacttttgacaaaaacaagcaacgaaaaacaaccaaatatccagcaatggtagttttgtggtttcttcgaaaaataaaattaaataattccgaagtgcattttctaggctaaaaaaaatacgctgatcacgaatctgagctcggattttgcaaaataattggttttgtctatgattattcatcaagtacttggctttttcagaaatttcatttttattttttctgatgaattaggggttaaaaaaatgcgttgaaaatgaatccgagctctgatcatgcgaaatcaatgtttttgtctatgatttttcatcaaatatcataaaaaaataagcctcagccaagcgggctcgaaccccggaccacgcgtctcatatgacccacaaaggattaataactaaatttcaaaaaaaaacgtaaaaaactaaaagcttgacttctccagaccttcaataggttattcgaaatccctttttatgctctacaacatctgtgtatgagttttttacgcccgattttattttaattaaatttttgaaaaatcaagtacttgatgaaaagtcat

SEQ ID NO: 9256 - DNA, 1919 bp, Heterodera glycines
tttgggccataataaattcaaaaaaattgaattgtgtatgtacctcagcacaaatttcgtcaaacgatttcaaatttgatgcctctcgtgaaatggaattgctttggactgacagctgacgacgtccaacggcacttttaaagtcggatggcattttcatcggattgaactaaaaattggcattttcagaacagtgccaacacagtttctcctcattataataaaaccttttgcaaatcttttccggtcgccaaaaagtgaaacgaacgagaaaaggacgacaatttagaaaaagagcagcgattagcaagcgtattcatattgcaaaaaaaaacaactgcagaaaaacggatggattaattttgaaaattaaattttaaataatgtaaaagtcggaatttggcattgacatcaggccgagataagaataccgggatggaaagttcatttttccggaatttgagtaccctgagtccggtattcaaatcctgcttttgctggggtcccggtcctgagccgtttttaaaagccgggatatgggcccagaaaatcctgcgggatccaggtcccatcccggctctaattagcaaatgattattgaaaacaaaaaaggtcgaaaaaaagttgaaaattttaaataagtttaaaataaaacgccataaatttgatttcccaacgcaattttcaaattgtaattgaaagtaacaaacccaaaatttggccattttttgtctaataaaattaaaaacaaccaaatacgcccgcttttgactttcattgcataagcaaatctgtgccatttgctttttgccttctctaatccaaaatttcttcattgattcttcatcatccccaactctctctcttttttggtcatttctttatcaaattatcatcattatcatcatttccatcgcttggcccttatcagcaaaaagtgcgtgcgcatgggccagcaaaacagcagagataaacgaagccgacgaggcgacggcggcggacgtacacaaatcggtggggggagggaaacggcggagtaaacgaaaataaaaaattttgtgcaaaattttgttgctaaaactataattataaaccttttaaataatttgcgggaagaatgaatttctcaaaaaaaaattaaaaaattaaaatttttggccataaaaattttccaaatcgcaatttgtccaataatttgtgtaaaattttgcaaattttagtgaaattaaaattcgtttttccaaaacaaagattcaatttaaaaaaaggaaattttacattttttaattgttctacatttcatccttttaaattttgaaaatttaaaattttttcatttttttaactttggcaagggaaatggacgccgacaattcgccgctgttgcagaacgatgccgaaaatccatctccaactcgtgtggatgaaattttgaaccgactgaatttgccaaggtggatttaaattattaatttaatattattaatttaaattattccaaaataattaattattttattttcatatattatattatttatagagcgtatattatttttttatgatttaccatttatttctgaatgcacattgttaaaaaaattaaaacactttttaaaacggggacggagcaaaacattgccgccgaaattttaaaaacaaatttcaaattcgaaatttcccagaaaaacatcttagaaaatttcttataaaaaaatttcacgaaaaaaaaattggaggctaggcctacgctttaggcctaagcctaggcttaagctttagggcttagactgagagattttggggtgcacccatttaaaactcagtgatgtcaaatcgaaagcacttggcaaatctccaacattcggttgattccttggctttttgttcctaaaatttgaaaaaaaaaattcacaaaa

SEQ ID NO: 9257 - DNA, 1629 bp, Heterodera glycines
tcaaaaaatggcaattttaaattgtgaaatgccaatgccaaaaagaaataatttaaacggcgccgaaaaatgcctttccctcagggcggaaatgcggtggacgcggcggtggccacaacattttgcatcggtgtgatggacacgcaaagttccgggcttggcggcggccatttcatgaccattttcaacgcgtaaaattctcctccagggggatggggtagaaaatttttgaaaatttctaaaaaaaatttgacagtaccacccgaaaatgccacgtggtcgacgcgcgtgaggtggcaccggctgccgcaacggaaaacatgtacaaggaccggtggaacaagtcaaaatttggtacggtttgtcactgtgtgtgtgtgtgtctttttgtgtattgtaatttggctagcaaatttgttaggtgtacggtatcttatcaatcaatttttatgtactgtatatttgattctacatgatttggcttaattatcttttataaattgtgtatttggctaataagcatcaatcataatgggtgtatggtaactgcagtttttgtatatacggtatttggcacaacaaatactgtatttggttaattaatattttaatatacggtaattttgtaattaaagcacatcgtttctttaaattaggttgggaagctgttgccgtgcccggcgagctgcacggcctttggacagagtacacacattttgggggccaagtcagctgggaatcgattgtccggccgacaattcgactaatggaggagggtgagtttggattttgatgatccaccgtatcaaatttaaatgggataatttgtcatgctgcaagaaggataagcctgataagcaaatggaaaagcttattgttagttgcgtttttcgatatttttttttagattttcgatttatttttggtaccataactcagtgatcggagaacaggtgacaaatacaagcaacatataaagcccaagaaagacatgccaaaaatagtttttagttttttttttaaaattaattacatttgcaattttttaaatttttatcccccaaaactctttttaaagtgatcggaaatgcatcaaatttttaaacccttcaaattttaaatgcattaaatttttgattagctaataggtaaaaagtgaagctaatgattttttcgtgttttcattttttgaatgaattttcgatttaattaatttctttttggttatctatcggaagagcaacacaaaccttttatttaagccagggttgccatcgtccatactccgtttccaaggacgggtatgccgatttgcaaggacatagtggggaaaattcatgaaattcaaggacatttaaaatttttattatatgcaatgcaaaatggttaatatttattcaaatggcttgtatttttcaccggaattgtttttttccaacatttttttgttttcacttatcattttcttcatttacgacgacttttttctgctttaaaaacgctttttttgtggcgcgctttttccaaaaattttgtgggacagaggggggggggggggggtccggcggtgccgacaggcgccgccggggaaaaattttgaaaatttgaatgcaatttgttaaaagattt

SEQ ID NO: 9258 - DNA, 2061 bp, Heterodera glycines
  misc_feature (2020)..(2020): n is a, c, g, or t
tcttaaattggtcggaagcgcaccaaatttttaaaccgctattaagacaaatgacttgctttgcctgaaattaggcatccatttttctaattttttaggaccgttatgatgtacaaaaattggaaaatttgcctatcaatttatcaaatacttttttttgttttgaaatttcgtgcccttttttccatggcattttctttggctaggctatccgacatcgcacgcgctggcacatgcgttggagcagtacaaagcacaggtgctcaacgagccgaccatgcgccggcactttgtcaacccggcaacgggcgtggtgtacaagctgggcgagcagatcaaaacgcggacaaatttcatcaacacactgcgcgggttggccaccgcggcggaccccgtggcatttttctaccgcagcaatttgacgcagcaaatggtggacgagttcaagcggaacggtgcgggcgggcggcattttaatttagtgggggcgggggagggcggtggacgattgctgatcaagcactgacacactgatctgaaaattctgcaattaacaaatttggaggggtggggaattgattgggactgcccaaatgcgaaagtcggcattttgccgcgcgagccaagtgccgaaaacagggaaacgatctcgagactgaattgatgccgagcatttaaccccgagaattgagttcatggaacgaattttaaataccgggggatgattcgaacggctcccgttaattgacccgtgagtcaagatcgagagttttctccgagtattgagacagagaaaatcgactccgagactccaaaaaccagcaaaatttctcgactcagtaacctagattctcgtatattgtcaatcaattcaagaaaaaggctccaagattactttaaacatttatttatcgatttttcgatcattttcccatttttgttaggtggcattttgacgatggacgactttgccaattatcgtgccattgtccgtgccgatgccgacatcatttacactcaattagaggacggtcgcactgtttgcgggcctccgcccccatctggtgccgcggtgacacaagcaattctgtccattttggacccgtcagtgatttgacgcatatttatctatatataattttcgaattgtttggcgcgagggtaattaaccaactaattaccccactaattgtatttgaaaataaacgaaaccagaattgtaatgtaaaaaatccgggaattcctaacttctccctcttaccgtataactctcaaccacaccgggccaaatacggtacatacaagcattctctgattactgtcatggtatcgttcaatccaaaaaatcattgtttcaaaatactttaatttgtaataccgtattaccgtaccaccataaatttccactccgttactgtaccaagtattttcagtatcgtgttcaacaccagcaccatttctggcaacgtgggcttcctccaccgcttcatcgaggcatccaaatttgcgtatgcggcacggagttcaatgggcgacatggcatttgtgaagaacgcgacggagttggcacggaacatcaccagcaagtggtgggcccagttggccaggtgcgttttgtggggctgcactttttaaaaaatatttcagcgattttttgaaaattttttgaaaagtttcgaagtgaaatttaaaaaaaaattttcgggatggggggggcgaaaaagccgctcctgttttgtggcaccgatcggagtcatcccctgctgatcaggtagggacaacgttgagaattccatgatcatgggatgatttcaaaatggcattaatatcattcattattcattcttcaaggtccaagatcagctggggcacacatccggacgactattacggtggcggttaccaagcgctgcccaacgaccacggcaccacgcacatcagcgtggtggacaagcatggcaacgcggtgtccatcacatcgaccatcaatttaatgtgtgtgtttgtgtgtttggccaanatttaatccaatgatccaagttgggatgctaattgatcatt

SEQ ID NO: 9259 - DNA, 2731 bp, Heterodera glycines
  misc_feature (2710)..(2710): n is a, c, g, or t
caagtacaaaggaaaagcccgagaattggccaagaagaagtttaatgagaaccaacggcagggattgagggacttggtcaaagctgggctggtcaacggttcagctgaagacattgcaaatttctttctgacctgtgatggaatcaaaaaagtaaatatattgaatgtctgatttttagcccaatatcttttataaattttcctttttcagtccgcaattggcgatttccttggcgagaaggacgatttcaatttggaagtcctacaacattttgtgcatctccaaccacttcggtcgctgccattggtgcaggcaatgcgtgggtttttgtcgcgtttccgcttgccaggcgaatcacagcaaattgaacgcatcatggagtatttttcggggcattaccatgtccaaaacccgggcatatttgagcatcaaggttggtaaaaaatgtttcaaaattgataaattgcaattaacttctattttaatgcaatgttagcataaaaccctatttttgaagattggcatcatactacgagcagaatataattttttgctttttcttcagacaattgctacaccctttgctacgccataataatgctaaacacttcgctgcacaatccgagcgtaaaggagcgcatgagtttggacaactttctaaacattaccaattcattgaatcttccgccggcactggttacggttggcaatattttttgttgctgggcatttaatatgaacaaataaaaatttaaaaaataaatggttaattctataaaaattatcgcaaatttgtttaaaaaaccgaattaatgctccttttctgtatgttttaattctaaaatttaaggacatttataattccattcgctccgaagccttcaaatttccggacgacaatttgcaagagcatttctctgccgctttgtttcaacagtcggagaagcagggctggcttgagaaacaaggtggcacaaagccaaaatatgcaattgtaacaacgaacatttgtttatttcttttcaggcagtcgttacaaaacgtggaaccgtcgttggtttttacttgccaatcgttgcctttactattttgaatcgcccagtgtaaaaattttgtaaatatttgggttcaatatgaaatatttcagagtcgagaacccaaaggcataattccattggagaacattagggttcgggttggtttatctaaaatgatacattttttatttctgtttttatttcataggtacttgaccaagaaatcgacacgattcggcgagcgcatgtgtttgaactttactcaccgaacacggaggtgatcaaagcgtgcaaacagagcggagagggacggcttttggagggacagcacagcacttaccgagtaaaagcgggggaatgacaaaggcacggacggcgaaacagggcactgacaatgccatgtttttaatttgcaaatacctaatagggaataaaattactaacaataaataataaattattagcattcggcgttttcttttagtccaattgccctttaattaaaaaaatattctttctttttgcagatttctgctccaaacagagaagaaatgcattcgtgggttagcgccatccaacgcagcattaacaaagaccaacacattgaagtaagaaacgattaatcatcggcaaagccttttatgaattacccaaaatcccatggatggatttttaattgagtctctctgaaaaaacacatttaaaaaaactaataatagtaaatctttttcaaatcaataggatgtgcttgaacagcgacgaaggcgaatcgcaagcggtggctcattggtgggaaaatcatcggcggggcagcagcaaaacccagtcgacgtcagtggtcagtgaatgaatatactgtatcattaactgataataaagcacgtccaatcaacaattttttaaaggttctctgctaattccccttcatggtggcagtgattgatgaaatatgatttatggaattgtacacaaaagcgttgaattgaattaattgctgtcacttacctttgcctttgagtttgtttacgattcactgtcattaattatttgttttttatgagctgaactcaataacacttttgtaaataaaatttcacttttgaaacctctcattcttaataaaatccacatcctttcatttaaattgttcttttattttgtgataaatgtgtgcaatgtaaaatgagaacgtatttttatttgtttgcgtttcaattaaattaaaattggtagagaccggatattttggaaaataccgggaccatggacttgccgggataagaaacctgggcctgagttttcatcaggacataaaaaaattcgagatttattgaattttttaattcggcacctgaaaattattatgtaatagtgatgctcggagtcttgaccccgagacccaaaagactcgaaactgagactttttcttaaaaaattatacatttataaatcgaaaaaattttctgtaaattaaaaaaaaatcatttttatgggcattcctaaaaaatgtttttctctttgttttttttgttaaaaaaattgtttaatcttttttttacaaataaatgaagtcttcgacgcatggatatcgctgtcaacggtgggatataaaacccacaataaaaacggagtttactgagagaaagcgcgagctgtaatttgatttgacganaatattactttcaaaccattt

SEQ ID NO: 9260 - DNA, 1616 bp, Heterodera glycines
ttatattatataagcccattaaacaatagggaattttcttgaaatgtccagctgtgcgctgtacgtcgtttgcacacctctgttttgcgacgttcgattgctgtgccaatgagtcgttatgagccgaacagtcgccttccttatgaaaagctcgatgctaatttggcaatcattcgaaaaaggttttttttttttactttcggatcacaaattcctgtgaaaagcacatatacttcgaaaacccatttttaaatctccaatttctgcattattgaaattcttcaggttgaaccgtcctcttactttggctgagaaaatcatttactctcatttggatgacccgcaaaaccaaaaattggaacgcggtgtgtcatatctgaacttgcgccctgaccgtgtggccatgcaggacgccactgctcaaatggccatgcttcagttcatatcgtccggaattccggcggttcaggttcgcacactcacaatcagagactgacacgaaaggctttctatgttcatttttcaggtccccaccacaattcattgtgaccatttgatccaagcgcaagtcggaagtgagaaggacctttaccgagcaaaggttggccaatttgatggatcaaacattactattattcatttaaattccgaaaggagtttattattagatagttattctaatgcgataagagcaactattgtattgctaaactgctttttaggagatcaataaggaagtgtacaactttctcagctcctcttccaacaaatacggcgttggcttttggcaccccggcgccggcattatccaccaagttatcctggaacactacgcttttcccggtctgttgctaattggcacggactcgcacacgccaaacggaggttcgtgacttaaaaaaaatacctttcaaatatgacaaacattttttaggaggattgggcggaatttgcattggtgtcggtggtgccgatgcggttgatgtgatggctggttttccttgggaattaaaatgcccaaatgtcatcggagtcaaactgaccggccgtctttccggatggacagcaagcaaggacatcattctcaaagtgggatgaaaatttaatgatatgatttgcaaattccattttttaaattttttttttctttgcttaggtagccgagattttgacggtcaaaggcggcactggggcggtgatagaataccacgggccgggcgttgaaacaatggcatgcaccgggatgggcactgtgacgaacatgggtgccgaaatcggtgccaccacttccatttttccgttcaccgattcaatgggggactatttgcgcgctaccaaccgaggagacatcgccgagcaggcgaagaaatactcaaacttgctcacgccggacccaggctgtgagtacgacaaggtttgctgttttctcggagttattttacttcgtatgtaactttttttagctaatcgagatcaacttggacgaactggtgcctcacgtaaatgggccattcacacccgacttggccagcccaataggcaaattgggtgataacgcaaaaaagaatgggcctgtggaagaggaaagtgggcctgatcggctcatgcacaaacag

SEQ ID NO: 9261 - DNA, 1134 bp, Heterodera glycines
tgatcggctcgtgcacaaacagttcatacgaggacatgtcacgtgctgcaagcattgcacgacaggtcaatcacataagaacaaggattgaaaaaagcctatttggccaaattataacaaattatgctaacaaaaacaaataaactgaatttctcatttccaggcttccaaacatggcttgaaagtgaaatccatcttcactgttacgccaggaagtgagcaagtgcgtgccaccatcgcgcgtgacggcttcatcaaggactttgagaacattgggggtgttgtgttggccaatgcttgtggcccgtgtattggccaatgggaccgaaaggacgtgaagaagggcgagaaaaacaccattgtcaggtctcatcgctaaataatgccatgtgcatctttaactgggtttataatcaattagtaaattgtaattcgtcagttcttacaaccgcaatttcaccggacgcaacgacgccaacccggccactcatgcgtttgtcacttcgcccgagttgaccattgccttggcgttggcgggcactttggactttgacccacgccatgacacgctgacgggctcggatggtttggaaatggttcaaaagggaaaatacttaaaaggcaatttcaggcaagaagttcaagctggaagaaccgaaaggcgaatgccttccggccaaagggttcgatccaggcgaggatctgtaccagccggcccgtttccaaggcgacgtggtggtggacccgaaaagcgaccgtctccaactgttggagccattcgacgcttgggatggcaaagacctcacggacatggttatcctcatcaaggtaatgggacaaggggtttaatcaatttcctctgataatgagtttggacaagccaatttaattataaatggtttaggtcaaaggaaaatgcaccactgaccacatcagtgcagccgggccctggcttaaataccgtggacacttggacaacatctccaacaaccttttcctgactgccaaaaacgcggagaacgacgaattaaacaaggcatgacgaaacaataatatataaaatatattttattgtttccttaggtgcgcaatcagtagagcggcgagtggggccaggttagcgagaccgcccgc

SEQ ID NO: 9262 - DNA, 3159 bp, Heterodera glycines
  misc_feature (1473)..(1473): n is a, c, g, or t
agggaaagaaaaaaatacgacgacgtgcaaaagcgtgaagtcatttcagccaccaacggacagacgagcatggaaaggaaatagtgcatggctctttggaaaagaaaagagtgggcctggggagagagtgtccttgtccttccacacatattttttacatctctcgcccattttccacctcatctctcctttcttctttcaattgcctgtcaattggactggctgcggctctttaaacttacctggctggggagttcctgcgatcacaaaggcatggctcctgtggcgaggcttcaccattgcactgggggctgacccgcagggcggtcccgaactgggataggcccacagctaaatttttgagtgtgggggacggcgttcgcgcctcccctttaaaagatttgcttttattttggatttggactgttcaaaattaccttcttcttggtcttaattctctaagctttcgattgaaaccagcaatgtttggattgactaagtagtaataaaaaagttgtatgacctaaaaaaatgagaatggtcactgattggacgcgttaaactggaataggaccaaacttaattttggttatatttaatttaaacggaattctgtgcgtagcaagtgtgcaggaattttaggcatttgcctaaaattaaagccctaattatcacatattatttttgagtccgacattttcctgataatttttttatcaatttttatttgttcaatataaatcaatacaataataatacataaacaaaaaacaaaaatggcaacgtctcatgaaataaaaataataataatcattaaaacaaaaatggaatgatttttacaacaaaaaatagtgaaaaaaagatcgaaaaacaccaaaaacattagcggcagagtgaaagcgaatggcaattggcaaaaagtgctgaggctggccgatcagtagtgatcagagagattttgtaaaaaaaaataaaaataattttttgtatacacatgtccaagcagggcgaggtctgtaatttcatttattaaaaaaaactttttttatttttatttccatctatggataataaaatatttgtttgatagaatttacaaaaaattgtatacttttgattgatttattgattaaattttttaaaattatttttgtttattttgataaaaatgaatataaatttctcttccatccttgggtctgatcccttctgcttggacatgtttagccaagaaaagaaatttatgccaaaatcggactttggccacctccttttccatctgatgactctgctcactgtgccatttgatcagctgttcctcgtgtctgccacatctgatcattgattgatcattttattattatttctgatcactctaattggccattttaatttgcacttattattacagggctcccatcgtccatcctccgtttccaaggacgggtatgccgattttcaaggacatagtgnggaaaattcatgaaattcaaggacatttaaaatttttattatatgcaatgaaaatggttaatatttattcaaatggcttgtatttttcaccggaatggattttttccaatatttttttgttttcatttatcattttcctcatttccgcgcacgtgagatcaaagttcacctgcaccagtagcaacgctttgactgattcaacttccaatagatttctttctttggtccattgactgcttgccagtgaaaaaactcgttccacgaatgcgttggatgtcggaatctttaaaacaaaattaattttaaaatttgaaaattgagcacctcatattggtcacaaatttcatgaaattcggtgtgtctttgcgttgatcctttgaaatatgaagttaatttgtaaacgacggactcaatgtcaaattgcaattgttcggcacccttttttgctgcattatgcaaaatatgggctgaaatttttaaataagaagaacaaacaatttaaaagtaaccggaacagccaatcggaatgatattttgcctctttgttttgagttttgcaaaaacattgttccccgtcctaccctcctgtaattgttgtggcacaccaaaatttgtcggcgcattgtcagcacaaaaactgatcaaattcttaaagtccagctgatgtttttccatggacgaacaaatccaatcaaatagttgatcagcagtctctccaggcaatgaagtcatgtccaacattcgggtcctgagtcccaatttgccattgaaaaatcggatcacaatcggaacgagttttttttcgccatgattacttgcgtcaatgcaaagtgaaaatggttgttggcccaactcatttttcagaagttccattgaaaacgggctcagaactcctttgttgaaaattcaatgaaatttttgatttttcaaaacctttaataattgctgcagttttcatctgtgccgacccatatcgtttcgcaatctcagaatcagagaaaacttctttatacaacgttgatgaacaatcagttgacgcaaacgattgatgatgattacacacatggtaagcaaaagtgcctaaaaacaaatttttacacttaaaaaagattaaaaatgaccctcagccgttgcaacttgaaggtcaattgaattaagtgtcgatttggatcgaacaaaattctcaattgttgtgcttttacgccgttcctctttaatttgcttatgttctttgttttccgtgtgcgactttatggccgaaactcccatcgactcgacattgatgtctttttggcaaaaagcacaataaaaaaatccattcccttttcggcttcttttgacaaaagtatattgcttttcccaatcgggattgaaagaacatttgcgcttatttgggaacattctaaaatataaattatgtcgcaaacgcgaaaaattgcgtaacaaattcattcacaagcatgagaaaatttgaaaatttgcattttatttacataatgccataaaataatcaaaatatcgttgaaaattacaaagatttctcaaatttctttgaatttttttaaaacttttctaaatgttcattttcaaggacgtccttggcatccaaggacattttttattttcaagaaagagggcccaatttcaaggacgtccttgccattcaaggacgaatggcaaccctgc

SEQ ID NO: 9263 - DNA, 2213 bp, Heterodera glycines
  misc_feature (64)..(64): n is a, c, g, or t
ttttcaagggctatctctcagaacgggtccggttttctctccaaggcttggagcccgtcatggntcggggacatctccttgaggaccctcagcctcgtcccgaccctgtcgatggccaacctaagctaagcttgccggtaccagcggcttttttgtacagctcgatgagctctacaaaacggtatcaatggcgtcaggctatgtctactacaaatggataaaattggcgagaagtgatgtcaaaaattaaataatttgaaaatgacttgcgtcccgccgtacattagtattaaccggactgcaccgtgttttgtgacttgaataattaaatttatttatttaattttatcgatcactgatttttttgtggaacgacctagtaacaccgaggggaacaacttggtgggggggaggagtgacatccattggatatttctttatccaaaataattcatcattttttttatcaattttcatattaatttctgtcggcatttatttatctttttttgccagtatgataaagaaatttttgcagtaaattttttttaaagcgttctgtgcctaagtcattttataagacagttatgtttggcattttctgacaatcattgctgataaaagcaaataaagttttgaaaataaaataaaaatgcaatataaacaaaaattaaaaatacgcgaaatggaaattctttctatagcttttattataagaaataattcgtatttccaatgacatttttggctcagacaatggtattatgcaatataggaaactacgaatttattgacagaaatattaaataccaattatttgcttaagcttcctttcccgaatctattataaaaacaataagttcctcaaattgtaaagcatattttttttggggtccaatttaaatgcggggatagaaatacactggtaagattttgataaaattaactatttttgatttaaaatctgataataaaatattcgaacttcagagaatttttactattaattcaagaaagttttaaaatttgaccaaaaaccgcacaaaaaaacaaagcgattcaaagaagtattttaaatattcaaacatttttctcatctttcttttccaccaatcatttccataaatggcaacaaattgtgccaactttcagaatgggtgtttgatgtgtgccgaaatgtcagagtgatcattagcctcttcttcttgctgctcctgcttaacttgacgaggcagaatgccggcagcgacgagcatttcatagtcgggctggttgaggtcggccaaattcattgcagccatttggcctgatttttgtgggaattttttaattttttattctcctcagataaaagtttgtgtaaaattatgtggcaaatttttcaggaattataagggttgtcagatgtaaattcaaaaagaaaaatcagttggcatgccaaaagcttcatttcttctcacaaagctttttgaagaaaaaaacggtgttgagaagtgcctccggggaaaaacttgaaatttttgtctaatttgttttttagaaatttatttaaatattttaaaaaatcccttcgtctagtgaaatggatatggacggttggcacatttagggccgtccattgacgccgaaaaatgttgaattggtgcccttttagtcgggagcaaaaaccaatgttcactttggtttacattagaaaaatgttatgaaaattatatttgtcaaataaaaagtgcaatactgaagtctggttgaaaatttaagagcctcacttaatgaaattttttgatttgctaaatatttgtattaatttgtttgttcagactaatgaatttggccaaaatttaagctaaaatattaaaatcactaaaaaatcacaactataaaagatgagtaacttacttttgcttaatcattggataccgcccgagcggatcctcaggcccccccccccccccgcccttcaaaattttgaaaaaaaaaataaaataatagaagactcagaattttgaaaattttttataaaaactgatgacaagctaatgtgataaaacaggttaattcttttcctttcagtatccctgcaaagtttggggcgcttctgataagtttcacaaaaaataataaaaaattaattttgcaaaaatcaataaataatgaaccctcctccttaataattttcctgcgcccatggtactcactcggccgcttcgcgg

SEQ ID NO: 9264 - DNA, 1678 bp, Heterodera glycines
tgaaaattagccaatttataggtcaaattttgaaaattttacgggaatttatccctcattcataggggtgtaatattcgcgttccgcgccaaaatgcgaaacgcgaaagtaaagaaaaaagcgaaatttgcaaccttaggtcaaggcttttctgggaaacttttggaaattttgacagatttttaagaaatttgcaatattatgcactcataaaaaactgccttaacatttataattttagcaataaataaaaagttttaaggaatgagaaaggatattttcattggcattttatgcaatttatggagtgccaaagtcttatgattctcaaaattcatgacattttgagtgattccatccaaccaaagtggcaataacattaacaggaaatgaataaaactgtaaaaaacaaaatatgaaaatgagggtaatttgtagggatgtcaaaattatctacaaaaaaatggtcgaaatatgtacataaatatgtaaaaaaaatctcgaaatatgtaagaaaaacacaaaatatgtaccaaatatgtaaataaaatttttaaattgttattttttgaaaaaaaattcttcgtagaggtaagatagccacaaaatgtaacctaattaagtcttattatcaatcatcttttagtatttaaaaattaatttttcgtatttataggggtacattttcaaaaaaaaatgttattctttcacaagaaatttctataaattttcaaaaattctaaaatattaaaaaaaaatgaaaatatgtacgaaaaatttgccaaaatttttatttttttttgaggatttccaaaaatttgcataaaaaatcctcaaaatatgtaaaaaaaatgaaaatatgtcagaaaaaagtccaaaatatgtaccaaatatgtataaatcatgaaatatgtaaaatatgtataaaaccccgaaatatgcaaaaatatgtaaataaaagtcccgatttttttcgcaaacataggaaagaaagtgtttttcctaatatttagaccatgaagaagccaggaaaaaaatatgtctttacataaaattggcatccctagtaatttggggttgactttttccagggaatgggcaatgaaaaaaaaagaaagacaacacaggcttaacctcaatttatttaaacgtttgtctattatcccaatttctgtcattaattttcattcagacccacaccccctccattcttacaagtgtatatttttttattgccgtttttgaaaaaaaaagaaattacgggactgggaactcaataatcgggatggatttcccggatgagaatgcccgcttttttcccctcccaagcttttgcaatttttgaggatttttaaaggaaattttttattaaatgccccgaaaaaatccaaaattttacaattttgtacatcttttcattttttacatatatataaagtgagaaattgaaagtgtatataaatttcttgtgaagatttttaattattttttttttgaaagtatacctctaaaagatcgatttttcaaaaaaagagataaaaataataatttttaaatactacaaaatgattctatgcctatttagatgttccttttatggaattttgtgcctatttcaccctttacaattaattttttccaaaaaaataaccatttaaaaattttatttacatatttt

SEQ ID NO: 9265 - DNA, 1977 bp, Heterodera glycines
ggtacttttctgttttggggcctgtaattgaatttttttttaaatcaactacctaagcgtttaaaaactacgcgccaatttcgagaggcataaatgccacaatttgcaccattatttcctcaaatactcctttcgttaattaagttctgcagtgagaacaaatatttgtgcaattttgcgcaccattgtgatcaaacaaacaaacaaaaaaaaattcaaatccaggccccaaaaccgaaaagcaccgcatacagttatcaatatcaataatttattcgcaaaatactcagattcatatcacataacaaaaagcaggattattgttccaaaaataaataatttgactaccataatattgggttggcacaaaaaatgaataaatttttaaaaatcaaaaatatgcattgaactttgaacttttgccaaaaatattgtttctttcttcgatcacatccatccattgttattactcatcaaatcaatctctcgccataaatcacacgggcggcggcacgcgtgccgaagcgacggcggaagccgatgccaccaactttgttgtctttttgagcaaattgtaggtgcggtaaatgatggagtagaaccaggcgttcaaagcgacgtcaatgcccacggtggcggcaaagaaaagcatgagggaacgaaaattcatttctgaaataattagtgtacaattagcagcgcgacaaattaaaatgtaattaattttgaaagccatggggatgtctgatttgtgatcagctagctatcccaaaaactctccgagaactgtttttaccactagaaatctttaaaatgcgcccaaaatacactaaaataaaaaatattaaaaaatcctgattttcatgcttctttaatctggtcaggaacaatttttcaaaatcaaaatttaaaaaaaaacactttctgcagcataccaataaaattaattattctttttttcataagtaaactctattcaccctgttccttagtagagaaggcttgctgtggagaccaaattccaaagataaacatagtcaatgagatcaccgctgcgcataacaagccgatgcccttaaaaaacaaatcgattgaacttggcggcatattatgattgctagaatccggattttttggccgggcttacttagacaactgatcgggccaaggcagcccggaaaaaagccatttaacatggcggtccgggccccaggtatttttttgaaaaattaccggcccgggctcaggttgaccggtaaatgcctatcgggcgcccgagcccgttcggtatccaattaagagctgatttatggtgatccccatttttaaaatttatttaaaaataaactttcatttgtctaaagattgttttatgtaaatcgaaatttagtgcgtttcaaaatttttttcgaaatgtgtgtttttatataaatcacctcgaaaatcagataaggcaggaacagtgacggctccttctttttcatggcaataataaccgacagatagaaaagagacgaagccaggtacacctgtggacaaatttcaaaaaattttttgaatttttattcctcaatcaattaattaatttaccattccggcatagatgttgtgaaagccaacatagctggaaattgcagaaagaattccgagcccaaatccgaacaatgccatcacagtggttccctcaaattaaaaaaaattaattaattaaattaaaataaacagtttttaccgtttcaattctggtgcggaacggtccccaacaacatgtgtgacgattggcgtaatccattcaaaacgaatattttattttgttttttgtaaagaaattaaaatatttacacaatttatgggtttaagaaaattttacttaatgtgaaaaaaaaattccttgaatagtgaatgtaaaaaagcacttgacatgcccatatacaggtgggaaatgacggaaattatgaaaaaagtctttgttgtctt

SEQ ID NO: 9266 - DNA, 3164 bp, Heterodera glycines
  misc_feature (16)..(17): n is a, c, g, or t
ggggggggcaacgaanncggcggttttgttagtcatccaaacattttctgtacgggcagcgcatcgtttgtcgtgttgaaatgtatggggggaattgaggtgatgatgatgatgatgaggaaggatgatgatgattatgaggaagatgggcaaaatggaaacgaaaacggatggatgactcatcaaaatgaggaattggacaaaattgcaatttctacatgggcttttgaggcagaaacaaagtaccgtcttttgatgaggaggcaggcgcctctgttttgccttgcccttgttttcgtggaaaagaaaagagatggatgactcataaatcagcaaaatgatgaatttggatgtaattgcagtttttacatggacttttaaacctaggggtatcgactttttatagtgcctgttttgctagccttgttttacgtggtaatgaaaatggaacgatttggataaaattggaatttatacatgggcttttacataaacttagaagtatcgacttttgatggggcctcccttttgccacccacccttggtcttcggccgaaggcatttgtagtattgaaaaggatatggaattgtaatgataatgatgtgatgaaatgatatcgaaaaaacatggattactcaaaataattgatgttcggcttccgatagggcctgtttgctagccttgttttttcgtggtaacaaaaacggaacgaatttggataatattggaatttctacatagactttttacacctaggggtatcggcttttgagaaaaatgatgaatttggaagatatgtattacgaatttttaaataaagatttgtttatttgttatcgttgttgaaaggagttttgaaacgagggagagatcccggctttcgtgtgtatgtcttgttttactagctaaaagatatttattttttttatttcatccaattcattcatgcaaaagtgccatcagttgaagtataaaaggaccttgttgtttttaaaatattaaagtgaaattgtaaaaattgcgcaatgaaaaaccgatgatgaaagaaaatttctaagtgaaaaaattttagtgctttcttacagataaattaatgcttcccgattattaatagcttttaaacttaatgatttagccaattacattttctttcatttttcagccatttttactttttaattgcctttttttgatattatacgtcacttaataaacaaactttttttttataagtaaaaattgttatttaaaaaaaattaattaaatatttctctcctccactcatatgtaaattagaatttcacgctccgattgtcttttaatcaacatttgtttaacattgccaactgtgcttcctaaatatgtaatttttatccattcattcagaaaactcattagcaccattttggtttagctttaaagctctgaaaattattattttttcaatttcataattttattcacaattatttaatttaacttgttttaatattaattaagaatggagggcaaaaaaagttatggaggcgtaaatggagcatttatggcaataaaaatacattttattttaaaattacaaattttgaaatttttaggctctgcgaaaaagaattccaacttttccatttgaaaagcgtctctccaaaattgacacattgaatttggcggtaatttttaaggcattgggataatcggcaaaaattaattaggacaataattatttttcgtgaattaattataagtatatttggaacattttaattttttgttccattaaagtttcttgttgttcattgaattatcaaaaaagcgtggaaaatataattttttaacaatcctttgcaaatatttttcatttggagaggaaacccaaaaattaaaaataattaatatatattttttattaaacaaataaaataaaattggcccactaaaattgccgattttccaacgccaatttctaaatattatattaatatatttttaaatattcaatttaagtgtgcttacatcaatcttctcgatgtttgtaatgcttgtaaactattaaatttttctcaaatttttatgtcattaaggaaattttggccactgaagagcatccagctgtttttctggaatactcaattagtttggcaaaatatggcgggaactcagcacaaactatttggggcacaagcggtaattattatgaaaaaattgaataaaaaactcattagtgggtgaagcgttaatttaataattaccagtgattagcgggtgaagcgctaattaataaacaatctttgtttgctcattaatctccttcctcttattgctctgtttctctcccatcctcccactttctatattttttcatgctctatctctccttctatatagctctttaatgctctctccacttttgtttctctctcccatgtttctctctcccatgtctctctctcccactctctctctctctctctttgtttctcactcactcactcactcactcactcactcacgcactctctcgccctcgttctctctctctctctctataatattctctctcctctctctctgtataataatgtgttgcaaattgttttaaccccattctgctgctctctcaaattttcttacccagccttagcgctaatgttattttttaattcatgaattcaaataattaaataaaaaacaattaacaaacaatactccagatctgctttctcgattggactggatcaattggaaaggaatgggaatggacccgcccagaacatcatctcaattttaaatttggcttcataattttgattattcataatattgaaaacaaataacaaatttaacatttcatccttttttatcaagcattcattggctatatgtagtataatttgccaaataattcatagacaaatcccgaatcactttttttcgatgatcaatcggtcacctcaaaattggtgtctctacttctcatagcagtaatgtttgggcagcagtgtgaacgtgcagaaggggtttcgtcggaaaatttttgtcggatttccatttctcagatagtaatgaaacatgaaatccggctgtttctttagtgcctgaaaattaaaaaaaaattcatttattgccgagaaaacaactggcattctataaaaaaataaaataaatc

SEQ ID NO: 9267 - DNA, 1696 bp, Heterodera glycines
ttttcagtttatggccaaagaaattttgaataaaaaataaaagggccttaactgtgtgaagtatgtatttttaatggcaaaaattttgaattacggcatttttcattgcagaaaattgtataccttcacggtttgctgcttgctcatatggtgccagtgaatttgctccttcaaaatctgcaaaataaaatttgaaaattaaattttccatttttttttgcctgatttcgttgttttgcattcagtgttgacacgacagctcctaagcttattttgctatcagaattttgcagaaagctcagcagaaaacaaaatgcaatttgtaaaattggagtatgcatttgataaaaataattaattaattagtaggggacaaaaccctggaaaaaaatgcattaaaccatgtgcaaaaaattacaaaatttgttccgtaaaatttatgtacaaaattgttaaaattatctggatgacaaaaatttatcttcttatgaaaaatttatttttgtatattttcggtatgaaattatggttactgtatttcttaattaatttaatgaaaataaataagattaacattttatgaagatttgtttaaccctaatactaaattatttatttctcagttaaatttaaataagaatgtaaaattgagttgaattgaaaatttttatatttcagttaaatgtaaaaatgtacgaatgatgtgagaataaataaaagttccttaaaatgttatcgactttaaagctgagcttaatctgcatttgccgaagcccttgaaaaaataaatccccacaaaaatatttaatatgttgtgccatactcaaaaaataagataatccatgccaaaacataaattagaatccgaataaattttcactagaggcaaaacttttgcatatgaccaaaatggataagaggataacatcatttttctcaaaaaagcacaattaagtgaattttttatgtcattaaaattgaaaatatttaaaaatgttgacgaataaaactaaatttaacttggcaaaaatgaaaaatatgaagtatatcaaaaaaaaatttaattaaaaattatattattgaaaatgttaaatacggatcatttgaaggaaatctggaattcttaaattgggtctgatattccgtttgtgtcattttaaacgatgtgatgcataaaatttggctcacaatttgatgcttttgaccagttttgttttttctgttcaaaaaaaacaaacacaccactaaagaccataattgatttctaaataaaattattttaaaaatttttctaaaaatctatctgggacacacacgaaagtttgtggccaaaaatctcaaaaagtgaccttttctggccattttggcgccgcatatcatacatcttttttggaacggaatatgctaatagagaacacttaaacatattgaattatatcaaaatgtaaaaaattatgacccttttaaactggcggcgccaaaatgtcccgcgccaaagtgaccccccacccctgctgaagcgggtcagttctgtctgagccaagtttagagcatcataccttttttctttgatgaccaaatccaataaacttggtatcattcgaaagctcttaacaagttctttcggctttccgaaaatcaaaatgatataccgacatgcaaaaaagttataaataaaaatatgcaaaaattctga

SEQ ID NO: 9268 - DNA, 2779 bp, Heterodera glycines
atcatcaatcatgtcagagcacataagagcgaaatcgatcgaattcaactgatcaagatcagtgagaattgtcggtgaagtgcggcgacacaaattgtccaaagcatcgccactggtaaagcccaactggcgaaggtttgtcgcaaaaattggcaaaattgtatagtttttgatttactgaatctgaaggaaacaaaaacggattttgttgggcagtggttggtcggggaacggaaattccacaaaagtgccgtcgatccgcacagataatttcggctttggtccttcgtccttgtcaattctgataattctccaaattgccaattcgccctttccatcaaaatgtttgtccactaaaatgtcgaaacggtcggaaagcaatgccattttgagtcagagttgagcatggtcaaaagatgggagaatgtccatcacacgtcgcgcactttttgcgacaagcattcgccatttgagctttcacgatggcgatgctttggacaacttgcgcagtcgcacttcgccgacaattctcactgatcttgatcaattgaattcaatcgattctggacttctattacccgatggaattgctgacgatgggccaaatgcaactgctggccaagctttgaccaaatggttacacactccgagcaaaaatgggcaaccgaagcaattacgtttccgtgcttatgtgagtccaccaaatttcgaatgcgtcaacaacttcaaagaggtgtcctgccatattttcgtcaatttgtttttattttaccaattttctttagacattcgccgtgccaccacttctgtcagttaccatattcaattttatttttgggtggacacaatgccaactgagccatttgaattggtgaacaaagtgacgaaagaaaagctgacactgaaacagaatatcgatgaattcgacttaaatgtgtgtaattggttgttgcaacggtgcccaattggggagacggcgacggcgccagttaagtgggaaaaccgcgaaaattcgggtgccaattttaactatatcagatttgagctgtggtatgacaataattcggatgccaatttgaacaaaatcatatttgatttgtggggtgaaaatgatggcaatcattaagaattggtgtcccgacgaaaaaaaatgttaaaaatttgtcgggtattttttctaggcttaaaaaatgcgctgatcacgaatctgagctcagattttgaaaatcattgatttttatctaagattttttgtcaactacttgattttttcgatttttaaagttattttttaaaaaaagtttagcaatgaatttgggttaaaaaaatactctgatcacgaatctaagctctgactatgcatgaaccttcattttgtctgattttcatcaagtgtcataaaaaaaaataaaccgcagccaaacggactcgaaccccaggcccccgtctcatacgacccctagggattaataattaatttcaaaaaatcgtaaaaaattcaaaacttgacttctccatacatttaatagatcatttgaaagctctttttagtatcagttttatgtccgactaattttcttaattttggaaaaaatcaagtaattgacaaaaaatcttagataaaatcaatgattttcaaaatctgagctcagattcgtgatcagcacatttttttagcctagaaaaaatacccgacaaatttttaatagtttttttggtcgggacaccaattcttaatgattgccgaattgattgcgagttggtttcaatgaatgaatgcataaattactgacagaattgaggctccgacgaaatgcacaaataagttcagctaactcaacaaacggaccagtcgcacttaacatccccttttacagatttaacacaaaatataaaataggcaaaaaattcattccctttgccgggagggtaacaaaattatggaatcaacttgataaagaactaataaaaacaaattctttaaatcaatttaaaacaaaacttaaaaattcattagggtaataaccggaaaagcaaaaacagaattaattttttaagtgatttgacatttgtgttatcgatctcgattgactttgacctcattttattcatatattttgattttattttttgatcatccatatatattatatcacttactctacgacattctatctgaacagtcgtcagagtaagtggctttttgcccttctgatgactttttattcacgaataaatgaataaataaccagtgcatgtttaattctacgtttaaggcaaccgtaagaattgactaaataataagaatgccaggtttccatataaagacttgttaattttcaagagcatagaaatttttgagcacaagggttgttaaatttagtatattttaaggatttatataccatgtgatgtatgtatattgtgttattgttctgaaatccctccctctggtgcccgaacttcccggtgcccaaatttttggtgcccaaacttgctggtgcccaaacttcgcggtgcccaagggtcatgggccaataaaagtcgatattaaaggctttttatatgttagtgattgcaggttatttgaaaaagaattcaatataaggaatgtagagaataatagaaatagggtggaaggaagcggttgggggtttcccgatgtctggttatttgatccgaatgggataaaacatatggcattttgttctgcgaagttgtgatatattttatattaattatattagtttgggatcacccagaagctgtaaattaatag

SEQ ID NO: 9269 - DNA, 1455 bp, Heterodera glycines
ataaacaaataacaagtcaacacaccacacaccatccccaaaacgagagatgaaccaataaatagagaatatagagaaaaatacgtctctcatttcgcgtactatttctttagtctgctaatcacagcgagtcaattgcaatcgatatggagtgatgggcaatcattaagaattggtgtcccgacgaaaaaaaatgttaaaaatttgtcgggtattttttctaggcttaaaaaatgcgctgatcacgaatctgagctcagattttgaaaatcattgattttatctaagattttttgtcaactacttgatttttttcgatttttagttattttttaaaaaaagtttagcaatgaatttgggttaaaaaaatactctgatcacgaatctaagctctgactatgcatgaaccttcattttgtctgatttcatcaagtgtcataaaaaaataaaccgcagccaaacggactcgaaccccaggcccccgtctcatacgacccctagggattaataattaatttcaaaaaatcgtaaaaaattcaaaacttgacttctccatacatttaatagatcatttgaaagctctttttagtatcagttttatgtccgactaattttcttaattttggaaaaaatcaagtaattgacaaaaaacttagataaaatcaatgattttcaaaatctgagctcagattcgtgatcagcacatttttttagcctagaaaaaatacccgacaaatttttaatagtttttttggtcgggacaccaattcttaatgattgccaaaatgatcccattgggtgagaagcaacagcaatttttgattgccaaattaattaattttaggccattgtcgccaccagcggaagaagaaaacgtagaagaagaagcggatcaaagcaacggaaatgtcgtctgattaagtgtacggaaatgaataattaattatatttgagaaatgatctatctcaatttgtttgtgcatattttctctctgaaatgcctttgttgattctttcgtgccaattaggtatataaaacataggtagattttttccttgcgtatcaattgaatggctcctggaaaatgcgtcagtgatagaaagtatcaatattcctgctgctgggattttcaagatcgctctcactggcatctatttcggcaaaacccggaccacggaccaaaattcgaataaaaaaccgacagctcaaatccttgaatttcgtatttttgtttgtcaaaagctgcttaaatacacggaaacaaattgaaagcattaattgctgcatttacctaagcctttttatacgaaaaagactaaattcccaagtttggattttcgacttttgtttcatcaaatagagagcaatttgggttgattgttttttgacagattcggatttagaatacgatttgtgggctctgttgcagttcacacgaccataaaaaagacacg

SEQ ID NO: 9270 - DNA, 1164 bp, Heterodera glycines
  misc_feature (1145)..(1145): n is a, c, g, or t
tcagtgcaggactaagatttacgccaaaaattaatttaaaaaaaaatttccgaggccacctgccaaggccatccgtcagggtcgccaagctcactgaatgtgcccggacaatcattgccaaacaggcacaaatccttctgttgcccggtgtaattgtagaacaggttgagcatggcatgtgccgccatcgccagaccgtgctgtgaacccagccttgtcgagtaggctttgcacgcctcctagggggggtagaaaatgaaattttttttcaaattttcggggtttttcctcatttaccttaactggccatcctggtaacggtgctaagaaggtggccgggtacgggtagtcgaccatggccaatgtctgaaagtggcgattgatcagtttaaggacgagagttttgaaagtgattcgctccgagatcactgaccatcgatcacattttcatgaacttttggggactgatcagaaagtgagagacaaagatttaatattgaaaatagattctaggcccaattattttatagaacgtttttgggaaattgatcacgaaaatccagttgatctcttcagcattcggagtctgatcggagcaatgatcagtgattaataattaaattaattaattaaaacaattatttactaatttttaattaatgaacccacctccatcacatccttaacagaattggccaacaaatcaccgtccgacgggcgttccaccaacgcttttggcgacaaacggaatttatcattcaaaaagcgacgtccattttctgatagtgtaaaagattaggttccgttaactgagtctatatcaaaaaatgaaaaaaaaaattaaaaattaaaattttcaaattattttagcaccatttttgaaggaaaaattagcccttttctcaatatttaatatttaaactcagtaaattttgttgtttttctgaccaattttataagaatttcgtggagggaataaaatttgaaaaaatatttaaaaaatcgaaattttcaataattaaaaaaaattattctccaagccgcaatttgcatgaataaaatagttttttgttattgttttaacttacgatacccggggcaattttttagggcatccgggcctttaagaattaaataaattcggngattacagggattttcttt

SEQ ID NO: 9271 - DNA, 2790 bp, Heterodera glycines
aaacacatttataggcatctgaaaatgtatgtaaaaagtaccctgtaaactgtataagtactatgattcataaaaattccaaaaaaaattcatggcgctgccgacgcgcccaaaaaaacaaaaaaacggagttttcttttaaatttttttttttaatttcaaatttccatcaactcattctctgtttcagcatgtgctgccgttgtgcgacctggaccatttgacggttggcgttgacgcccaggtgctctgtttccactccaagcggcgcatgaaattccgctgttcgcccaaccaattggccaccgttgccggcaccaaccagcaacaacatgagcaacgactgttggcggtggagacgggcagccgccggttgggcaaaaccattgcgcactgtgtacgccgtgcggttgtgctgcagcacagcgtgtggctggaacgagagcagcgccgccggcgacaacaacgacagcaccagctacaccggcgtggctctgtcgccctcgcgaacggcggcgtggaggaggaagctgaggtggcggagggtaagtctgtttggtaccaaaaaattggcacttttatggaaatttgcaaaaaaaatttttgagaaatttgagtgaagaaggtggtggaggagtagataaaggcaaatcaacatttttctcttagcgaaaattgttttaataaatatcaacattgacgttgatatttatttaatatcaacataacattatgccatcaacgtaatatcaacgctatttttaaaattgggataattttttaaaatttaaagcaatttttcaaaaatgacttttggcggaaaataagatggggagagagataacgcaaaagtgagagggtgttatattcagccccagtcatacaaaagcatttttggtaaagaagaataaagaaaaattaattaaaaagagagtgttatgggaagagatttaagacagagagagaatagagaacatagcgaggaatctgcgtctcttaccaaaagaatcagcgaagaagagacatgaactcccttcccattgcgctctctattgaaattgttttctctacctccttcatcaaaaatgttttgtatgactgggactgagatccagcactctctcatttttgcgttatctctcgcactaaaattataaaccgctcatataaattttaaaaaatgatttgccattctctacctagcagcacctttactacaatgtttattacaataatgtgcccacctgtcttggcaaggtctcggatcgcgtccatgctctgtttgatgctctccacattgcacccgctgttcacaaatgttcgggtcacaattttgtcatacgcatcctccggcggagttggcacattgaggaaccaaaacaccggcgcgctggccgcaatgccactgaaaatgatcaaaatttgaaaaaaaaaattggtatcattagaagaattataattagagagatatgataagagatcaatgagtaggaatcacgaccaaatcccgatcccaaaaggcaattaattgagtgatattttatagactctcgactcaacaattgaaaagcttttaatattaaaataatttttgcaccagttattaactgaaacaaaatttttttttcaaaaagtctaggacaaaaaccttgggctcaactaacagtagttatggaccggtaccataactactactgacggtcttaaagtttggcattttttttatttcttgaattcaaaaaatcatacccgtccatgaggtgcgggtatttgatgcgcatccatgccgtcaacattccaccgtaagacccgccaaatccaatgaccggcgaatgtttggcattcggtaatttctgcaatatttatagacaggataatggtcaaaatgcaaatgatttgatttgtttgattgaagaatcagggaaacagtccaattatgagatcattcttctattttcccgcccttatattccaatattactttttgtgatcggatacaaatcgaaaactaaacggaagccgatcaagcgcattaattataatcccagctgcacagcgggctgatcaagcggggtgatcagagtcagacattcaaatgccaagcagatcaagtgcaatggtcaaggccctaactcaaaaacccaaagggaactgatcaaagcgcagtgatcccggatccaaaatccaacgggagctgatcaatcgcagtgatcaaagtcccaaaggattgtcgcccacctcatttttcaagtagtcgatcagttgagcaaagtcggccaatgcttgttcagagctcaggtagcccaaattttccaattttgtgtagctctcattgccgaacggttgcgttttgccgtaaaagcgatgctccgcaaaaacaatggcggcgccaaactctggcgcaatgtcccacatgaagcccttaatgaatgtgatcactgatcagattgttcaatcaagacaacatttttcggcaaaaaacccctcaaaaatgccaaaaattaaagccaaaataataaaatctccaaatcaaggagagacttcattattacaatagatcactacagatcagagcaggataattgtttttggccaaacaataccgtatcctcgccaataattcttaccgtattctcggcaaagccctcaatgctgccttcgttgccggtgtaaaagaaaatgggcgcatttttatcacgaaaactgtccgtgttcaaaagatatctaaaaatgaatatttaaaatattaaagtcatcttatgatccgagaaatacataatttttttcaat

SEQ ID NO: 9272 - DNA, 2291 bp, Heterodera glycines
taaaaatgaatatttaaaatattatttttcatcttatgatcctgaaatacataatttttttcaattatttcaatttaaaactaattaggcctcgagattttctgcgtattacgctacgaattttttaaaaattttttgtattcagaggcctgaccgctttacatatttttcatagattaaggtataatttttgggggtttccattattttgagcccgtcaaggcctcattgccaaattttcgtttttttcaaccccctaacccaataaatttaggtttttgcaggtttttcgaacctcagccgaaagctgcgcgggtcgctgaacgaaaagtgatcgatgggcatgttgtcgtaccacagctcttgccatttgtatctgggcgcttctttcagcgcaaaatggcgcgaaaatttagtcaaagtgatcggatcacggcgaatccatggcttttcgatcgccaaaattggggacacaatcagcaaaaacagcaataaatttagcataatttctgcaaaaaatttaatgtagtttagtccccggttctacggggacgaaaagtcggggggatttcggggtcgaggactaactctattaatggaaattattatttaataaaaataataatttatttttgtttttggcagcaaaaaacgggagaagaaggaggtgacaatttatacatgtataagatgatgatgacaaatcgtttctaatttccttaaaaaagtgtgaataacaacaaatggaaaatgaattaaaagaaatgtctatgaaacattccaaaatataataataataataataataattattattattattattaataaaagtatttttataatattttagagtaaatttttgagtaattgctagaaaaataattaaattatttttatataaacatatgtaattattctaataaaaaataattgataaaataatctttttatgaacaaattaattaaattaaattttttataaaatattttagcattaaattatttttattaatattattttcaataaaaaaagcaatttctgatcaaaatggacctacctacaacagagctaatacgaacaatttattctgctgacaaaatttgacccctgccccgaggggaggagaatttttgggagatgagacgggggggcggacaactgttcaccatttccactattcatcagcagcctaatggaggggataaagcaataaatctccaacacatttgacagcagcagcagcagcagcaagagaagtgaaaaagatttataatggagaaaaggcaaaatgccatcggtcaatttttagcaaaaaaaaaatatatatatatatatatatatatatataaataatatttattttaatggatataaaataatcaaaaaatacttggaaaacatttgaagctttcgtcaatcagatcagaaaacaattttcaaatgctacaaagaagggataaagcaattttgacaacagcaagagaaatgaaaaatttataaatggcgaaaatgcaaaatgccaacagaattcgaaccaaaaaaaaatattgaattctcggcctttgattcaaatttggttaggatacaaaaggcataagcttttagcattttcaaaatcccccaatttaaaacagatgccaaaattttttacaaatttgaatccaataaaaattgccccgaagcgcaccaaattttaaaggaacaatatttaggccaactgaatgatataaaaatggaaaatttttctatttctaattaatcatcggcgatcagatttgatcattcagttagcttaacgcgttgatccggatttgttcggatgtgatctatcactatagaagatttagtgaaaaaatcggacaaaaaaaaaattgaaagtatgcataaataaataagatattttaaaagaattaatttttaaataaaatgaatttcaattaaaatttgtattttatataaaattaagttaatttatttgttaaatttatggctctttctgctgataaggaaatgtctatggtttaatcagtccgtaatttatcatcatttttctaatccatttaatagttactctaaaaataaatcaatgtcattaatattttatattattatttatttataattaaatacattataatttggctgaattttataagtttagctactatagcctgtacatattttaatgaattttatcaaaagaaatttgctataacaaattttcaaaaataaaaccttaaaagattttaattgaaaatttcaataatataaataacacgaaaacaaa

SEQ ID NO: 9273 - DNA, 2558 bp, Heterodera glycines
tatcatttgcgttttaatttggcttctcgggtattatttttatttaggtttaaaagaattcttctcagaagtcattaaataaaactaaaaaatatttcattcttctaatcattattattatcaaaaaatacaaatcaaaataattgaaagttcagataaagcaatagatttttcaaaataaagatgccttttcaattgacagttttacgaaacgactcaatatgaaaataaaatgcaaaaaatttcttatatttatttatttattttgaaattcaatggacaaaaagaattgacgtatatggtgcaattaactgatattggattgcataatgaatatgtaatttcttcgcgaacttgttgggaaaaatattattttgaaaacattaaacaaattatttgtcacgatttcttcatactttttcttaatcgtgccttcaatttgggctttttttcggcatatttacgctccaatgacgttatgtgttgtttcattgacattgaattagtctaaaatttgcataaattattctataaattaactaatgaaatttttttattttacggcagcccatacaaaaatctctctttgtcacatgggctataaatcatatgcactaaaaatgcgcataaaatatgcattaaaaatccctcaaatatgctcaaaacccgaaaaatgccaaatattcaataaatttaccttcataaaacaaaaaatgttatcgtaaaaatgcgattttgagccctttaacttaaaacgaaaattttcatttttggtttacaaatcaaacaattaaaatatagaaattatgatttgattggggtctgggacgcggaattaattaaaccaaaagcaataagaccggtgatcagagactgggaaacttggacttttatgtgtggcatgcccaccacaaaatttgactccattctctccacgtcggcacagattgtccaaatggcacggcgcatttcctccaccttttcctccatgcttgtcgccgcttggtcactgtcctccgcctcacggaacggcgacaaacactcggagttgcggcgacgcaaaaatgctatagaaacaaaaaatattaaaataattattatattaatcctttttagaatcgaaaaatagaatttttttcggtgcggagttaaagagcaaaatagagagtcaatagtaacggtaaaaaaaaactcaaaaatcgcagaaaaacactaataaaatggaaaatttcagctcctatgaacatgcaaatttacttttctttcttattttaagaattaaataatattcatttaaataagttttataaggatcaataatgaaaatagccaaaaaagcgcgcaaatcgctgaccgcggtcacatcacaccgttagcacttaactgctaatataaaaattacccatactttccgctgagattttggacaattttcgctcatgtcgttgatgcatttgggtggcttaaagcgaaaatttttaaaatatgcaaattttcacttttttttaaatttacctcttctcaacaccatttttcgtgctcgaggataatccgcaaaaacaacactgaccgcgtcacggctcagcgtataaacagtggaaaagccaacggaacggagctgaagagttaattgtgaaaagaacaaattaattgttcaattaatttattgattaaaataaggtaatttaatttcataaataacagtcatgctctcaaatatattttatgtgaattgtcgatgagaagattttacagatttttcgagaaaaactcgttataacgttttttaaacgaaaccaaattaaaaaattttgtatcaaacgatagctctttgagttttagaattataaattctgagactgtatgtataaaaataattttattttttaaatttattttttcttaaattaaatcagaaaaatttataaatggataagaaaaatgtataattcgtggctcatatattatgggaaaaaagaaaattagttattattagttattactgtgtatggatatcgtgcaccgctgaccaaagcccaatcaccgtacacgtaatccacggataattggcaaaaaaatttaatgtaataaataattcatttatttaaaaaaactatttataaatcaaataaattaatttttaaaataaattttataaatatattatgataattttctctttaattataattataatttcgaaataaaatttaaataaatattaaatttcaaaaaatgtaaatgaatttttaacccatatttataagttaattagttgaattattaggtgtaattagaaagagaaaaatgaaaataattgaatattacatgttttcttctttacctttcctgttcaagcaaaagtcgtggactaataaagtgccgttcggccaattcctcgtcgtaatcgtccaacaccaattccaattttccatgtttcacaacaaacatctcccctaaattaaatatatgaaataaatacccaataaaaaaattattcttttcaaaaataccaatggggtttttataattaaaaaattaaaattaaaatgatttaa

SEQ ID NO: 9274 - DNA, 2818 bp, Heterodera glycines
  misc_feature (25)..(26): n is a, c, g, or t
  misc_feature (60)..(60): n is a, c, g, or t
  misc_feature (79)..(79): n is a, c, g, or t
  misc_feature (85)..(85): n is a, c, g, or t
ttattaatttaaatatttagacttnntaatttgaaatgattaacaaatttgtgttaaatntaattttacttttggtttntattcngccatatattcaaataaatgcaattcgatgctacgaatgctcaacggttttttaatttgaaattaaattttaattcattttaaaaatttaaatttcctcaaaattagttaaattccggtgaccaaagctgcaattactactcgggaacaacttgtggctatggctttttcggctgcgtcaaaattggcacttacggtcaaaaaatttaaaataatttccgagtgccccaaaattaaaaaaaggaatttcttcctgaattagttggccaaaatattttctgataaaaacaagtttaaattggcaaaattcgccccaaaagacaaaaatttttaatcgctttaaaatattttaacagaaaattaaaatgctttttaattcaaatatatagactaaaacccaaaaaagagattatttggcgtttttttattcagatggcggcgtcgataaaagtctgtgtcaattattccttattaaaataaaaagataatcatttaataattttcaaaacaattaaaaagtgggaaatttcatcgacgacccggccgcaattgtgtcaatggtccgcggctgtcaacttttgccgttgggtggcgtcgatgcgtgccaacaacaagtcattctcggttttcgggttatcacttgtaagccacaaaacccaaatttgagaaatttacattctttttttagtaaaatttccaaattttttttaactttcacaagtcacagcgatttgtcattaaattaaattatataaattttattgtctatctaatgaaaaaaaccaaaatccgcttttaaaattaatgagaataattttttcgtagaattggatgaaatttgaaaaaatagcaaaaaatttttttttagatttttctagattttaaaactcattcagattttcctattaaaattctttaaaaaatttttgttagaaactccattacaaactgaccattgtacaaactgcaacgactccgcctctttccacctcttttattttgaaattttctttttggttacaggatattacaataataattttcttgtcctacaatttaaatttcatcttccatttttaggttactgttactcggattactgtaatggtgctagcagaagaactgttggtccattgctgttcaccaacattttcattatgttgtctgtttgttcttcttattttgctttgtgtaccgccattttttggaggcaaatttaaacaaatgttataaaaatgaatttttctgttttttttttgattaaaataaattttttaaaagatttaaataatttttattcccttaatctatcaccaattttacctaaactgttttttgtattttaatgattttgaattttcacaacataaatttatttgtacctttgcaacttcgtctttgccacaaacgatgtccccgggcccaaaacggtggcgttggaggcgaagcgaaagttcactcaaaaggccgcgttcgcagaagccaaacaccttttggcagaatcaaataattatcattaagaatcagtttaatatctaatggcattttttataattttttttatttggtcgtatttaaataaaaatataaatcattttctttgcaaatggcatttcttatgagaatatttttaaaattatattttggcgcactggtgatcggctgagtgcgttcagatggaattcggctgccaattcgcgtgccaaccgcggcggcaacgaatttagcaattcctaaaatttaaaatatttgaaattattggtttttatttttgccacattttcgtccactgtttggccccgatcgttgctcatccattggtattccacccatttgatcactctgtcgtgcatttgatggttgacatggctgagttattcaaaagaaaaatggaaaaaaagtattttaattttaaaaattcataaaaaatgaaaatataagaggagaaaatacaatttaattgaaaatttattaattaattcctcatttaaaatagaaatgtaaatttatcatttaattaaatatttataaatattcgtcaaaatgtaaaaatgcttaccgaatgtgcatgtaaagtttgcagccatcaatgtattcttgaaaacgcgctttggcagaatgggcacgactaacctgaagaatttgaaaaaataaatggcgccaaaacaaaaaaatcaaaccataatgccaacatcgccgataatcgcagcaaataccagcagtccgatcaaagtgtccacaatttcgaacatcgattggacggaattttcgggccaaggcttaaaaagcaaaattataaaaataaatattttttataataaagtcttcgttgatctttttgtcaattaatttttatttatttttctaaaattatcaaatttatatgtatttaaaaaatggagcttttattaaaacagattttttatttttagcattaaaatatgcttccatagtctggtagattaagccaataacacttaatttctttaatgattttattatattttcatttacagtttaaaattctgtcacctgttcacccagtgtaaccaatgttaaggcggaccaataaaagctcattgcatattttttggtcaaatttccgaatgccgtgggaccggagctgaaaaatcatattttaataccaaaaattttattatcaatattattttattttaagttcaattaacaaaataaatttattccgtcgaatatttcatttttttaatttttt

SEQ ID NO: 9275 - DNA, 3486 bp, Heterodera glycines
  misc_feature (3325)..(3325): n is a, c, g, or t
  misc_feature (3384)..(3384): n is a, c, g, or t
  misc_feature (3443)..(3443): n is a, c, g, or t
  misc_feature (3446)..(3446): n is a, c, g, or t
gccacagagggaacagaacgagcagaagctgaagcagtacaacagcaacgctccccaacggacgacgacggcgacagcaccgacggaaaggcagacggaagcgccagcagtgggggaggcggtgcagcaacagttggagaggcggagacgccaattggtgcggaacggcggacggcgaagcggcaaaagcggaggcacaccacgggcgatgcccaaatttttgcacgcgctgtgctgctgtctccggccgaaagcatacaaaagtgagcagccgagtgacctaactgattagcgtggccaatttgtatttaccatttctagattataaattgggtcccctttttgttgtgtttttcagaaaatttatgacctccccccactgcaaaagtacccaatttaacaactccaaatctgtaaaaatttaaaaaaaaaatggcgttgccgataaactaattgtaagcagggaggactttgttatcacttctctaaaatggttgtttttttagggtgcacttcattcccccccccccgagaaattaaaaaaaatttgctaacttagaaatttttcaagaaaaaaatcttagaaagtttttcataagaaaattctatgaaaaaaaaattttgtgaaattctcagcgatttttctgaaatttttttgaaaaatcttagtaattcaccctaaaaatttctcgaaaaatttttttcttcgagttttcttatgaaaaaactataagatttttttcttgaaaaatttcttggggagtgggacgagctgctcccgttttttaagcgaagttcattctttggtctcctggtttaaccaatgtttgtttattggcctcactacgataggattggcatggttttgtccacttattcaaatcaaatgccttttttaattgccaatttctcacagataaacactacgacggttcgtcgggagcggactttggcgatggccgtggcgacggcgtcggcgtcagttcgtcgccgtccccaatcactcaagtggtggtcggcggcgggggcggcaagcagttccagaaacaacagcagcagcaacaggcggcggcgagccgaacggcggcctccaattccacgaaaatattggtacgccatttttgttaaatgcacccaaaagtagcagggagacggagcaggtcgtttcccctcccccgatttgttcaaatttcaaacagaaattttttcaacataaaaatcttagaaatttttttttataacaaacttgataaaaatttagaaaaaaattttcagctatcttttaaaattttattatgaattaatgtttttttcaaaatttttccaaaaaacccgttttttttgaaacatcaaaatggccaaaaccagaacgaaaaacaaaacagttcaccagatcatcgcaaatttcgcttccttttcttgtcccttgcctggtgtcaaattacaacaaagtttttttctcggtcggttcacttgcgcattgtgttgttgcaggtggtggaaaataagtgatgaaaatggaaatgggaaagaaatccgtcgctttttctgatcgctgatcagagtgggttttctgatcaacacattgtgagaagtgcgccacttatctttcctccctttctttcccttggccttccgtctaacctttgtggtggtaccctgatcagtcccattaatttggtcatgatttgattgcgtcgtcatttaactgtttttcgtcccttttttcagatgggcggtgaaattcggcaacggttcacttcctcccgccagcagcagcagcagcaagaacagcagcagagaaggcaacagccgcagcaacagcaaagtgccggaaaaggcagcagtctgacggttgtggtcggcggagagtcgcaacaacagcagagacaacaggtggggagtttattttaaaaattttacaaactcacaaattttcaagtttttttaataagagaatttcaagaaaaattaggaaaaatttttcagcgattttttggaaaatttttgaaaaaacaaattgattcatcttaaaatttgaaaaaagcgcttcaaggtcactcgcagtattgttctcttttgacagtcattgagcattatcttttcttcccgaccaaaattacgaaaaacaaattcatttttttcaaaaagaaaattagctataatttaaaaaatcaattaattaatgatagccaatgcgttaaattttagtgttttcctttagccgtcctcccttctcaattcgtcttctccattccttttgccacgggtaaattcatcggacgccaacaaaaattgcctaattgtggaccttgacgagacacttgtgcattcctcgttcaaagtgagcactaatgaattgtatttaaaaacaacgaatttcccttttagccggtcaaaaatgcggatttcatcatcccggttgaggtgagacattttccatcattttatttattcatttatttgtcctttttcaatttcagattgacaatgtcgtccatcaggtggggaaatttcataaacatgatttaatcaacataattatttaagttaattagattcaaactgacaaagaattagacttggccgggttcaaacccaggccttttttgtcaacctgggttttcctcctaaattttaaaaacataaaactcgataattttgaaaaaaagcctggatcaccctagacttggattccatgtttgacctctggacctggatttctagacaaaagcccaggccgaggaaaacccagggctgaatccgtgtccagatcgaactctaatattattattgtcaaaagttcaggaattttccaaaataccgggctctacaaaaaacattcattttcaaattcgcatttccttttttgaaggtttacgtgctgaagaggccccacaccgaccactttttggaacgaattggcgcactgttcgagtgcgttctgttcaccgccagtttggccaaggcaattaaaaacaaataaaattaaaagtttttcacttttgtattattacagtatgccgacccggttgtcgaccttttggacaaaagacgcattttccgctcgcgactgttccgcgagtcgtgcgtcttctacgagggcaactacgtcaaggtgggcaatgatgtgaccaattatagccaattagcttttaattacttatttttcaaaattgttttttactagaaaaagcctctaaaattttttaaaaaacaagctgttttttaatattaggttgggtattttttttaaactttaatattttcaattagtaaaattatgaatttgggattgtcggaatcccccttttaattgtcgttnaactgcttgtcattgtgcccccgtatttccaggaccttttcccggttgggccgcgattntgcgtcgggtgattatcatcgacaattcgccccgccagtacgccttcaccctgacaatncgngtgccgttttttggtgttgctgttggcactttgctttgtc

SEQ ID NO: 9276 - DNA, 3077 bp, Heterodera glycines
  misc_feature (49)..(49): n is a, c, g, or t
tttttgttgttgctgttggcactttgctttgtcattatataacatttcnccctttcagatccgggtccgcacttgggtcgacgaccccaacgacagggaactgctcgaacttttaccgttgctggaggaattggcacgagtggacgacatttacaaggtgaacatggaaaagggaaattcgaaaaaacaaaaatgtcaacaattcattttgggtaatgatggcacgatgctaatacaataaagcttggacaagtgtgaagatcacaacccgctaaaaaatatacacaattttatttgtttgattttacctttagcggcaacatttttttatcgtagcggtttttctttcatatttttattaaatggaaggtgatcaaattttacggtgcaccccaaaacatcggcagaagattttttggaccataactttgttcgttgtcaatcaaattaagcggtttttatgttgttagcgataactctttgtttattatttttctgctaatctcaaaaaaatttcgttaaatttaaagaaagttatggcaaaaggaacaaaaaaaaacccagtttatcaaacttttttttccctgattttttgtacattgacaaaaaattttaatttagtagttaaatagagtttgatgagtgctttcgaacagtaccaagaatgtttaatttggttgagaaataaaaatgttatggtccaaaaattcgtccgacgacattttgtcctggttacgaaaattctaacccttcactctcccccccccaataaaatactggtctgtaattgctcaattagtcgctcattgtcaatattggccacaggccaccggcaccgtgccgccctcgcagcagcctcgctgtctgactccctccgaggacatgctgttgccaccgccgttggcgccatcatcaccaatcacccaggtgttgccgccaccgcaacaacaaaacagcagcaccgccgccaatggcatcagcagcgttcaattgaacggcggcgtcaaagacgctaatggcaacaatttggcaacgacgacaacgacgccgccaatggacaggaggagcgcaaccgaagggggcacaacgacgacgaaacggctaacgatgttcaatcgggtaaacgaaaaaatgtattgcgaaatatccaacttattaaagataaaacagtattttaaatcaaaatttttgatttcccctattaggagtccctcctccgctcacacaaatttccaaaaattcccgctaaatttttacaaaaacaccaaatcagcaatttaaaataggcgatttaaattgaatctgttccttttacaaaatcattgtcttttgtcaggaaaactccgcttcgatgccacggcggtgagaaaacgcacaaccattttggcatgccccgaggcgttcgggttgaccagcgaaaagtgcctgaggcgcgcgtcatttgcttacaacacacacacaagaacaacattcttcaaacatgcgcacatttgtacagaaatatagtcactaccatatacagtaaccgatgacactaccgtaggcaaaacattttattattctccttttctgttcctccaccggtggtccactcattgtcaatgttattaaccctgtcttcttcactgtacttttaccatcggatgtcagccacgccccaaaaatggacaaaatcggaattcgttggatcaaaaatcaaaatttgaatcggctgctggcctccctggtgaagctaatatattagaaattgatttatatgttttattaccacataaacatttacaaatgtattatcctctctctttctctgttccctcctcaaatcccccactctctctcaataaaaattctctgcgcaatttcgtgtaacacttataaaattgatataaacaactttatatacataaataatacataggtgtttaatgcactcacttttgatcacatatttttgtttcttttcccccggccaaatgttcaaaatcattgtcccccaattgtgaatgtgtgcgcgtgtgtttgaagtttctcttttttatcaccatattttttattcctcccgagtcgcgccatcccttttttctcccataatcaccggtgattcgactttcaccccttcgcttccccccccattccgtcattttgtccatgtaaagtgcacaacaccgtcgagacatgaggggccgaccacagatcagatcacttaaaaatgccgtttttgtcgattttgccccgcttttttcgctcgccatgtctctgcttcggctgttgcactaccgttaatccaacgcgattccctccccccttttttgctccctttctctttttcctctctttctttgtcaaatgtacattcagtgcctttgcctccccccctttgacttttcctttttttgtcccttccaattttggcgcaaagtttcactttttagtcttttgtttctcctttttaccggcttattattatataataacaacaaaattattatgacgaataaaaaagtgatgaataaacgcactaattggaaataaaataaaatattttatcgttttataaaaacattaatttgataaaccattaaatgtttgtttgttttttgatggcgtaaatggcaaaaaacaaaactcgagagaacctcgcgaactctaactcggaaaatgcacagtgttataggtatatccctttgttatcttacaaaaaccactgatttgtgagccacacatgcaaatattttttggtacagaagctcacttttgagatggtatgtaaaaatatgaattttattatgttataattgtcggaacaacacatttctatataaatcttgggatattttttgattgaaaaccccaaaaaggaaaatatttatcaaaaaattgctaaaaattttaaaacataaaaaatatatttttataaaaagacaaaaacaattaattatatttacgggatatgcatattgacattcaaacagagaatttccatgctaaaaagatgctttcctgcatctatcaacaaaacaaagctgcagaatgaattaagaatgtataaatccgtcccctataattgagcaaattca

SEQ ID NO: 9277 - DNA, 1181 bp, Heterodera glycines
tggcgatgcatggcactgagttgattgcctgccaaattgagaagactgagcacgggaaggttcatgaaggaaagtgccggcagaatgccattaagcaaattgttgtgaagatgcaatgccatcaacatacgaaagccacggatagctgtcaaattaagcaaatgttaattaaattaattaattacgaattaattacttatttaaccaattaaagaaaaattcaattcaacagtcaaaaatagatttttgcgttaaattttttgatttggtgaatgttatctatgaatcgtcaacaaattgaagtttttatgagtgaaaaattttaaaaaatgggttattccaaaaaacaatagggctgctggaaagaattttagtgaatattataaattaaaaagggcaccgctggcaggcacttcttcgatgacattgtggccaaggttgatcgtctgcacagtgcctttgaccccatcgaaaaaagttttgtgaacagctgagattcgattgtacgacaaatcgatgtctgtgagctaaatttaaatttaaaatagtttattaatttggcaatttgtccattcgtttgtccgttttctcttacttttggcagcctcggcagggaatgttcgaccttcaattcttcgatggaattgttggacagatcgagtcggaccagcgaatggaatcccgcgatggtttccggaatcatttctttgatctgatttgtcaaattcatttcctttttttgtccgctttattttacccgattcccattaatggccaattcctgcaaaacattttccaatcctccaaaagcccctttctccaaaagttcaatttcgcaattgataagctcaagtcgacgaatgtaaagcccagcgaaaaaattgttggaaagcgttttgatgggagttgagtgaatggtcaaaacctaaagaagaagaagcaaataaaatgtaaaaacaacgaaaaaaaaagaatggacctttagcaggccaagatgggcttgagaactccgcaaaagctaaagcaaaaaatttaatcaaaaactttaaatttgattaatttgttattgttttccgcttcacctccatcatttgcgttaaaggttctcattttgttgctgtattacacttttcaccagggggggaggccactttcatttgccgcccctaatgctggaacag

SEQ ID NO: 9278 - DNA, 2398 bp, Heterodera glycines
aaaaaaataagaatcttttgaatgtatgtacaaattccattaaaaatttagaaggccaaaaattcccctacgttttaaaaattaaccaaaaatttttggttacaccccaaaatctcgccgcggaaattccaaaaaaaaattgtttgttgttttttttgaaaaaatagtaatttatcataaaatttcataaaaaattgttgaagaattttcaaaaaattttgtttttctctaaattttcttgtaaaatttttttgaaatttctgcggcgagattttgtcgcgtcgagacttcgggcggcgagattccgggggcgagattttgcacgtccccaaattttcattcaccttactttggaatttttgttgtttggcgagtttgttccaccgtcactggtgttgttgtggttgttgtctgttccgtagtctcttcaataattatgtttttcaacgtcgggaaaacgtctctggggaagtaatcgtactgaattaaacacagttataatttggaatttcattgtattaactaacaggtacaacagatttctttcgtcgtcgaatgtttgtcattttgcccattttatggccattgatcgttgtttcaattgtctcagcaaattggtcggtcgattccttgggcggcctggtgctctgttgctgaacaaatgcggattcttctgctgcttccgtctcctccgatgcgttgtcttcgatttgatcggcggagagtgacttaaaagggaagttaaatttgaaatgaatttcataattattttaggtaattgcttttaatttgcctcaatttccgaaactgtcgtggattttgttgtcgaaattgtcgaatggcgatgcatggcactgagttgattgcctgccaaattgagaagactgagcacgggaaggttcatgaaggaaagtgccggcagaatgccattaagcaaattgttgtgaagatgcaatgccgccccttctgctggaacagtgcaattcagttgcactccgtcgacatggtcaacacatgcacaaaaggcacgcacttggaaagggcacgcattttgaagtcggaatttggaggaaagaaaaagcagtgaaaaaatgaggaaaaagggacggagagaaaagagggaacttttcattttgcgatgtaaggctaaatgggataattttagctaataagtggacagaatgcgcaacacaaagggaagaaaatctccaatttcattttcccattttttatctgagcatgaattgaacatgcttcgagaaatcaacggaaatttgctggtcattcgatcggtgacgtcgtgagcgaaagacgacaaaggatcgaatcggacgaattgcgcattggagagacagtgtgaaaagggagagggagggagagagtagagagagagggaggtgaaagcaaaagcaaaatatgttgggggatggtcagcgccggaggggaagaaacgtatgactaaaagaaaggaaggaaaggggagggggatgaaagggagactcatccatcgtccatcctccgccctttcatccgatgatcccacgggatttgcccccgattccctccggcgatggatgaattggaatgtgtggagatgtgcttctgttacgccgaaaggtcacagaagcggagagggaaaagtatggtcaaaagacaaaatgaatgggaagaaagggtatttatgcaaaaaaaggacaaataattggaggggggggggggaagtgacattataatatgacctgcctgatgaaaatcggtcatttgcggtcagtttattaagggaccattttcgaacattgcgaccagcggcggattcttatttcaatttaaataatactaaatatgattaatttaatactatttttttctaattaattccataaatttttttaaattaattttcagcaaatttttcgatcaatttttttatttgttcaaaattttattatttcatttaaaaagaatatctaaaagaaaaatggaagtgattaatgtgttacattaatataaggacaccttattttttgttagttcccatgaaccgatcgagttgaaattttaactgtacgtagcgattctgaaaatattaagattctaacagtgacaagacgaaaggatttcggaaaaaaattttatggatttttttccaaaaaaggggtgttacataaatataaggacacttttcaaaaggctgtaacttttagaattgagcattaaaaaatctgaaaaaattcattttagcttagttttttgtacttatcaaaaaagtcatttgtaacaaattgatcagatcactcctttatgttgatctgaaaatcataaaatgacttgaaacccgggaaattttataaaaaaaattcctagtgggctgaaaaaattttttcgtgaaaaaccatta

SEQ ID NO: 9279 - DNA, 691 bp, Heterodera glycines
cccccgggtggaaagaagaaccgtaaaaaacagcctttttattctttttttatgggaccagtaaaagtcagtattaccctttcatccgatgctcccacgggatttcccccgattccctccggctttactaaagcaaagacaaacagaaaaataaatgataaataacaaatatataaatgacggaggaaagacaattaataaaaatgaaatgaaggagagaacggcaagtgacccgaatgagtgaaagggtcaacattaaataaacactatgggtcaactccactgtgcagagaaaagcctagtactatctcgtcgttttcttttttttgtaatttctctcactttggcgtactatctctccggttttaatcatgtaaaaaacaacattcacttcgctacgtttaactttttttctatacgttaaatctataccaaattttgcatatcgatagagaaagaaattaggaacaaaatgtaagggtttttaagagcaaaaaaagggttaactaaaaagttataacggtttctcttgtaaaattcttattttttaaattttagatgggaaaaagaaaactattacctaaaattcacggcaaaaagggagtgaaagagcgtcaaaagaagcgggaggagaggaaagcgcaaacggccaaggcgatgcaagcccgatgggcaaagaaaagtgagtttt

SEQ ID NO: 9280 - DNA, 2433 bp, Heterodera glycines
tgaaaagattctaaatatattatatacccaggtctcgttgcaaacttttggaaccaagttttacgcaaatgtatttttattttttaaattaaaaatgccaaataaaattttcatttaatcttttattttcttgggggggggggggcgagggggaagcaacggcgtggaagaaccagcttctcccatttcatataggctctattatttaaataatatttacatttaaattaatttaaaaataaaatatttctctattaccaccaaaaagaattgtggcgccatttggaatatcactaattgcttcggctgcatttgtacaaatccttgcaaaattcaactgattgctggtcgaaaaacaacgaaaattagcctataaacaatcattataaaaatttatttcaatatttaatttacaattttttcttggagaattcgagacaaattgtgtgatgctttccaaaacataaaaattatttgtattgaaagatttttaaaatcctaaattaaaaatacatttaataaaaaatatttttgaattatttaatcatttaaaaattaaaaagcactattaacatttaattaaatgttcagacatcaaatgttctactattttgtcacaggttatgtaaacaagcagaagcatgcttgtttaattactttgagtctaaattatttgatggtattaaatataaagctaatgcaaacattagactaaaaaacagtttacaccgtaaaaataaagatttcaactaatttaaaaaattcaaattgaataaagacccaataaacaatttaagaaatttgtttttattataattgtatttaatcaagaatttggtgcttaattaaaataaatatatttcaaataaaaaaattaatttaagatttttcactttatttaacaattttaaataaagaatttatgagaaattactctttaattataactttaatttttttaataaattatttaaaaataaaattaggtaatttcaaataaaaaattaattcaaaaaccgaaatttcttagataattgcgttctatttatatttcaaataaattaattcaaaaatttgataattttttatttagtcaattttaattaaaaaaaataaataaataaattcgacttaattattctttaaatttttaataatgatttattaaatatatatatatatataagtatatttctaataaaaattaaataaaaaatcgaaatattattagttattttattttaatacttacttgtgaatgttaaatttttttaacaatgacataattttttgtacttttatagtcggttgaaaacattaaaaaccaaatttcccgctgagtgaacatattgaagccgtttattcagccaaaattcactaataatttggacttacgcagtttggcattttaatggacgcccccatttcgtgacaattttggggttttttctatatttttttttgccacgtgggggccaattatgtctggaacttattgtactttcaaaaagagaataaaactggaataaaatttgccatttcaaaaaatagatattcgggtaaagatttaaaaataaaataaacattagcaaaatttaaaatgttgtggtattattggcggatggcgtaagtgcaaaggatcagcctgcggtgggattcgaacccacgtcccttcctttccgtggaatgctctaaccactgagctacacagggcgccctttgcactcctttcaatcccaactttaggggaaagaaagctctcttcattagtttgagagagtcgcatatcacaatgtaggctttgaattttaaaagtgtacgaatttacgcccttacataattgctaatgagtctctattaaaaccagaacgcatattttaaaattttctttgaatattttaaaattcataaattttctatcatgaaaaatactattgttactaaaaaaactattttacaacgactttttgatttattctgtatattaaatttttcaaaaatatcattaacttttctgtcattgaatcctcgcattaaatgaaagccaaacaatttttttttctaataaatgtctgtcatgatataattacctcccaaatgaatagttttttttgtttttttaatttccgcccaaaaaaggcccattataatttcacgattattaagaaaaaaattgtcccagaatattaaatggtgaaatttttttattttgtttaggtctttctgcgatcccagaggtaccagattttgtgagattttttttaatccaaaatttgaatcgagtaacaatccgcggctcagaattaaaaaataatagaaaactttcaaatttattttgggtgatcctttatggcatcgcctcaaatggaaaaatcttctgttttctatgagtttatcaaaattttaaaacttaattttcatttaatttttttt

SEQ ID NO: 9281 - DNA, 1342 bp, Heterodera glycines
  misc_feature (22)..(22): n is a, c, g, or t
ttataaaaatataatgaaaatnaattggcccttttgagggcacaaattattcaaattttaaatatgtagacacaaaagattttaggcttaattaaaagggttttaagttatcccatatttgcggcccggaaagttttaccaaaaaaatgggccgcaaatattcgaaagtgccacttaagaaaatgtccggtacgcaaatgtcggggccataaaagtcgggacgttaatacccgatttgattgtgttggattccatcatttttttcttcccaagatttactttttaaatacatttcccacaaagaaattgatcaataccatagtttaaaataggcataaaaaatccttgaaaaaagtacttttcaattagtacgtcaattagtcactaattagtacccccgactaaaaggaccccaccaaaaacaagaagttgttgatcacaatcaatgttcagcttctctacgtgccgtgtattgtggtttttgcgcaaaagaaaaacatccgtgaatcatgttacaaattgttgctgttcatgggcttggtcagcatggtaaacattcactcgggctgtctgctgattggcacttatgctgtccgtggcgatgtgttttgtgatcggccattgttcaattacattgtcggcatggcagtttttggtgatcatgcaaaggggatgaaatccgttgccggtcaccgccctccgacccaggacactcactaatcctccaaaaaattttaactttttccataaaccatcaacaggcattcgtgccactgacatatgcgaaagttatcggatctcggatgttctgtaatttctggattaatttaccatctagattctaactaaatcatttctcgcactatagaccaggctggcattctgaggccccaaaaatttttcgtaaaacgaaatagagaattgttaagggccatggttcgtatgcggtgaagtttaaatttcttgggtccaaattcatttgaattttgtgtcgatttaaaattaatttattttaatcagctttttatacatgcgaatccatggtgtccgtcattttggcactgaaccgttgcattgaaatgttaaatcatcatttggcccgtgcactgtttgacggtgccaaggtgtacatttggattggcatttcaatttgctacggcattttcatgggctttttcttcattccaccgataccgaacggcatgacggtgggatatttttggcaagctcacatcggctacattgatgacgcggaaggatgggtgggttgcattttgtaatttgtaattgcaaattgttgctactgtacatattttggaatgaaccgtattcttttttaatt

SEQ ID NO: 9282 - DNA, 2582 bp, Heterodera glycines
ttattgtattcgcacatttttcatgggcatcttcccaaggttggctggcataatattcattttctacaaataattttatagaaactttcaaaaaaaaaatcttaggcttcaaaaaagtttattgaataatttttttgcatttttaaaacaggattccaatttcagcatttcgaagcctattttgcattaaaatcttgattcccgatttttttttttataaatttagcattttaatttccgattttctaaatttgaatttgtatttatttattttcatttttatttgtttaaataatcatttttcttaaataaaggcttgttcgcaatcattatgatcaccctgaattcacacatccgacgcagcatcaaagcagtgtttattgaaccagctctgtcacggttgacgagccaggccaattcgacaataaaccaagcaaattgagaatcggaaattggcaattttactgagtaatttgccataattaccctaaaaaaaaagaaaatttcaattgcgttctgtgtgttcttttcatatgcataaatatgaatattttgaaaaattcgactttttaattaaaaataaaaaaatttaatttcatcatatttatttctttgtatgtttgagaataattaaaaaacaaatttcacttatttgtttattataatattagtaatttaacaaaatcaattaatttatttcaacaaaataaagaaataacccaacaaaaattaaattaaatatttaactaattttctcatttttaaatttttttgctcatcatcataacacatcattctaagaattttgttttaagaaatagaaactttttttttgtcttttttaaactttttaaaataaaattttccccttgacaaaagaatttctcccagacattttaaacttgtccagccattccaaataaaaaaaatttcagaaaatttcctctacgatctccggtttctcactccgaaggtcagggagaaaaccagtaattacaaattcctgtaattaatatgccttcaatgttctgggccacaaactgtacacttttgttgagaggattatgattttattttcgttatcttcttcaaagcactcaattctcctgggactttcttccttaattatgtatatccggggcaaaggcataacttaaatttataaaaaaatgttttttttcttttttaaatgtacccaattaggttggcagctttattttatcaatggcaaaaattttcattagtaagctgataataacgagagaagttaatgcattaatatagtttgtgcttataaaatattatttcatttgctgtacaattctcgagaattggcctttctcgagactgtaattttcccagattttagtttttcgtttttatcctttccaaatcgcaaacccattgccaaatattcataaaaaagttatttgaattttaatgaaatcaattttataaacaaagtaaaaaaatgttattaacataaattcatttttacaaaaagaagactttttaattattgaaaattattgcttgaatgcttttctgattttttaatgatattttttttattattataaatttgcaacctctttacctaatgggggcaattagcaaattagcaaaacaataattatttcatcacaataactgcaaactgtaagtgcattgcagaatgtacatcatcatcattgggcaacattattcataattgtactttttattttttgttttaatctccataattatttttttgcgcgccattgtgcctttgatttcatgattatttcctgcggcctgtctttgtacgtctcactaattaaaaagcaacggaattattttttaattaaaagatgcaatttatttgggaaaaaattatttttttattttatatatatataaattttttgacttacaattagacatatttgttaattgtaattcagacccaaaaatttggtagttggctttccatcagggatgtgcgaaaatcacaaaaaaaattttcgtatacgaaaacgaaacgaaaaggggcattcgacacgaaaacgaaacacgaaacgaaaaaagaaattttgaaaaccgaaaacgaaacacgaaacgaaaaaattttgacggacgaaaacgaaacacgaaaacgaaactcaaaaagtgccgaaaatgtaggacgaaacgaacttccatccctgctttccatccaaaattttctgaaatggtattccaaccaaacgctttggaatttcgacctcagaaatcggctgacttcccactcttatataaaaaaattttatatattatttaattaaagtagcacctgctgtttatgttgcgattttctttttttgtgggtggtatttttctgagaatggcatttgctgttgtcacatgtcaaccctgaccctaatgtactgaaaatgctctctctcattcccaatttgctttttctaattaatttttgacttatggtcttgccttttcaattattaatttggtaccctaattaacaaaaattgcatctgttaacatttgtcaagaaaaacgtcaaaactttctttaatctttttggtctaatttcttctcgt

SEQ ID NO: 9283 - DNA, 6931 bp, Heterodera glycines
tttttccttgtgtgtgattctgaaaattccgtaattgccaaaacacgtgacatagacttccattttgaaattgaatgcgcagttaagctgttattaaaccaatcataataaaaagaaaaacacaaattgtaccataaaaggttgcaagtgcttccactccaacaatcagttgtcagtgtaataaatgcggattcttttaattcatctttaattttctgtctgacacgttggtatacaattggcaaggcagtttttctgaaaaaattgaaaattaattttatttaacttttaatgtaattcatcacctataaaaacattcacttttcactttttgatggggaaacaaagaatgaaaagtttggtcatccacagcgccgaagggaatggttttttgcaccaaaaatgaagaattttcttatcaaacgaagagagttgtgctgaaaaaagatacaaactattaagctaattaaaaagaattacagtctgaaataggcggtctgctggaagactgaaagtctgagattgtcttctgtttttgtttgtcctttttggctttcgattcaagagaattcagcttttcagtgaattcggagttttcgtgaatggcgtgaagatgagtatgcaaagttttaactgttcctttggcaagctggtattcatatttgagctttccatttgcttgacattcaagacaaattgctgtagtctttgacgtttttttaaataggccaatttgccaaataagactcattttcttaaaattaaaaagaactaaattatcatttcaataaagtagaatttttcgaatgaaatgaaaaatttaccagaaaattgacaaaaaaaaaaatttataaacattatgccaaagagatttttgaaggaaaaagaacaaatttttgttaaatcataacccggtaaaacccggtcaaaaatgccgggttccgggccgggttgcattttcaaaaacgaccgggttccgggcccgacctctcaaaacccggtcaacccggattttcccaaaaatcgccgggcccgggttgccgggcccgggaaaacccggtaccgggcccggccccggttcggtctctaatttttagcgtccgacggtgccgataggcaccgccggggaaaatttttttaaatttataggtaaaataagaacatttggccataaatttccaaattatgaatatatttaagaaataagaacaaaataagaacaatagcccgaaataaggacaaatcttacaaataaggacatttttattttgtaagatttggaccctccaaataaagacaaatcttataaataaggacagatccgaatcctgatataaacggtagcttgaagtcgatagatagaatttcttttaatgccaatatttgctcttgtatttatacctaattcccgagactaagcttacgattgataccaagattttaggcattttaggtcctaagaaactgaggaagggtattgatttgaacgtaacaactttgtccagggctcccagatcaaaattttcaaaagcctcaaaacactattttccccaaaagcctcaaaatttctcaaaaaaccacaaaaagcctcattttgaaaatttagcctcattgacctatcaaaaaaccacaaaatgaggctaaagcctcagatctgggagccctgattttgtccaattttttgtcatttaattttaggcattgattaagacattgcagaataaaacaaattaaagtgaaacatggcaaccgaagttgatgaaaatacagcagttgctgatccttggagcactgttgaagatgtgagcggtggagagtcaatgcaccaattggtcaccctggacgttcccgagattaaactgttcgggaagtggtctcttaatgacgtggacgtgtccgacatttcactcgtggtttgcatttgcattcctaagcatttttggtttactttaattacgactcaacataattttaggattatgttgcggtgaaagaaaaggcggccaaatatttgccgcacagcgccggtcgttaccagcagaagcgcttccgtaaggcgacctgtccggtggtggaacggttggtctcgtcaatgatgatgcacgggcggaacaacggcaagaaactgatggcggtgcgcattgtgaagcatgccttcgaaatcattcatctgctcaccggagaggtttttgtgggggggggggagaaattggacaacttttcattcactctgtttcaattagtgggtatccgataaaaaaatgcttaaagttaaggcaatgttcttgagttgtttcataaaaatagctgttaattcaattttgaccttttgtcgatgtaatgttaaagttttatttttcaattttcagaaccccgtccaagtgttagtcaatgctgtgatcaacagtggacctcgcgaggattccacgcgtattggccgtgcgggcacagttcgtcgacaggcagtcgatgtgtcgcctttgcgtcgtgtcaatcaggttggagtaacattccccatctcacacccacaaaaaatacatctgaacatgtctttttttgacagactatttgttttcaatgttaaatttagaattataacttttgatattttaggcaatttggttgctttgtaccggttcccgcgaggccgctttcagaaacatcaaaacgatcgcggaatgtcttgcggatgagctgatgaatgccgctaaggggtccagcaattcctacgcaatcaaaaagaaagacgaattggaacgggtggccaaatcgaaccgttgagggaaaaaagcacagaatggaaaagaggataaaggacacaaagggatcaatttgttcaattgttgttgaattttatgttattttgttcctcataaaacaaagagacaaattctgatcggattgtctgaataagatttgttttgttgttaaatgcgttgtttttatcacacgtccaacgaccgtctaaagtccgaaatttacttttgttgtgttttgttcgtcatttgattgtctaaactcactttgtttacaaatggcaaaatcaccgaagaaatcgcccactaaacgacacgtgagcgtcgcttctcacaatcagtccttaactaaacggccaaagttggacaattttaggggtcattagaagatcaatttggcttttaagggttgaatttgccgcaattctcaataaaacgaatggaaccgcagacaaacagccgatgtcatttgagcacagattggcaaaactcggtgagtttttgaaatcttattcctgttaatgttcgtgcctttttcaagatggtgatgatggcggtcttcatagagcatccacgtcgaggtcagtcacttcatttccgtatcccatgggaacctttccagttttagtggccacatttctgcccgacagcctggagcggaggcgaagtggccacggccagcgccggccaaatgggtcagagaggggcgaacagacgcgaacttggcctttcaactgattgacatcgacttttacatgggtccgacttttcattcgaatgactggtgggtgaatccgaggcaaaagaaggcggacggcacttacacacttgccgttccgttgatacaaacctcgaaaagcattgcctttttgtcctcattagcagagttggtcggcctccacttggctgaacaatcttgacaggacaacaataaccgtaatataagtgttgtgaaaattttgcctgccggtgtttttggctgacaccctttatgagcaattttgaagcctgaacctgtatttgaataaaaccaacaactccgaagttttaactctttcaatttagagcgaaatggggtgatcattcgactgttcggcgtcaccgatttcggcaattcaatcgccgtttgcgtgcccggctatcggccttatttcttcgcttcggccccacttggcttcgaccaatcgcatatttctaccgctatttcactgctcaattcaaacatttcggtgaatacaaactaccttttgacacttgcatttttcgcattaacttttcctcagataagtgcacaaagtggcgttccgaaggatgcgtcggcgatggtcaccggcattgagttggtatacggctcaaatttgttcggctttcacgccgaacttcgccagcaattgtttttgaagatttttgtgctatcaccccgcataatcaccgcatgtaatttgcatgccctattttcaatgagtttagagtttagttgtaaatatctaataggttctcgagtactttacgtgttggagagaattgccgccgacgaagtgggccattcggcaaactttaggccctgccaggccttcgaggccaacttggacttcgaagtgcgtttcatggccgaccttggcctcgtcggttgcggttgggccgagtgtcccgctcggaaatttacttacatcgacccgaaacaacggaacacaaattgccaaattgaggtgggcacaaacagtagtgcctttttaattgcatttccaattgtgcaggtcacaatctatgtcaacgacttgaacgtgcactccgcagatgaacccaattggtccaacatcgccccgttacgtacgctgagctttgacatcgaatgcatgggaccattgggtgaatgagttaagtaagcgatttttttataaatttccccttgaaataggcacttttccggacgcttcgcgtgacccgatcatccaaatcgccaacatggtcaaggtggagggccaaagggaggagtttgtccgcaactgtttcgtcgttggcggttgtgagtcggtcgtcggctctgacattgtcgagtgccgtgacgagaaggaattgctcgaggcgagtgttttttttcctctccaatttttatattcatttccatcggtcccatgtgtgtagaaatgggccgcgtttgtgctttgcgtcgatcccgatttgcttaccggttacaacatccaaaactttgatcttccatacattttggatcgggcaaagcatttaaaggtattaattctcaacacacgattaattttttgtactaaaggaatacattttcctattttggttcgtacctttcgccaatttcatttattttatttttgtcacagattgacaaaaccgtctgtctgttgagtcgaattcgcgggtcaatgtgtcgacaaagggacgccgccatgcagtccaaacaaatgggcaatcgggtgaacaaattcgtctccatggacgggcggatcatcttcgatgtgcttcaggtggtcccttttccgtctgtcccatttcaatttatttttccttttccatccttttttcctcagttggtccttcgcgagtacaaattgcgcagttacactcttaacaatgtcagctattttttcctgggcgagcagaaggaggacgtttcctacactttcatcccccaacttcaggtatttttcatcaatctccaaatttttaagaaaatgcttagaatccaaaaaaaacattttctaacgctcttttgcccattttcacagaatggctccaacatggacagacggcggttggctttgtattgcatgaaggacgcctttttgccgttgcgtctgctggacaaacttatgctggtgatcaattacattgagatggcccgtgtcaccggctgtccgttgaatttcctcgtctcccgtggccaacaagtcaaaattttgtccatgttgttgagaaaggtgttagattaaaatttatataattaaaaaataataactttttccgttgtttgttttgcagactcgcgagcactttttgttccttcccgtcgtcgaaatgggcgagggcgccggcggcgacgaggtcggctacgagggggcgactgtcattgagccgttgcgcgccttctacaaggacccaatcgccacgctggacttcgcctctttgtacccgtccattatgatcgcccacaacctttgctacaccacactgttgcccaagggggccgtagccaaaaaggcgattccatcggagtgtgttcacactactttcattgttttttccaaaagttttcatttctttttgttcagttggcgcgagggagaagattacattgttacgccgtccggcgatatgttcgtcaaggccacccatcggcagggattgttgcccaaagtgctggaggagctgctcagcgcacgcaaacgggccaaggccgagctcaaaaaggagaaggacccttttcggtaatgctaagtccaagattttgccattaactcattaatccatccattagttgactaattacaattctttgaataattgactatttgtattttcttcaattgcagacaaatggtgctgaacggtcgtcagcttgcgctaaaaatcagtgccaattccgtctacgggttcactggtgcctcccgtggcaaattgccgtgcttggaaatctcgcagtccgtcaccgcttttggtcgtcaaatgatcgaagctactaaacaaatggtggaaggtgtgtgcaaccaatgccaactactatcatgaactgtttatttgcattactttaagaatcttacattgccggcgctgtcgacggactttgtcctgcaaatgccaaagtgatttatggtaaatctttttcaattgactttttaaataataaatgtttgtatattttcatcaccatttagaggtgacaccgattcggtgatggttaaattcggcgtcaaaagtgttggcgaagcgatggaattgggccggcacgcggcgcgagagatcagccgacgttttccgccacccattcagttggagttcgagaaggtctacttcccgtatttgctgatcaacaaaaagcgatacgcgggtctctattggaccaacgaggaacgacacgacaaaatggactgcaaaggggtaatggaagagaagtaaggcaccataatcaccggatgaggcaaata

SEQ ID NO: 9284 - DNA, 1114 bp, Heterodera glycines
  misc_feature (49)..(50): n is a, c, g, or t
ctgtgagaacgtactgaaacgaatgaaacagggcaattaatcggaatcnncaatcagccaagattaccacacaggtccggtaccatccgaattaattttcatacatttgatattttatcacatgcgaatgtacgaaaatggaccttaagaaagctagtcgaaaatgtacggacggaaaaagtcatgtaatcgtaagaccgaccccaattaacagcaatgacactttagtaattaatttctgggaaaatttatgcataatgaagcaatacctttccattacgagtgaactgagcactgcaaatcggggctccgtcatgcgcgcgggtaaaagtctcaatgcatcgattggaaactccgtcccaaactaaaaaaaaagtgaaataaaggacaaaaaagaagggggccgtgagggagaaggacaagggctgaaaacctaattctaaaaacctccatttttgggaccttttatcggcgaaaaatggctttaatgagtcgactccctcgcccctctttccatatatgacctatgtctaataatcgaccttttacattcccatcacgacttcccgtgacaaacattcgcgcattttccgaatagcacacatccgtaatggaatcagaatgttggtccttcggtattggagaaacaaagcattgctaaagaaacagattcgatgaagttttcagaatcatgtaaaaaatgttttctatgctatttaaaaacggaagaacatattgaaagcgattttaaacaaattaaaatctaaaaatatggatggtacctgtgtttcggcactataaagacgcaaggtcggatgccgagttgcgcatagaaaaaactctccgctcggatgaaaactgaccgcagtgatcggctcgacctccttccaaacatttcattgtaaaattctttcagaatatgacttaccgtgatcgttttcattgcccttttaaccgcagtttttgaataatcgaacattttcagcgtaaaatcgttgctgcccgaaaggaggacggactcgcggggatggaaagcaacgcaagtgacttcctagcaaaaagaccaacgattcttcgtagagtgtttttgttgtcacatcgaggtggtcataaa

SEQ ID NO: 9285 - DNA, 3304 bp, Heterodera glycines
  misc_feature (43)..(43): n is a, c, g, or t
taagtgttttgtttgtcacatcgaggtgggggcataaagggtnccgaatgacccgggtgatgggcgtcggggccggactcactcagagtcacgtcaatccttggtgggccaggttaacaaactgcacccttttggggaacttgcctggaaatgattttatcgacatccaaaattttaattgaacaatcattggaggccgtggcgacaagagctcctaaagaaattaaaatgtaaagcactaaacgcgaattgaataccatctggagagaaagcagccgcccgacacggggccttgtgtgtggtgaggtacacagtttcgtacaaacttggttcagggccttgagaaacatttgtctttactcagatttgatgctatattatacttgtcgggacaacatcagcatcgaattccaagtcaagcccagcagactcaaacccaccgaccttttgtcaatgaaataaatggtcataaaaggaaaaagtcagtcatcaaaacaacacctgcaagattgtctcccgttctttagactcgggatcttccacaaattgtttagctattgccacaagacgaaaaagtttgtcagatggaggaggcggtcgtagcgaaaggccaagcgtttgtgccaagttcagtgccaattgttgatgaccatcgtaaaagagttggctaaaatggattattgaaaacaaaaatcaaggaaaacatacccaacaattaatttgtacataaagtcccggtcttttaagtctggcttcattataaaaactgtttttaacaaatatctaaaggtatattgaaaattaaaactaatgaactgaaaaatgtccaaatcagaatgtacatcaaattggttaactattaaaaaataataggatttggaataagtaaaattgtaaaaaatgagcaatgttaattaaacctaacttatgccaagtggcgagggatccctcaggcttagtttttagaatcttaatttttaaaaaagcacatttttctatttttgggttggggcccaaacgaccccgggccccaaaaacgggggcccaaacgaccccggggcccaaaaacgggggtccaaacgctctggtcccgacccgtagtgctcgtttaaaatatgaacagattattatatttggcttaatgttttttttaataaaataccgtaacaaaaaaaaagaaaaaagaaattgattttcttggtagccattgcaacattttccctgcatttccattccgtcttattaaattttaaaaatgcttcgtttattggtttaacaccttcatgatgctgacttttccgactgtatcctttgttattgatgggattttgcggcgatctttagaatttggtgagtttcgtatttcttcaggcaaacaaaacaaaatttttaaaaaaattctaaattttactatctactggagaagaagccgaatgggctacaacgtcttgtgatgcccactgccaatgtcagaagcagcctctagcttcattccaaaacctattataaagcatcaccgcgataacaacaaaactaagattcggtttaatatccttatttggaaaaggcagtcaacgaaaaataatgggaattaaattcatggatcaatcgagctttttggtcatattatggaattaaaacaatcttgagcttttaatgattgtgatttttatcaccctattgttataggaagcattaaaaggttgatttcataagactcaagagtaaatcattttgagagcaaaaggaaatattttgaaatttttcttgttacataggtgggacgatgtttctagttaagtaaattccaaaaaattatctcaaaaacggggttcctaaacaagaaaaatgccgttttatttaatttttaatctccaagtggaggccagcttataaaagccattcaataatgtcaaaatagctaattgtaagcaaattgtacttcagaactaattttcatttttcttaacattttttagtctattaaattcaatttctgcgacgcaataatttttaatcattggcattggtcgctctgcttaatttggcttgcaatttaacacatataaattaaaatttagagtttaaattccaataaatcacgttaaattcattcggtccattctttcatcgtttaaagcgcaaacggtaaattgaccatgtaagttaaagatgtgcggagaattggagcatcagaatgagtcaattaattgcggcaaaagctttgaaaaatgtgttaaaaaattcaaaaactaaaaaacggtcatcgtgaacgtaaacacactaaaaatcaaacataaaaatatgtattaaaacaaataaaatttttcttccaaagctttgagcctaacgaaattaattaaattgcatggaaacgtacattaacaattaattttagattttctcctccatcgtcaacaattatgtccaaattcgaaggagggttctcttctcatgatgttcgctttttgcttcttccatctcgtaaactttgctttagtcctatggctatggtcaaatgccttccgctttcccttccattggtggcgctgcgcccagtgcgcctccttttggtaatttgacaattcgtgcactacagtttttgaattcatatttaggcttttctggagcaccgttcggctcgcatgcattcggaggcgatattccgagcccacttgacgcggaaatccaaattgttctgagggaaattcagtcggaagtgcatcagctagagaacagtggcgaatacggggaacaattgaaaaatgcgcgtcgactgttggccaccggtaagaaatttgagcagcaaaaaccggattgactgcttttgaataataaatcccagaagcaaccaagctcgagaataacatcgacccagaatggctcgaagtggacatcaacaaaccgatcaaagtctccaagaaggtgctcatccccagtttccgtcatccaaaggtttcttccccaacctttttcattaaatataatcactgttatttggattcagtttaattttgtgggcaaagttcttggaccaaaaggcacgactttgcaaaatatcgccaaatcatacaaatgtcacgtgtacattttggggcggggcagcactcgcgaccgaaccaaggagcaggtaattctcactcaattttgtttttcttttcatttcttactttcttttgttctcataatggctatttctatcgcttggtcttctcaaaccaaatttcccaggaaatgctcagcagcggcgacccacagtacgctcactacggtgggcctttacacgtcaaagtggagacgactg

SEQ ID NO: 9286 - DNA, 1509 bp, Heterodera glycines
tttgcttatttcgcttcaatccttcgatattttggttagattggggtggtccaatccaaacaatagcaaaacgaacccatcgcccatttctcccaacggtgtgttgtccctttctctcttccttctatttgttcacgcgatcgaggcgataaagcacccaaaaagaggtcagccagcaaagctcaacgcctctgaagtccgaggggggggggggggcgttgggttggtccaatgggaaggaatggacggaccaattttaagtaatttccctccattgccaaatgcagagttatgatgtcacttttttagctattgcaaatgtttctaatttttctggccatttcctttttcgtctgttatttccaattgtttttgccccgctgaccaatggtctcaaaaattttatctttttcgctgacctccgttcgattctttttacgaatggatggcctataataaagccagcgttaacgaccgtcggtcgccatttggagacgcacgggaaaataatggcaaagaatgtgcggggggggggggggggagaggcaatgattgccctccctttccccttgatcatttcggacatcgctttaattcgtgggttcgcttcccatcggggcctaacattttgccatctctcaatcaatgtttcaacactttgctgttgtttcgggccacaaatgggctgtattttaaaaaatccgtatcaattcatgattaaatttcttttaagctttcgtttgacaccaatgatatatataagtattgaccaagtaagcaaaaagttatggccaaaaaactgaagaatggcctcacaaagtgcgctaaagccaaattactcatttgttggcaaatgttttgttaagttaaatttttgccccatggcgtttacaatttacggtactgtgctgttactcccatttctgctgttctgtcgggtgcactttgtccaaattggcaatttcaaaattggtaagcgttttttctgctaaaattaaattggttgacattcatcccaaaatgccttccaacgatgagcctaatttctcttcagtttaaattaaagtaaaatttttaagcgatttttcaaaacttttccttgaaaaaagaattttcggcgcggggagcgggaaacgaattactcccgtcaaattgtgcctaattttgcataattcggccattttggctaattaccccccccctttttgtgccatttccgtttcctcctccaacagaagcattcccaattaattgctgcggatcattccttcgccttctgctccgtcctcccgaactcaattcacatttttgggttcctccgccgcctcttttcttttctcagccaatttattcttctcccctcccctccgttgcagaatttcgccccaatttctctccttttttctgctgatttattttattcggtaaaatttaaaaaaatgcaatttttatttttcaaaaataaacatacctaaccatataaaatatttggaaatggggaagaacatt

SEQ ID NO: 9287 - DNA, 1654 bp, Heterodera glycines
aagcaggcaaaagcatcatctccagcagcatcagcagctggagactgcagaagcggtagcagtgcatccgcgccaccgtcaccaacagcagcaggtggtgccaacatagaaaatgagtgccaccaacccaatggcgataaacggatttgaaattgcagttttttgaatgaatacgcaatctcgaaggccgaaaggtcgggagacttaatgatgccgaaaagtgtgtcaaattgacatggcactacccaaaaaaaggagggacatcccatccaccattcatatccttttttctcacactgattttccattccccaaaagattggcaaatcgttgatgccagcaacaacggtggcggacgttttggcacagtcgcagctgctcaacgggcttttggagcagcacagccaatgatgaggctgaacattatcgcgtgtgaatggtggacactgatggccaagccaaaattgcttaacaaatgcctttccccccaattttgatcggactttcatttttgaaatccccttttccattaatacattccattccattccttcattgaaacaatgctttaaatgtgttttcttttttttctgttccaaatcatctgaccaacaatcccaatcactttgtgtgctatgcgctcaccaccgatcaataattcgttgtttccatttctggccaattaattaattaattgctgctaattgattggctactgctggtcaatcagttttggccctgcttgacagccttcaatagtataattattaggtacttttctcttggtatcatgccaaaaaaaaggaccatttgattatttgccgagccaaaactgctgattgattaagcaacatttatttacggtgatttttttttcaccgttttgatcacttttttgtgttgctccatttctctgtgtgcaattgaatgagtcgcagttccaacaaccgatcactgactgcataattttcgatcactttcttcccccttttttgatcacaaattgtttgttgcacatgcgccacccatttttacaccacaataagagctttatcaacctctttcttttctcattttcatgtcatgtttttgagaatgaaactgcataatatattttgcacatcccattgcttttttttatttgatcaaagggacggcaaaattggaaaatttccaaaatttaccacattaaaacttgtaaatttgcaccgaaaaatcctgtcgtttttcacgtaatttaccggttttcacttttaaaaatcgccttccttcaacgcaatgtagggctaggcaccttttgtatcttttttttatgattttaaattccaaaatgccaaaattttccgtccttttcactacataacaaacatatgattatttgtgtgtgcctttgcttcctcctcccctccttcagcaggtgttttttttttgtgtaatttaattaaattgaccaatcaaaaaattttctacaaaaaaacccagccccatgcctcgtctgacgctgtccaacgcccacaaaaaaatcacaaccaccaacaaaaactctcaacagaatatgtgcattcctcataatttaaaaacaattttgccctactaattctcaatctatttttcgcttctttttttgaatacagttccctcgaacatgtttcgg

SEQ ID NO: 9288 - DNA, 1473 bp, Heterodera glycines
ttttgacttaatttttatctgtatcaaaaaagtgatggaaaataattataacggtgaaaaggtcatttacacacagcttatcaaaaaaaaacgagcgatgaaccagtaaataggggcgttaacgcttaattagtaatttgacgagcgctaagcgccgctttgcgacgcgccaaccgctcggccttttctcagaatttaaaatgaattttgatttattggcattttgtttattacgccaatgatttattaacgatttttttcgtttttaccgtacatgtacctgtcatttgaaaagtttgcgagaaatgtaatcttatgtgtgtaacctcccattccatatattaggctttattttctacagattaatttgtatacaaatgtttaaattcaaattttgccatacaaaaatttcatttaggtttttaatggcaccgcccgtcagaaaaaagaaaaagttttcctccgacaatcaacgcctcatttcttctaccgcaattggtgaacatgaacagcaatccatgggttcacttgtgacatcatttggagaacggcgaagtgttcgcgtggcaaagaaaacgaaccgaccgttgtggacgaagacgaaacggtgtcattcaaaattgcaatttttcgttttagggccccaattttgaatttgttcatcaacttctgccagttaatgtgatttccgcgtttcagttgggtgtgtaatgatgtttggatggacattttcccgtttgttgaccgtcctcgactcggcctcaaattggcactgatttcgccacgtttcgatggtttagtggacacgcattttgatggcaaacgtgaactgaaactttggaaacgcatcagaattgaccagattggaaaagtgtcgaaactattcgtgtttatcaattatgtcaaatttgtgccatttcctttgcccgaacatccgctgcccagcaaaattcactttaatgaccttgaaattacgtaattcgaacttgaaaaccaataaaaaggcatgcttttttcagttacatcgaccacgccgtcatcgcatttctccgcgcaaataaacaaattttcgatggaagaggcaccaaattggctttgttggttaattcacaccaaactgctactactcctactgctgatgcccagccgatttgggatgtgttggcccatgaaatttggcccattttcgcgacaaatattcgccatttgcaattgtccaatgacgatcatttggacaatttgcgtcgtcgcacttcgccgacaattctctgtgatctgctgaacctgaattcaatcgcttcatattggatgttgcctgttacaacttctgctggccaagcgttgtccaaatggttgcacacgccgagcaaagatggacggacgaagcgattccattccatttttcatcatctatcaattagcatcaacgaatggatcaaattgatcaacagtttcaaagaagtggctggcaac

SEQ ID NO: 9289 - DNA, 3071 bp, Heterodera glycines
aaaatgaatggatgagccgatgggtgatgaagcgatgccaaattggggagacggcgacggttcaatgggagcacgaaaatttggacaatttgaacagtgtcaaaatcaatttgtgtggcgacaaaaagtgcattgggtgagtatggaaaagaaaagaattaaatttttataatttttttacacggatggtggggggttccattttgaaggaaaaaaatgaagaaattttagagataaatcaggtttttggtattttcagggtcggatagacacttaataatttaggtttttgtctccacaaccagcagcaacagaagaagaagaatcgggtcaaagcgatggaaaagggcgccgaattgtgcggaagtgaaaatataattgagaaatgatcggccattaattgatttgttttgttgttggaatgatcaacatggattatgttctgtgatcaggataaaatttcgtcttcagcgtagaattctttaccgtctcacatcttaataattgaaaaaaaaaatttattgcaacgataattttatatcgattgtattgactttgcttggtgacgaaaaatgctatcgccattggtagctgctaacttttcacccaccaaacaaacgcattttctaactttttgctgtaattttgtttgttgtttttttaagaattttctaaatttcccttttcagttgcaaataattagttttgttgactgactctgatacaatttttgagaggttggttttattcgaaattttcatttatttcaatcaattctttacttcgtttaatactttacataatgtcccattggtcagtgaaagctgtgtctttgtcttctacgacatttatttttttaagaaagcatttaaatgcccaaactttaggtttttattgaaaaatcatattttgtttggtttagtgtcactgatgacacatagaatgagtgccaaagaaatggcgaaagtaattaattatttgtaaattttaccaaattcgtggaagccattcagttcattaagacttaagaaattaaaaactgcataaacgcatttttcattcaaatttgggtgtgaacaacagacaataattgtctgaataaagacaagagatgtcaaaagataagagcgctttcaaattttctcaaccaattagtcctcatttggaggcttaattaggaaaaaaaattgttgataagcagaaaatggttatggtaatattttacctgttcgggatggcacattcttgggactcaattgaataatttacattctcacaaatacaataaaataaagaaaactgtttattttttgcaacacagcaaaattcgtcaacaatgcggtttacttaatttaatgggtgggctactttaatttctcttaaatcatttaattacattaaatgagtctccccccccccattcttttggcaatatttgagcactttgctcgaactttttttttaaggttgtatcttattttcagcaaatttatacaatttttcaatccatcataaaaaaaacttgcgctttttttcgctgcgaagatggaacccaataacaataatgatcaggcaaatcagtgccaacaaaccgatataagcaaaagcattgagtccgcggttttgcccaccatgatggagcttggtggtgatgaagccaatgcttcttcacctcgtgctgctgaaacggcacaaatgccgtcattgaatgccactgccacaaatggtggcccgggttcattttgtgatgggacactgggagcaccaccttacgataatgggcatcaaaatgctgctgtcacgattgcggcggcggcgtcgcttcctaagaccaccaaagcgcttggcgagccggcgaacagcggcgtcgctggcggcggtggtgtcgattcgctcgaccagccgagcgacgatgtcgaggagtcccaccaagcggaagagcttgtggtcaaggaagaatgcatctttccccaagacgagtacatggaagacgaagaggtacctcattcccatccaatccatccaaaccaaatataggaatgaatttggccattcccatatggccatggttaggaagcaaattgctcttcatttactcttggcttattgtcagcgtcttggccaacttttcactctttctcaaagcatttctgtgccaccattctgtcctgtcaaacttctttttcattcatctcacttcgtcattctctttgtttattggttcatactaggcaaaaattgttattatgccatgacgtgaccgaacatccatccccccccccctccatttttattaaattttcttggcacaaaaacagaagtatgtgttacaagcggaaggaatctggcaaaacccctaggaaaattgtactaaaagagcggagaaggaatttttttttatttaccaggcgatttctccaaattgctgttgtgactccccaaaaaaaccccaagtcaaattttagggtgtaattttacagaatatctgcccctttcgtgattagagactttcttagtccaataatacgctcattgttagttgagctgacgcatttggggataagaaaaacaaaacaaaaaatcgctaaaaacattatattgactttgaaacaacgcaaattattgtatttattcgaaatttccttttctaactgttctatcattaaatcgaattcttatccgctttttccattcattttactttttcattggcacaatattttttcgaaaattgttcaccattaaaacgagcatttttttaaaatggaatggaaaaacatccacaattattccatttttttttgtagctgcaactcgtcgatcagcacaatgatgacagtccgccagaaaacggaattgccaccaccaccgatggcaccaatgagcgacagcagaaaaacaatggcacgacagcgcgtgatggggagacaaagcaaaaccaaccgaaaacaattcggatggtggtgccaataatgctgaccacactggtgggaagccgtcggtggacagcaaaagcaatgcggaaaaggaggcggaagaaatgcggaaaaaggaagaccccgcaaagcaca

SEQ ID NO: 9290 - DNA, 1394 bp, Heterodera glycines
atttctcagtcctagcaaatttctaagaaaaataaagaatttatgggcgaccacggaatttttggaattacacaaccaaaaattagccgttgatgtcttccgtctgcttcctgcgattagtccagttttcctctcgaatcgggatagatcgctcataatttgattaatggaaatctaacaacagccgaatcgcactacttacgagatttcagcgcgtaaaattgagtttaattttcatctctatccacatattagctcaatatttacgcatattatatgcacaataaaaacaaaaattttgtttgaaaatatgttcgaatccgtgttaggggttcagaatttgtcaaaaataatgccggattcgtgctcagcaccataaaatagccctagaaaaatttttccaggcttttcaaataaaaaaaaacgggaccagtaaactagacctttgccgcaggacaacggacagaaggaggaccttttgagagcaaaggaaagggaaagactgacacgaccgaaaattctgataattagtgatgggaggtgtggaaggggaggggaaacggtgagggatgcacacacggacggacggacagatggcatgatcgaaaagatgagagataaagagagggagagaaagagagagagagagagagaagagggaagaagagaaaaagcgagaggagaagggatatgggagagagtataggaagaaagagagagagaaaaatgaggagagaaaagaatgccaaccttataactctccccccccccgcaattcacttaatttcccatgcttttcacgtgttgccattaaaattccttgtcatcgaaaaatatcaatcaaaaagcaaaatgcaccgaaaattgtccatttatttgaaaatttgtcaaataatggaaaagtgaaatgaaactcaattacataaatatttctaaatattacaaatggtattttacatatacaagcatgaatattaaatgatcagcagtggaaaatcggacattaaatagacaaaatgggaaggggaggagtcaaccgatcgattgcttattattggctaacgaagaaaacaattacctaaatggaataaaaaggcattcattaaaatgaatgttaaattgtgataaatgcttcagcaatttaacttaattgggatatctcttacactgtcaaaaatatccaaatatgaaaaaaggttaatcatcggagcaggtacattttcaaacattttttcacaaattaaatcggaaagaatgggatttataaaaataggaaaagggagggaagacgatttgtgaaggaatgggactggtcgcagtttctgcccgaactgatcggatgatcggacggctcgtcgccctttgctgctaatcctttcttgatcgcctccccc

SEQ ID NO: 9291 - DNA, 2473 bp, Heterodera glycines
ttttcacgtgtgccaattaaaattccttgtcatcgaaaaatatcaatcaaaaagcaaaatgcaccgaaaattgtccatttatttgaaaatttgtcaaataatggaaaagtgaaatgaaactcaattacataaatattttaaatattacaaatggtattttacatatacaagcatgaatattaaatgatcagcagtggaaaatcggacattaaatagacaaaatgggaaggggaggagtcaaccgatcgatgaagaaaacaattacctaaatggaataaaaaggcattcattaaaatgaatgttaaattgtgataaatgcttcagcaatttaacttaattgggatatctcttgcactgtcaaaaatatccaaatatgaaaaaaggttaatcatcggagcaggtacattttcaatcattttttcacaaattaaatcggaaagaagggatttataaaaataggaaaagggagggaagacgatttgtgaaggaatggactggtcgcagtttctgcccgaactgatcggatgatcggacggctcgtcgccgtttgctgctaatcctttccgatcgcctccccccttggccattctccgccgtttctttggcccattgggtcggcttttcctctgcttttccttttccccaatgaattcgcatgttgctaaatcggattcgctcaacaaatgtccatcttttctgctccgtttgtccgctttttcgcgtgccaatttcgccttttgccgtgccttttccttccctttggccataatttttcttttattgtccttttttgcatcaaccaaaggtcagtctgtgccacttttatttcttttcccccctttgtttccgttaggttcgctttttgtgccccctcatttggtgcccgccgcttctccctttgcccgtgccgactttcgccttcaaaatgcgcacttttaccgcgtcatcgttcatcctccgctctttcccttctctcttccgttttccccgctttctcctcgcccttcggccaattcggcgccagttccaactcagcgccgatcatttgagccttcccaaaaaacatggcgtcagtaaattggccataagagaaaagataacatttatcattatttttaaaataaaagatcacaatcagcatggattttgaaataaaatatattcaaaaccgataatttcatcccaaaggcgtcgttttgggtgaaatttgtcagttgccaaatttgctgcgaccaactgagaacagctccacttttgccgagtgtgagcagctcgactggggtattgctgagctgttgaacaggtgattgattaaatgttcaattaaacatgggcaaattaaccaattaacatttaaaaatgcttaatctaaggtccgatttgggcttttggcggttgcgtttctgcgaatcggacactcttttcgttccgtcttcccagcgttgtctcacgcgtcgttcggtgattcttcaaaacaaaatttgctcaaagaaatcgctgcgaaagtcaattgacgaaaacgaaactcttggagagaatggagcaaaagaattggccactaattacagtttatgccccccgggggacagtctcgacttggtaagtgaattttcgagaaccattaaatatttggaggaatgtgaagcgggtgtggtcctttttctgttcagtggatgacagtgcgacagaaagtgccaacgaagcaaaaaaggacggaagagaaagtgcctgaggggcaaagaagggaaattgccaaaacagaagaggaggaggtggaggaggaagacgaaagtgccgaagaggacggcaccaattcagacttagaaatggtggagccgtgcagagttcgaatcggggagaagggaaaaggcaaatcgatgcatcaattggcaaaatgtccatgcgaaagtgacaattgcatttgcatggaggtgaataagcaaaagcaaggaaagttcagccatagctttcctttattcattatccctgatcaattcattcttcaacaatattaattaccccaataattgtcggcttcccactgttaattaccgttaattaccctttgtaagtctcaactcccgcggcttttctccgcctgctgttgcccaaccaaacaatcttcgccctgtctttgccccgtcgctccgccgcattttgtcaccaccgatgacaaacgtttatcagctaataaattggcccaacaaaaagtacaagcaatggcacttgcgccgcaacggaaaagccaagagagcagcaacaaaatatttgaagaagaaaatttcgtcggtccgccggaggattttgggcgatttgtgccttttccctcgggcgtggaacagccgcggcaatgccctttgagtcagtacaaagccaaaccaaaggaaaagctataaattaattcagtcgatcaaacgaagccccaagtcgcgcactatcaaagactgtgtttcatgggatgttggaccctctt

SEQ ID NO: 9292 - DNA, 3018 bp, Heterodera glycines
  misc_feature (52)..(52): n is a, c, g, or t
attaattaattgttttttatagactcaattaaattttccaactgtttttccncaaatacacctaccgtatgctttttgtcccatccctttacagtaggcttttgtactttcgtccaccgtatccctccccttttttccctttttttcactacccgttggccttgggtagcatcccttcttcagtcctttgaatttgttcttcaactcgtcgatcacagctgcgtaattctgctgcgctttctctctcaccgggtcgcgcacattttgactcattctttcgcgtcgcgagcggcggggaacccaaaatatgaaagtttaattaacaaacgtttatggacatgtcccccccccttcccaaattgggcccatcctctcagtattccgtcccccccccccgcctcactcggcactcctcgtccctgtcaaatcgcttctcctcgtcatgtcccattggtcccttcactgtgcatcggcaccctttccctttcggccgtggaaaacatccctcacgcaaatcgccaaatttcctcgtgaactcttcgttcagtgcgtccttcttttcagcaatttctactaaaattatttaataatcaaatgaacaaaaagtgatcggacgaccgttggaaagggcggactcgcgtttgatcaacccattctgaaaaatgatcgaaaatgggccaaattggccaaaattgacccaccaaagaatgaaaattgagcaccatagccaacagaaaaagagcagaaaatggggcaaaagaagacatattttggagactgagcaatctaaataaaatgaaagaataattggggaagattaaaaggcgaattaatgccaaattaacagctgagtaaattgggaaagggaaacattcattaattaatgcccttggggggcaattgaagtgtttgtctaattgggtatttataaacagcggcagagtgaacggctgctgctgacggctcatcccatcacttctctctctctctctcatcagcagcataagcttggccatttgttggtcccctggggctcccccccccccgccgtttgccccctcactttttttttgttcgcatttttctcttgcgatttattgcttttttcccttttatcgaatattttcatttgaaaagtcaaagccaaacgaagtgaattcatttgtaaacaaaattaaaggtgatcgatcgactgatcaaactttgtttttgctcccaatgattcattaaatccgccgatgagtcatcatctctcattgtccgatcatttacttagtttccgatcactccgtcccgtcccatttaagtttaactaaatattggcaaagaaatgattcattccgtccaatttttactttgataaaaatgaaaaataaagaattttgtgatggaatgtgttaaaatgaggaaaagaattgagatgaaatataaaagaaaatgaaatgaataataataataatatataatataaattgccttttgaaaatataaattaaaattcgatttaagaaatggaggcgtaaaaatggggtaaaagtgtcaatgagtcattaatgggttcagtcaatgattctttttatgggatattaaatgcgccattcttccgtctgatttggtattggcactttcttcattttctctattcattgctcgttgttctgcctgtacatatgctgttgaacattcctaaaatgttaaaatccatcgacaaccaattgcctttttttcttttacctcaaccgttgttccaattcgcgagtggccgaaaaattactgaaaaaaaagaaatttaaatttggtcaatgggctgtttttgcctgtcggccccgcccgggctctgatcggattcagactcggcaccagcagggctccgactccccgggggcaccaacgcattgttcagttggacagtcgacgaatcgcttccgtcaggcccacccaaaaacatacttcttgcctaaaatggtcacattagtccatttgtcctttctgtcctgctccaacttcttggctttgactccctcccctcaaatgcctcgccgctccacgcggcaaagtgccgccgccagcactttgctcatacggctgttcatcctcgtagtacaagccaatgggaggacggatggagccggcaagggatgacgaatgggaccgatctatggccaagcggggcggggcacggccgtagagaaagttggaggccaacggcgagtcgggctggacggaggagaacacggagggcttctccagggaggacactgcgcaaaggtgggggaagactgatcaaaaagacaaaatgaggaagaatgaggagggggagtgatcagacaaaggaagggcacaaattgtaaatgatggcaaaaagtgatcggatggtaaacgagaaaagggagacaagaaaaaagtgatcgaatcgaaggacataaggaaaaaatgatcggaaagcaaatgggggtcatggatgatcagcagattacataagtgatcaaccaaaacggaagcgaagaattactgaatttggcctcggaggacgacgagcgattgaaacgcaacgaaatcatccaaatgacgacaacgataatgatgagaaggaataccacggaactgaccaagtgacagcacatttaccaaatgataaaacccaaactcacacaatggaacccgtccaataagccaatttttgcgatcgcggcttaaaggaaaaagcattgaaatcaaaacaaaaccaacaaaaaacacctgaaaacgaatttcgcagcgttcgcccgagaagttctccttgcattggcactccacgtgacccaagcgattcttacggcaaatgccatcgttaaggcagaagttcagacaagcatctgcaattggacaaatggtattcaggccgttccatggcactgattgacccgtgcaattgactccgttcccacggaagcccgggttgcacacacagcgccaactcggcacgtcgccgtcgtccggcaaatcaaagcattgggcattccatgagcagttgtcctg

SEQ ID NO: 9293 - DNA, 4527 bp, Heterodera glycines
  misc_feature (2115)..(2115): n is a, c, g, or t
  misc_feature (4460)..(4460): n is a, c, g, or t
aatccattttagaattttatttttgcttgctgtatgcatgaccaattaaaaaaaaattatgaaataaaatcttttttaatcttatttcattacaaaaaattcattaaatacaaaaatacaataaatatcttttctaaaaaatttaatttttgtctaatactttttgagtaacttgaattttcttgtagtggacccgaacctgatgtttaaaaaactgacaagagcactaccgataaaccactggacatttcgaagagaatcacataattatttaatttctttattcattaaaaaagttaggaatgtaataattagggttgcgttttcaggttttaactgaattttttgctctattgatttgaagaagagctcaaaaaacgggtcggggtcactttggcgcgggtcattttggcgccgcggactttaaagtgttataactttttcttatccaaccaaataaaataatcttgataccattaaataggcctaagtgttgtttattagcgtgcaaaatattagaaaaatacatttggttgacaaaagatatagcgtgcgggcgccaaaatggccagaaaaagtcagttttttgaggttttttggccataactttttgtgtatcaattaaattttttgaaattatgcaggctattagggactatcaagcgctttaaaatgatatcaagcttatttaatttgaatgcaaaataaaaatattatagcgtttggcgccaaaatggctggcgccaaagtggccggttccccaaaaaacgcatttctgcattaaaaattttattctgatgtcattatcggtcactagaaataattattttggcgacttcgtcactaaattagttaaaaatcactattttggcgttttgtcactatttttcactatttcgacattttttgtaaaattccttaacaaaaatgcaataaaacaaaaaaaatctacacctctaagaatcgacccaaaaaaatttcaaaaaaatacacccctaagaatcaagctaaaatttttcaaaatatactccaatgaactgaaaaaaaatttctcaaaaatttactttcttgatttttaattttaaaaacttttttaaagtaactattttgggttttttgcgcttaaaatcccagtgctagtcatttgcaacagcaaacagtgaataaaaattatttttgctcaatttttggctgaaaattatgtcactattcgtcactatttcggactttttgccactattatgtcactattttggcatttttactcacaattttagttaactatttcaagatttttcgtcactaaaaatcgcaaccctagtcataactctgcactcactcatttcgcagaaaaaacatttttcttaagaacccatggctcctctatccacccaccaaatttcattcggaaatcccacggacacatgaggacctttctttgttagtgaattacatttcattcaagtcgcgtccctgattctcaatttggtgctgttatacaaatatggggtgctgaaattctaatcttttcttgttcaactgaaggagtatctggtcgcggtgatccaattgattttttattaacacgaaaaattatcctagtgtgaaatttcacttttttcatggcttaatcgggcatacatggataaggtacgaaatacccccccccccctcagaggccaaaatttttacgaaattgaaaaaacgctcaaaaaatgtttctgacgacctttttgcttttccagtccagattttttgcctttatttatcacatttttgcggtgttttttcaaaaaaaattttcaaatttcagtgcaatttgttaacatttgttgtaaaaaactaactttacgaaataggaaatcgaaattcaatttcgtaaaaaaattacgaaataggaaaagatgaaatagaatttcgtgaaaattttaacgaactgcaattcaaaatcgtaaaaattttgggtttttggcacaaaattttaattatatttttcaatttcgtaaaaatttcccatctttaccagtgctttttaggtttttgccgaaaattttacgaaattgcctcggactcccgtacgatttacgaaattgaccccccccccccctgtccacnctagcgtatgttctgataggcacaatgatcagaaacatgatcaatgatgagctgttcagaagaagtctctctgtattatataggaacggggaaggcaataaaatcacaaaagatggcactaaatgttttaggaaagggcaaagtaatttaatataattttcctacttttacccaagatggataaacttggcacggagaccaaccgcttgtgccaactgtacccggaaaagtcggaagatattgccgcgaaggtggacgaggcacgcgaccgatgggtggcgctgaaacagcgcggaacagcgcaagcggggccttgaccgatcgtacaaccggcaccgcttcatggccgactaccgcgagttggtcgagtggaccaagggcattcaggtgatcggatacaattaattccatgtcaaattggagtttacccagggttttatggattttggataaaaaattgcataatgtaaatatttatttctaacttttttgtaacctcatccctacaaaaatataaaaattaattttacttcatctttactttgtcaaccaaatctaacattattcacagatttttgttccattccagttgcacaaattggttgaattttttgggtcagatttttgcggccaccagccacaaaacaaatcgaatagttgatagagattggaccggtcggttttcgttatttttcgattttcggtttttgatcgaaaaaaaatcgaccgagaaatttttgagttttttgctttcggttttttgaccgaaaccgttcgaccgaatttatcaaaaaaccgaaacaaccgaccgacttatcaaaaatcgaaaaaaacaaacaaatggcgaattggagcgacataacctgttaataacaatattttagtgcttttttgtgctcatttaaatttttcttcgattttatcgattccgcttttttaaccaaaatcgttcgaccgaccctcttgtccgttctctacaaatcaagcattttatttaactttaaatgaaattatcccataactcacaaaaatttggaaaatttttccaacttaataaatcatatattagcatttattcgttttaatgtgcacaaataagcatcgcaactaaaattaatgtcaatcatggccttgacattttttgcgaactgatcagtcatttaccaatcgctgattaatcatccaaacacaccaattccttcccgcccggccccgctctatcatttctgcgagaataatatataatagaataaatatcttattatatgaaacgaagttgacgggactttagtaccaatctaaaataattagcttgtataaaaataaagaattattaataatttatttataaatttggcgtttgattgccattattttctggtttcctagggcctgattttctatatcacttaatggatttttgctaactcaacgataaattttgatacattgatttagaattatgtcaaacaaattaattcagtttttcgtttcgctcttcatatctttggctgcatgcgggcacgtaccgccaccaaatcactggagtgcatcgttggacaagccaaagtcaggagctttaccaaaatggacactgaatcgtcaggaggaggaggatttcaacgaagactttggtaaaaaatttgtcttcgttagctatagattttaaatatctaaatgtgatttaatcatttaataaacattaatgacgagcttaataacttatttcagggcgagaaactcaatgtggcctaaccaagcaccactttcaatatcgtgttagtatttaaataaatatatttttaaatgaaaaatgaaaattaataatttttcttctttgcgttttatatatttttttagattgttaatcattgtttatctataaacttgataattttaaaatattatttattactaattatatttaagtcactttttatcgataatgatttttattttttccgacatacagattgaacatggacaaattgcaccagataacgactggccatgggcagtatcagttaggcttgagtgtgaaacgaaacaaagtgcaaagcgagaggtgcttgggatttgttctggcgttctaataggcgcaaaatggattttgactgctgcacattgtctatttgcaactgatgatattttgcgctgcaaaggagtcgaacttaatggactaatcccagaaaagggtgcacggtaagtaacagattttacttagtcaaattatcttgattttccaaaaaagacaaaagaaatattttatccatttatgtgtgaaattttcaagctaattccgtttgaacaaaatttttgtggtttgcctttagatttcacataanatattgtagcaagttttatattataataaataataattattaagttacctggtttttgcgcatatgt

SEQ ID NO: 9294 - DNA, 1450 bp, Heterodera glycines
  misc_feature (10)..(11): n is a, c, g, or t
atgcctgcannggtcttataggatttgtatatgtatatatacatcattgtgtaaataatcatttaatacatctaactatagttatgactatttgtataatgaatatagaatacttcattataccttttttatcgatgctaaaccatattactgcagctagcttccctggtgtttgcccttactgtaactggatcgaagagaagacgaaaggcgaagtcaaatgcaatggaatcgcccattaatgcggttgctttcgcgtggatgtttacgatcatttggacaacactgacgaaaaacataaaagttgtgaaaattgaagttaaaatgttgataaactaattattaaaggacgctttttattttggaattcctagccttaagttttaaactgataaaaatttttttaaaagaaaagatatttgaagtaaaaaatttttcgaaaagtctaaacaaattttttggaaacatgttaaaaatgtgataaaactacaaatattttttatgtaccgaacatccaaattattttatagatgctgaaaagccattctaatccgaaaattagcgtagaaaatttattaaaaataatttatatttatttttttacccaacatttttttattgaaaaatttcgtgcttcgaaattcgaaaacttcgcgtttttcgcttcgaatttctgttgccatctaaaatgacctcctgtctcatttgcaattttgacttcttttttaataatacaaagcaaatcccttattctaataaattccagccattttttcctagttaataaactgtttttattattatttatttatttttggtcgagactttcaccaacgactcccatttttgacccatataatttttcccgccggcggtggtattcgcgcgcgggcggcggttcatttttagtgcagcgaattgcaatgcctaaaaacagtttgcctgccttttagtaaatgataaaattgcttggattattgagcccccttggcaatattcgagaattctcgaataatccgaaacccgataattagcaaaaatgtttgagtgctagaaaaaaaattactttctgttgagtcatcggaaaaaatgactatcaaggaagtacactaaacctagtaaaaaacgggtttctcttcgcgatgagttgaaagatccgagcatctattttggtaaacaaaaaaaacggtcttcctaactgtgagtcgtgtgcccaaatgaagggcctcaaaaatactggctttcagtttttcctgaaattatttcagtctcagtttgcctattccgagtgaaagcatttcccgagagcatcccccctctccctcttagccctttcctacaacggcagtccccaaacatcttatagtccctgcttttctcgctctcatccgttctttaaccggctcggcgacgtcgccgcattcgtcgacgaccttccccccacctcctc

SEQ ID NO: 9295 - DNA, 2985 bp, Heterodera glycines
cggcttttgcagttcttcgtatgccttttgcgcataataagtcatcaaagtcggccatgcggtttccttgacatttaatcattaattaatgaaagatttttcgcattttcaaaagaactataaaaatcgtagttgtatattttgatatttattacgagtttttgatcactataaattcgcattccggtggtaatgttgacgccgaaggctttaagatccgataactcatccaaagtcccttttttgtcgccgttgtgcgaaacattggcacacaatgagccgactgagatctgttttcaaataaagaattaataatataataattttttaaataaagaggaccaattttaatgagtccaattcaatcattaaaatcaattcatacaactcttcacgaatgttttcgttcgcatcagaaatttccttcaaaatgcatctaaaagataaaattttggcgctgccacacaattattaggttttttgttattaataaaattgtaaataaaagtttcaatttatcaaatttttaacttaggtaaaattaaccattcttacctgccatgatttcgctgataaagaccaattttaagcgagtgatgcaaatcgacaattgcactctcaagtgcaaagcttggaccatatattttatctgaattaattaagtattacaaataaaaataattgagactttttaataaatattaattatttttaattaaattaaattcagcaatgggctatgtttaaaaaaatatttttaagtacttttaactgaatccaacaatgagatatttttggccaatgatagctgatgaataatttctaaaatcaaatttaaacaacaaaaaatgaagaattattatactccttcgaaagtcggcgtatcgacgttgagttaggtgaacaaagtttgttgagtttttgtcaattaagtcaaaaattttgctggctttggcaaaggtgtctgcttcttcctgtgtcggcttaacgcaattgaggttcactcgtttgttgagccactgaatttaaatatatattagtgtaactaaaaaatatttatattttttaaaattatatttttatcgcatagttacaagcagcgaattgtgtggagataaatggtacgtacaaaaatggacaaattgttttcggtagagagtccggtttcggcttgggtcggtaatttttttgtatacacgcaaaataatgtcaagcggatgggtaatcatcttaacatatttataaaatatatttaaatatttattactcatagtatacacctgatcgtattcaactagggccatatgctcaatcaatttgttaccaaggtgttcaattcgttggtccagcccattgaactgcttaatcatggtgacgtgcaacaaattcaatgcctgtagctcttcactttctggctgaaaaataggaggaagggattattaagaagtaaggcttttcgacaaaaatttggtgtaagtcataagcataaatttattgcctttttttcaaaatggaaaacaaacaaattttggagcggtttttaatataattttctgtatgcatttttgaagaatggtgatttgaccgaacctcaaaagccttctgcatggccaaagctgcaaaggtcccaacgggacccgccaatgaaccaatcttggcatgctcagggatatcatttttagttgttctccaacacttccggcgggcacaatgatgttggaaaatgcctcaacataatcctttacatcctcaagcactacaaattattaatttatttattttagtaatttaaatataaaatttgtttttacctccacatttaaccgaaattgggccaaatgctaatgcggcaaatgccactgcaacaattaatatcataagccaccgtcgcattgccaactaaacagaacaagtaaagaatattctaattggtaagatggatttggttatgaaactccctcaatttgtttataaagccgaatgaggaagagcaactgataaaaattataaatttgtaagtgccaatcaaattaacgattgactgaaaaaaaattattatttcagaattacttcagttcaaatctaattatttttttaacaatgaagtaaaaataaataaaattaggctttaaaatattttacatgtttaaaagcgataaaaactcctaaaaaagcgtaaattcttaaattaatccacatttatatttttgtttccatttaaaatgtaaatgaatgctttattacgaataatatttcaaatataaagtctaaatattaattcctaaaaaattctttattttgcccttttcggaaaatccatagagtctttttcgacaaatattggtagcagcgaggaaaagcaattgttggaatgcttttccaatttgtcatgcagcgaagaaagctttgactaatccctccactcttttgagttaatacaaaagccaatcaatacacttggcaatttgttaaattgttaataattaaaagagacataatttaataattatcaaaattcttacaacaatttattaaaactaactttcctaataaaccaaactttaaaaattaaaatgtaatataaggattttcagaaaatttttctcatttactttccggaaccaaaaataagcctcaagaagatgaagatcactctcgatactctctgatgtcattaataaaagtgagaaaaatcgattgagtaaaaaatgctttataaaaaaggaaaattaaaaaagtaacacaacaaaaatgattaactgaaatcgaataaatttttatccgttaatggtggaaacatcgaatttgaaatttgggccgaaattggccaccgccaaatcgccagagttttgcagggaaatgcatggaaataatggcggatcatcgttagaataaggggcggacaaatcggcggtctctaaaaatgaatctacaatttttaaaaaaaatatattttttttccaaccccaaacgttgtccattttt

SEQ ID NO: 9296 - DNA, 2557 bp, Heterodera glycines
ttctgcgaacggcgcctttttgtaggcaaatccgacgagggcaaagctgaagatggcaaacacaaaatttaaaaattgttcatttaaacaattgtgtgttagtgctaaaagaggtaacaataaatggctgccaaaatttggatctctaacattttaaacgattttttgtagaatttttaaaaattttaggtaattttgccggcggtgccagtgacgataggcaccgctgttgagttttttaaaatttcattactttaaaaaacttcgataaaagtgaagaatttttcaggggcgatctttttataaaaattttattaaacaaaacccaaaaatattttaaaaaaatttctcggtgaaagtctttcaacttcggtagacttatcccctccatttttgggactccattcaatttgaataattaaaaattcaaaataataattattaagtaataatatgttttgtgttaagggtccgtcttacttttgcacaacagccagctttatttcgaagtagaatgtgctttgttctgcgaacaccgaacgccaccctttatggaaaataaattattataaaaggtgcgcttatttagagaacaaatttggcgacttttttgtgccgtcaggcacagttggaagcaaacattttttataatgttgagaaattatgcaaaatttaaaaaaaattccttccttacgcacgcctctcccttcttcataccccccccccccccacctaaacgaagttccccgaccctctggccaaactttgccaattccgtctggccaattctgtcgcagccaaacccaacaaatttggtgtattggctgggacagattgacttccaccgtctctggcaccctaacacatgaacgaactcataatttgggatagaccccctcccctaccccatttcctggcatagtcaaaccgaattatttaatagggaatttaataaatcatttttaataaataaatttctaccattattttctccattataaatgaccatcaaaccgtcgtcatcaaagatttgaatttgcttgtgacaataagtgtcatcccaacaatttttgtgtgggttcaaaagcaccttaaaaagtgataaaagcatttggcatgacgaggaaacgtggcaaaattcgagctttgtgattggcatggaacaaaagtgttgagaaactgaccaaatttgttttcaaaataaaaaaataactcaattttaattaagcaccaacaaagaattttctgctggacggaactgataaagccgaaattcgggaccattgccctcataaccaattataattaattataatagtttaattatttaattaaaagaatttttacttcaacagcggacggatcaaatttaaaattgggcccaaaatttgccacaattttgtcatttgattcgcacaaagaaacacaaggaaacagtgggtcatctgcagaagaagccacggcgaacattttggttgtgtctgacagtaaattaatttataaatttaaatttattaatttttgccaacccaatcgaagtccatttttggttaaaatgatccgtccggtggccaaattgacgccgcatccgaccgtgtccccctccgaaaatcccagctttccacttacgcagaaaccgttaacccaaaaggtgccatcgctttggtatccgtaactgttggaatgttttcccgccaatttgtccgatggcattgctttggtggcgaggccaaacgaagcaaaacgaaaagcataacggattaattaattagccaattaatgaattaattgagaattgcacctttccagattaatgaacttgatttcgtaataaaaaatgccactgtcactgttcggaatgggaaattgtgcgagcaccgatcgaattcgttgacctaatttataaatacataaataacttctaaataattaacttttaaatgaattaaatgcaaaatttgatacaattaaatttaataaaattcatagaatttgcctctttcattccctttatgctgaacagtcaaacattcagggccaaaaatttggatgtcaccatgacaatcattggcattccaacaattttgtggagggtttgaaaatttctgtaaatttttattttaaaatttggctaattttcacacctcggcaattttcgggcgaaaatcagaatggacagcattcagcagctcttaacaacaattcgattaagcaattttaattttaagttcttaccttttccaaatcgatccttcaaaactccaacaaaattttcaaattgtttgaacctcgccacagaattttcaattccgacaaaattgtcaaaaatttttgctaactaaaaaagggggtcattcaagtgcatttttaaaagattttaaattttatcggatgaaattatttcacctcgtcaattttcgccataaagtctgtctgttgatgcaaaagctgatcaactacgcgaaaaaaaaatgttaattaattaattatgctaattaattaatgatttggcaaattggcacaccaagacaattttccatggtgacaaatttggcac

SEQ ID NO: 9297 - DNA, 1603 bp, Heterodera glycines
atttggtgttggacgaggcggacaaactgctgaaggcgagaaatccgaaaagaccgaaaacaataataaccattaaaagtatccccttaagaatgaggatttcctgaattgtgtccaactgatcaaaaaccatcccaaactcgtgcgtctgtttaaattagtcaccacaatagccatttgacttttaattttcgaaatcttctgtttttactcccccctccctttctttattttgtcagtgcccttctcaccgttgtctgatgttttctgcgacttttgaatctggcgctcagaaattggcgcttcaatttttccgtgatgactttttctttgtcaacatcggacgactgaacacggccaccgatttggttgtccaggagttcaagaaggtctcatggggaaattaggaaatttgaaaaaataataatgccaaccgaatttaaggtgcccaaattcaataagtctgacactcttgtggagtttcttttgggtgagaatggtgccggtcggcgggaattggaacgaacgaccgacggaggttatttataaattaaaacgaaataagtattaaaaagacgaagcgataatgcccaaaatcataaatttcacaataaattctcatctttattaaatatttggcagaatattggaagacgcggaaaacgcttgtttttgtggagcgaaaacggagctcggacatgttggcaattgcacttcgacagaacaacatcagggcgttgagcatcaacaggtcgggaaagagttcgaccatttcccgattctccctttgtttcagtgaccgaactctgaagcagcgcctgggcgctgccgaagactttgcctcggggaaaattcttgttctggttgccactgatgttgctgctcgaggactcgtaagcattgcttggagttgtcctcccattttgcttattttctttcagaattttccgggagttgaaacggtgatcaatgttgatctgccggaacaggacgcctatgaacgggtgaggagagggggcgggaatctcccagaagagcaaatttaacagttcgatggggaaactttggatatgtccaagtttcgtttcgaacgtccatttctttttatatcttttaacaattgttctctttcagtacattcatcgcattggtcgtaccggtgcgtcagccattcccccccccccccattttccccgttaattcccatctttaggccgtgtgggaaatgccggccacgcaatttcatattttgacccggacagtcccagcgaccttcaaaatgccggcgaatacgttaaggtggtgccgttttgctttagttttgttttattttatgtttccattttcagattttggagaccactggtcacgaattgcccacttttttgcttgaaattgcgaaagggcaaaagtgagcgatcggaagcggctaacagacaaagcgaacaattggattgatgctaacttaactcatttttgttgtttgttttttggtctcattttcaacttttaatatttcaattgttatcgattatccgtaatgccttccttcaactcacaaaatcagcttttcgccttcattttctcattattttgtctctct

SEQ ID NO: 9298 - DNA, 2534 bp, Heterodera glycines
cgggggagggaaaagctgaattggactcattcgatgataaagcgacggaagattcccccgggggggggtggtccttcgcccctccgtcgtcacttatatggccattgcaactcgtgggggggggggggcgcctgcgccctctttcccgtcggaagcgggcgaattcttacgcgaaggtgcgcgcatttgctggaagaggccaaagggcaaggggagagaagcgattgggcgggggggggcgaaagcggggaaaacaccccggaagaacttttactttccattccttccacaattcccctcggggctcctttctccaattatattcgttcttccgtcttttctgctcttccattaatttctcccgcaacaaaacaacaacagccgaacaattcattcaatggaagctcgggtcaaagcggggtttcgggagttgtcgctctccgacgaatgttttgtcggtcgagagtgccaaatcgggactgagtcggccatgcccttggccacttcccctttttcgggagaatgccttcctcagccctttccccgcttgactccccgtacgccccaacagcggccaaaatgccgatgccgaattgatctttcttcgcctgatacgctcgaacgagacttttacgcatggcttaaagtcagtgaagcattgggaatgccttggccaatggcgtgccttttcgtctcttagggttctgagccggccagtggcactgtgccgtgtctgttcgcttcgacctccgccgtccattcggactttaggacgaggcaacagattcaagccgcacctccctttttaacattggaccctctcgccgacctaaaaagtcccccgggccgttgggatgcgctcggctcatccgcctcttctgactgtctgtcgtcgcactcctccgtcagcccggggcactgctcctcagccatctcctcgttctgctccgcctcgtcgtcctccgcttcctctatcggtccctttacgccgtgttcgctggcgccacctttcccgcaccattccctcccgcccaaccaccaaatgccgctgcacccattattccagcagcagcactaccgtttgatggtcactccctcctgtgctgatcagctacagcaacacaaatactcctcgaagatggcatcctcgtcatcgcaaaatgtcaacgccaaagttggcccaattttggggacgaggatgagaagaaagcgcaatgttgacaagggtaatgcgcgatggagggcgtgctgagaaatgcaaagcaattcacacaattgattcagcttccggccgcggcacaaatctgtacggacgctcgtattgtccaggttcacgaccaacggaaaggcatgaaaatcacttcgtaatttgaatgtcaggtcgacctctgagcatggaggagagggcccaaatcattcatctgttccacgggggcatgaaggtgaatgccatctccaaacagttgtgcatttcgcacggatgcgtctccaaaatcatcaccaggtcctccccccccccatttccatcggatggcgattcgatattcattttccaggttccgtgagacgggcaatttgatgccatcttcgcattcggaatgccgaagaaggaaacgccaacaacagcaacagaaaaatcatctgacaaatgggctaacggacatcggaggatgacggaaagaccaatcaatcagtagaattttacgcaaaattgtgatcaaattccaaaaatgggtaaaagaatttaaaaggctattggtaaatgaatctgaatcaatcgcatggcaaaattattttagcggaacaatcatttaaaatgccataataatttagaaaagtgattgtcaattaatataatttcattgatcacaatgtgtttgctcttctgctgctgccctattcctgctgataagagaagatcggctgtccgtccccctggtgcgaatgcgttttcgtcctcctcaattggtccgccacttcgtccctttctctttccacttggccaattttggcttcgaattcgctcattttgcgctctttgtccccaatttgatcaacgagttctttgatctgtgcttcttcgctgttctccgtctttttacatcattccctcccccttcttagttttcccccgatccgtccccccccccctcttttttaccttttcctccctcctcccaatttccgattcggcccctttcagcttttccgtcatgcttcggcattcctcttccagctgatcttttctgaatggtcctccgattcgattcgtcgtcctcccctctcttcccatgtcaactcacttttggtacagtcggccattgtcctccatcacttctctttgaattcggtctctctccctaaacctccggtcgaattccttcgcttctccgttcacttgctcctccaaaatcagtgcctttttcgtcaggtccgccttttctctttcgcactgtctcaattgtgccgacaattctttcattttggcgttgaacgggtcatttctgtgaccaagaggaattcgatgacaaaaa

SEQ ID NO: 9299 - DNA, 996 bp, Heterodera glycines
ccattcggtctctctctccgtccattcccatttcttctcctccattctttccaatttggtccttatcccttccacttccgtcctcagtccctcaatgattgcgtctttgccggcacaaatccgtgccaaatccgcaaagtcgcgacccaaaccccggttcaattcggcactcgatgaacttggccatcgtctgctgagtgtgtcgcttccctgtggtaagataccgtacgcctttcgccaaccgtatgttcgatcacctttctgtgtgtgcctaactcctctttctctcttctgccccattcttcctcgcttcccacagactcttttcgtcgctctttttccctgtcctctgctttccctgttgtattttgctgttccctctttctctgcccttccaaaatccacctgctgctgtcccattcgctccgttcatcatttgctgcaccaaattcacagaccgttcgaattgtttcgctgcttgctcatagctgccgaatgggaaagggttatgccgggcccctgaacaaatggaagaagcattatttcaatttgcaacccattttaattctaagcattcgatcagtgctgctgatcaccagtgatcagcagatggtccgtttcgcccacctcccaactccacaaaatattcccccgtgccgttccatcctccgatcggtggaaaaaagcgtcgtccgtcgaatttgagcatcacacgacaatcgccactttcctttgtttttgaccggtaataaacgccagtagaaagaggaaaagcggactgaacggaggagaggagaagcggaccatcgacgctttccaacgcgacttccgcgggttcgacactcagccggacattttggagaggcaaaacttggcaaatagagtgatgatgtccgagagtctcggttcgactcgagaaaagtctcgggtttttcgtttcggtctcttcttggtctccgagactcgacgaactttgacactaacactccccccccc

SEQ ID NO: 9300 - DNA, 3670 bp, Heterodera glycines
  misc_feature (9)..(9): n is a, c, g, or t
aattaattntcgagttaaatgggtttgaattggttttttcgcgcgttattattttatttttttaaacgttaattaaaagtcaaacgggaaatcattaaccaagactgaaccgtttcgtgttcacttttattggccaaagctttactcacattaacaaaaatttctttagataattattttttgctttttttgaaacttcgattgcattgattgtgaaccgtgtcccttaaattcctttcttcctcgacgtgtctcgcgcgagttcggctaaaaataccgaaaaagctgaatatcaaagagcaattcaaaacagtggcaaagacctttctggtgagtgcataggttcatgacaatcaatttacacattcaatttgcaatatttttgctaaccggcgccgcagcgggaaaaaatttttaaaattcctttgtaatctattaaaaagtttaatgccgaaaaagaatttttttcaatttgaactgtatttttttaattatgcgtataactttttcaaaatttagatttaagcttagattttcgaatataaatttccagctataacggccgccgaaattttttaaatagtccatctcaaagtttgatttggcgatttttttgtcattttaggtgaccgggaataaaatttttaaacaataattgaggttaaacggcgatgatgggcctattgagaaacagtcaaattttataaaatttgtttaaaaatattagcaaaatttttcggaaagagcaacctcagacaggtcagtcccaccattgggactgaacttcgtaaaggtatgcaaaagtgaatatgaattgaactgatggcatcttgtttttgttgcctggtgcctctacacttttcatgacaaatttactgaataactcgaaacatcctattgttctggtatataaatgccattttccccatggaaacgaaaaaaacgcttcgaccattcaaaaaaaaaatttttttttttttttgcttaatcaaatttttttgcggcatttttcccaaaaaatcgtttggagaatggggggggggcggcggtgccgataggcgccttcgggaaaatttagaaaaattagatgtactttaacagattttcactaaaactaaaaatatctataattttctaagatttacgaatccaaattcttaaatcactttacgttttcttttctttatttatggtttcgtttccaaaattaatctcttaatgtttttctccatttaatattcccttcgaattgttcgcttcgtccatttcatttcatccctttgggtggtatcccttccctttccaaattcttccgcttgaatttgttatgtcttcggcgtggggtggaggactaagaatgtgtggcgtttcttccacttgcaaaattaattttaatttatcctccacaagtgaatataaaagcggggaggcgggggagaataatgaaagtgttgagggggggggggggtgagttcggaatgaatatatattggtgtagaaataatttttattctaccagttatcattgcgatttaaacattatttcttctcaacactttacatattacctcggcaaaatctttgacaactttccgtcttaaattttgtgtgcagcacatccatgaaacatcactttcaaggcgataacatgcagtttcatgcggacagctggtcttaaacgaaaatctcatcaagtttcggggccatgtcgtttcggggatttcgatgcagacaattttgaaattttatggcataatatcactttttttataagaaaattatgcgcaaaatttgcagattttttcggcgaaaacttttaacaaattttggcaccgcaacggccctggtgccgacccccaagttgcattccgctctcgcaaaaatcataaaaaaagagattaaacattttcataatccaccatgcttttctttttctatccctggattccttctgctccattccacccccccccctactcacatgacaggcgaatgatttaccaaaattgtaaaaaaatcctccgattgctccaactccaccagcaatcaatgatccgactgccgcacccactagcggagcggctgccaggccaaggccaggtaaaatgattgtggcaactaaggcaccaaatcctgcggctcctcctgcgactgtgcccatatcgcttgctattccttcaatgttttccgatattgctcgtctccgtccgtcataagccaccaaacgatggtccagctccaaagtccagtagccgtattcctaaaaggatcggagatgctcgggtcagcacaccgatccatgctttaacggatatatattcggatatataactgaagctcaaattgattcctatgcataacaatcatgatcaaaaatgatccaacgagatggatctttgttcctggtccgcagaacaataaatcaatatatctacctccacagtgatgccaaggatttttggctttattaaattaaatgcctttaaaaaaacttccttgtctaaatattttgggtttctataaatgaaatagtacggtttttgtaagaaatttcaacaaattttctttttaaagttgcaaatgatttttgttttaatattgttttattcagtacatcgaaaagatgtgaaatttttgtcaattcctagggattttaaatctgaaatacgactaatacagattttaacgcatttttcgatccacgtattagtgatccttggatccatgcattgtatgagcccgaggatccaattctcaactgcagatgaataggagggagattcaggacaatgaaaagcaatgggatgcagacgaggagagcttggcgaacagcaaccattttcaagcagtacaacgaaaagggttcgatctaaaattttccaactcagaaaattcaattgaaaaaatggattttaataattcagaagatttatgaaaaataacagcatttcaggtggaaagaaattattaaaatcttttcgcaaaatatttttcattttcagtaattttgtggtattttattaacaaatttagcaatttttgaattaagaaatgagataatcaagacaaaatgttaacaattattcccaaaaggaacctttctgaaaaaccggaccatataaaaacgatggtataaagaaaaaacgaattgtatataataaaaaatgcaatgtgtaaaaacaaaaaataataatttagactttatccattaacggtaatgaaaaaatatacaaaaaatgtgttcttcgtaaatcgttttgaaaatgaaatggatgtgcttctgctgtgttctgccgctgattgctgctgatggcttccaatgatgacgaagccgacaattttatttgggattacaaatggaacgacataatgaaaacgaaagctaatcatcattctctctcgaaaaaatcataagcactgctgctatactgcataattaagctggaattatcaaaattggggaaatttattcaacacaaaaataaaaaaacacattttttagcaaaaaaaaaaataaatttgtaggaaaattttttttcaaaaaagaagaaaagaaatgtttaaaatttagtcacttttaggatttgtgataattgataataaaaatggttcggaattatgcatatttttcctgcactgcaacagccagcagaaattcacaaaaaaatat

SEQ ID NO: 9301 - DNA, 1729 bp, Heterodera glycines
tgggtgtcaattagtctgctaattactcaattagcaggccgatcagtggttaattgcttttgcttattagaagccgccgttctcttacatttggctcacttacatggccatccaaaacagtgaggacaaaatgttgccgttgacagacatttacaatttcatcatgaatcgttttccgttttatcggcagaatacgcggcgatggcaggcaagtggcgatggacaaagggcaaaatgaaagaaatttgggttaattagtgtctaatttgagtacactgtgagcatggtcaattaagcagttcgcttttcgttcagaattcccttcgccacaatttgtctttcaatgattgcttcatcaaagtgccccgacgttcggataaaccgggcaaagtgcgttttttgagttttattttacattcttttgatgccatttcagtgttttctccaatgttttcctttctttcccctaagggttcatgttgggccattcacccaaaagcgattaaaatgttcgaaaacggaagttgccttaggcgtcaaaagcgattcaaagtgagcatgatttaatgatttaagtgagtttcgtttttgaactgtttcagctcgacccattcgcacccggacgaatgtcaaagcgaaaaaaaagcgaaggaggggagagaatggcacggccggagggacgagggagccgaatggcaccaggggaaagtgggggagaggagcggacagaaggggagacgagcgacgcatcagcgtacggggaggaggggagccaaagcgaacagcaaatggcacttgcaatgctggccatcaattcggcacttcaacacttcggagaggtgggccatctcacttaattaagtcggcactcattcgttagaaggtcggagggtggtcctttattttgctctgctcccgatccgtaaagggattgccatgggttgttaatgcaactccttcccgccccctccctcccgcgctcctcccattgctcttccttttcctttagctttgtgctcctcccattccgtcgcttcttcctttgtttgttccgccgcttttccctccgccgcccgctgtttccgattctccgcttcttctcaacttggccctgtgttattccacttgcgccgatgttaagctccctcccgctcttccccaactgttggccctttccctgccgtcccaaaggggccgagcagtgcttcgccctccccctcctccgattgtgccccttccgtttggcaatgccttcgccttccctccgccctcttttccttcctccccctccttttcttcctcctcctcttccaccttttccatcacttcgctgttggcgcaatgacaaaaaaatgcgaccaatgaacggacgcaaatgataaatgaaatgagcattaacggggagcaaaactgaccaatttattgtagaaaagatttgctgtatttaatgtgatagttcgcaattgcatttgatttgtcctttttactttgctttttgattttaaattcaggtttctccccttcccctccctctctctcactctttctccatcttatctttccctcctttttttctcttcgtttctctcctttcttacacactttctttcctcgcatctttttatgttctttaagccccattattattgttcatccccttaagcaatatgtagacaattattctctttgtccccctaggggaaatcacccaaaatccacccatttcccg

SEQ ID NO: 9302 - DNA, 5018 bp, Heterodera glycines
aaaaaaaatgaattgtattaaaggtaaaaacccacagcacaatccgtagccgctggcaaaatcccaccacgctttgaagcacatctcgtcttgtttacagaacagcgcctttttcttgctgccgtcgcttctgttcactcgatccaacagacaatctgttggcaattaatcaattagtcgttgctaattacccaattagtcactgctaattgcccaattaacacaaatcccaacttattcatttgaattagaaacttacgctgatttcttggccttagtccgtttgggcatgttctgctggtgtgtttagacggaccttggagtgatcgaattcgtgtctttttttgttgctaattcacttacaacaccaccacccggtgggcgcccgaccgtggcaaataattgcactttttgtttgttgggcagtgcttcttcgttttgtcgcatgcttaaatggccatttttgttgtgactttaattaaattcaattttccaattaatacaaaatattttttaaattttaattcccaatttaattttccgcttttacttatgtgactgagcgatcggtcagcacatctcgccgtatttcttcgtctgttttggatgattccttcagttgataaaataaaagtaattaaaaattggacggtgaaaagcacagaaaaaaacggaattcgcttcatttggataattaactaattaatggatttaaatttcactttcaaacttaagtatgcacacaattaatccttttgtttgtctaattgcctgaagcgattgacgaaaccaatgaaatggacggacggacggacggacggagagaggggagagacacctgagtaaattgcaacattgaagaaaatgaatggtaaatattcacaaaatgtgttaaatgaaataattagtgagcaacaggaaaagaaaaacaataaatgaccagaaaaagtcgaaaaaggaattcattaaaatatattcaattaaaaaattaaattaaattaatatttatttctttgattatttaatttaaaatgccatttcggtcccaaattatgtgccattcattgcccttattcttcttccacattttgttaacgatttgctctgtttgctctgtccctctcccattaatttttcggcaatttccccatttgcctttgggatggatttgtttagcttttcactaatttcgtcaattttaccaaattcattccaataaatcccaaaattcttaaactaatccctcccaaattttattcttttttttcaacgatgtttcaatttgcgctgtttctgctgttactaattgttgagttcgctgacattgctaatttatttcatttgtctcagttggaaaattccctcgggcaattcccgacgagtagcacaactgagaagacaatcacagaatatgtgccgtggctttaccgattcggtcaaaagctaatgcgtgagtttaagagacaaaaaatttaaaaattaaatttcgatggatcaaaggatttaaatattttcagcgtgccaagacaatattccatcggacgaatgtcagaagcatgaaaatgattgccaagtgattgttggaggggggggggaagcatagaagggatagaagaagcggtcaatggcaactcgtacaaaaggcaactcgtattttacaaaataaagcctaagcctaggcctaacctaagcaattgtacgagttgccctttgagttgccatgacaccgaagaagcgtctgactttccggaccaatgttttaccagttgaaccactgagactgcagtccatcacagaggggggggggactgattagcgagagactaattggccaatcaaagggtgactgatttgcggggaaagaatgggtccatcattttttaagtgcaactttccattccctctttcccaggataccataaagcgccgagagatggcattgttctgttgtggcacctgccgaactttgtatccgaattttttgccaaaacaatcggggagaaaataaggcaaatgcaaaagttgtgaagattatttcaatttttattttcattgcagaggaaacatcagaagcaattacgagaaagagcagataaattaaaatggacaaattttcttttattgttttattcacagggcgacaaaattaacaaagcaaatgaaattttatgataaaatgttacaatttctgggtttttatggtctaatcgcgagaagaacaaatcgaagtgaatgcaaagaaaggaaatgatcagaaaaagccattaacaagaaaaagcgagagataaacaaacacttgcaacaaaacaagaaaattagtgaacttttgataaaataatttctgaaattcaaaaagtttgtcatttcatcatttcttagtgctttttcgcgatttttgagtcatttaattttggggcgccggcgatgccgacagacgccgccgggtaacaattggaaattttggcctttttcaaaattcctattttgtgtctgtttggattaaaaattaatacattgaatgacggtctaactcagttgggcgcactccaacttttgatgctgctgctgcgcattgtgcagaatgtgctaattaattctatggcttatttggccaattgagcgatgaagcgagcaaaaattcctttgattttttgttggcgattgttttgcgtgaaattgtattttgataaatcctccaatgccactcctttgcctgcttcgcttcccttcccttgtccatatggcttttttcccatgctttatcccatgcttttcctccatttccctgtgcctcccctcggggcttacattccatgccctccctcccccaccccacccttctcattcatcccgttttcgcttctctttttgcctctcctataattcgattattctccccgtttatttcccaaaagtgccgcgccgtcgtaaaattccttcgtcacttttttcgccaattgcactgcgcattttcgttaattttttcacgccattctttcgagtttttcaggaatttccgtccttagccgcgaaagtgtgtttaattggattgacgattttagcgaagaacgatgtgcttttgttgtgttgcactgaggcggaatcgtacacagcggcggagcgaaagtatttaagcgacaaaggcaacggacagtcaccgaaagagtgccgaaagaacgaagaaatgtcggcacacgcggcaacgagcggtgccatcgcattcagtggagcaacagtaagttaatggcaaaaaaggagagggagggagtcaaaaatgggaaagtggcagagtgatcagcagtgatcagtgatcagtcactgctcgttaagctcgtcctttgtttgggctctctgttgtcggtgtacaacgaaatgcaaagcatttggggcgaattggacgtggagatgagtcagttcagggtgagagaagagtgttttgtggcaattggattaaaattaaatgtaggcccaagcggacggactttgggacgatttgctgacaatgggcgcgggcacttcctcaaaccgaaagcgacgagcagcgatcgaaagtgcggcggaggacgacaatttgccgaccaatcgaaaccgccgaaatgggtacagcgtcgcttctgctgttcctgcacctccttgcagtgagacagtgaaccaaactcgtaaatgccttaaattcataaagagtgcgaagcgatcaatccatgcccacacggagcggccgggccgccgggagacaatggcccgccgggactggcgggaatcccgggaaaagacggtttttccggggtggcggcgtcggattggcacagtgggccgttgaagggatgctttgtgagttggtcccacttgacgagttcattatattttcttacacaaagtcctattcagaattgtctcgccggtccgcaagggaaccccggcgaggcaggacgacccggggttcgtggaatgtgagtttggaagaagacaacacttttttgattggcgaacattaatttccaaaatgtgtaggcgtggccccaaagggtcgcctgggatgccgggccgtgacggagtgccaggactgcccggaatacaaggggacgaaggcgagcagggcaaggacggattgccaggaaagggcggcgaacacggacaggacgctgaaaagccaatcggacgacgggggccaaagggcgcaccaggagaacatggcaatgaaggaccggtcggaagcccgggcaacccgggacccatcgggaaacagggcccacctggtcaattgggaccgcgtgggttcgaagggcccccgggggcggacggagacgaaggcggacttggcacgggagggaaaatcggaagagacgcggcttattggtcggtttgggcagcaggcacaaattcaagacaaaggataacactaatggcattcattcagtccatgcccgggccgagaagggcacaaaggccgagggggcggcgcagggatcgaacacggaggggcacagagagaaggcgaatacggcggaaacaaaagtggtggcgcatatcgccgaagggtgcactgatcggaaaagcggaggaaaaggacgaagaaacgataaatgatttaaatgatcagtcaaataatcacaaaatccatctaaatcggaaacaaattgcccacccaattagcaattaattcgcttttgaatttctctaatgagttgttctcccctttttcctttctttctttttcctccccggacatttcattcttttaattaaaattaataattttcaatttaaaccatcctaaaataactttgtttttaataaaatattttatttttgtctgctgttttttgatgaatcggtcaaaggcaaaggcgcggagagcagacgcaatgcaaaatgttatttagcaagtgacaaaaaaggaaagaattgggaatggccactccttttgaataaaaactaattcggtggcattttccgggagggggcgggggagggaaaacgaaccggggaaagaaaggaccccgcggggggggggggga

SEQ ID NO: 9303 - DNA, 1307 bp, Heterodera glycines
cgacggaatccaatttattttttcttttaaattccttttcaaaattcactcctttccatcgttttcacagattgcccatttccgactctttcaatgatttgccaaatttttttccctttgcgccgactcactttttttggtcttaagttttcgaattccttaaaattgcttaaatatatatatatatatatattttttttgtcagttggatcatcgttgattaattagcagttgttaattgctccatttaattgtctcccaatggcatttgtccaaaatgccctttccctttgcctcctcctctcttttctcaccagtgtcagtgcgtatccaaccttttatatgatacagagtcttctccagcacccacaaaagtacacatttcgctataattaatcgactaattaattaattgctttaattaagtgccccccagtcgtcggccggcgtttcgtctcttccgcgtcccaaacgcgcgttcgaccgcctcgacgcgtctccgttcgatttcgacgcactttcaaaaaggttcaacgacaacgaagacgacaaccaattgttgtcggccatttcggtgagtgaaatgaacggccaatgcccctaattaatcaactaattgactgaattagccgacttttcagctcgacgcccctttcgtttcctctccgtatatttttaaagcgcttcgaaagcgcgccttcgatcgattggaaaagggcgcctttttttggccaacgaaaacggacatttggccaaacggcgagcgaaaacgttgactcataaaagtgacaaatgaacacttttgtattgtatttgtggccattcacaagtcaaatgattaaatccgttttctacgttacaactttgtgggtcagctgaaaagaatatggaaattgaatcgtatttttcacaaaaatgggttactgtaatggtattttcaagtaccgtagttgcaaaattttttggcttaacgattggtatcattggaaagcacattagctacaaaaaagattaagattgtacgtctaatgaaccacccgaaccaaaaatgatcagaaaaattgatcacatgaaaaaagccagcaaaaattcttaatttaatctttttttggtacagcagctcattttccggacgcaatgtttaattttgaaattattggcacccatatatagtatttaaaggatatatataaaaaacaagtctgagatcacaataaagaacttggaataatttttatcctatccaaaaactcaataacaatgcaataatttgatgaagaattttaaaaggctacatgacatttcgc

SEQ ID NO: 9304 - DNA, 5255 bp, Heterodera glycines
  misc_feature (5190)..(5190): n is a, c, g, or t
  misc_feature (5198)..(5199): n is a, c, g, or t
  misc_feature (5206)..(5206): n is a, c, g, or t
  misc_feature (5208)..(5208): n is a, c, g, or t
  misc_feature (5216)..(5216): n is a, c, g, or t
  misc_feature (5234)..(5234): n is a, c, g, or t
tcgatttttcacaaaaattgggtgttgattatgcagttgtagtcatatattttatttgcaaaaactggtctgttactattatgtgaaaaataattttttaaggttaaggaaccttaatcattttgtacttcactgtgttccatggcctggggacatccaaaaaaatcgtgaaaatatttcgggatttattgatgacgtgttagaactttatgccatcaaaaattgccgaatttattatgtaactgatgaaggcagcaatttatctcatttgggtgatcgagaaagtcatcatttttgccttgcgcatatcatttctacaatttgtcggcggatcactgaaccttatgtcaatgcgaatttaacaaacgaaaaaaagcagattgttaacttgtggaaatggtgaaattggaaaattcgtggattgatgcaagcaatcaagaaagtccttacatttctacattagcttcttcgggtctagcggcatttcacaaaaaatttcggcagctttatgggcaacaacaaccaactttaatcagatgtgcggcttttttggatcctaatatttgtgcagttttgccaaaaatcgttgcgactaacagcaattggggcaaagttgcagaggtaaacgttaagataaatttaaaaatgatggaataattaagatttgtgctaccataaaaacagttgcacaaataagacaccctgattgtaattcattaattcctcggccttgtacttcgccaagtctttctggttttgatcgttctccgagagcagcgattgacattgaaatcgaccgatatatgaatttatgtgacagtctttttatgaaaattgatccattaaaattctggtccgaaaaccagaaatccttgccaattcttgcatctcttgcgcgcgaatttttgggcattcctgcaacatcagtgagctgtgaaagaattttttcccgatttgctgctttaatagttgattttcgtcgaaataaattagacccatttcagatttcccgtcttattactcttcaatccctatttcgtgatacttaaattgtgtatcatttaataaattattttttttgtttgtttgtttttataaatagcttttattaaaaattattcaacgagaataaataaataatggaattcatttttaaatttttaaaaattacgttgatatttaagttgatggcgtaatgtttgttgatttaattaaatatcaacattgaggttgattctccgcaaaaagtaataaaaaggttgatttgtcattctctatatacgcccctaaaaataggaattttcaaaaggctaaaggaggacaacaaaatgccacaatttttaatttaattatccctttttcattcctcgtttatttcttctatcactcatttttggattttcactttttatttcccaataaattttcattttttctattttttgttcctcctttattcttttacagcgaattccaaattgtttcttccatttgttaattatgtctcggctgactccaattttcttacaaatttcggcataattttgttgccattctttttcaacatttttcggcgctaaaatttcatttttggccattttacaccaattttctgatataatgaaatttcataaaatctctttaatttttctaaaatctctttacattgtgaatttattttttttttattgaaatatgtttattattttcgaatgagcgccagtagaaagtaataaaattttatttaatcattaatttaccaattggcaatttttttgtcattaagataaaattattattattatttctttgaaattaaacaggatttccttattttactaagtaaaataatgatttattcagttttttaatcagaaaaaatcatttaaatgcctcaaaaaatgaattgtcatttaattgaagaaaaataaaataaaatcatttcgagacgacaaaatgaaattatttccgctactattattaattatattatttttaattgtaaaaattggatcagaaaagaaaaaattgcaacaaaagtcatttggcgaaatatttggagaaaaatggcaagaaaaagaagaagaaaaacgaaatgaactcaaaaaaagagaaataattggaaaatattataaaataaaagagaaaattaagcaaaaaggaagaaaatactcaacaaaagaatggaataaaattgatggaaaaatagcgaaaaaattggggacaaatagcaattatattcaaaaatggatcaaagaatttggtcttcaaaaaaagaaatgctataaatcaaaaactgatgaagaaaaattagaaattgtgcaaaaattcattgaaatgacaaatgaatataagcaaaaaaaaaaatattcgcacatcgaatgggcaacaaaattatgccgaaattggcaagaaaattggagttagtcaattcacaattaaaaaatgggaagcaacaatttggcatacgctataaaagaataacggagaaagaaaaaatggaaaaaataaaaatttattgggagaataaaaagcaaaaattcaaagatgcatgataaagaatttgccaaaatgatggaaattgatagaacgaccatttcaaaatagaagaaacaatttagaaacaaaaatgattaaaataaaaaatttagggaatttggagaattattttcgaagaacagcagaagaagagtgattattagttggagcatttctttttgaaaatttcgcatgcaaattttaatttttctttattttttattttaattaatttttgaatttctcttaagtttttttgtggaatttagatataaacaaattttgaatacgttttatcaattaattgaattttaaaattcacaaaatacttttaaagtaatattatttccacaccgatattagggatggggagggaacagggctgggcgcaaatgcggattacggaaattgcggggtttttggagttgaggattacggattttttggatttttccgcaattttgatccgtaatttgacttttggattagttttcgagactaacaccttaatttgggtattttgcttagaaaatagcggcattctttttgtcgcacctattcatattttatgaaaattcataaaaccatagccatgggatggtgatgaattccctccaccaaaatgaaaaatgaaaattttccaggaaaaattggcatttttttaatttatcgatttttcttaataaaatcattaaatttcaaaaaaaaaaattttccggcggcgcctatcggcaccgcagaccccgattacccgattttaccttatttagttgctcccagccctgatgggggggaaccggcatggaccggattgtcataaatcaaatccagttttgccaagactaaacccggaatcgggaatacgagactcaagtcctgattttgtttagagaaaattgtaccatgcgtcatttgagggatccggtcggtgtgattctttcaaaatttagctaccaatttgcgtttttttggtacttttaattaaaccaattaataaataaatgtattgaaaaattctttattgctatgaatgataggaaaaatatatttttttatttcaacaaaaaaagtaaaaaaattttaattttcaaatggaaatccataagaatcctcgacctaattattatagttttatttactagcttattaccaggactgtcattctttgttaactaaaaaacagaatatatttataatgatgaaaataaaataaagtatttggaaataaattcaggtgaaaattttaacatgtacctctctctccattggtgatttttttcaataataataattaatggttattaattacattaagccattaactcgtcatctatcgattgaaacaccggccaatttggctgatgccttgggaatgcacactccaaattgggctttttatcactacagttcgcccaattatcggtcagcgtggccatggcgaatgttccgtgaccgtttcgatgtaagaagcaattggcaaaaatgcaaaaccaaattaaatgcattttttggcaaaaaatcgtcataattttctcgaaagtaatcaaaaaatcactatatttttctattaacctaataaatttatgaaaataaattattttttattaaaattattttaatttgcttaaattttaaattttactttttactttattaatgaattaattaattaaattacaaattttatctagtgtgaacaaatcatgtacaataagcacttttctgtgcagcccatctacagaaataattaactttaattaagacgatcaaaaaataattaaagtgaataataggcatagtttcatattaattctttgattggttcttaaatttattatattatttgggtgatgtaattccgtcacaaaaaatgtcaattcaaatttacgcaaaaagaaacataatgccaaagaaattttttattgtaaataaatgaaagaaagattatgggcgcccccacaaaatgtccaagccacgaaatgtccaagccacgaattgtccaagccacgaaatgtccaagccacgaaatgtccaagccacgtattgtccaagccacgaaatgtccaaaagagtaaaaacccacgaagtgtccaaaactcgaaaaatctattaaaagccggaaaatgggtctaaattaaggtgttaggggtcgctgaatacgaatacgacatttatataacccatttcctaaccttcgacccacccgaataagaaaaatctcaaattcggttaaaatatatgctgttttttgtcttcagattttgttattcattgatcgaacaaaatgattcgtaataaacttgaaattctacaaaaaagtcggaagaagcgttatttgtcagacatttcaaacacaactgaggaggccgtgaatttgggagtgaaattcgtcgaaccgaatgccgtgagaacttctgacagcgttgaacaaccgaatttgaaagaggctgaggtctcaacaatgacttttgagcgcggaaaaaccaattttgggggagattgcctatggttgaacggtatgtttgaagtgccgcaaaaaatttaatttccaaactattcaggatttgtttcacacacctctcaggaaatcgctgaagatgcacaaatcgagttgctcatcatatgaaacatcacaaacaatggcgaaaccgnaactactnnaaccttnantcaaaaanaacacacccacctccctncacctcataaacaacaaattt

SEQ ID NO: 9305 - DNA, 4597 bp, Heterodera glycines
agtgacggacaaagcaacaaataaaaacaatgataagcatcttatatgaattaattaagaatgaccgatcgatcataatttttcagtggtaataatgttttttatggaaaaaacctcttgaatatataaataaattggatgtataaaaatgtacaaaagaaaaattttgagatttgcacaaaatatcaacaaatttctggttccggtaactcccgtactatttctttatctatgttagtagtgaaaaactgaatgtacttcgctacgtttaacttttttctatacgttaaatccgcttcaaactttgcatatgatggagaaaaaaaaataagaaattgtcaatcgcttttttaaaaaaaataatcgcttttttagtctaaaatttaaaacaaaattttctaacacccatatcttttttcgaattcatcaaatcactacgtatttggttagaaaaagcttctcgttaataagagctttcgaatgatatcaagattgtccagtttggtgggcaaaaacacttcaaaaataattcccaaaaatctattttttaattttttggacaaaataaaaaaatattcatgttgcacaacgggttcgaacctccgccctcctcctcccatcccttcactatcttacaaaaaccacttcaccatacatgcaaatctttttggaactgggaggctaaaattgaaacggtgtgaataaaaataatcatttatgaatttaatattttttatttttttaaaactagtcaattttgtaagcacaatcggaatgagagctagagtttaagtccaattaagaaagccgcacattttaattaaattattattttgtgggtcctttgtcactgcaccgtttttatatctctactcatttgtcagcaccatttgggtcatctctgctgatgactcatcgataaatgacctcatttggtcagacagagcatcaataaacattcatttttctttgttaaaattatattataatataaatttttgaagaacaaatcaggcacatcatttactgcaaaagtgccaaaaactgtctaataatttgcattaacaaaatgtcagacaaccgaaaagaaggagaagaaaaaatggcaaaagccatgtaaaagctaaaatttcaattttaaatttaaattttatttttcctttttcagcttaatctctgccgattgtttgttcaaagtgttcaatttgcttccgcctactcaacttggccttggaattgcactgattagccaccgatttgactgttttgtggacgaacatttcaaaacgctcaaatgggcgctaaaattcattcgaatttgaaacgaaattggacagaatggcgcaaaaaaagggaatggaaattgtcaatcgctttggaaaagcattgccaattccgaaaatccaattgcctcgtaaagtcactggatttgagtgcatcaagatctcgtaaatacaaataaaaatcccaaaatttatgttggcggcgcctatcggcagcgccggactcaaaattttcaaatttttatccaaaaaacgcaaatttttaggaaattattttaaataaatcagtaaattcaaaaatttttccgttagaattatctatccttcaataaattattgaaaattttttagtttaattgaccgcaatgccatcgcttttctccaacgttttcgccaccttttctccgtctgtccaattaatttgatcaccgatatgttcagtgagcgtattttggagtttattttgcaaaacatttggccaatgatcgcgaaaaatatttgtgcgatatatttgatgaagtacactttccgacatttgcgtaaattcgtcccgacaattctcgacgattgtccatcacttcgcattatctctttccatgccggtgtcgactatttcttcaccgaatttccgcccgatgacagtgccatggcatcggatggacaagcgctggctaaatggcttctcattccccacccggacgatgtgccaaaggtgctcaaatgctggttgaacatggaaaagggaattggccgttgaaaattgcagcgttcaaagcggtacataccgtaattaattaaattttaaattttctcgattttatgcatttgtcaatgcttcatctcatgccaatttcattgctgtcgtttggtgtcctccgtcttttgctgactctgttgtgccatttgatctgaccaacgaattgactcgggaaaaactggcgcttaaaaaagtgactgtttccacccttttctgttggtccgttgtccaattgcgcgagacgcgagcaaatgggcaaaatgggaagaggaagcgattggctggtatattgatgatcaatggaatcaaattgacataaaaattttcactgacggcgacatcagggacgggttagcgaatgcttattaaaaaataaaagtttattcagttttttatttttaggcttctcaacgcaactcctggcccaagtgatcagccgaaatgaatgaattgtggcgaagtgatcgatcattttgaaattaagtaattattgacgtgtcacaattgttctatgatcaacctgcatctcataaaatggataaatattgtattataaacaatttaaaagccaacaaaataataatcctaaaaaataaaaatttattttttggtgataaaccattttttattttcaagtcttttttattgattgcgctaattgcctttaattggccagttaaagcatccatcacttcagcagagattatatggattttcaactaccttttgctcagtaatggaataattagacattcattctcgagtctaatcacataaaagttttagattcttcaaggtcgggagtcgtttgatcaagtacgagtattattcaatttaaaatttaaagccaaatgttaacctaattattagggataggaattttatgtaaatacatatttttaaaataaccatttaaaaaattttatttacatattttagtacatattaggggtttttgtacatatttcatatatattttagcattttttatacatattttatttacatatttcgcgatttttcttacataaaattcccatctctactaattattaaagaatttctaattattcaattttccaaaatattttaaatatccaattttcgataaaagagctgtcaaaaattacacctaattaaatcccaaaattctgccaaaaaaaattggccattttgggtgctaagtttaaaaaaaccgcaaaatttctcattttttaataaattgtctagaagaaccacacataattgtcactatcattaagacaaacctcctctaccggtgtttaattagctcgcccctcccccattattttgtgccgtgccaatttccgtttgccatgacaaccaaatgcccccctctctcccccgttccattctcccctccccctcctaacccccacaaaaaggcattatttttattgcttacctattttcatattttggtgccatcctcgtcacatcccaaatccatccccgcccaaactttcaatgccgaagccaatcccatatgtgtttccagcagattgtacttaaccgtgtcggatctttgttttacaaaatcacacttttattggtttttagtaggtgaaaattgttatagcatttctcataagcagccaaattaagcagatttgaatttggtattttgctctgatagttcccaattggctctattcgcatggaaattttcaaaaaattttgttagagttaaaaggaattgaaaaaatattcttttttggttaaaacttttttaaaacaaaattttttgaaaatattcatgctaatagagcaaatcaaaaactatctatggggaaaatgtcaaatttacttcatttgctgtttccgataaaagctacaacgattttcatttaaaaaccataaaaaagtgacgtttttatagctttggtcatgtcttttgctcttatagcaaaatctcatgtccttgaaattgtccttgctttaattacccgggacgacgtgtccttagtgttcacaattttccttccttttattatcattgacaattatctctgcccttaatttgtccgttaagaacagttccctaaccctggttggccatgtccttgccccgatttccttgcgatgacgtttacttaattgctcacatcattgggcttttccctttatttggtcactgacattatccatgcccttaatgtgcccgttaagtacatttcccggactctggtccaatgtccttgtccccgccctcgtcctggagcagtatttctgccactgctgctggtggaggtgctggtactgcttcaacagctctctcccctccgctgctcattgcccaactgtttcttgaccgtctctcctccccatgggagtcccatttcaactgcacaacgcccgtccaaattcgttttgtgcccctttcatcgacggtaaaacaaacaaaaatatttattggggtcggcgctgattcatatacaaattctcgggttcaattcggactgatcctctccatattcccgattgcgtctcaattctcgactcgagaaaagaccactcgagccatttttaggtatca

SEQ ID NO: 9306 - DNA, 4487 bp, Heterodera glycines
gcgccaagctgtatagcaggggatgacaaatttgtgagagagttgcggtggttgttgatttctctttgagtcaacaaattgtggaattgctgttaaaagctgcaattttatttgtcctcctctttttttttctgcttccgaacgggcgtcgccaattttgttcggtccacagaatgggtgctaagccaatgtttagtgtccaacaaatataaatatttattttgggtgaagacaatacaatttatttagaagaaaataaatgaagagaaattggggaagaacaataatgtcaattgcacaaaaagtgaactgaatagggaagagtgaacatgaatgagggaaagggggaatttaaataacaaacgaacagaggggaaaagaatatcgattgggtcaaagggcattgcgtgtggcgttatgttgaccacactcgaaagccaaagggcgctgcccctaacagataattatattgataataggtatgcacctagatttgtgttcaaaatatttttcttgaaccgttttttcaaaatttcttgatgctccaatggggccctacaagcactaacgggaaaatttttcgtcaatttaattttaacagatttttttgaaaaattgcaatttttaagatttttatcaaaaaaatgagaataaatcatcataatggatgtgtattagtagcactcagaattttatttttaaattaaattgcattaaatttttgtcagattttcatgtgctgctgccgctgcaataactgctgaggtcggaacaaaacggagcttaaccaagaaatgaaaatggaaaaagaatagatcgtcgcattaatttggacaaataattttttttatttattaaacataaataaaatgcgaataattaattattttattcaataattagggagaaattttaataacagtcaatcaaaattcagattaattttggcaaaaatttggtcaattattttttgggattttgtgtgaaatgaattggatccgcagcatctgctgtcattaataaaatatggttcaaaatccattacatttctaaaccctaattagataaatgttgattgaattcaaaggattaagcaataatttaggaaaaatggcaatttaatttttagaaatttattaatttacctaatttcgatatgaaattttaaaaagggcatttatttttcagggtcgggaaataggcccaaaaatgtcgggggttgagtcgagggccgggggctcggagtcggggagcagttctagttttaagccgttaaattgatcgttaattaattacctaattgtaaaattaatgtataaaaatttgtaattaattaataagaacttattaggctaatttggatgaacaaattttaattaattatttgaactgctcaactataatacgtcacattgcacattaacaatttacttctgataaccatgaatttgcatattttaaattgatttaattttgaaaaataaaagaaaatttgtgcttttttgagttttgtcttctcaatttattttccgccaacttcttctcaccaataaaaaattagagcttctaaattaaaagtaaaagtcattgtttttaaatttatttttttttgtcgggttattttagtattaagaaatttttttttcaaaaaaaagtctcggcccgtgtctcgtcctagttaaagtctcggcttttttgtgtttcgaatgctgaaaattttaaaatttccagtcttgagtattactggaaatttatgtgctttttaaactgaaccaatagtttcaagacgaatttgctcaaaaaattcgttgaaattattttttaaaattggagatagataattttctacggcatttttgtcatttttttacatatttaaatccaattttggcatttaaaatttccacattttcacattttcttaattataataataacaataatgagacaattacttcccaatttctctgctggaataagcatttagtgagcagtgtttttcttttcgcaattaaatttatatgtccatttaattttaaattatttttgaatttcaaatttccattttcccattaaatcatttgcatctttcgaaacattttttgtcttcggaagaacagaaaaaaaaaattattttgcccatccaattcatccttctttctgctgctgctgattcaccatcatttttgcatctttttttttaccgattcattatttttcgctttttcgtcgccttttttatgaataatgttttcccatttgtccattttgcgacttttcatccctctttttatgaataatgttttcccatttgtccattttgcgcctttttgcccgcttttgccacatctccaatcgcattaatcagcgttgttagatcatcaaaaatgtttcgtatatttcgtaaaacaaatgcgaaaataggcggcccatcatttttttgctataaatattcaatttctgaatagacaattcattttcaaacaatataaatatatttttattcaatattttaactaaataataatcattaaaacataattcctaaaattgaaaattttttttaaattaatttaatctaatttttcattcggatatttttaaatgcaaaaactatttttaatgaaataatttatattcataaaattaaacattaacatataattcctaaaattgatgaaattttatttaaattaatttaaacaaatatataataacattttttatttttagatttgtgcaaattgtcttttttaactctctgttacaatgtcttccatgtatcatcatcttctgctcaaaatcacgatgtttttggctttcgcggcggcgcattttccgggtaagcaaattcttttttaaattcttattattattataattatataacgaaataattcatttttaaattaccgtattatttcactaccgtattttttcaaagattgagtctttttttgtacatatacggtagtcatgtgttttttatatttatttttcaattttttagtcgcggctatccaatgtgtgtccggcatggcacttacatacatcaacaacagcaccggcgctgaaaatgtcacgatcggcgttcagcagatggtcaagtgccaccacggttgcgttcgcgcggtttgcagtgtgaacttgcccgaactgagcgaccactttggattcaaaattgtccatgcgtttggacacggaacttacagtaagtccgacctctaatgtttctttatggatggtcaaagtaaccgtagaaatttgtatcagagtagtggtcccggcgggaatcaaattgaagggcaaaaacaattttttttttttttttttgggttttgccaaatttttttctcaatttttgttgaaaaaaatataccataaaaattttgcctttctcgcaacgcctattggcatccatagcccaaaaatcacactccgccccccctggccctcaattcagcaatgttttcccactttttttttttgaaaattgcgcggcgttttttgagtttgaaaggcatacattaaaatatgccgttactgggcgaaattaattttataaacaacaacaaaaaaatcctttctgccccattcagagttgtacgggaatcggccggttgcggttgtcagcggatgtgcggcaccgaaaaatggcacggccacggaatcggcagccgacattttttttgggaacggaacgatcggtgggaccgagtgcaagcaagtggcagtgtgtaccactggtgaactgtgcaatccgaaaccatcatccgcgagccgtacttcatctgctttggccattgcgtttccggttgttgtcgcgcttggtgaacaataaaatttgttgaaaatttatttaaaatttgcatattttcttttcagtctcctccatggtgtccggctatgtgcagccgttctgagatggcgtactgatggtttgcgaatgagggaggaagaggacggaacggacgggcaacgaagaatacaaggaggggaaacgatgaggcaaacacaaagaggatggaacaaaaattggcactgtttttttaatgtgatgagtgatcagcatacaaaaacccaaaaaaaaaaaatatatatatatgctttgtaattgcttgtagaaaaataaacagcgctttttaaaatttcatgtcgaaaattttaaaaaaaaattatttctaaaaattaaattggcatttttcctaaattattgctttaatccttcgaatccaatcagcacttaattaaggtttagaaatgatttctttgtccgataatatttttcaaaggaaataaatatttcaaaaagcaaacttttgaatttcaatctcaaaaatttatttttaaaatcaacaaaaagcgcgctgcatattcaaaaacagcgcttcagctttttgggagtcattaaagcaacaatttagcccaaaatataatcgaatggatccacatggcgcacgctctttgttgacaatgtcaatttaaat

SEQ ID NO: 9307 - DNA, 2110 bp, Heterodera glycines
tccaatttaaaaatttctattaattgcaattagtcaatttctcttaaatacttttacgttaaatctattataataataactgttttattgctctactgtttattcacttttatttgtatatacttgaaatccatatcattccttggacatggtaatcgcatgatggtgttaaattattttgtacggcatcatagcatttattttttttttatttttagcgattaaagttttatgatgaattactaaatgtttcagaaattttcccaaaaatcaaaaaaaaaaatttcttgtataaaaaatgctaattgtaagattttttgaaagtttctgtctgaaaaattatgaaaaaagcgcaacggagtcgaaattttatggcattaatttgaacaaaaaaaacgatgaaaaatgttcccccacttggaggtcgatgtcggcaatttcccactgcttcagcgggctcagttcgtccagctcggccaaatggagttggaattggcgcagattgtcccgcaaatgggcatatttctcgctgggaaagtaaaaatttaggaaaattcaaaaaaaaaatgaaaattttagacaaaccataaatttttcgagtaatttttggtacttgtctagtttaggggacagatttcacatacattttcaaatgcctataaatgtgttttagaaattagtgaaaataagttttaaggggtattgggggtcgctgatcacgaatccgggctcagatcagcgctaccattcattataagagctgtacaaggacaaagaatttataggcttcctgtaccaataataccctcatgggtaagatgccaatgaggatatcatccatacaaattttctaattttatttttgttcgagtccgggtcaggggttcgaaattgggaaaaacggatgctgcattcgtgatcagcgacccccaaaaccccttaaaacttattttcactaatttctaaaacacatttataggcatttgaaaatgtatgtgaaatctgtcaggaaacttagagtacccaaaaccctactccaaaatgccaaatttgtccacaaacaccgagcgaacgtgcgaactggtgggaagcattgtgacgatttcaatacaatccgatgcaacttctgctgggtttttggcaattttcagcgcagatggtccacgttccgactgaattgtctccaactttgattggtcaacatcgtaaacgacgagttgggcaccgcgactcagcaaattccgggccatgtgtccacccatatttccgagtccgatgaagccgatacgttgcatttcaaaaatgggaaaaatttttagtttgtttttgaaattgcggattttgcgggattaatcccgcggggtcccatgccgcaaaaaaatctgattacatacattcacgcacgggatgcgaaaatttgtgtttgtgcgtgattccgtgagatccgcattttttgaaaattctaagaacattatgccaaattgcgaaaaaattttaaatttaacatttttcattacaaaattttcattcaaaatatgaaaattttccctttgttgcaataaccgattcaaaaaccgatattggagaggaaaagcattgttagaagaaaatgaacacagttgcaacatgacacctttattcatttcaaacacattaagaatgatcaattaatcaaccaaccatcggaattcattaaataaatcatcacggggaatttgatgttgagattggattttgtgggtgttatggcgctatatgggggctttagcgatgtctttttattcaaacggctttgttaatggcgcttcttcaacggattaagagaaccattgtgtgaaattgagacaataaacggggaaaggggacggggtggtcatttatttggttccctcccccttttatttcttccctccttttggccatgtcttttaatgttgctgctgttgaaggcccttaatgcgtgaagagatctcttccgcaacacagctaaacacgaatttgaactgttcctcattctccaccattcccatgcgttggtctctcaaatgctccaacgaaagcggcgatgttccagtccttcaccccctgaataactccgttgatcaattgg

SEQ ID NO: 9308 - DNA, 2762 bp, Heterodera glycines
atgccatttgccaaaggtggccacggtgttctgttgctttgcctgtgccacaatgtatgtcggctctgggttggcatcaaatattttgctggcgttgtaataagcgggagagtgctcggcaacggatgaggacacgtcaattagcgtttccgtggagttgaagccgtgcagagtgaccagagagtcatcgtctgaatgtgtggtgaactatgccattatttttcccaagtcgttcggtactcacatggcagcactgtcgcgtccacatttttcgccgcattttccgctcgccgtgcgaccgtcgcttcgcctgctgcgttcgcgtagtccttcaccgactcccactctttgctgacttcgcccggcttttccatgtgctccttcaaaaatgcgagaaggacatgtcccgtgccgatgtccaattgctggtcggcaccggtcggtgccgacaattttcgcaggccacgaggaagtgcttgagtgtttagagcgatccccggcacttcgtccgctgctgatacgctgtgaaatgttgccttcctctgcgattcgctgacggcacaaatcgtcgcaaactgagccgcctgctttgccgcctccgtctcggcacggtgccaaaattgggccttcttgacgatgacggcgcattcggaccaaattagcagccaacacaacgagaagggtgaagatggtcatggcggaaacagccattattggcacgaacagccaatcgcgctgagaacgctccaccgggacgacgtcctttaattggttggcaattagcgtaaaagacatagaatcatcgcttcatccacgccttaccactccgcttccgatgcccgtctcatccacgcggatgccggccaacgtttggatgtccttccgtcgtttgtacaccgcctgcgccactccgctcgcattttccaatgcggcgtccgcgttgccgtcctttttgtctttgttcggttgcaacacgccgaggcgagaaatgcggaaggacaactggccattttcgtagaggaactcgtcaaagtacaggttgttcggctgcgcaatcttcttgtccaggtagccgatcagcttgtacagctcctcctccgtcagctgttccttggccaccttcaaatagacgcggtttccctccacacgttggatgccgcctttcacttcaaattgcaaaatgcaaatgcaattcattgtgggcatctgagttaccgattttgtgcacagtgtttgccaggcccatgtcggcgttgttgaactgctccgagtccttcttcagcaacagcacgtggtccaccgcgtcctcctccgtcggctgtgctgcttcggcttccgcgagcagtggcggcggcgcctcttcctgcagctgttcctcttgcgcttcgttcaccgtttcttcaactgagttttcaattttcgtccattgtttgccgtccccctccgcttttcaccgttttgcactacgttttgcagttggcgaatgaatcgtgccaatcggctcagctgacgttcgcttagtgcgcccatctgtcgctccgccgctggtcggccgtcgagcaaattgtgaacgaattggtccaactcgacctcctccgtcgcgctgagtgcgtccgttgtgcgcttgtccatcgccttttccgcttaaaagcattcctttgcattggccacccttttttcagtcccaccattcgtctttcattccccccgccccctccgtccgttcatttcttcgcttacctttggtttcgtttttgctgccggtcttcttcggcacttccctctccgcttttccgtacatttcgtatgccattcggtcttttccgtcttcgtcctccccctgccctccgtccaacacaacaattggtatcacttccacagcctctcctccgtcgtcttccgccgtttggaattgagcttgtccctgtccggcagctgctcctccgtcccccgcttcatctcgcgggtcggtgacaagcagtgattccgcctcgtcctcctcttccgcccgttcgatttccgcttcggccaaaagtgcgttttgtaccctctgaattggcctgtacagtttgaatctgtttaaagcatgggactgacctgaatcagtgcccaaatgttctccgggttgcgcaccgtgcagaactccgtgtcgtagtccaagcgaaaagccacggccaatttgaaataggccaacacgcactgggcacgtgcgtccggccaatccagtcccagctcggccagccgagtcagctccgcacgaagcagctccgactggacgccgttgatgggccggtcgaggaccagcggcctgaccaaagccgactcatcgtccgaatagcactggccgaacagcccgtccggcaaacagacttcgccatcggtgcacaaatcttcgctaaagtcgcaacctgaatggagaaaggggttgtgccaaaaaacattccctctttgggcccatttggccactctttcgcaaattaattttggcatttgcatatcttcaaatgataattgtcttgtctatttgtgttttcgttgtgacaacggccaaattattcaacaaaaataaagcagtaaaagcattggcaattatttgccgcccttttcctttcgtggcattcatttggcacgaacagacgacggaagggcgggtaattaatggagtgaggagttataaggacaaacatgaagaccttccaccaataaaagcttgttagtaattcaaatgaggaagaggagaggggaggaggggggggggtaag

SEQ ID NO: 9309 - DNA, 978 bp, Heterodera glycines
cccccccctctcaccgggggaggaggagggcaaggcttcctccttcccgcccccacaacaggggaattgccggggggggctttacgttggggaagacaatttgtcaatggtggaattctcaaaatgaggacaatggttagtgttacctcattaacaactttgtttttcaaattgtctccccctccctccctcacttttccttccgtcccttcccttttgcctttccctttggctttttctcccccatttccaatccccccctttccccctctttttccctccgtttccatgccaatttttctcatttatccgtgcctcttgccccaacttttgtccctatttctgccatggtcaaataatgccaatttcttctcgaacacccaacgtcactcaaacaaagttccctctaattgagtccgagtgcatttgtttttgttcctttggttaaacatgcaaaagcttgccggaaggcgaattttatctcaggccaaaagcgaatgggccatttattgacgtagggacggacggacttttgtcaaaactaattgcgtaagtgttgtccatgcgcaagaggggggagggcatgacaaattatggcaatttaatgcgaaaatgtgcaaattggaacaatgccaaagaaaaagaaaaagaaaattgtggatttgcacaaaacataaacagcaaaattggagtaaaaaaacggaaatgtgaatgagaacggtggtgtactgatgggaaaattggccacatttggccaaggcaaaggaaaagttggcaaacattgaaaggaaggaggggagacaagaaaatcccatggaaaaagaggggacagaaaatgagacagagaacggcacaaaaggagggagtgccgcctacacgcacatcaaattcaaatttaaatgctcttccgtcagccattttaatgaataaatggacgagggaatggctaattagcaacgtaaatgtcgcgttaatttt

SEQ ID NO: 9310 - DNA, 2056 bp, Heterodera glycines
atatgttttttcacctgtaccgaatccaccatttgtacactttgctttttgcgagcaaattttcctggtaataattgaacattgtatctttgatcactttgctgcccattctgctcaattcgtgccgtgccaattccccactcatttcctcctcaatggcattgccattggcaattccttcattcgcttttactttttgttgccccattttaccaaaacatttttctgcaattaatccattggtattccaaactttgtccagaatttcatccaacaaattttgaatgtctttttgggcggaattttgaaaattttccgtaatttctttcacaatttcgcgcccatttttcgccattatttccattgaatttttgtgttgcgtttgctgttttaatgcttcaatgaaatcgccaatttcagtaaaattcaactgaattttcttcgttttttcgtgtttttccagcgaaataaaaatggacgaagaacaaaataaaaagacggagaaaatcaatttcattttgccttaaatatatttttttcatttataaaggtattttaaaagtgaaattatattttttttctatttaacaatgctcaattttataaaaatgtgcttatgtaataattgaattttcataagaatatgtcaaaaatcaatgaaagaaaataatcgatggaaaatttttttttaaattatttaccttgggaaattgctaattagacctttttagaattaattaattttctgctaggaaccaaaccattgcgtcttactgttcttacaaattagtgcattatttatttgttaaagcaatgaggtttaaacaaaacaaaaaataaaaggtggataaaatgaaaaaataaaactatcatttaaaataataattaattttctaaagaaaagagtaaataaatcaatgaaaattgaaaacaaaattatctttaccaaatttacagaaaatagaataattactaatcgtcgtccgacaatcactaacaaataaggtcatttactcaggcaataagaattgagtcgatcacatcgtaaaattgccgggtgtgcaaaattccttcgtgcgaaacatttgcaatttcgaccacttgattcaccttaaattagtctaattaatttgtttttcgtttataatttattgactcttttttctctctctttcttcccataatccgctaattaattttttttattatctttgctaattgagcgtccgactctttccacccaccaatttgccctggtccttccattgttggcacactctcaacgagtcgatgtttacagtgccgtcccccgccccttttgtcactgtgccggttgagttaattccgttcggatatgcgtattgctgcggtgtgctgtccgcggaattcccatgcacgcaatacatctttagaaacccgagagtgaattttgaaaataatttctattttagcgaaagtttaattaatgaatttgtgttgaagtttcaaaaaccaactaaaattaaatcatttaataaatcgattaaataattatatcaataggaaatcgagtaaaattttatgcttcgtttaaaattaatttttcactattaaaatttgttttattttcattttaatttttttcgccccgcccattaaaatcatttaattattacgggtgtgtattgctgtgcgttaatttgtgatgccgagttttggtaaatggttgccaaatttggcacattggccaatgccaataagttggccatgtcggccactgtgtaggcagtgccttgaatagtaaccagtgttgtgccggattgaaaggccaaccaattgggcaaaagaatggcgagggaggcaaaggttcggaccaaatcgcgaagcgacgaattggaaataatcagagaagcaccgttgaacaaaaaactgttgggattgcctgacagtttgagtaattgcttcaagtaagaagtataaaaaaaattgtttttaattaattaaaatgtttttattcaattaataattggctattttaattgattcaatacccgagaggagcgcatcaagcgtttaa

SEQ ID NO: 9311 - DNA, 3698 bp, Heterodera glycines
  misc_feature (38)..(38): n is a, c, g, or t
gaactgcttcagagccgagaaaattgggttgtgtttcncaagttgcatcagcaacttcaaaacctacccatctaactagccattcatccataccggatgaaaggttagttcggtgggccaaaatattgttgacctaaaacataaaaataaatgatttgctaaaaaatgttttaaaatgtacaaatgttttgttaagttttttgtaaaataaaaataaattactaccaataatatgcaaacatttttttttggataattacctcaaaaatgtcgtccgtacattgcttattctcaacaacatgtccttgtatttgttgtggcgctaaaggaaaagcctccaatggctctgtaatagctggttgattctggatgaatgtgaaacgaaatgaaaaaatataaaaacaaagaaaaatttttgattactgtatataccgtttcaaaataattttccagttcatggaaatcaaatggcaatggacttggcgtctggtgatcaagggtcggctgggccaaaaatggaaaattaaatcataatattgaaaataatttttaatttaaattactgggattgggtcaatttccatttcgttttcgattattttgtctaaattaatcaaaataatttacgtaattgaaaaatttgttttaccaaaagaaagaaattgtaaaattgtaggagaaatggacatctcaagtaaaatttggagtattagattaaagaataggaaagggcctagcattttcggtgcttaaatagggtttaaaatttaatttagttaatgaaaagcctaaaattttcggtaaacatcattttgggaaggcaaaagtgtgaagtgcgcagggaattccatccacaaagggtaaaatgtggttaaaatgagatatttcgtttgttgtcccgctaattatcctttggaaatggcccgcctctctcctaaaggccattttgccggtcagcgcagcacaaaagggcacttcaaccatcaccgcttagcccattttcggctttgttttgcacatttggatgaaaaccctcatcattttcattatttttatttattttatattgtttattctttattttctatttctattaatattttattttcactttttagattttttaaatattttttaaaattttcacctcctcagggatttaattttacttcctccgttttacctctacttgggttttaatatttttatttttaccctttagatgttttttctatttttacctcctctgagattggatatatttattataggtgttttttaaaggtttaaatttggtactgaaacgtccctttccattgggactgaaatggcggggctgaaaattaagggccaaaatctgcatgggtaactactttcgatcgtgcatatcccttaaaattgttcatttacattttttactcattttgttattccttcaattatctagaaatattgcttgtttttacaggtctaatattttatatttgattacacgcttctgataaattttgataatttcaacctttgaattatattatctttttcgttatttttatttggcgggattttgactttttttaacttaggatttcgatattatgatatatttatatatataatatataatatacatgtaaatagatgtacaaaaataaataaatttatattttttaatttgtcgggattatgactcattttggcttagtcgggatttcgacgcatcgggatttcgacgcatcgggattttgacgcgtcgggatttcgacgcatcgggattttgacgcgtcgggattatgacagcgcgccctccctttgtatgtcccacctgagtcattcgttggttcaaaaaattattggtgaccaaatttcccatgctgtgagacaatataaatgccttcttgcccgttgtgttgaacacattttcgattaaatttttcaacttggcagaataggcatccatttcatctaaacgatgaaaaaagggtttaaaccaaccattagatgataatgaataattaagaacatttatattcttcaaatataattattaaattgtcggcactcagttgcggtgccaaacgccaatcgtaaggggcgccgaaaaggttgcatcccttcacatagccaaattgggccaagtgactgataagtgccccaaaatacacatctgtcgacgtggagttctcgttgggattgcagctttggttgctatcagtgagcagacaagtcatcggacacgtgctgaacattgggaaaaggaaagtgccgaaatttcaacgacaaaaaaagtatttaaaattcaaaaaatggtatattatagcagttccctataaatggattggtttggttatgtggtctttaatggaattttaaattttgcttaatcagccaaaatttcaaccaaaaaagccaaaagattcatctatttattttatatattgtataatagcaacaggccaaatgggcgtcttgcggtgaatgtgacattcattccggtccgatttctgtaggctccgctcgcactgtcataggacagtctgaaaaatatacaattccgacacgtatttccaatgtttctttatgtcgtgaagcatcaatttggggttgccccgactttcggggagcaatttcagttcaaccgaaattgttttagattttaagcatatgccaaattacaaagcaaataatttcaatttgacgtacgacatcatataaaggatgcacttttggagatcgaacgggtcggaaatggccaaggcataggccacccacgccttcagtgagaaagtgcccgaatacggcgaagggatggcaccgcaagaagccaaattggacgggaaattcgagccgtggccgtccacgtacattttgctgccggtaatgccatgcactgtgcttttttatattatgccaatgatttgaatttgcaattacaaataattaatggcgacagattctgatttgctgttgagcagtttggagttccgtctccgttaacggcacagtcactcgaatctgagactccttgtcgggaaaggccaatttggcaaaagacaattgccaaagagagggagcaaaggccaagcatttcgaacaaaaggcccttaatcaaaaaattaaattaaataatatttaatataaaaatggaaatacagagccgctgatttaaatgcagtgcaaaattaatggaccatccgatgttttcaaggaagaaaaatgatcaaattttaaaggaattgaaatgataagaaccaaaaatgaatagtcatgagagaattccaacaaattttgcaaggtttttgctttattttattgaatatttgggaaagtattaaagtggcgatttggagatttgcataattatttctcctttttttttgcaaaaattatatttcacggaaatccaaaaatagtaacaaagaaaattttataattaagtttgtgtctatgaaacattttgttttgattcttaacaaaaacattttttacttttcagagctcaacgaattagaatactaagcatttaagagcagatttttccccaaaaatcagagtttacttaaatagtcaaacatttttattcttacaaattagccctgttttaatgggttattttaaaaagagcacaaacagatgttgatattccgctggtgaatttagagcatttagaatgaattttaaaaaattcaaaattctat

SEQ ID NO: 9312 - DNA, 1388 bp, Heterodera glycines
  misc_feature (1355)..(1355): n is a, c, g, or t
acacatttttttaatttattttttatttttattgtttgtaaaaatacaaatttccgatattgcataagtgcattcggcgcaacccaattaaagtgaacgcaaaaaatgaatgagtatttttcgttttgttcctccgtcgttaaatgcttttaaaataattaattaatttttgaattgcaaatttgaagaaatttaatgcgtattttgttgttgaatcagattttacataaaaaaacatggaaaggacccattaaaaacctaacaaaattttcaaaaaattttccatactttaaaaaattagtaataaatttaggtaactttgaaacagaaaactgggcacaaaaatccaacaataaaattatatgaaaattgcaaaatatgtaccaaaaaacatcgacaaatgaattttttatatttctttcatttcatataatcatccatatcattcttctgatatttcttcaacaaattgttttttccattttaaaatgttttgtctatgaatgttcaataattttgcaataatttcatcactcatttttggattttcactttttattttccaatattttttcattttttccattttttcttcctccgttattctacagcgaatgccaaattgttgcttccattttttaattgtgaattgactaactccaattttcttgccaatttcggcataattatgttgccattcttttttcgaatattttcttttttgtttatatttttttaacatttcaaaaaatgtttgaacaatttctaatttttcttcatcagtttttgatttgtaacttttctttttttgaaataatcataaattagcaaattaaaattttgtacaaatttataatttaataataattttttaaaataaaattttcctggctgcttaaagattgcttacttcatttggcacgcggattggcaggtcaccgtttgtgtgccatatacgatgcagaatgtttggtgatgtttgaagcggcatttcccaacattttttaaatctttcccgatagactcattcaattttaaaataaattcaataaaaattaaaataataaaaattataaaaataattcaatggaaaagactgacaatgctatggaggcgtaaactccaattttcagtagtgcgatttctaatctcttcactttttaaaatttaagcgaggcttagtccttcacctttctttatcagacttcctggcagcgattcgtcactttttggctgagttgacgaattatcgagttaatgaataggaatcgtagttttttttttattaattgacgaatcgtttgcttttagttaagttgacgaatcgtcgagttgacaaatcattgacttccaantcgtaggtttttgacttaggtgacaaatagtcg

SEQ ID NO: 9313 - DNA, 2436 bp, Heterodera glycines
  misc_feature (1351)..(1351): n is a, c, g, or t
aaatttgtaagaaaattggagttagccataacacagttagaagatggaagaaacaattgggcattctctgtaaaataataacaaaggaacaaagaatggaaaaaatgaaaatatattgggaaataaaaagagaaaatccaaaaatgagtgaaaaggaaattgcaaaaactatgaaaattcaccaaaatagcattagaaaatggaaaaacaatttggaaaagatgaaataatggaagattaattagtaaaaacttaaattttttttaaaaagctatgtatgatgatggattttattgattcgaaaagattaatgtattttttaaattctttttaaaatgtaagggtatatatttccgctaaatttactcatgtttacaatttatatatgtcgatttgttagttgcttctagctagataatatttggccattttttcattatatttattaagaataattcgctttttatatttttattttttcgataattcaaaaacagaagcttaaaaaacatggacaacaaaaaccaaaaaataaaaaattttgaatttagtaattattgtcataatgtcacttttacgagaattttttaatccaggaaaaaacgcaccaatttatataaaaatttagaaaatatttatttttgcaaaattacaataacgatggatttaagcgttatctatagcctgcaaaatttcaaaaaattatattaggttaaaacaaaacacatggtttgcgacgccaaaatggctaaaaaattcaacattgagtttctaggccataagtttaaaattttttgaaattttgtatactaatagggattatcaagcgcttttaaatcataccatgtttatttaatttgggtgacaaatagaaaatgctatagcatttggcgccaaaatggctggcgccaaagtgggcagttccccaaaattgaaccctcccgggacaacttgagggatataagtgtgttctatacatatcctcaaaactaaattcttaaaaaaataaacactcatctcctgaaaacaaaaagaaagattttaaaattttaaatttacacatatacatgatcagtaaattattgataattaaaatcattaatttcattacaggaaatcagtagaaaggcgattgtatacgtatgaataatataaagcaaataataataaaaataaataaaatttaattttttaaattttttttggcgaaaaacggctaaaaatttgtaaaatacacccctcaaaatcgaatttttgacttaatccccccccgaagccaagggtctggctacggcagggcgcgtatctgttctgatttatcagaaatgacctgataaaatctgattttttnggcttgatgttctgattttgaaaaattttcgatacgcgctcctgcgctacgcccttgtttgtttctttttttaacgtatgaaaaccaccccgctatttccaactatttaccaagtcgaacaaacatattttcaaaaagtcttcccaaaaatttttgaggcattaaaaataaataattaaatggcaagaactgtccgatagggtgtcaattatttcttaataaaattcattaatagtccctttatatgcataaatattattttttttaaattttgttttactgtcggattgattgtccatctgtcggattctaagtggacagaccaacccaaaatcaaaccgtatatgactatcactgcagtccctatgttttataccgtaagccaacaacggcgacgatggcaccttcctactgtacccgagtggggtgggggacagaatgcctttcacaaaatctaaattaatgaaataaaaaatttaatatatccgagccgacttaatggaacttgaactcaagggcttttcgaggtcgctgatcataaatgcggcattagtttcgaccaattccatacccctgaactaaattcgaacaaaaagtcgagaaattaaattttcgaattccgtgtttttgggtcgaatcagattaaaatacacgaaaaaagcttaaagtcatctaaactgcaataaaagcgtattttaacgcactttgagtcatacatgtagaaatactaaaatttttaaagataataccctcatgggaatatgcccatgaggatacccttagtactggaagttgtcaattcgctataaaatgagtacatttataggaatctgaaaatgtatgtatgatctgccttgtaaactgtataagtaccgagagaccaacaacgataagtgagcaaagatcagatacgaagagatcaatgatcaagacacacaactgatattttttaaaaaaaaattgagcctattatttactttaattctatttttgaaaatttttgtagttagcagcatttaaatgatatttgtaatatttggtggatttttagtcccattttatatgcccaattttttggacctgca

SEQ ID NO: 9314 - DNA, 4534 bp, Heterodera glycines
  misc_feature (25)..(25): n is a, c, g, or t
tttcttcaaaaaggggggcaaccantcggcagtattaccgaaaattaatgctttttgccttttaaaatttgtcaaaaaatggtatttccctcggattagtgttgtcttagatttcattttttcgcggtgtggtcgagtaatccctattagccagtctccggtgcattgcaatttttaccgattttggtgatttttttttaaaacctaattttcaaattgtccagggaccgccttaactgatcggtggtgctgatcactgattaatcggcacgccacgcgctgtttggtgattttggagagaaaagtgatcggttctatcaaacgctattcaaatcattaattttcacctaatattgtttttttaatttattcaaaaaacaaacgtcatttctccacacttttaaagcttaagaacaacggcaaaataagcatcaattttggtcactttttataaatgtaaatagcatggaaaaatgtgtaatcagtcgaacaaacaattagcatttaattagataaataagctttccttttttcaattttttaatgagtttcatcaatttttcgtcatgtcaaaaagtttagactttcgaaataaaaatatctgctttatttgttgaatttagcatactttgatgaattaatgtattaaaagaaatcattcctttccatcatttttgttaattaaacaacaattatttattttcccccaacccaaaatatgtacccttataataatggtaaatgtacgttccttcaacttgtccagtggcgcagtggttagcgcgtttggttggtgtcatgtgttgacacacggagggccgtcggttcggttccgcttgcctgtggtcgatcactttgcaatagttaagccccgcatttatgtgggtggccgtgttcggggttcacggcttaaaacgtcccccagtgatcgccgcggagagcggggcttgttccgacgtgcttttcgttcagccaagggctttccatacagtcatatggagttcgtactgggaacttgtctcatggtggtatggtcgacataccaatcggctcgctttgggaggtttggtcagattggtggccacagataaagccccgtggtccaggccatgggggggttctgaagcaacttgggggttgtcaaacagtcggagtcgcttcggtgacgctgtttcctcccatcgcctccacagggagtccgtgcggggccacccgaactttttgcattttctttttttattttgtcatttttgtggatgttttttttaagtttccaaccatataaggagacacggaaaggggacaaaaattacaagttttaattgtcggcacaattgaaattcacaaaaacaaaagaaaagagatatgtagagaataataacactaacaacaaataaaacaaatacatataataattcaagtaatggattaatttgatcaatttgtccaagtattttgctgctcgccaatataacttggcacaaataattgaaattaatttacctatgtgtgataaatttgctgccttatcaaaaaaatgatgcttttccttgcgcaccaccaactcggagattatttcatcctaacatccaactttttactacacgtttcgctttaattaaatttacatccgaaaagtggaggctacgctatattggtattttagtaaaaccacactcattttgtgacggtttttttttttgcatgcttaagttttctggggctttcttattcaagtgaagaaccaaattgcaaatgaaggaaaaagactgattgatgccttcccaaaaaatgtctcccaattatccttcgtctctccatttgtcgccccgggggataaatgtaaattgtatgacaccattttttacaaaacaaaatgaacagtagaaaactgccattaaatgaaaaatgcatcgcgtcatctccggactccattctgcgctcgctacatcagctggacgacggcttctgacaatcatcagttgatgtcttgttgcgcagcacaaaatcatgcctcctcaggaatttctgcagccatccaactgaggcctgaacaaacaaaaattttcttttattacagttttttagcgtctatcagtgaccatcctcagtgatcttaggccaaaactttttgttttcttactcggtaatccaaacattcttggtatcaatcgaaagcttaaagtttagggaatttataaataaatacaagaaaagtgaaaatatttgcattcggaaaaaaattacgtcgagaaacccgactgaaattcatcatttggattgatcaagaaaaaagctatggcgtttaagaaactgaggatgctttactgatgggacgcttaaattgcgggaatagaaccgccgtttttcaccttggtgccagtgtccatgaacagttcagctgctcttctttgaatgatgctccttgacacgggctgttgatttttttgtctttcggtgacccattcggccagtgcattgtcaatgtccgggcgctgaactggacgaccggctccgccaagtctcatgcgcttgcccccattcggtgtcatgcttaaatttgagtcggggtcactttggcgcagtcaactttaaagtgctctaacttttttgttccgcaaccaaataaaataatcgtgatatctaacgatagggctaagtagtctctattagcctgacaaatttcaaaaaattattttaggctgaaaaaatatggcgtgctgcgccaaaatggccagaaaaattcacttttttgaggttttttggccatatctattcaagtgtaaactaaattttttgaaattttgtaggttaatcgggactgtcatgcgcttcaagaccatatcaagattatttaatttggatgacaaataaaaatgttatagcgctttgagccaaaaaaggctccaagatgggcggttcccaaaaattgttggcataaaaatgttaaaatgccaagtacatctgctctctcagtttgtcttcctgtgccatccattctctgattgctttcctgtccacatcgaacttcgttgctgctgcacgtatcgaattctttcgcgcccactcgacagcctccagttttttcgccgaatcgttgttcctgtgccgcttcttgccttttgccggcatgccttcattctcgttgttactgttttgcggttcgtgctcaacattttctgaggcttctgctgtcgatgcatttacgtccttgtttacgcagttgtggcacacgacctttgcgccgaagccttcgtcttcaactccaccagcagaattgccacagaatgtgtggcacggcaatttgcacacagaacagctgtggcttcctccgtaaattgccaaacaaacgcagcaaaacgaatccattgataaaattgaaaaaaacgtgctaaaacagtttatgtcattaaaaatttgtcgaaaaataatcccacccggggggataattagagaaaatacggtataaattgcataaaatgcgattttattgtagctgttattatttattgtgtgattgattatgtgttaaaagctttaatgatgatgcgctgggaaacaatttgctgttggatttgatcaattgatgagaaatgaaatgcataaaatgaaactcgcaattatcaaaaatatcatcattaaatcaacaaccattcaatgtgtgtgcgatggaattgctttgattttgaatgcaaaaaggcaatgggcgcaaaaaatgtcctgattataatgggccaatttattttaatgacggcaccaaaaagccatgaacaatttgattcacatccagatttttcattacaattaatcccgccctgcttaattaatttaaaaaaaaaatacgccaatcgccaaaaaaaaaacggggtggaaattgtgtacaccaaaattgtaatgagatatgagtgaaaaaatcaaaatcatcaagaacggaacacacaaaaatattcggtaacaaaatgcaacaaaatgtgtgatggacggagaaaggatggaaggagtcaagtgtctcatcagtcatcaatgatgaatgtgataaaaatgaacaaaaatcaaaaaaaaaaattggggtcaaagtgtgtgccaacggacggacgaaatatgcatattaaaacattgggtttttttattgtgcaaaccatttcagcagaagagagattctcaccatacaacacagacacaataaatttattacacgttttttttgttgttgaattatttgtctgtctgttgttttttgctcgccaaatcaattatgtaaccccatcaatttcggggtgagggcacatcaattaattatggtaattagagagtgtaaggcgccccctttctcagtcagcgtctcaaatggtgattgttgctgctgttgttgtagcggtggtggtgctggttgtgctgctgcggatagtgctgatcctcctccacctcgtcacccctcttttgttggtgatgtgccatcgctgccgccgcggcaccggaagccgtactcgcagcagccgctgatgacgaggacgccgccgccgttgcggccgtg

SEQ ID NO: 9315 - DNA, 1107 bp, Heterodera glycines
agcggctgagtcagtaccttggtcgcaagaaaaaaaaacagcccaaaaatttaagcttatctttttagtgaaaatcaatcactcataattttacgagtagtgatcagaaatgcaccagattttgcagggtaacagctgagaagaatgcttattcatataattatttatctatcccataatgtttatttaaaaagtttaaacactgcaattttgcgtacttttccaattttttgaaaaattaattcataattatttttttcagaaaatgctctgaaacgcacctaattttatttacatattaataaggctctctgatgctttttctatcaaaaaggaagatgaattaaatttttaattcctttttaaacaggccaaaatgtttaggcttaactttttagtgaaaattcaatcactcatttttcgagtagtgctcagaagcgtaccaggttttgcaggggcctaaaaaggtcaaggaaaggcgtctctgcgttgatttagcagtagtacctatgaatttaaattttctaagaatttttaaagtttcactatttatttatttttgcaaaattaattcatgaatattttttcagaaagtgctctgaaacgcacctaattttatttacatattaataaggctctctgatgctttttctatcaaaaaggaagatgaattaaatttttaattcctttttaaacaggccaaaatgtttaggcttaactttttagtgaaaattcaatcactcatttttcgagtagtgctcagaagcgtacgaggttttgcaggggcctaaaaaggtcaaggaaaggcgtctctgcgttgatttagcagtagtacctatgaatttaaattttctaagaatttttaaagtttcactatttatttatttttgcaaaattaattcatgaatattttttcagaaagtgctctgaaacgcacctaattttatttacatattaataaggctctctgatgctttttctatcaaaaaggaagatgaattaaatttttaattcctttttaacaggccaaaatgtttaggcttaactttttagtgaaaatcaatcactcatttttcgagtagtgctcagaagcgtacgaggttttgc

SEQ ID NO: 9316 - DNA, 977 bp, Heterodera glycines
ctaattttatttacatgttaataaggctatctgttgctttttctatcaaaaaggaagatgaattaaatttttaattcctttttaaacaggccaaaaagttgcggggggccgaaggccccgcgggcgggggggggggggggttccacaggcgagtcgtcatattggcgagtattcggccatcggccatcggcaacggtgctttgtattgaatccgcagttcacattttacttttatatttcacattttacttttatattaaaataaaaataaatgccaaaaacatgttaggtatgccaattaccaggactgtcaaaatatgtttcctgggttctacgtagtctaattagtagggatgccaaaaacatgcaaatgcatatattttttcctggcttctccatgctctaaatagtaggataaaacactttcttttttgtgtttgcgtgtaaaagtcgagacttttatttgcatatttttgcatattttgggtttttttgaatatttaatgcatattttgccatttttgtacatatttttttagatttttttgcatattttgccatttttcgtcaaatatgttccgatttgaatatctcttaggataaaatattgaaaatgcctaaaattaaatccaaatctgaattgatgcgcgagtgggtcaacagcgagtttcactgccgaaacccttgagaaatttttgatttacaattacaaaaacaaccgatataatttctgaggaataaaatttatttttattattttgcaccccgaattttcaagtttttttgtgtatatttggtgcatattttgcgatttttgtgcatatttggcaattttatttgcatatttatgtgcatattttggtcacttttcgtgcatattttttgaagccctgataattaccagccctaaaaatacctaaaatcattgaataatttttcaagcaaaatattcaaaataaccaaaaacattttttgaa

SEQ ID NO: 9317 - DNA, 1183 bp, Heterodera glycines
tatgaatatgcattcttctcggctattatccgccaacgtcaggtgcatttctgctcactactcgtaagattaggaggcatgatattttcactaaaaagataagcttaaattttttggctgtttttttttcttgcgaccagggtactgactcagcctcttctcggcctcggggggggccgaaggccccccacgaggccaagaagcggctgagtcagtaccttggtcgcaagaaaaaaaaacagcccaaaaatttaggcttatctttttagtgaaaattcaatcactcataattttacgagtagtgatcagaaatgcaccagattttgcagggtaacagctgagaagaatgcttattcatataattatttatctatcccataatgtttatttaaaaagtttaaacactgcaattttgcgtacttttccaattttttgaaaaattaattcataattatttttttcagaaaatgctctgaaacgcacctaattttatttacatattaataaggctctctgatgctttttctatcaaaaaggaagatgaattaaatttttaattcctttttaaacaggccaaaatgtttaggcttaactttttagtgaaaattcaatcactcatttttcgagtagtgctcagaagcgtacgaggttttgcaggggcctaaaaaggtcaaggaaaggcgtctctgcgttgatttagcagtagtacctatgaatttaaattttctaagaatttttaaagtttcactatttatttatttttgcaaaattaattcataattatttttttcagaaaatgctctgaaacgcaccaaattctatttacaagttaaataaggctctctgatgctttttctatcaaaaaggaagatgaattaaatttttaattcctttttaaacaggccaaaatgtttaggcttaactttttagtgaaaattcaatcactcatttttcgagtagtgctcagaagcgtaccaggttttgcaggggcctaaaaaggtcaaggaaaggcgtctctgcgttgatttagcagtagtacctatgaatttaaattttctaagaatttttaaagtttcactatttatttatttttgcaaaattaattcatgaatattttttcagaaagtgctctgaaacgcaccaaattttatttacatgttaataaggctatctgatgcttttt

SEQ ID NO: 9318 - DNA, 1477 bp, Heterodera glycines
  misc_feature (1451)..(1451): n is a, c, g, or t
cgtaaatataggagatggttgtggtgaccgaccaccacgacagttccacggtgccctgtttgagcagggcaatttcccgaaagtcgaacagtctgtcgtccctctccgtcgtgctgaccatcgctctctccgccgtttccgccccttccgccgtttctctcacataaattacgccctccttaaactttcgctctttcgcttcgttttccctttttaattgccttttcttcgccgtttgctttgaaccaaatgtgaaaaacgctgtccacgcgaatttcaataaacacaaaatggtccttttgtggtgttggcggtggccgtgcggtggtcgaatttgggccgggggtcgtcggaaaaggggcggcggtgggctcaatgggagagggcacggcacagtcgcagttgccacccccaaaggaaagagaaaattaaataatttaatcaattttaatgaaaaaatcagaaaataaatttaattgtgccgcccaattatggcgcatttacttactttgttaagagccaaattatgactaacagaagggctgtcagaagacctgtgcaaatcaccgaaattgccaattttatagtgtttttatttttgtcacccattttctggaaaaatcataaaatgtcataaaaaaggcaaatattaattcaatttggccaaattgcgtagcaatgggcgaagagttcaaaaagtcactgaacgaatggggccacctctgctgctaatgagtgaatgagtgaatgaatgaatgaatgggcccaaccgccaaatgatcgccgcttttacccttttggccatggggagggtcacccccgcccccccccccccaattcgtttcatttttcctttcatttttcgtcggctcttcgcttttccatcccaaaatttctctcctttttttcatttcgttggttatcattcattctttcattctttctcaaccatcaaaatgtgtgctacggatgtcataaacaatggaatttgacttatcggagaattacatgcattttatggccaaatttctcatttttttttgttaaggttcgatccttacaaagcaatcacaaaaacaattgttttgctgtaaagagggcaattttataaaaattaattgatattttgatcaattctaatgatgagtaatggcatccaataattacataatacttaatgaatgtgagaagactattaataatagtccgtttcttgagacgaatttaagggtaaaaataaaaaatgataagaattgtttattttcttaaaatatttttataaaattaaatttatttttaatataattatccttctatccttctcatcagctaagatcaaattggccaaaagtctgtttagtcatttccatctcgtttttgttcgttaattaaacgtgcattttaaaggcaacaacttcgttagttttaggccaattcgttcgactcgcgcngggcggtgcgaaagtgccgcaatttg

SEQ ID NO: 9319 - DNA, 2473 bp, Heterodera glycines
aaaggatcgttaaatctgtatatttctcctgactaatggaatacattttgagagggcaattttctatgatctctccgtatctttttcaattgaaatgattgcctttttgttcaattgttctccttttccttctgcttctccgtttacactcctaaaatatatatattttaaattaaattatttaaatgtttttttgttcacttttcggctattccgtcgttgtcatttgctgttgctgctgtccttggatgttcgtactgaatgcggttgagcttgggaatttgctgtggttcgtccgttccacaaatgccccggttgaaacgcgaacatcggcacgacggcgcaaaatgaacgcgagaacggcacgacgatacggcttcacgagaagaatggtggccaacgggttcagaacctttgacaaaatgggaaagcttttggcatttatgggcataaaaagcgaaccgaccggcgcaaaataaagagggatggcaatgaaaaggatgatgaatactgtagtgtctttggggtacagtatgggcaggaaaatttgggtgagcattgcagcggcctcgaaggtgggcagaacggcctgccattgtcacttccattttgggaatgttccttttggttggcaacgcacctggacaatcagtgcgcgtgtaatttcattattatattcgcgcattttctgctttcgcagcgaagtcgtggcacaaattccgcccgtggcattttcctgttggccctgggcgaaagtattgccgacgtaacgacggattttgacggcacaaatctgtaaatggacaaaatatttgttcgattggcatagcaaatgcaccccaatgacaatgtaacaggaggagaaaaggacaaccataatgaccacgtggcaaagccatgggaaagaacgctgaaagggtgaaaacggcactttttgacgggggagggaaatggcaaaaggacggcgcatttacagcccaagtgaacgaagtgaatttgacagcggtgacccccgtctcctgctgaacacgaagcgccaattcgaccatcgcctggttgtaatgttcacgcgggtaatcggaccaggtcagcaaaacgatgtggaaaaggttaagccaaaaagcgaagattgccataagccacatcgctttggccggaattcggccgtctctgtggggcacggaattggcaacggatgattgaaatggcatttaaatgccaaagaatggaccgggagaggagaaaatagcggaaaatgaattgggtggtggtggagaccatgaagaagagcagcagttgaatccaaagaacattcatctgaaaagcgcactgcgcaaattggggagaagccaagtgctcaccatataagcgtacggttggggaatgtttcgaaaaatctaagcaaaataattacaaaagtgtgtttggaatgttgcttattaaaggtgaccccattttggaacaccgcacgataaccatggtcgacaaccttagggaaagtcggacaattggaaaaaaacaaacggaaaaggaccagaattggttggacagcagtcgagacgattacgatcagaatgtcctgaaacggggtgacgaaataatcagccccatttcgaagccgaatgatcggaattttgaattggccaacgatataagccccaatttgaggccgagtgatcggaattttgaattgaccaacgatataagccccaatttgaggccgagtgatcggaattttgaatcggccgaagaatggcctcaccataaagcacgaatggagcagcagacgagaataaatgcgcattgccttcaccgttttggtgtaaatcaaatacatgaggaggacgtttagaaacattccaagcaaaaagctaatcgcggcactgacagagtaaacgaaacgcacaaaatctgccgaaagggcgacaaattggccaaggggggggggacacccaccaaaacggtcactttcctccatttgcgacgcattcatttcgaatttttaaattttttttatttgcagcaattattaaaagaaatgaacaaaaccgaactgtctgtttttatatgaactttaaagggggtcttattttgcctaagattcgcctcggttgtgacacttaaattgcataattacaggaaacttttagcccggcaaagggtcattaaatataaaaatggccaaatgttcggttcattggtagttggatttacacattcataaaaacagatttaactatgacaattaacggattaaagtggggcaattggccaacaatttgttttaaatgcaacgagcgcattttgagaaaattcattaaatgccgccgttttgtgccaacaaaatgagtccaaaataatttctaaatttatgtttacagttgaaaaacttttgtcccgggagaccaattatcaaaagacaacgtaaaaaaaagagaattaaatttataaaaaagtgaataaatgcgtagtg

SEQ ID NO: 9320 - DNA, 1077 bp, Heterodera glycines
gaggatgataagcgatatgatcatttgcgttgccgaggccgtaaaccattttgaaattaaagcagaaatataaaaatgtaaaaaaaggaatttaaatagtccaaaaaatatttcaccagagaaaaataaagaaaacgtaatattaaatcaaataagaaaataattgataacagcaataaatgagtaaataaagataaacagaacagcataaatcgaccgtcgttaaaaaaatatttaaagttaataaatccgataacatttggcattggcacaattcgtccattcgccatggcatcctttgttcgggttcggcacctctctctctctctcagacaaattctggtcgttgggtcccttctctggcagttggctgttcctcttccacttcttctccttcgtcgtcatcctcaaaaatattgccaccgttttcgctgtaacccatctgatgggagcgagcgaattcggaagaaccttaaagagcggagaatggcaccgatcagtggagaaaagtgccgaaaaaggacccccaagaaaatggggcggacgaacgtctccgccgtatttggccacgtaacgacggcgcgcatagacaaggccaacggccaccaaagaagcgaagagaatctgagggtaatgggcaaattgggacaattttaagggcggagagaaggaccatggaaaccaaaaaaacgacaaatttggaaattgaagacggagtcgggtcgcaaagatcgctcaatcggttggcatcggacagactgagactctcgagttcagaggggtatttgcagcttaacggtgtcattttcaaaatgtcattattggaaatgccagtttttccaatttgacaaaggcttttattacgtcggttcgtccgctttgtaaacgatgcgcatcgcttctttcatgtccaccatccatttcaatttgcaatcgcacaactgaacagccaacaagcatttgtgatgctttatccgtccaatgcttacaaaaggatttccgttcagttttaacacgtccaaactcttccaataaaaagaggcaaagttttggcactcaaagtgctgaaattgcact

SEQ ID NO: 9321 - DNA, 2828 bp, Heterodera glycines
tacatcttttcgttgctttttttctacccgaatttttctagttcggtttcaatgactataaaaataatacagaaaagaaaatgttgcttattgtttagagaaagacaattattattcagcatttttgtgacatcgatcagttgtaaaacggcaaattgttgtgctaattgaaccgcaaaaaatgaacagacggtgaagaattttttgaaaaaaaaaaaaaaaaatttcttataactttgctctaaagcaaccaaatttttcattcgtaatatcattcgataggcctaaaggttctctattgcctgaaaaattcaaaaaaaaaaattttttgttaactcaaaaaagttatggccaaaaataaataatgactccgcccccgttaatttgtttgactcaataaaagtcgattggacgcatagaatgagttcattatagccatttttcccatgtttcagctggatttgtaacgacgtgtggatggacattctgccatcctttgaccatgctcaactcggactcaaaatcgcattgctttcgccccgttttgatgcgctggtggacacgcattttgatggcaaaagcgagttgacgacttggaaatggatcagaatttgcaaggatgaagcccaaccaccaaaagcgaaagtgtctgtgccggtcggtgccaattttgtgcagcaatctccgtgggagccgatggatgccaattttgtggattttccgttgccggaccttccgctgccaaacaaactccgaattcgtttcatgattgagtaagttatgttttttttcaaaagacatgaaatcatatttccgagcgttttcgggatcactggtcacgaatctccgggtcggggcgaatttgatcgaaattaatgtcaaaatcggattaattcctaagaatttttttaggaaaaatttctaggtttgaaaattaaaaaaaaattttcggaggggaaacgacgggggaaatgaagtgcaccccctaagacaaccttagttcaagaaaaaaaaattttttttttttaaaggggaggggggtaccatcgacagtattaccattttttaaataaaaacttttgtatgtaccgtattgtctctaattatcgcccggggggataaatggagacggagggataattagagatattatacggtattgtgtgtttgttcatcacaggtacattgaccattccgtcattgcatttctccatgcaaacaagcaactttgggacaccaaaggcaccaccgtgtatttttgtgtggactcggatggcaccgaaagtgacgcacatcagctgcagcatcagcagaattgggatgtgttggcccgcgaaatttggcccatcttttcggcaaatatgtgtaatttgatgttaaacaatgcacaccacttggaccaattgtgccgtcgcatttcgccaacgctgctcactgatcttgacaaattgaattggatttattcgggacgtctgttcccggatgtgtgtgctgctgatggctcaaatgcatctggtgctcgccaagtgctgtacaaatggttgcacacgccgacaaaagatggcacgccaaagaaattgtattgccgtgagacgattggttttccaaataaccaatgggtccacaatttcaaagaggtgtggtggtccgcaatattggtacttgtacagaatttagaccagggatggcattacgaggccccaaaaatttttggaaaatcagaattccgggggtcaaaaattttcggaaatcgaaattccgtgccatccctggcttaccacacaaaaaatttgtttttaatgataaaaacgtatttccaaggatattctcggggtcgctgatcatgaatatgacatccattccgatcaatttcgaatcccgtgcccgaattcgaacaaaattccaaaattcttttcaccaaaatccacctttattgtccaaaatcattcaaatatactgaattattgggatggctattccaagcatttgaatggattttgaacaataaaggcggattatggtaaaattgaattttcgcttttttcgaattcgggtccggggtttgaaattggtagaaatggatgtcatattcttgatcaatgaccccgaatacccctggaaatacgtttttatcattaaaaataccaacaaaaaaaaaagaaaaaaagtttttttaaatattttttatgtggtctaatcttaatctgtacaagtaccgccatatttttcgtgtcaaattgttgtttttgttttgccaattttgtgttgttttttaggaatttccccgtgccaccacttcggccagttacaccatcaatttcaatttgtatttggtcaaaatgcgaatttggccatttgagttggtcaacgaacggacgaatgagaggatgacgctgatcaaggagccggatcgtggtgctcagctcggtgattggctgctgaatcggtgcccattggccatggcggatcagcagcagcagcagcagcagaaagtcgaaaattcggatgccaaattgaactcagtgtacttccgtcttcgtggtgattgcattgggtgagccaacagcagcagaagagatgacagtaaaattttggaaaaatttgcgacgatttttttttttttgaaattataatgaattagaaagttttcgaaaatttttcaaaagtcgccaaaaaaatttttaccttataatctcttcatataaaaaatttttttaaattaaaaattaaaaaaaaattcgtcagcgaaattatgtcccggcgaaaagagtacagtaccctttgtacaatagtactttcttggcagggcgcccatttcgaggcttgga

SEQ ID NO: 9322 - DNA, 1518 bp, Heterodera glycines
tatacaatacaacaatggaaatggacgaatttgcgagcaagcaaacgtcaaatacttaacacaacaatattgaaatggcatagtgccaacatcatttcggtcatataaacatcaatcaaccaattaatcattcatttctgcttctgttgctgatcagtgatcactcggcccgggtgaagcggtgtcgagaagactaaaaaatgatgatttaattgaatgacacccatttcgatcaatttcgaaccccggacccgaatacgaacaaaaggtcgaaagttcaaattttgaatttatttttgaaaaagatgtcatatcaagctaaactattaccaaaaaagcattgatcattttaattaaattgttcacccctcgtcaaatccatcgtccttgatccaaatgataatctgtttcggtcgagcagcactcacttcctcccacacattgtcccatttgatctcatcccatccaattggacaacgcgtgagccaacaatggtttgtatcatgatgttccagtgtcaattgctccccagtcacttcgttgatcagatcaaatggcataacaaagtcaattaaagtggatgaaagcgtcaagaaaatgcagaaagtcactggtgaagaagcattggaaaatgccttaaaaagggacaaaaaactcataaaaagtggtgaataatccaccgatttgaattgttccatcgttgatgaccattgttccaccgatgaattaacagagcatttgagccacttcggcacaccgtccggatgaggcgtgaacagccattttgccagcacttgaacatccgacgccatggcactgtcatcgatcggaaattcggacactatgccgtcattgaagacgacagcgcaaagggatggacaatcggtgagcattgacggcgccaattgacgcaaacagcgaaaagcgatggcgttcaaaaacaagcgacgaattgaatcgcggaacattggccaaatgttgtgcaacacaaattccaaaatgcgaccattttcaatgacaatgtccaaatccattgcagaagtggcgaaaaaacggtgaaaatggccgagaaaagtgagcacattttgatcgatgtaactgaaaagcatagaaaatgatggtcacaaatcagtctcaatctaatcagtttttacatgatctgaatgcgtccgctgaatccgatcactttgttcggcaaaggcttttgcgggattggcaatgtttcttttctgtcggcatcgataatttgcattttcttcgtgccattttcttcaatgtcccatgtaattagcaattgtttgttcaacatccatttgcgtgtcttgaagtgttcatcaacgtagaagtcaaatcgacggctgatcagtgcaattccgaggccaagttgagaaggcgcaaggaaatcgaacaccaaaagccaacaatcggcgcagataaagctgaaaaaatgaagaatttcaagaaattttttgtttattttttttacatttcttttttgggagggagtcgtttttttga

SEQ ID NO: 9323 - DNA, 921 bp, Heterodera glycines
aattagcgataaatttatccttttttctttgaccgacaatttaaaaattaattatatatattttcttttcactaggttgtcctcccctggtgtatttgctgctcaatcaacgaattcgaaatgattgtgccaactatggccgtgccattttccgttttttgcgcaatcgcaacaataattcggtgtcaaacgggctagttgccgtggcatggtccacacaaaatgatgccggaaacaatgccaacaacagaatgagagacgataacaatgtgcaacagcagtgaagcctagcgggagaaaagatgaggcgaatatttataaactcaatattaaatcatttcggttatcaatatattgcttttttttaattgtattcctcaaaatgcctgttggacaaaattcatttgttgcaacaaaataatcccaatttaatggcctaacaaaatggaaaaatggctcttggttaacttataaaaaattttttaaatgagatagaattaggggtaggtcgggacactaaaatttatgttgactacaataaaacgacacttctaagaattacaaagaataaagcgtatgggtgctgaaaaatttcaaaatattatttcaatgaaaatttacagtatgatccagaatcattctaccgtgctctaataaattatttttatgaaaaattcttttatttcacgttttggtgccgaacttcttcttccatccgattaagctggttcggttgacacccaaattttcggcaattttcttatcactcatcgttagatttttcttagtttcatttcctcacttcttttcacatatttcaatttcctcaccatatgtaagaattttcaatttgccttaaacaaataaaataaaaattaaatgaatattaatttaattaaaaaaaactttattacgtttatt

SEQ ID NO: 9324 - DNA, 4172 bp, Heterodera glycines
  misc_feature (4089)..(4089): n is a, c, g, or t
  misc_feature (4094)..(4094): n is a, c, g, or t
  misc_feature (4108)..(4108): n is a, c, g, or t
  misc_feature (4117)..(4117): n is a, c, g, or t
ttctgcttccggaccagtcaccaatcactatgctgataattcgagaccatcacgaaaaaatgcgacactcaggagtagaagccacgctcacttcattcctggagaaattttggtgccctaaagctaggggcacagtgaccagagaggtcaagaaatcacacaaggcctggatcgtgctgtaacctgcctggctactcgtgacgtctatcttgagccggtccgggacctaacggcctcgtcatttcttctcattctgcgccgcttcacatgccgacgagcggtcggggtcgttttcgcgtggccgttttcgcgtggccattttcgcgtggccgttttcgcgtggggacgttttcgcgtggctggggtacgttttcgcgtggccgttttcgcgtggggtacgttttcgcgtgagtagctgtttaggactgaaattggtcggatttgtgcaaaacatccatgtttcgaatccgaacccgcattcggacaaatttcttaactttttaatttttttatttcttgcggctaatatcttctacaataatttgtcagtttggcggatgtgcgtcaaacggaaaaaataattaaaattttataaaaatataacaaaaaataacaaatttcagaacaaactaaggtcgcatttcatagtttcgggaaacaccagtgagaaaattgataatgttttcgggattcacattggcattggcataattgtgatcattttgggggaggtgaatgttattgatgtcgttatagagtgcgccgtcatgttctaacttaactttgtttcgttttgttatttgtcctttttcattcttttggcctttctttcgtcgcatttggcgacactccccgcgcagagaccaggtggaccagcgctcgaggaggcggacttcactgagaggacttcttcttgtgtcggtggcctcctctatactgcggcgcatggaccgaaaggcgaccgcctgctcatttaggagttgtcgttgaatgtcgatggagtcgacgatcacttccttcagccctttaagcactcgttccgcttcctcagcaatttcgcgctttcggcgctctgtccattgggcggcagcctcttgatcagtggcgaggcgagcaaattgtcgatggagtatggcccgcaaatcgtccggtgctgcttccgtggcattgcgattggcgagggcgggtttttggatggggaagggcaaatggcagccaaagaaaggggtcgtccagcaggggccggagtcgggcggcggttggtcctttctgcctcggctaactcttcttgggcccgtttaagggcagcacgtttttgggagagcaggtcggacatgttgttggcaaggcaaggcgttagggcgatgacagaattgggggaaaaaggaatttggcaaatgatggtgataagtgctggctggcagtatttaagtagtagatcggaaggcagcggcaaatgaatcacaccaactcgaggaacattggattgtgtagaagggcagtgggtgaataagaaaaaattgagtcgaagtgaattggttggagggaaccaaattgtcgtttgcaaaggtcgtgtggcagttgattggtagatgcgacgaatgtcgccaaaaaatgcaaaaggcaaacgaggagaagggcagggtagacacgcaaggtgatcgggccatgaatagttaatgtttgtccacgtgaaagtcggcgctcaattcccggctccccaattggcacgtcatcggtgctgaggttaacgaaaagatgatcgggagtagtataagacgtcaaaagcgcacggttgcgcacgggtgtttaccgcacaaacccgtgcctatgggaggggcgcagccctttgatattaccgcccggggacattttcccgcacaatcccaagcctataggaggggtgcgtgccaaccgaaccctatgtgaggggttgtttctttgaagtctgccgccttgtagatttaatttcctcaaatccgcactggcgatttttttttcactccccctctccgcgccgcgcagcgccgcggaaggtcatcaatcatccacctgtcaccaaagtggcaggtgaaggaaattcaatttttctttgaaaatttaaaattttgaccccaaaccttttagcattttattttcacaaatcctgagatttttatgatgggttttcggatcctgaaatttcatttttgaaaatgtgccaaaacagtgcgggtttttttttgcatttcctccccgctcgccccgcgccgcgatgccgccgccgcgaaaaaaaaatcgataacggaatttggaagaagtgcaaattaattgatattggcagcaaataatatcaattataaattggacaataaaattaattatttaaattgtgtttaaaaataaaaatcgaaaatgaataaataaatcggatgaaaaaccttttcaaaagtaggtcacctgtcaaccaaaattgattgatgggtttttatttctcttccattattccgcaatctgcacgtgactttttgttccaattatttcgcagtgtggaccattaattaggtcaactgtcaataaaatgggattgattggtttcttattgaaatttctccatatttttagtttttttgttccaattatttcgcaatagggcccctaattttgcaaacctgtcacaaaaaatgattgatgactttcgaaataaagaatatccagacgatttttttttttgcagttttgaataaaatgtgacagttgtctacggaaatgattgattaccctcaaaattaaggcagacccagacagtcacgtgactagcccctcctcttttttacccatttcgtacacccggcccaaatcgaaaatcattcaactaaatagttggatttcattaaactctctcttcacgctctaattttatttctctccgctctatttttatttgcattaattaaatctattactatttacctacgtctttttcttttcaaatctctgctctctttaattcttctgtttcaatttcttgttttaaaatgtcttttaaacgcgtgaactccttccaacccgccgtgccaatggccaaaaaatgggatttccgatcaatcgggtaagtattacatgcgttacaatgcccaatggagaagggccaagaaatgcccataaattcgactttggattcaaggaacaccagcggatagggtaagtgtttttaataaaatagaattaaaatagaaaaaaaaactaaaataaaaaaatcaataaataaatttaaaataaatacattaaatttatttaatgaagcaaaaaattctttaaagagaaaatgaaaagcaacaaaaaaaaccgaaaaataaattaaaaatattttaaaaataataatttaatgagccaaaaataaataataattaaattttaaaaaatcaaaaaaaataaataataaagaaaaaaataattaattaaaaaatattaaataaataaaaaataaaatttaaaaaatcaaaaataaattaaaaataaaataaataaaataataattaaagtaaagaaaaaaaataatttaattataataataattttattaaggattacaaatgcggataaattttgcctgttttacgcgcttgtggcgtctaaattttatttggaagtgcatcgaaacatttttaatcgatttatgaacaatattatgagacagagggacgcagctattgagcttttacataattgtggaattgatattaacgaatatagctatggtgtggagcaattgccgaatgttcagaaatattgggtgggtttaaatgaaaaaatgcaaaattaataaatttttcaggatgagatttaccccggaaagtaccgggttgtggcatttgagaagtcagctgatccgcggaaatcgatccgtgttttgtggaagggccagatggggcgagagaaggtcgtaccgatatttttggagaatggtcactggaatggtctgaagaattacgcttgcttttttaatcgagggaaaaaattttgtgttgaatgtgaatgcttttacgatcaggatgtaaaacatactttcgattgccgggcaaggtgttattattgcaaacagagtgngaggngtgccgtgtcaaanggagagtgnagtgaagattgaatgcccgaagtgccaccgtacttttataattgggagtgtacac

SEQ ID NO: 9325 - DNA, 4369 bp, Heterodera glycines
tatcattcaaaaggaaatcagatgatgaagtcgaactgactccgtctgacaatgagaggttttgagccggttctaaacccgaagaaaattggtgcagctaacgaacttcgcatgcttcttttgcatttttctgcttttgcttctacgatttttcatgacagacatatcataaaaaataaaatggagccaagcgggcgcgaatcccgtctcatatgacccccagaggattaataattaaatttcaaaaaatcgtaaaaaactcaaattaacttttccagacattcaatagctcctcaacaacatctgcgtgtgagttttttacgcccgactaatttcttaaaatggaaaaaatcaagtacttgattaaaaatcagataaaatcaataattttgtaaaatccgagctcagattcctgatcagtgcatcttaaattttaaacaaaactttaccattgccgaacttttgaatgataccaaattttcggggtttgattttactgatgcacaattgtcttcattttcgggttttaatcaagttcaaaagattaaacacaattccgcaactagagacctatttttaattttcagtttttttagaaacttgaactatttaaataatagttctgatgaggagagttttagtatatcatttatgccattttttgtgatggattgctatacttccgccaaatccaatttatataaacattcttcttcttcaagggtttattgattgccattggtgtcgatgaagtgattgccccgtcttcctcagcttcaaatttaccttcccaagatacgactcttctaaaagtttggagcttaaaccaatggaatgacgccatttctccgccatgcaaattttctgctcaattgaattttggcaggaaaatagacgcttcgctggccaactttgttgccatcagcgaaaagcttaatgtgattgttattggtaggcaatcaattcgcttattgataaatgattatttgtttaggactttcaaactcatcacttttttaccatttattgttggctgacccaagacaagatcgctttatttctccaaaatgggtccaacttcgtgaaagcacaaacccagccaaagatggccaattggcgggtgttgtaattggcgaagtccgcaattttacacttgtctcgtgtattacggacaaaacagtgcattcatacattttgaattccgaaggaaatcttctgaagacggtgccaaactttgataaatgacaaaatgcactttttggcacagatagtgcacgatgtgaagggttgtgaacggaaatgttggcattattcgaagacgaccaatcagctcattgtcgcgagtcgggaggtgggcaaatggcacaaacgaaggtcattggttggtaatttgcgagttgctaagatggtctacttctatgacattaatgactgcttggaaatgggtggcgaaaacggacgatgtcacgccctggggagaggaagtgaaaaagtgcaactgctggagaaagatgggcaaatcgcactggtcactgagcaggaaacgcaaattcagtgagttttgtcaaaataaatgcatttaattgagaaacaacgcgaccaacgagctggaaaaatctttgggttataccatgaaaaaatttcatatagggctactcttttttttctttgccttattacacttttatctgatggcacaatttgttgtcttttaaatgattttattttaaaatttcttaaaagttttaattgtttgctttccattttcactattcccatgccattcatttttcatagatcagacaacaacaaaatgaatgttctctatctgtttgacatcgaatcgcgttacatttcatttttctgctcaatgccttcgccctgtcatatttttacattgggcggtgaaatttatctgcgcaattccgagggagtgcttagcaaattggtagaagagagtgtggagaccaaattggacattctgttgaagaagaatctgttcgatttggccattaggtttggtcgagttttgcgtttccaattgctttttttcattttttaagcattgcgcggcgtggcaaatccgaggaactgctcaaaagcattttcatgaaatacggtgactatttgtataaggtaaagagagttatttttactctcatttttgtgtttattttcagaagggggactttgacaattcgattaagcaatacacaaacactttcggatttgtcgagccgtcgaatgtcatcaaaaaggttttgtttatttttaccaaattgttcatgtcaattgctttctgttgacagtttcttggcggcgctcgaatttcacaactttgtcaatatttggaaggttttttttaatgagaattgccaaatttaagtcccacttgctttagcgttgcatgccaataatttggccactggtcaccacacgactctattaattagtgcttatgttaagcttcacaatgttaggaagttggaagaatggttaaaggacggagctgcacaattcggacccgattttgatgtcgattccgcgataaaggcacctaaatcgaagcgataaaaggccaaagagtacatttttaagctgttacgatccgctgaactttttcacttggcctcaaaattagcagcaaaatccgatcgaccattcacatttttggacattctttgtcaggacactcgcgaatggggaaaagccgtcaaatttataagtgaaaggccgctgtcagtttcatgcgaattactggaaacttatggcccgattttgcttgaacatgtcgaggaacaaaccctcgcgcttatcggacgattgatttggtcggaaggtgagaaggtgttgaatccagttctttatggattaaatttgttagcaaatcggagggttggtgggttttaatgggtacctttttgtgttcacaatcaaccttttttcagtgcaatttttcaaattcaacgtaccgcagaaaaatattatttttaacagattttgcccaaaaaggcgatttatgttttctagaaaattttgctctgaataggaacgcaagcaaattttaatagcattttttacgcgttaaggagtgaaccttaaaaatctgacgaaaatattgacaaataaaccgaaaagaatggaggaactgttcagcgagcttaatttggctggcgaactgaaagacccgcaagtgaggagtcttttgcttgagcaacgcctgaaaactctccaagagagtgccacggttagtgcatttggacgccatactcccaaatggtcattttcattcagaacccttcgaaggcacagttcgcggaattggtctctctggttgattcggcctctccccaccactcccttctcttagcttatcagtacaattgttcgccgttggtcattcacattttgagacttttgaacaggtttaaatcgactttttgcttggcattgaggcctatgcacaaatcgttgtcagttattttaggtccaaaatataaaaatggccactttagattttgagcagcaaatcacattttatatactgactgacaagggaaccacccgaattgtaagtcaaaaatgcatatttattatataccattggatagaaccttgccccatactttgatttttttcacacaccgctaaaattaaaaattcaaaaacaagtcaactctgtcagtccaatggaaataatacaaatgcatttttcggcttaccgttcgggtggttcccttgcaagtttcaagttattccaagttaagcagtttgggtgtaattagtattctaatttccttgaccagcccatttaaaaagattttgggcatgggagtaatgtctgggcgcaaatgtttatttgttgttttcacacaaaggatcgaagaactcttccgttatttgctcactgagggcgacgtggtggcagcgatcgaattgtgtgaaggcaaatcactcgaggacatgtgggtcgaactgatcagtttcggaacgaagagcaaaagcgccacaaaaaaagaggatttgatcgcgcttctacgaaagttgcagagatttgcttcttttattaatttttacaatttcagaatttcggaatccgactctttaaaccctttaatcgttttggaaattttgtctcgggacgagtcgctccaagtgggcgatattcgcgagtttatcatcggatggttggaacgacagaacgagtcactcaaggacaatgaacacagaatcgcggagcaagagcgtcaattgcaaaaaatgagcaaagaaattgcggacctcgagaataagttgcttttcggggtaaaaggcggaagggaaagaaagggttgtcaattttccatgacaattcgtcatcggcggtgct

SEQ ID NO: 9326 - DNA, 769 bp, Heterodera glycines
  misc_feature (757)..(757): n is a, c, g, or t
ttgagaattttgaaaatttcagatttccgacttttttcgaagatttcgaaattggccaaaatgagtgtcagatttgtgttcagcgaccccgaaaccccttagaaacttactttcagtgacttttaaaaagttaatatttttaaaaaaagggggtcctaccatcggtagtattacccgatttctggaaggtttaactgttgtccctttgcagtgtccaagtgtaccaagtggcgaagtgcacggtcggttctccaagtgacccatcaacggtaacttttcttctgcctcttcaggtgtgtaacaaccatctccaagtgcccgccattcatttcctctgccgacattcctaccatgcaaattgtttcgagtcgtacagcggaaacagaccagacgaatgccccgcctgtgcaatgaacgaaagaaagggaggacagagcgaaggcagcggaagtgaacagagccaaacccaaccgatgaattatcagcagttccgaaaaacggttttacgcccagggtgggaagggagttgaattgacatgcactttagttggcgggaagtacggatattatggcatttatttctgattgtctgacgaatggacaatttggtgtcagccagaaaggcccggaaagaccacgagaaggaacgccttttaatccgttcaacgaagatgaaacgagttaaattgatatacctatatacacaaccattgacaaaattttaaaccctcaaaatgtaacgccttattctcaaaantgtgtatatgca

SEQ ID NO: 9327 - DNA, 609 bp, Heterodera glycines
  misc_feature (11)..(11): n is a, c, g, or t
tttattttttntatgacacttgatgaaaatcagacacaatgaaggttcatgcatagtcagagcttagattcgtgatcagagtatttttttaacccaaattcattgctaaactttttttaaaaaataactttaaaaatcgaaaaaaatcaagtagttgacaaaaaatcttagataaaaatcaatgattttcaaaatctgagctgattcgtgatcagcgcattttttaagcctagaaaaaataccagacaaatttttaacattttttttcgtcgggacaccaattcttaatgattgccttacttttggcaaagttttaatatgttttcagaaacaatttaaaaagaaacttttaaattctttaaccttttccgtaaaaattgcttaaaaaatacggcgctactttaaaagtggccgtttttggaaattttttcaaaaggggggacccttttgttttgcaaaatttttttgtgagtcataaaaatttattcatcttaggtttttggggtccccgatcacgaatctttcaattattttgatcaattccgatttcctaatctacatatgaacaaaacaacgtaatttgatgaaactcaaaatttccatttttat

SEQ ID NO: 9328 - DNA, 1655 bp, Heterodera glycines
cctggacctggacctggattccatgttggacctggcttccgatttcctggacaaaaatccaggaaaatccaggtccagctaaaatccaggctcctcgagacctggatccaggcctggacctggatttttttaaactcattttaaaaatcaaaaaaatgtttgaaaaattcaattaattacttggcaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggacctggattttttttcacatttggcctggacctggatttcctggacaaaaatccaggtccaggaaaaatccaggttgtcaaaaaatgacctggacctggacctggatccaggaaaaatccaggcctggatccaggtccaggccgagctctatttgttatacataaatcccaacttttcaaaattttgcgctatcggcaccgcctgaccaatttcaaccaaaatgaaaaaacactactaacaaatatgaacttcacatttttttcaaaaatgacccaaaattactttttcttgcttttttcagaccaaaattaatttgctccctctctaaatgccgaaggtttgtgcttttcctgttaactctgatttgggcactttttcactattctacaggaagaagtgcccgaaggagttgaccagctgacttattttcgtgagcaatgcgagcataaggttgcccatttgaagtccattttggaggaatgcaacgagcgcgtgcggtccaagccgaagaccactgaaatttgtcacatggttcgatttaagtattatcattacaaaaagaatagacttgcgactttttgattggaatgttgcaaaattgggagacggtcacaaatagagattatctacgggccgggtccgtatacgggtttttagcccgtaacccgtatcgatgtcaaacccgtaacccttacccgtacaattacgatacgggttatttttctgacgttcttctaaggtgaaatggagtaaatttttaaattttgtgcagtcaattcgccaaaacattgaaatttggcggttacttttgtaaaattttctgtgaaaatcgaaaaagcactggtaaatgttggaaaattttatggaattggaaaaaaaaatcaacataaatttttatgttattcaatagcacttcgttgaatttatgaaattctctttcattttttccaattcttaaatttcttaagaaattggtttattcttcaaaattatagatcattttagtgaaaaactgtcagcaaaattcacgaaatcgtttaaaatcgcaaagttgggcattttttctataaaatctttgcactctaattttaaaaatttttcccagcggcgcctaccggcaccgccggactctcctccccatgttcctaaaaagttttttgagaacgcgcgccgcaaaaaaaagtagggtgaaaagtggtcgttaaaaatttttgagcatatttttatttcgtaaaataaagtcttttagcttaaaatattcaagacttgtatttgtaaactaatttttatcaaaatgaaaaaaacccttacccg

SEQ ID NO: 9329 - DNA, 2728 bp, Heterodera glycines
  misc_feature (2682)..(2682): n is a, c, g, or t
ccttacccgaatacgggcccgtatttttactggataccgttttttacggactacgggttttacggggttttagcccgtctcccgtattgatgtcacccgtaattattaggcgaatcactcgcttttgttcactaatatctatgtctgcctacaggagatgatcgactacgtggagggcctcgatcattgtgccaaaccgaaggcattcaaagcactgaaatgatgcccttcaccgccggatgattactttaggttttttgtctgttaatgtttttcggatttatgacgacgatatcagcaagcttttcgaatggatattaatcaactggtaaaatatgtaattaaactcattggtgcatttttgcgaatgtgaattttgctggttcattttcggttgctttgtaatttcaatttgccttcttatgctttttctttgttatgaccatagagcactcgcttctctttttctcgtaaaatttccttttcaagaacagaaaacgggtggaaagtcacttcattaggagacactttcgaaggcgcaatttgccatttcgaggagcgctgcctttaaccgtccatcattcacttctctttgtccattattcattttgcacattctgcggttggtaattccccccccccgcttttgaaaggatttgtgtgatcgataaatgaagggagaggtgagtgaggagcactttcgaccccgtccgatgggccctcccccgcccttttgccctgtgtacgcaaatacaattgaatggcgactgaggggactcgggtgggtgttgaggaagagaagaggattctgagaaaggaaagtcctttggatgttgaagaactctcattttctcctcctcaaaagcataataataatgtgtaacggcacgcacttttttgcccttcaatggatggacggactgtttttgcattttgctcctttctttttttgtgtgttatgaaaaaatcattttggtgcgatttgttgccctttgaagggccattcccactgaccattgttgttttattggatcattaattataataattaattgtctgacacccgtcaactttcaaatgaattggtttcctttctgtttccctttgccccaatctttcgtccatttattgtctcctcccccctaattactctttcttttgcattttaatgaaacggttaaaagggcatatgttcttcctttcatttagcagagggaacccctcgccaattgagtgcgttttttggcattgccatggcttttccccccctccccttcttttttctgtttccgcttgccctcgtccctctccaaaggacagctgcggttcatccaccgctgttcaaccgaattgtccccaccagcgaacggacagtgaatctgactttgacgcgggattttggcgaggcaaaagcggtgaattttggctggaaaagcgaaattttagaggacattcgttttggaggattatccaaaaaatgaacggaaaaatttatttattaggaaataattatgcctttaattaggccgcatcaaaaaatgagcttaaggggaacgatgaaagcgcaaataattcaaatttgaccgcatcaccggtggaggcgaaaattcatcgactgaaagagctgagaaacgaaatgcgtgcattgacggcgatgatcaaagaagaacgacgacgaagtgggatggcgggggctcaaacgaaacttaggcgactcgaaaacattcaggcaaatccaaagacattcggcaccggcaccgatcaatcgcggagaaaatgcgcaccgaaatcagtgggacaattaaaaatgaaattgaaaagcataatttccccatttgtttttcgcaggcagacaatttcgaaaatggcgcaaaaaagtgctaagcaaaattcacttggttatgcaacgattggaccaattggagggcgaaatgcacaggacaaaggataatttgcaaaaagtgatgcacgacaacggccgggaggaagggggcaaatggggcgggggcagcaaaaagcggcgggtgagggaaagcattaaaattggaaaagagaaagccgacttagccaccgccttcgcattccgccgaatcattgtcagcagtgcgccgcgtgcaaatgaatcggcgcggcgaattgggcaatgtgtgccaaaaccacggggagtgcaagcccggtacaatgggatgagcaatgccaccaataaatgaacgatcttacctcaccccaaggccattgctgtctccgggatgccccaatgtctacagtacccctgccgattggacgaggcatcggacactgtgtacggtacgcgcttgaggaaggcgtcgactgccaacactcgtgcgcatgcgcagcacaacttttgtgcttcagggagcaccaacagcagcagcaaaaggtgggcaagagagaggaagagcatttggagaaaagagcataaaaattaaattagaaattttgactttttaagacaaatgccaacagttcttcgctgatggctgtctgtaaaagggcttcatcttcggatttgctgaacggagtgtacgaaaatgcattggattccgtgttcgagcataccaaaagagtgcttaatgccaatagtttttgagaactgaaaaccaaattcaaaagaaatcaacaaaatccgagtctcttttttatttatttattttcctctanttgtccatgccattcccatctcatttaacaaccctctcatttgact

SEQ ID NO: 9330 - DNA, 1306 bp, Heterodera glycines
cgggtttaaaaacaaagaataaaaaaaatggtaatttaggaataattcccacccagaaaaacacaggaaaacgcgaaaaaccgaatcgattatttataatttaaaaaggacaaattcgaaactaagaaattctaacaatcggcgaacagttttctgaatcaaattctttgcacaagaatggcagtcgcttctccgcctccgttgcaaattgcagcgataccaaattcccctgattaataaatttggtggctttttcgcggtgtattacactgacctgactcgagttgatgcaccaaagtgaccacaatccgtgctcccgaacatccaatgggatggcccagcgccaccgctccgccgagtgcgtttacccgtgccgggtccaagtcgagctgacgaatgaaagccaaggcagtgacggagaacgcctcattgacctcccaacgcgcaatttgatcgatcgaaatgttcaccgattgtaacaactgaatttttacattaacccttcctttgaaatataaacaagactttttggattgctataagtaatttaataaatcaaatttaatggatttataagtcgaaacgaatgtaaaagtgggcgttggtcaagcatttaatttccaagaataccgttttgaccgcgtcaacgggcgccactgtgaagtcgacgggcgctctgccagcctcggcgtaggcgataaccttagccaacggttttgccccttcaacttggcctgatgcgatcacaagcgatgccgctccgtcattctgaaaatactcaaaaattacaaaaatgctcaacattgagtgccaaaaccgctaaccaatgagctggcgttagccgccgtgatggtaccagtgccgtccttgacaaacgccggctgcagcgaaggcactttgtcgggcattagtcgccgatactcttcgtcctctgccaccattaactcggtgcccttccgctgtttgactttcaccggcacaatttccgcaccaaatgcgccgcccgcccacgcgcgagtcgcacgagcataggaggcgagtgcatacgcgtcctgctgctcacgcgtgaagccaaattcagcaaccgttttctcagcacaaacacccatcggttggccgagcattgcgtccgaaatgccatcgcgttggatggaatccttacaattagcaacatttgctcagtaaaagccaattataaatttaaacaaccaaaagtttgatatccccagtagttgttgtcaccacgcgccaagtaaaatggtgccccatgaaaggtttcaacgccaaccaccaaaaccatggaacg

SEQ ID NO: 9331 - DNA, 2724 bp, Heterodera glycines
atgaaaacgaaaaaacaacagttgactcacgtacaattgaaaaaaatggacgaaaaatggttacaatggccactgacttttgcaacagattgccaactgaagggtacaattaaaaaattaaattttatttagccggggtgccaattttatgaaaaacgataacccaaacgctagcccattttgattagaccttacaaattttatggctttaaaattcaatttccgaaacatattggttggtgccttctctcaattcatatgcgcacatataattcgtggccaattttttgccaagcgatgaaaaagctgacaaatatggccaaatgatgctcccctcttacaattagcacaaaaattaactctaaagccgaccatgactggttaatgctttgaccttttttgtctgctcttagccggaaattttgttattaaacacaaaagtttatgttatgttaattctatgctttttaaatttttagtggtttttaggcccgttgttttttcgcgcataggtgatgagaaaagaaaccctaaattggctcgaattaggaaaaatttttcaaccaggccgccattacccaatcgcaaatgccgaacccgcaaatatcggttaaaccattcattatattaaattattatggaataattaccgctttttcactattttatgccaaaaatccgggcccattttttatttaatgccctacaaaatgccaattttagtgaaaatgtttcatctggatacttgcattgtgtgcagtttttgctttaccatcatatgcaaaagctggtgtggcgccttgagaacaaatggggcattatttctgatcaaaataatgacaaaaatttggaagcaaaaaatcatttattgcaaatttacacggagaaaaaaatgatcgcatgggaacaaatggtgaaaatctatgggaaagagttgaaggatctgacagaggtgaacgaactgattcggaggaaattcgaattttgtctgatcattgagggcgaaacgcgtgagtttttttttgatgagatttgtcacaaggaatagttttgtcttatgtgccatttatttttcggggtccggacaatccgtcagtggtcaatccgtcagtggacaatccgtcagtgaaggacaatccgtcagtaatggacaatccgtcagtaatggacaatccgtcagtaatggacaatccgtctcagcggataatccgtcagtggacaattcgtcagtaaatttttttttgagcaatcattaaaaatcttgcaaaaatgatcgttaaatttaataacgtaatttcttatagattcataacatttctagttactttataattcaattaattgaccatctcaagaaattatcatttaattcttttaaaatgattatttcataatttttataaaaattattaattcacatttttagcgacttaaattaattttcacatggttacaaataaatctgggtgttttaaaaataaatttgcttatggattagttactgacggattgtccactgacggattgtctacttactgacggattgtccactgacggactgaccactgacggattgtccgggagccttatttttctatgttatgtttttgtcgcattagtcttttttttttgaaaaattcgccatttttacattgaattttttattaatttctcctggctgtgactattggtgccgccggccgttcccttaaaatattcagtatttgacctaaaaaagctacaagtaattcctgaagaatattttttaacaatgcacataataattccaaattttcccgctgcgcctttcagcgccggcgacaaaccagtaataaattaaaattttatcacggcaattccacaagttgttcataaaagttaaaacagtcacagacatatatgagggcaaacaacttttaaaggattttaacagtttgaaaaaagtttagatattttttgatatttgggtagaagtaccaattttagtcatgttttttttttaatttatctttgtatagatattgttacaataagactatcagattcagaaagctataaaatcataaattaagaattgaaatgcaatgcaattggtgccgaaaatgcgcatttgttcctcaaaaatttccacaaaattgtgtttgagccagaatatgaacggaactggtcaaaaaaagcagaattaattggaacaaacattttcaattcgctgagaaaagaattgcggaagaacgaacaattgaagcagaacaaagggaatgaggaccaaaaagaaaaggccaaaattatggccaaaaattggaaattggccgaaacatcgatgcgtgtacgagtccaagtgttggtgaacacagcggagagaaagtgccgaacattaccgaaaaaaccgtttcgacagatccaaaaattgggaagaaatttatcgaaacgactcgaaaggtcatggagttcgaaaaatagggaaattaaccaaaatgaaagtggaggagataaatttgatgagttgacgttggaaagtgaaaattatacaaaaaatccttttcgaaatggagagagaaagtcaattaataggacgacacgaagggaaaatgaaaataccacgaaaaatccccttcgaaattttcaagaatttggtagaagcatttcaaaacgattggaacggtcttggagttttaaaaataatgaagagaatgtaagcaaaacggaggaaagtgccaaaaacgg

SEQ ID NO: 9332 - DNA, 1849 bp, Heterodera glycines
aaaattcggtgcttatgggttttgccaaccctctagaaatatatttatagaatattttatggtataattttaagcgcggatcacgaacgtcacgtttatttttaaccatgatatgtttccagtgagttaagtgaaattttagtttttttttgatgagattttacgaaatttgttgcctttatgtaaaaaaaattcagaaggggtggcaaaacccataagtaccgaaaactcttctatagttttttggtatgccatttctgtgtctaggcctcgcatagtactctaatcaaataacgcgatattggaattccattgatttatttgaaattttcaggcggcttaatggacaaaagctttgatgagtttttgttccaatgtgctggacaattcattgaggccgttgccgaggaacaattcagttataaattgtttgtcaatcttaacacaatgcaattggacaccgaaatggactttccgccatccatgaaagatgaaataatggtatcaaaaaatgttggaaaaaatgccaggggcaaatggttcatgatgcggtcgatatcctaaataaatttactaataaaaattttaataaatcaattatcatttaatttgtaagcgtttcatttccctttaatcacagtgaactgttaaaatcgctgaacaaaaatttggcgcatcgtctgaactttgagaaaatcacaagcagaaaggaaaaggaacgctggataatgctgcaccaaaaattggagaatttacggctcgaaaacattgacaaccgatggatgcacagaacgggcacaaaactgtcgcacagttaccaaaactttgtgcgcgactttcgcaaatggaaagccaaaggcacactttaccatccgataagggacggaattcgaaaggttcggcacgacatgggcagtcagaggaagcactcggcggagaggaagctgtacaaggcacagacaatgcgccggaggagacgaaaacggacagacgacaacgaaatttttgggggacaaaaaacgttgggtgaattaatgagtgaggaacggcagctacgaaaaagcgaattcaccggtgagagtttagctcgatgaaatgaaaaagtgaatttaacgggccaaatttaatgaccatttaacgttaaaatttatttaaaaaattttaaacaattaaaataaacggatagcataagttttaacacatgagccttaatgggtattgtaaacataaattagaaaatgaaaaaattaaaaacatttatataaaataacacaaaaagccctaaaaaattattaatagcgccgccatggaaattttaatttataagtgagatttgttaataatttttattaaaaaggaagaaatgtagatattaatttattagatgattaaaaaaaacatttatagccctccagtcaaaaattttgaaaatctatttctgtaaacatgcagatttttaaattcctgtctcgaacataaaatttttttttgaaaataataaaataaaataatttatgttatacacaatggaatttagacacaattgttgcgatccgatgcttacaagaagaagacgaaaccagctcaagtgaacagcagcagacaaaaacattgggagaattatttgacgaagaccattttgaagcaccggaaattgtaatggaaaaaattgagcggaaaatggagaaaatcagacaaaaaattgcacaagaatcattgggaaaacggttaaaggattacgaaatgtttatccgcgctttttacatcgctttggcatttgaactgtttgagcgaatgcacggcgaggagggcgcaatgacaacaaattggcactttgtgtgggaagcgg

SEQ ID NO: 9333 - DNA, 971 bp, Heterodera glycines
aaaagaagaagcaaaaaaaattgggggagggagaaaaagaagagaaggataaaagcagcggagggattgggtacgaactgcgctatttgggctacacaacggagaaggacggcgagcaattgctggagtcgttgcaggacgagatgaagctgaacctggaccagttcactatgagctacgatggtacgttcccttcattagtgcttttgttcaagagtcttggtctcgcgttaaagaatgcgggtttttaaggagcctcctcggtacctaatctcagtctcgatgctaaatcttgaccggattcttgggaaatgaacaatcaaacagcaccaaaatcatcaactcattttaataaattagctaacgttgcaataaaaggatcggtcatttgctaaatgatccacctacaaattcatacaattcaaaaaatacaaaaacaaattaaactttcaaagaatattatatatatctaaaatttaacaattaaaggacagtgcgatttgaccaatgatttaaacgattgttttgttgcgtcggatggcattgactttgatgcccaagttgaaaaagtgtcgctatttggcaaggaaaccagtgaaatgagcacattagaaaaggcagcggaaagtctgttcaaaaagttgaaccgatggagctacaaatttgggcagagaggcaaacggcaccgaaatatactgaagcggtatttcagcggcaaaatgaaagacattttgggagtcattcccgaaatgatgactgacaaagtgtcaccatttgaggtgatttggtcgagtcaggacatttcaaccccatgaacattttacatttcataaatgatttcttagtcaagcattttattgcttaaatttgtatggcaatttacaaatatttaaaaaaagttttcgttttaaattttagaactcattcaaaaaattgaggcatatacacaattgaatatttatttaattaaa

SEQ ID NO: 9334 - DNA, 3528 bp, Heterodera glycines
aaagagatcaaaattcttcaggtccgttacttttttatcggtggttaatgaaaattaaaaaaaaagaaaataatgtctccattttacaataattgttttcctaggaattgaaagggttacaacatgaaaatttggtgtcactgttgcgctgtgttgagaccagtacccacgtgtacttggtgatggaatattgcaaccacggggacttggccgagtatctgttcagcagacagtcgctcaacgaactcaccattcagcacttttttacacaaattgcgcgggcgttggaggctctgaatagaaaagcgattgtccacagagatttgaagtaaggcaattaaaatctgtattaatggggctatatttgcgctattcccattctttccttactgaaaatcgttcgcaggccccaaaacattttgttgtgcaatccgcgacatcccctcgtcccgctgccttctcagctggtcgtgaagttggccgacttcggcttcgcccgttctctacccgaagggataatggccggcactctctgcggctctccgatgtacatggcaccggaagtgatcatgtctcacaattacggagccaaggcagacctttggtctattggcaccatcatttaccagtgtctaaccggaaaggcgccatttgtggtatgttcagcagaaatatttggactaattagagaaaacgtgatgtacacatcgaattaaggcacaaacgccacaggcactaagaaattattacgaaagacacgcggagttgaagccaaacatcccggatttctgttcagccttgttgtccgatttactaatgagtcttttgaaaaagaatccattggatcggattgaattcagtaagtctgtgccttcctgtcactttcactcttaatcagctaatctttgcaatttatcagactctttcttcaatcatccgtttttcaccaccgaattgccaacttcgaatgtttcaccttcgcgtcatttggtgcgtcgcccatccgctgaagttcaagcccaacccacccaaaatcggcctaaattttccgggagtcccacacaaacgcaaaatgggcccaattgcaagtcaccacaacgatacgcaacttcgcaccaacgaattccttctgcggatggccacagacatttagtaagttggcctttcgttgatttctttttatgcggttggccttacgagaacatttgcttttactcattcattggcttttcagcctcagtccgtgcgaaatgcgcacgccccgggcgttttgcggcgccaagtgccgccaccctcccactcacgtgccccctcctttcccctggcgaggccgacttcgcttgaccggtcccaaaacgcagccgcgatgaatgaatcgactgacttcacttttcttccgcctctgcaagagacccgtcatcaatttaaccaaatccaacggacaaaagcgaattccccgcaaagccttcaacagtcgggcggttcttcgaccggttcattggaaaacccggtcaaacaagtgcaagttagctactgatgcattgaatttattgtttgaattgcatctcccaggttcacagcagcattcctcgccaaaaaccaaatatcgcaaaggctgtccctgtgccgaacaaacggcacgcttttgccaaaatggaagaaagacgaaatgcgtcaaacagaagtcagcagtcaatagagcgacagacgagtttagaggagcagcaacggctcgggaagggaacggatgtatttggggaagagaagaagctcaaagaaccgattgcattgattccttcggtggaagagattgaattgcctgaaagtgggaattgaaatttagagacaaaacctttttaaggcatgtttagcccgtttcattgtctatgaccagcaaaagacgagtggtgctgctgcttcacgttcctctcttccggtctctggccgattacgtcgcaatacgactgcaattgatgagccgtccacttcgaatgctccttctcaaacaacagacggaaatgacaaattcccaatgatggcaattccaaagtctgccaccttcgttatgacttcgattggaggccaacaacaaaaagaggcggagaagacggctaaggagttggacaacatccgatttcagaacacaacgccaccacccaccgtttccggattaaatgcgcacaatcagaagaaaatagaattcaaagtgatcaatgagacgaacgggacagaaaggcattccaatttttcaaattgtagttaatccgtttattttaagtgaaatggacgaagatgaagtcggaatggaagacccgatccaattgccgttcacggaagaatacatgggtaaaaaagcaacggcgtaaggtcaactcgtttttttcgtgtttcagaagaatctgatgttatttcgcaaatggccgaaagcacatgtgctggcgaaagggaaaagcgaattgaaagtgtcggcgatggtccgtcaccgtctatcaccgacaacagcgaaatgattatccaaaatgcagatacgaatgacaaggcgccgtccaccacagatcgttcccctgacaattttctattcgatgcacccgacccgccccccgaattggagcaggagacactcctcggggccggacacaaacaaaccctggctaaattgcgcttcgtgttggacctaattgaagcaattgcgagcgtagcggagaacaaaacgaatccgatggcaattgcgatggagggaaacaagcggaaatcggtgccctttcacggaattatcacactgacaaacctttactcgaacagcgccaacatcagtcggatgcctaccgccgggcggagcaattggtgctttatgtcagagctttgcatgtcctttcttccgcactcgtaatggcacaaaaacaaagtacaaacgaaaatgcaaaaatgtggccaactttcacaatttcttttagttaacgcgagcattttgcacccatcgtccgccgttcaaaatgtgttaaatcaactcaatgagaaataccactatgtataaatgatacatcacaaaatttgcaataattattctgccctagtgtttggcccggtcacaagagttggcttcgttgggaattcccggccaagacccccaggcgatggttgtttctgcggaacgcattatgtaccaacatgccatcgacttgtgccaatcggcggcgctcgacgaactgtttggaaacccgcatttatgtccaaaacggtaccaaactgcttatatgatgttgcacactcttctttacacagtcagtttttggatatttttcatttatcatattacgttaattttaaggtgcaaaatgagcaggacaaaactgttttgttaaagtacaaaaatgcagtggaaaaacgacttcgcattctcggtttcatattgggaaatattatactgataactaactattaaattgcttacaattagtttttctaagtcggaaaactttagagcgccaaggcctatgtgcatctgtgatcaatgatagaactttttga

SEQ ID NO: 9335 - DNA, 4829 bp, Heterodera glycines
  misc_feature (4477)..(4479): n is a, c, g, or t
  misc_feature (4502)..(4503): n is a, c, g, or t
  misc_feature (4524)..(4525): n is a, c, g, or t
  misc_feature (4618)..(4618): n is a, c, g, or t
  misc_feature (4706)..(4706): n is a, c, g, or t
  misc_feature (4764)..(4764): n is a, c, g, or t
tttcagaaaaaaattcatacccgggttttgaaaagatattctgaaaaaataaaatactacaaaaatccgcagtttttgctctattatataatttttatttggcatttttatcatttttttaagaatttttataaaaataaaagtgattttgagatccagaccaaagggtgagcataggatttttgagttgaaaaattttttcaccaaaaatcttccaaaaacatgtctttaggggttatttgggccgctgatcacgaatacgtgatcagattttacttttgacatcgataagacctcagaatccctgtgtgattggggattctgaggcatcattttttgggggggggggcaaagttcgaatccggacggtgtaacattatttttctgtgcatttttgggttattttgactgtttttaattaatttaaagatttcttttaaattatttaaatttattttttttaaattaaagaatttcattattttttttgaatttgtaaaaaaaaataatttaatttcaaattaaataaatattcaattaataatttccaacgttgtttttaattaataactaccatttttttcgtgttttcattgttttattcatttaaaatattttttattttattaataataaattacatttttttgaattaaatgtttataaaaacttttcattatttatttaattttaaaccatgttgtacctcttctaatcactgttgtacctcttctgattactgttggactcatcttaagacctcagaatccctgtgtgattggggattctgagacatcattttgaagggggggggagttcggatccgggcggtgtacattaatttactatgcattttttgcttacttttacattttttaattaatttgttttgtttgtattattaataataaataaaaatttttaatttaaattaaattattttggtgaacaaatgttttaatttaaattatttaattttttatttaatttaatattgttttattaattattttaaattattttctgatgaataaatgttttatttaatttgaattttcgagaaattaattcctttcaatttcaataaatattctatattataaatttctaactttatttttaataagtaaaaggatttttttaatttgataaatttataatacatccattaatataattttcttatttatttcattttaaaccatgattgtacctcttctaatcactttcgttcaaattttaatcactgttgtacctcttctaatcacttttgtacctcttttatcacttttgtacctctttaaatcacttttgcacctctttaaatcacatttgtacctcttcatcaaatttgtacctcttctatcacttttgtacctcttctaatctctgttgtacctcttcatcaaatttgtacctcttctatcacttttgtacctcttctaatcattgtttgtacctcttctaatctctgttgtacctcttcatcaaatttacacctcttctatcacttttgtacctcttctaatcattgttgtacctcttctaatcaccattttacctcttctaatcaccgttgtaacgggcgcgaatcgcccgttcgaggccgcgaagcggcctaaaaatccctgaaaaaaccgtagttgtatctcttctgatcacaattgtaccttcccacccgtggttgtacctcttcccccgtaacagcctaggtagcgaagctccgaaagcgcgaagcgctttttcccagctaaatatccgacggttcacgcacccgctagtttctactctatatacaataatgttgggtttcgtttctaaaaccaaaatctcgagaacgggcgccgggaggggcgcgggagtgtgacatcacttaaccaacttttgacggcgcatctgggaaaaatacgggttttccggtccggtggccaactgagcgccagcggcgctgaaacggcccaaaaatttttttgtccgtttttgccggcctgtatctttgcgggaagaagcgggagcgaaaaacgcttggtgggaggattttaagttggagtgtttgggaaaacttggcgtttatttggcaggcctacctgcaaaagcctggcctgtacacgttggcaaaatttgaaaaccatttttggcgtttttcgattttcgcgaataactcgctgggggttaagcggagcgggttgacgccgcttgagcatttgtgtagtttttaaagctgcatccgatggcgttttcagattttgaaaattttgaaaatttttcgagctaggccccctcgaaaatttttcgtttttgaattttattattttttgccgatttttcccaagaaaacggagaccactttcaagcaaccgtttttcgagctctatcgattggtggcatttttgaaaaaatttcaaaattttccggaaatagaaaaattttccggaattgagctccccatttccgtttgaggcttataactcgtcaggcgttgattttagcggaaatttgtcttagagcatttttgtagagaattttaagctctatctaatgtgctttatctcatgtttttaccatgagtttaaaaaaagttataaaattaattgtgattttgaaactcaaaaccataggggggaccccatggttttgcatttatgaaaaatttttttactcctaaattagccaaaatgcatttttatggcataatttgaggtgctgaatacgtatatacgctttatattgcgttttggattttttggagggtggtaaaaaaattttgaaaaatcaataatttttggcccttgaaaattcaacctaaattttaaaaattcataactcgcctcaaaattgtccaattcagctcatttaaagcaataaaaatcgagaaaaatatggagaattttaagttattttttgagtttccatattttaaaaattcacaaacttaggcctggatttctcaaaaattttaaattttcagaaataaatttataactcatttcaaaaaaggcgctaaagaatatttaaatattcatataatccgcaatttttttctctataaagagaattttatttgacctttttatcacatttttaaaaaaagatataaaaataaaagtgattttgggattcgggaccaaaggggggtgaccagtatttttgagtggaaaaattttttcacccaaaatcttccaaaaacatgtcattaggcgttatttgggccgctgatcacgaatacgtgatcagattttacttttgacatcgtcaagacctcagaatccctgtgtgattggggtttctgaggcatcttttttgggggggggagttcggatccggacggtgttcattaattttctatatattttttgcttatttttacatgtttttaattaatttaaaatagtttgatatataaattaataaaaaaataattttaaattaaaaattttcattatttatttattgaatttgcaaaaaaaattaatttcatttcaaattaaataaatattcaattattaattttcaacgttgtttttaattaataaaacgagtattttattataaaaaattttaaattaaaatgtatgtgatttttaatctttaattaaaaaattttccttagttatttaatattagttttttaggggttatttatgacgctgatcacgaatctgaaatcagaaaaaattaaaagacgggcgcgaagcgctcgtcctgaggcagtgaagcggccggattccccgcacaaaattaaaaaacgggcgcgaagcgcccgtcctgaggtcgtaacggacgaatgttctcaaaaaattaaaagtcgattaaggcagccgcgcatgcactagcaacgaagtcctttgcgcgaagcgctcatgtaatgcatattcttttcatctctcacaagccaactgtctacaccgagcaattactgtgcaaagcatactgtctacaccgagcaattactgcgccacacgctagtttatatatatatagaataatgttgcagttcgtagaaaaaattataagtccccgtggtttgcccggaggctcctgaaagtgcggcattgcttaagcaactttttgaggcgcatctgggaaaaataaggatttttcggtccggcggccagttgagcgccagcggcgctgaaacggccaaataaaaaaaatcgtcgcggttttcgggctgtaacttttctcagggaaccgggagcggaaaaagtccgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggttaagcggagcgggttggcgccgcttgcgcatttgtgtagttttttaagctgcatcaaatgacgtttttcagatttttgaaaaatttcaaaaattttcgagcatggcccccctcgaaaatnnntttcgtttttgaaattttattanntttttgcagaatttttcccanngaaacggagaccactttcaagcaaccgtttttcgagctctatcgattggtggcatttttgaaaaaatttcaaaattttccggaaatagaaaanattttccggaattgagctccccatttccgttcaaggcttataactcgtcaggcgttgatcttagcgaaaatttgtcttagagcatttntgtagagaattttaagctctatctaaatgtgcttatctcatgtttttaccatgagttnaaaaaaagtataaaattaattgtgatttaaaactcaaaaccataggggggaccccatggttttgc

SEQ ID NO: 9336 - DNA, 1829 bp, Heterodera glycines
  misc_feature (52)..(52): n is a, c, g, or t
catcgatttaaatataataaagctttaaaaatagcgaaaaatcaggcgaatntaatgaactttatttgggatttctatcttctaaagaaaaaaagttattccagaatttctggaaattttcgatttttcagaaaaaaaatcctaactccattctgaaaaagtattttataaaaataatatactcaaaaaatccacaattttttgctctattttataaattttaatttagctttttatcatttttttgaaaaaaattatacaaataaaagtgattttgtaattgggaccacagggggtgcacatggtttttaagtggaaaattttgatttcacaaaattcttccaaaaatatgtctttaggggttatttgggccgctgatcacgaatatgcaatcagatttcacttctgacatcgttaagacctcagcatccctgtgtgattggggattctgaggcatcttttttggggggggggggtacgaattcggatccggacggtgttattcttttctatgcacttttaggttattttaaatcttttaaataatttaaatttttttgtttaattaataataaataaatttcttaattaaattaaattattttttgatgaataaaagtaaatcatttcacattattaattattattttatatttattcaaagtttatttaaaagttgcgttgattttatgcttcagataaaattacacgggagtcctgaatccaaaagggttaataaattatgctatttgctaataatttaaaagttcaaaaattattagtatttaattaaaaataatatatttaacaaaaattttataaacagtaaatcctttgttggcattaataaaatgcgcaacatggaaaaaaatgaaataaatagtagtaatgaataaaaaaaaattgaatatcaacaataaaatggggtaaaaaacaccatggaaaataaggaaaaagaattgcctgaaaaagacaataaatataatttttttttgtctaaattttattttaatcttgagaatttaaacatgcctgttcttgaattttatagtttaaaatcaaaaatgataatatttgacaaatagggagcaaaagaatattgcaaaatgataagatgaataaataaacaattgataaaaaaaatgaggttaaatatcaacaataaaatggaaaaacaattgtaaataaggaaaaatgaattgcgcgaaaacggcgttaaataataattttttttaatataaaaatttttaaattatttgaaattgttgttgttgttaaacgttttcacatcggtcataaaaaattgaccgtctgagacggatcggccaataatcagcaaaacaagagacgggcgagatgaacaaaattaataaataaattaatgttactggcctatttttctgcattgtatattcaatttttttgatttcctcttcttttgatactttccaaatttaaactatattttttgacattaaattttgttcttgacttttatgccttaaaatcaatttgacttaatttaaaaaattgaaaaattttcatttttatgcccttggcaattgagcgaatttttaaaaattcataacatactttgtggtgtctattttctacaataaagctctaaaaatagagaaaatcgtgagaattttatgtattttatttggtttttctagcctcaaatcgaaaaaagttattcgataaattatgggaaaattcaaattttgataaaaatttcttaactcccttcaggaacggttttttaataaaaagaataagtttataagataataataattagagataaaattaattgttcttttcaagcc

SEQ ID NO: 9337 - DNA, 5796 bp, Heterodera glycines
caaaggatccgtccatgctttctaaagcttcttcaatttcgcgctgggggtctgtctcgtccaaatcctcttactataagacatcatcaaaccataaagggaaagtcgacccttgtccacttaattatttgcataactattttccagtgagcaactcgatttccagtcgcttttgcccaggagatggagaacgtgaaaagttggaacgtgagcggctccgacgtttctcgcgccggcgaggagagcgactgcttttccgcgagcgagaccgggaggaagcgcttgaagcattgcgagaatcattagacatatgtcgcttatcaaatctaaaaactaagagaaagtttgaatcggtgaaatggaaaatcgtcttagaaagagttgggagtcaaattggaagaatatgatatgaactcctttcctggtaaagaatttatagagaggactggagaaaattgaatgtaaattaagagcatccatcaatctagcgccttgctctccttcacagaagatctgtaaatatcggcggactattctgcaattccgttggaaacgtcatctcaaaattttctcaatgcatttttgtagagatataagatgcatctaatcttctttgctttatttggtttattaatctttaatataaaaacatctataaaactaaactagaatttctaaaagctgtttctaaattgtcactccgagtggatgacccttcagtaagggatctgcctcctgttacagatgacacagtgtcggttttaatctagggttgttccccgacccctcggggggcaaaatgtcgggggccggggacctcgggggcgacatgtcgggggtcggggcggggaggagctcaattgtcggggatcggggaccccgatcggggaatggccaaattttttttaacccaaaaaaaccattttttcttttttaactgctcgtaaatcttctttttttcactttaatcatctgatttcgttagcgccagtaagcgtgagtccaagttggcctttaaacctggggtttccatttgttcttatttataagaatattctgattttttgggggggggggtagcgactaaaattattctgattttttaaatatacttataattttgaaattttatggcataatgtcagaatttttcaagaaattttaaggtctgccgcaaaacttttttgatcttttgatcccgaatttactgaaatttataattttgcattttcctcaaaataactgattggaaaaatgttgctaaatgttcatatttttgacactaaaatcttattttggacttggtgtttatattttgaaaaattttcaatggaagccctgttttgaaaatacgtagaaaggagtggggttaaacagaaattttgcgaacccgtctcaacatcgaatttgaccatcattttttgcggcgctctttttcagaaaaacttttgaggaacaaaggggtgatgagggcggtggtgttaggagccgcgaggaaaatttttttttgaaaatttgaaatttgttaacagatttttcctaaaaataccaatttttgcagacattttttgcaaaaaaaaaaaattgaattttggggggccggcggtgccgataggcggcgccgaaaagtttttcggaatttttaataattaatattaagaaaattgttcaaaatttcataaattttcaacctttccccccttcgttgttgaattaattttttgtattttcacaacgcttggagtcctcaattccccgaattagtgtcggggagtcgggggcaaaaagtcaggggccggggacctcggggagcgacatgtcgggggtcggggcggggaataggcccaaaaatgtcggggatcggggtcggggaccggggagctcggggacggggagcaaccatagtttaattcttacttttgcaatctgatttcttcccttatcatattcctccatcagttcaaatccccaaaatcccctcaaagttgcgtttcggtcgtaatccccttccctcccacaacactgcaaaaacccattacggtctcacttaagaataattccgcttccaacagaacaactggacataattctattattatgtgctaaacacgccattttataaaaatgggtttttcttttattcttcgtatgaattgtaaaacaatttatgtccaatttacaagattttcatgcgatatttgatgatagacaaacataaagcaccaagcgaaaatgaaaagcacctgcatctctttcatttaactaatgagcggcaaatggcaaatgggttttccattaacggtagtaaaaattagaaattacctttaaggtgtccattaaaattatggtcaaacgaatcgatgaattctactgtaattacagcagcctattttctgatcagcggtgtgtcgcttattcactttgccacactaacaattttcgtcctttaatctaattgtgttgggctcgatcaaactgcttcatccgaatttgaaatttgttttgatgtgtcaaagtgtggccgtgtttttgttgaattctttcgcataatggagatattcgaaaagtttttgtcaaaggacatttcaatccatgcttcgtgttttttcaggtcaaaaagatttcaaataacttatcaaattgactttgaaatggtctccggccggagattaggaattttttaacactcaaatattattttaatattcaatttgctcaaatttattctatcattttcaatctttccgtgattaatccttcttcaacagaattttttgagagagttatgaagcattgaatttatcatgcatttttaaaattgttttaattaagtactaaagaaaatgttctcaaaatattgttttgtatttgtttattttactttttctcagcctaaagataagccccaacattaaatatcaaacggtaccaaatttttaactttgttaggaaaagcagcccgtgaagacgagttggacccaagccattcgacaatattttctaacaaaaagtcattattaaaaaacaataattcgtagaattttactttttgaaaaagcctgaacctggatctgcatttttggactaaataggaaaatacaggtatttgtgcgtaacattactggacttggattttttggacaaaaatacaagaaaaccaaggtaccgaaaaatggcctgaacctgggcctggattaggaaaaagttaggcatgggtccaggttgctgcagattgaactttattaattcctattcattatcggttcattatgccatttagatgtccctgcttttctttggcatgtttcggatattaacaattcacgttttgtttattgagcggctgatggccatcattttcttggacaaatataaatttacaagaaaattatattcagcatttgctggtttatatttgcggtaataataaaataaaacacatttcacttgacttttattagaccgttttatgcagtttaatgtcatcacaaatggacaatcgtggacatcaacaattttaaatttgatcacattctcttttacattatccctgagtcttgtggaatgtatttattgtacgcaaaattttaataaactatttgtaaatttatttattcaatttaataattagtttatcgcaatcattggcatttattgcagagaaaaataccacagcaaatggataatgtctacagcaattaaacaattttcttggagcaagatatcaggtagtaatattttaaattttgaattagcctattttttactgcatacaaaaaactatgatgtaaattaatattttgtggtatcactcaataaatttaattgttctctatcagaatattattttccaaaaagccaatcacatgtattttagtcgtttaaaaattttaaagccattaaaatgcaactgaaccataatattaatttaaatattaattaggttgattttgagccaatttatgaatttttatgtgttacatatttttgttttcgaacctattggcgtatttaagaaacgcgcaaacccattttgtcggatttaagaaacgcactagcaccaccacgaacctacgaatttttaaacccgacccaaaatttccaaaaatgccatgtatgaaaaaatatgttatcaagtctcagttgaattcactaacttcttccagaaattgtggaattgttaggcctaaaatagttggcgaatgatttataatttgcgaactcaattaaagcaaaaaagttagaaaatttatcattgctaattgcaaaaatattttattttaagaataaaatttaatttcaattaattgcctaattaatatcagatgaccgaaaacataaagaccagcaaacaactgcttcccgtatttttttttgcaattctttaaatacaatattttcgtcggaatgtttcctgcgctaaattttatttgtaaatggacaacggatgcgaaattaataagcatgatcattgcagtagacttggtctttattctgttttaaacgcaatcgctgaagcagtgataatcaagtaaaataattttatttttataaatttgaaattaaaaaaattgtctcttatttttgaattttttcgacggtaatgttaaataataatttttcaaaactcagccatcatcttgcactcaaaaaacgcttcgtctttttgttcgagagatttttccgttgccatggtggccaagtgtcgaatacacagtacaaattttgacatcattcatgattttaattagggtaggccgggtccgggtacccgaccgggtcccagaccccgatacccggttttttcactacgcggacccggtttttggaaaatccaatacccggtaccccacccgatgggtccgggtccaaccgggtattaaaatagactggtaaaaatgggggtcagggtcaaaatgttgacaaaagttcgaggaaattttttcaatttaattaatattactttagaaaggggctaaatttatgctcatatggcttagtggttagtctcttggattttgtgcgttatttctcaggttcaattcttccccatttcactcttttttttattgaaaattgatattttatcattacgtaaatccagatcccatgaaaacattttctcaatattttttgtattgttccatttagtaaattatttttggatttttcccattaaatatcgatccctagttttgcatttggaaatggcttttccttacgaaaaatttatttttcattaacatttatttattcgtttcattgagaaaattttagggaattgtcaaaatattcgttaacaaaatcaattcgttcaaggtgaacacgcacaaattcacttctgcagttgatcatttgagctggaaattgtgtcgagaagtcttaaaacaaaagtcgaattaaaaattcgaaaaaataaaaatgtaaatccatgtgagtacggaccgcttttccagaaaattttcagaattccgcttttggaacccttccatttttgggcattggtgcgcattgctggtgaattaagtgacaaaaatatcagtgttaataataattaaatttaattgttatttcaattttatttgcaaaataataagcataacttagcttaaacttaatcaaatttattcatcttggtattagaatgtagctaaattcaaaaaaatatatatatatatattctctactatttttataatttttaaaaaattagcaaaaatttacaaaagttgtgaccaaaaacttgcaaaaaaaatatagactcaacaattttgaccatactttttgaaattcaat

SEQ ID NO: 9338 - DNA, 6033 bp, Heterodera glycines
  misc_feature (2753)..(2753): n is a, c, g, or t
aagttttagaaacttttatttcaaaacgaatttttttatactcttaaaaatttcacttttaaacattttttccctcttattatttttaccgtttttttaaatattaaattttgtataagtatttcaagagttttatctcacatttaacgcagtaaactaatttttgagaaatttccggtatttattcgaggcgtgaaatatttgtcttttcacgaggttgtcatcttttcaccggtgtgaaaagttttctacaaaagattatattttttcaaaaaaaattactttgaatcttaatatttttcgcgccctccctagagaaggcgcagttccaaaaatttgtacacagtgatacccaaccctgggccaaaaaaaaagccgaaatgggcatatattactaattaaatcaattttatgattagttacaaatgaggaaaggcagagaaacattcctttacaatctcttttgttttttcttttgtatgtcttcttttccctcatgtgtctcttgtgcttataaatttattcactttctcttttgtctctcctctaattgtaagagagtaaggtgcgagagaagagaatgggtaaagaaatatgcgtaagagaaatagcacagggaaagacaatgaagagggagggaaagagtgtgggggttttccctccccttctttcttctttttcaacccatcataaaaatatcatttcattttcctcttctttcactctttcccctgtttctttagccttgcgctcgggcaatacagcgagcaatgaggcctagccgagctgctgttattgctgattgaaaacttttaccaattacccgccttggcctgcgcaagcggtgacatgtgcaatttttggacgccctccggggcttaaaaaagcgtttctacatatttagattttttggttcagcttttcatacttaacctctgttttgcgctttttttcgaatttattggattttttttaaaactacaaaagtttttaaagaggtactccctaaaaactggtttttcaaaaaaaaagataccaaaaataaattgcatttttgttctattttatgcttctctacgaatttaatgtctagaaatgatagactcactattcaaaaggcaattctgtagagaattttgtcctctttctgataggcctactcaaattttcctaaccccctaggaattttttcgaaaattccccgatttcaagccatttttggcttttcagatcaccatgaaggagtgatctgatcaagttggcgaaaagactcttttgatcagtatcaaaagttagcttacaaattagcaggaattttttcagaattttctgccgaattggaattgaatttttggcgattaactattttgttcatttacttttgcaccgccaaaaattgggtcaatttgttgggcactcgtaaatttttgatggattgactgatcggaatgtcttttgccgttttttacgagtaatattgggggtttgttttggcatagataaagatttccatccaatcacgcatctcatggaaaaccgggtttaaaaaaaattttttttttttttgttcatatacttttgcacctgactgtattttatgcttttctacgaatttaatgtctagaatagcataatataaacttatatttgcatattttgtacctatttgggatattttttatatttcatataaatttgccatttttattcggttttttttcataaaaatttcaaattgaccatttttcatcaaataattacaaattttgctcccttcagttacaacgttttccttatgttctctctgttggacattaaacggcgccgcgatggaaaacagcacaatttcggcgcctccgttcgctattttccctccccccgggggctgtcaaaggatgggcccccaattttggcatttccttatttggttttggtggacgacgacgcaaatgcaaaatatttggaataaacattttctatcgctttcactgatgattaattatatgtattgatttgtcggatttgctttttttggccaattaataatgtaaaaagcctgcagaataatatttgctcttttcttgtatttatttataaattcctgcgatctttaatttgattttatttttgctttatcatgaaaattatatgacacaaattgacatgaaaaccctaattggacggaaaaaactttttttcttttaaacatattttgagatatttgaatttgaaatacattataaaaattcattttttttgaaaatgtccttaaaccggttttttcaaaaagataccaaaaatcaattttatcctaaacctaattaggtaaccttgtttttattcacttgtccaaaaaatatttaaaattttttatttaggtatgtaatacttatattggggttttgagtatttttcttacatatttcatgatttttttttcattcatattttatgtatatattttgtgtattttcttacatataattcccatcaaaaaaatacacgctagaaataatatttttaaaatcataaaataaaatgcattaatacaaatggaatggaatcatttgcggaaaatcacactgaaaagcacagtgtcatcgcgaatcagaaaggcacagaacggacggtcggcgacaaaacggtattctttgctcgaaccacactccacttctacttctgtgactgccgcagcgacagtgccatcctcattcacctaaatttcgttgtttaaattagttttttttttgagnattgagctaaaactggtcaaaaatatataaattttctctggaccggctggtgacttttttttattttgcaattcgatggtggcaaatttgtataaatggaatccacaaaaataagggcactaattgtgggcaatcaccgtacctcaatgaccgccttctgcaccacttcgctgagcagcaacgttttcttgccggaaatgccctcaaaattggcgttgtcggtgaacgcggtgggcatgcccatgttggtcaacggtttgttcaatccgtgcgtggcctccaatttgaacttgggcaacaccacctgggaaaagaaggggctcggctgggatagggaccaacaatttctccctttttcattctcatggaaaggatcacagattagggccgactgctgagagttacagaaaaaatatacaaaaatataatcatggtaaatattcgttgataaattggcagacggtttagaggtgaatcgcaaaaaacaaggaataaatcatttcatttgccacatctaaagaaggctttcttattcataatccttggaaaaaaataaataaagtcgcccagttgacccccactgttttcttccccctcccgccaaatcaacgtccccatatcgtttcacggattaagaaaggtttttttaaattttcgtgggtatacatgcctaacgaacaattgtaacacaatgtcaactttcgccgtttcagggtcaccgaactaagccatggcacattggcactgattggcatttgttcgtttggcatacccacgctaactcttgaattagattaagccatgaataaaattacgtcgacgttctgtcctgctccagggttttttaccttcacggtctctttgtcccgctttttgatcagtttcatcagctttttgccgtccaattgagccaacaattcggtcagtccaaagcgttccttgggcaacagcacgaacatgaactcttctccacctttgtatggcatgccgaggagtttgagctgtacaagcaagcaaaaaattggcaaatcgatcgaaacaaaaattcatgaaaatgtctaaacgacctgagcgttcttgtagtaaatgaaataggcctccaaatgcatcatttccagctaaaaaattggtcgtttacggacaaaatgaaaatgaagctaggattttaaaatgtgtttgtctccgccacctctttgaagtttttcgcgtccacatgaaatttcgcttttttggtgaattttgagtcgaatttgtccgcccatgtgcctttgaagtaaagcgcgttgatcagcaccaaactgcaaaaaaataaataactattttcaaacttttacaatttttttgttgttgctatttccatcaaataacatttaaaaaaaaataaatattcggacttttgaaattgccgcagaaggccgaagacagcctaattcaaaaactttatgatttttttttacgtttttttctttttttttttttgatatttttttgcggaacgatgttttgtccggcgacgttttcgggccaaaagtatgttatccattgaataagattagatttgccacagaattttagaaacaaaatttaaaaacttttaccgagtgttctcgtcaaaattgtcgggcgtgaccaaatcgcggattttcttatgagtcgcttctttcacgaacttgttgattttctgaaggcgaaaaataatgtttcccaacttttaatgaaacaaaaaaattttgcaccaaaaggattcaccactgtccgtatgccttttaagaaatttcaaaaacgggcactttgaagtagcgcagaatttatttcaaaaagaatttaaaaaaaaaccccaaaatttgacttttatgaagagttattattctaacggaatggaatggcttaaaaatgaagcaatttttgacatttttagctgaaattttcctatttttgggactgatttcgcattacgccaataaaacatttcccacctccgccgtccctttgccgtcctcaaattccaccgtctcaaactgtccaccgtaatttccctcaatttgctctttgaacgcgtccttcactttgatgcctttcttcacgtacactttgttggccgtctccaaagtgttgctgctgttcgttccacttgtgatcgatttgagcaaagcgccgaagtatttgtgcacctccgactcgggcgcacctagggggcaattaggaatagggaggggattaaaaacgggggattggtgggggagggtaattaaaaggggaaggggatgattattgtccctcattactttaggtgaggcatttttcaaaggcactgaaaagaagagaaattgttgttttcaaaagtaggaggataatgtttctgggggttttctaagtttttgataacgaatctgccatttattccggccaaattcgaattcaagacccaaatttaaacaaaaaaccgaaattctaaaaatgatttacataattttcagtttatgaaatttcgaaactttccaccatttgccagcagttggcccatttcttcgccggtcttttccttggcgcccgcgtaaaccatggacaaagtgacggcggcagaaaacggcgaaacaatgcacgaacggtcgtccgtggacacttcacgcagcaaattcaacgcaaaatcggcctgtgcctccaaaatgagggggacatttggcgatgggggagaagacattaattaatggcggataatgaggcaatttgaaggaaatcaaagagattgcttaaaacgaaaatgagacaaaagctaaagaataataaaatatgcataacatacatacataaatcatatataatactttacgaaaagttggcatttttatgattttttcatgagttttaggaatttccagtaatttgattaacaaaaaaaatatattaaaaagagaaaaaacggctctattccaatttatttacgcgtctggctcaaaataattggcgtaataaacataatgccaatgtattcaaaaacgttacaaagtatcttaatgtttgatcaagttcctaatcagagttcagtgcttccaattcacttaaaatatgtcaaatcagatgttttttagagataataaaataaaaaattaacttataacatttaagaaagtttcagtgtcttatttttgttgtttagttttgatcacatttgatcagtcataactcgattcattcccccactaaatcgaaataaatttactattattcgaaagatattgaaaagaagaatctttttctaagcgaaggttaagaaatttga

SEQ ID NO: 9339 - DNA, 808 bp, Heterodera glycines
taatttttgcactattttggcgtttcgtcattatttttgccactacactattttggcatttttggaaaacttcccaaaattgcaataaaaacgaaaaatacacccctaagaatcgacctaaaaaattttcaaggaaaaatttcacaaaaattcttccccaaatatttttttcttgttcaatatttgctaagaaaatattttgtaactgcaatcagtgaacaaaattgtttgccttaattttaaattattttcaaattaaaaatagctatttaaaaaattacacccctaaatttggacctttttcgccactatttttgccactattttggcattttttggtcctatttagttaattattttgggattttttatcactaaaaatcccatccctaaacataatcctctttgccattattctggaaacaattaaaagattcatttacaaatatgttgaaaatcggtttttagcttttaaatttacctcatcataaatctttttgccatcagataaattctggaattaaaatgaacattaaattattcatttacaaatattattgaacttcaatcagctccggcgcagcatattgttcagtacaatgcatgaaattttcctttttattttgttggtcccccattctcttccatttgttcatcccttcttgttgttgatcttccaccatctcttcttctcttctcttctcctctctctctctctctctctctctctctctctctctctctctctctctctctctctctctctctctctctctctctctctctctctctctctctctctctctct

SEQ ID NO: 9340 - DNA, 3186 bp, Heterodera glycines
aaaaattaaagatggtgtctacaaaaacctctaatcttcctcaaaaaattagctcgaaatctcaaaatttggacattttttggtgaaaatttgttaaccaatcactccaaaattttcaaaaattttctcgccgcaaaaaagctcattcaatcataaattggatcagatcggttgataatgctttttaactgtttttacaaagtaaaaagtcattttttcaaaaaatcttattttggtttctcaggctgtagtgtcagaagaatattcatactatttttgagagaatgatagagtcggagtaccaacggtcgcgcgaattgtctgcccggcgcatggttgattttgttagttgcctgcaaaactaccacaagcaggtggttgcgctatgaattgcgcgtgattaatgggcttattggccggaagataattatttaaaacgttaggtgtttaaaaaattttaaaattacatttttccaaaattgatatattttcaaatttttgtatggtgaagagcggcattattttcggacgaattaatgatcagtgagaggaaggaaaatttcgaattccactgtggaaaagttgaaattaacaaattttaccgggattaatatcgagaatatcactcatatttccaactactaatatttatgatatcatgaattgctgccatttagctgctccgtgagattgagctgcacgagaagcagttcaacgacgtgcataacctgggcgccgttctgatcaaacagggccacccggcgggcgaagtgatcgaggtgtacctgcgcaccatgcagaaccagtgggattggatactgaacctgaacaagtgcctggagggccacctgcgcgacgcgtgcaatgccaaggcttttgtggaggagtcggagcaggtggagcagcagatgcaaaaacaattggtcagtttggcgtggcgtatgactgcatagggggaggggggtactgtttgtttccggctcaggaattttcgaaattacgaaattatttaaattttttaaatgttaaaaaatgattatttaattttttagaaaataaaaattattattacaagacttcccttctttcaattaaccatctagaatttccaggaaaataaaaatggtttttatttattttttttgaaatatcttttggtgagtttttttattgattgaaaaactaagcccatggaaatctcaacacgcttttggctctattcctgaccgctccaactgttttcaaatcttcattaagctggctatacgagaaaatgccaaaatccaaatcattcgaatgccaaagttgttgttggcatgcatttttttagtatgccaccactaattttggcacacattttttgggacgggggagggggagtggaccattaatgctgcgcttctgaacgttaattaaaggccatgccatatattcaggcttccttcccatcggtggtgttcggcattcctccgcctgacccgcggttggcctcgttcctcagccgactgcacaaccaattcgagaagttgcgcaaattgtgggaccgcacccatcatttggtgggtgttgtacaaatggggaggcaattaagggtcattagcgacggttatcaaactacgtaaatatcaccgaattagcttcgtgaccaccaaatatagtattgtataaatcctcttttgaccgtatacatctcagcacaattattctctgtcagtctcctcatccccgacattacaatcctactgtatcaaatccgctccgattgcttttccaattcttactgtatttgtctgtttacaggtccgttacaacatggtgctgaacacaatgcgcacagtgcgtgcatgggacttggacactttcctgtgtattctatccgatcaacgggacgagatcatcaaaacattgaatgaggacgtgaacaagctgctgtcagagatggaccccaacgatcccttggccaagcggctcaaggacgagctgcggatgaccaacgaacacttctacgatttgttggcacgagctcagaaagagccgggtaattaatgcctgactaattgggaattaattgattcattttttgccattgatttggtcgtttttgtgatgcgttaggaccagttgattgcgaattatttggcacataagtgattcagacaaaattgatttactacgagtaatagaccatttctgattaagcgagtaattaacacagctcaagctaataatcaaattaattaattatcgaacgcacttttttgactagtaaacataaccaaaacctaatgaactgatcagcgatcactttttccattccatttgaacttgccatgatctgtgtattgaatcagatctgatcgtgatcactcccgtccttttctgatcactatcaccctctctcttttcagagcccgactactccaaccagttcgatgcggcatgtgccgagttgttgtgcaagttcaaggagggcgggaagcagctgaaccaccgggtgcagaaacgaatggccaccaatgtgcgacgcttttccttccgtcgatcgtgtgccatccttttgtttctttttctgcttgtgtgcaagtttccgcacacaaacagtagagaaataacaattgaatatggcatgtgttggatcgaacggaatacggagacacgaaccgggatgtgcccttcgacaccaacaccgacgaccagcgacagcacaacaccgacgaccagcgacagcacaaccacaaccaccacaatgaccaccactccgccaacaaccacccaaaaaaaacaacctgacgatggaaaaaagccaaaaaagtcggatttttggaccgtgaacaagatcatttccatcggtgttccgctctgcatcctcgttctgcttgctctttcggcgccttggtggttgccaaaacttaaaaaatgggggtcaaagaggcaaaaaaatgtgaagctgccccgcagccgcgaccccggagaagaggtgcaataattttttgggacaaaaaatttgggcctttgggtcgcactcgtcatattgaagaaatgaaaaaacaaaaaaagttatggtcaaagtgtttaagccgttttgaaccggccaaagctcagtaaatggacaaaattgggcactcctaagccaggataattttaaacgtttgagtattttttatgagttaacaataaatcgaaaaa

SEQ ID NO: 9341 - DNA, 947 bp, Heterodera glycines
  misc_feature (20)..(20): n is a, c, g, or t
gagtatttttatgagttacnaataatcgaaaaaaacatttgaaattatagtgcatcatttgtctattttttcggtctgaaccagatcaaaatcggctataaatgatttgccaaaacttttttttgaatttttctattattttaagcgcctaaaaaatcctgcctctgaaattttgtttttttggctatgtgcatttggctatgtgccatatggccaatagtttcaaacaaaataactttttgaaattactctgattatttttttattaatttattttaatacattttttgcatttttcagattttaagtttgtatttttaacgggttttttttgtttgaaattattttagctactttatgcgaatttagttttttgagttttctaatttttaggaaataggtattttccacacaaatattttatgttaattttttttaattaaataggaacgcggaaagccaatcaatgagaaaaatgcttccaaaaaaaagttggtggttcaataagattaaataaatttatgattaaataatattttctaataaaataaatttattccttatcattcatcaattcaccttaccacactcggttaaggcttaaggattttaaaaaatcaatcactgatatgggacagaaaattgaaaaaaagccgctgtccctggacgagaaatcggtgctggacgaacagacgcaacttggcaatttgcgggaagaatttgatcagaaaaggaagaattttgaggagttgaccaaatctttgacgagtcaagacgaaaaggggcgaatcaatgaaatgaataagctctggaaaaatcttaaccagcagatcgttgacaggggcaatttgctgagcagtgtaagtttttaattaagatagaaatattgaattagtattgttcgacagaaattattttttcccaatcaccaatggacatgaaaatag

SEQ ID NO: 9342 - DNA, 2013 bp, Heterodera glycines
  misc_feature (5)..(5): n is a, c, g, or t
tcccntttgtttctagttgtgccacctcttctaatgcgtcttttgctctcccacagatcactttctccaaaatgttctgtccttcctcggccaattccctctccattctcttcttctccgtttcgtccatttccaccacaacattaagccggcttttccacacggagttggcatctgaaggtcattttcactaattaaaaagtgatctccgctaaaaccgttcgattcgaaagatcgccgacccctaaaagggagaagaagctgatcagatcgatggtgatcaacagagggcacttatccccatgcttttcacttgcctgtgggtgccttagcgaggacacattcattaacaaagtgacatccgtgaccacaaatttcgcagtgccctttttgtcggcggcgaaattcgttccattggcggaccgactgatcagcttggccttgcaactgcgtgtgttttgtttgccatttccattaccattcattcagcagaatggctttagcacccatttttttttcttggcttttcccatttgccaatgtttccttcacaattcactcttccactttctgtctcacttttcgccttgtctctcttcccccacccctccattttccatgtttttcttacatttatctgtctttcttgggtttgatttcctattttatctatccctacattctctctctttcactccctctttctcttgcaccctccctctcgctcctccactgtctctctcccccttgcttcactttccctcctctccctcaaattggccgacccacgtaaaggcattgcccggcaattctacgatggcctgccgtggtgcctccgctcgtgcctttaccgttcgtggccttttctgcacgacaatgttaaattcgctgagccgtgcctttccctgcaaatggtcaaaattgttgctcctccttttggtcttatttataagagacaaagcacataattaaactatgaaaatgctaacgcatcgtaaccaataaaaaaagttggcttttggggattctgatcgattactgcctaaccgcggattggagtgatcctttctcccattaagcggttggaatgatcaactgaagttccaatcaatcccaacttgccaaattgcgtgccctcccctgggttcacctgttctacagcttcttccgccgtgttgctagcaaattttgcgccaaatccgagcacatcttcgaccagcaaatccgtgaacagattggcaatgtaagagatccctttctgggacagtcgcgcccttacgccgactttctgaatgccaaatttattcgagactctcgacctttccctcctttttcccccatttcttttcttacattgccaatgccttcgcccgccaattccttcggcacattttgttgagcattgtttagccaaaagcttgcggagaagcagaagaagaagaagtgtaaaaaggacatcatccgaatggggaggaagaagccttgggtcaatggcctaagaaaatgttgaggagaaatgaaagggaaaggggcgaaaagggaggggagagagggggggggggacacggacactgatcagtgcgattggaaatggaatgggcgacgggtggggtgggccggggcaactgatcaaactgatcggacagaaggacggggggtggacgaagtgctggcgatgatgaagtgtgatggtgaaacaaaaagcagaagatgatgatgattggtgatcagagggaggctgggaaaaggtgctaaaatgaagggcggagaggggggggggcgaagggggaaagaggggggagaaacgggtcccacaccgccggggtatggaagaagaaagccttgcttccttttatgctttttgtcattggggcaaaatgagggaaaaacggacggaagaaacaaatatttatgtagaacaaagagaggggacgggggagaaacaacggaagaaagggaagggcccccgggggacgaaggggggggggcgagaatgggcgcgggggggggggg

SEQ ID NO: 9343 - DNA, 3843 bp, Heterodera glycines
aatgggtttgtagaaattatgaaatagaatattgaattcatttccatagtttgtagattcgccgaatatttgctctgccttttctccgtaaagaagaaatttcaaaaatgtggccacatttgccaaaattcagaaatgattttgaaggaattcttagagaagatatggattcttttgtagattatatgaataatcaatggatcaaaaaagttggactaagcggggaggggttccagacggaccgcgcgatgcaatgaaataactaaccgcttacaaatacgattgacaatgacgatgatgatgctgcgggaggaggaaaagccaccccgaggaatggtcgaagaggcaaagtcaaagtttgaggaaaagcatctgcccaagaaaaagcctcccaacggcacccgccttatgaaagtgaggaaaaaccggggaccaaacagtaaatttttaatctatattataaatcacggcaaccgttttttaaatattagcttttctctcggcatgagtccaacgatagctcagttggctttagtgcgttaagccctccctgccccagctcctctgggcatgagtccatttgatcggaatggtggtaggaacggatcggcttcatccggtcatcccccgttgggtggcagttgcgtaacagataatccattcacattctttctgctcccacatgctgtgttgctgctgttacccatcccaaatcgcccaccgttgggttagcttttgtgtgcattccgtccccccccccccctccccccccccgcgtcccccgttcccttttttgtctcctccataactcgtttttgggtgcgtccgtccaccaaatccttccaggcgccgcttcatcttttgctgcttttcctgcctggtacaccaattagcgcattggacctctttgataagcaaaacaacaacaacaaacagacaaaaaacggaggaggaaaagcaaaagcaaaatgaaactcaatttgatcaatttgaacggaatgcgcagaggcggaccaagaaattaatgaggcaataaatgtaaattagccaattaaggggtcaatcgcatcgtcccctttggaatgagcggcgtttagtgccgccgaatcaaatgggcgatttttaatggtgcgcgattggatgatgttcacttttctgcttatactttgctgcttccgctgatcagttcagtgttttataatcactttcacctttctcttttaattataaaaagtgaaacaaattaaaagggaaataaaggcgaaaaacagaaaaatataaaataaaaactaaaataacttaatatgtcaatgattaatcatcaaaacattaacaaaatgaattgcccgctgtaaaattattcttcatttttaaaagcaaaatttgaaaaaaacaaaaacaaaatttggtataattaaaatatatttaattatcaattttgattttgtttcctttttgtgttaaattaattcgtctgtatttcatccgttttcccattggcttcttttcttctttctctcccatcactttttgttctcttcatcatcacccttttacctgctgatcatcacattctgttctcaacaaaagcattgtgggaatgaatggataaatgcgatcagtcgacccaaaagacaaaaagtggcgaaaggtgccacgaggggggggggggaggacggagtgatcagaagcaaaagtcaaagtcgggcggaagaagaagcagcaaacgaattgatcggaatttgctaccggtgaaagaaaatgggggcggatggactattttaagaagcattgggaccacagacagcagaagcaacacagcaaaggccaacacagctgccgacggatggccccgagaaatgggaaatattgggggaggggaaggaatgattcattggcagtgctttctgcgtacacccaatttttgctgactttcactgccgatcgatccatttttgtttttgaggatgaaaatggcacaaatttaggaaatgacacttttggcctaatcccccaaaagtgccaacatttacaaatgcattttcagaccttggcagtgcaacaagttctctttgccctcctccaccaaactgcgttgtactgcttgaacgtgtcctccccacaccgtttcttctcctcgcaccccagcaaaatgtaccgctccccgtcctcctcctcctccctctccttctctgccccaaacccgttcctgtcctctgctgaccagcagctgatcagtgaccgtacctttgacccgacccgcgtctaccgtaacgaaattgctggcggaaaaatgagcgaaacgtacgagtcgctggtgcgaaacattttccggcccgaacaaagtcgccaggagagctccgtctttctgccgccctcatttgcgccgccgagtgcgcatctcagccagcaacagtttggcaagcatcggcaaaacaccgtcaacgggcagcaatcgacgctgggcggagtgccgtcgccatcaacgaacggcagagaacggccgcgcatcagcgcagcggcgatgaagcgcatcgaggatcggttgggcgaggacgtgttggacgattcgcgtaagcggacggagggaacgggcgcggaggggaattcgaaaaacacgcgttttgctggcccttaactttttgaagactgtgaattgaatttcgccgaatcaggcttgggcattggcattttggcccattaattctcgaaagtaaaaatccattggcaaaatcaggcaaaatttagtgccgaaggcaatcacaaatttctgttcttttgggcagatgatgacgagctgtggaagtcgccgttggatgagatttacgccgagttgggcattgactcgtcctccgcctcttctccgttcgcgccggcgcccttccattccgcgctttcctccgcttacacttcgccctcctcctcagacgcgtcgcgacgtcgtcgccccgcgcccggcctcgtgtccgaatattccgtctacgtgcccaagtgttccgcggaatatgcccaattggccaactcgtcgcctccggcacaaccatcgtaccgcagctcaacattgggcgcgtatcgcgtaattactcatgcattttcaccaaatagacctcattaaaagcattgaattgggtgagttctggcgggcaaacgccggtttcagattctgagttttgaaattggtcctttcttatctttttttcgcgctgagactcacaccgagaagtcttccattaattaggctaattgggaatgcacaaatggcctttgttttgccgatgccgagatgctcttgcccttattctttcccgagactctcctcccatcgtccgtttggtctctcatattttctttccattcaaattcgggtacctttctcccccgactctttgatgggtttttcctgttcacagctcggaatgccttcgtcaatgcgttcgtcctcttcggcatttgaccgttccggacgaaaatcggactcacagcggacgctggtggacttcaaggagttctccaggtttgtgctctgattagccagaaaacaaaaggcaaaagtggaccatacgaaagtgattttatctgattaacatttcttttaatcagcaaaacggcgaatcgaaaattagatcaaaagaagtgcaatctgatcagaaaagtagacaatatttagaaggattttaattagctgaacagacttttcaaatttatcacttcgatctgaccaaagcaaatcagcagaagaagaagcaaattgttggttgttttgatcattgatttcccaccattttcagttcatccctttccaagtcaatgtatcgaataaacggacaaaattcttcatatgat

SEQ ID NO: 9344 - DNA, 5049 bp, Heterodera glycines
cgtatcgcttgtgctgctcgtcaaatggcacaggtgtcttacagtcgaacagtatggcaaatgtatgaaatgtggccaaacagtcggcaagtgcaaacgaaaacaggcccatggcttggcaaattccctaaacaaaatcaacaattagcataagccaaaatggaaaaattaaaaaatttaaataattcaaaacaaaacccactccttgtgacagacgatccaacatctcaagcagcaccggtgcttcatcttccacaaactcattgcgctcttgggccagcgggtacggtccatcgagtacaggtggctgcgagttttcgtcacggttttggctcatgatttgtttttgtgtctaaaattttaaaaattaattctttaaatttgaacaaatatttattttgttgaaaaaacacaaaatggtaaaaattgggacaataaaaaaaatttttttttttaacaaaatttggagtgatagatgcaaaataattcgtaataaatggacaaataataaataaattttggcgaaattattatcagactggtgtcaaattacataaatgaatggcacagcggtttggcgcaagacaaattccagacaatctttttaatttttaacgaaaagataaaagaaacggtgtcaaattacacaaatgagcaggtgtgagggaggggcaacgtaaagatgtgaaattaaaaattattggtcaaataaacaaacgcccaacacctgaaagggtgctgtaattatttttgaggagataaaaaattaacagacaaatcaataattaaacttaaatgtatttgttaattcactgaaaatatttatattattttagaagtaataaaaaatttatttggaaaataattaattaattaaccttttaattattttaatttctaaattatattttattatacgggcccccatttctttttgcttttaaaagagaaaattgtgaattcaataattgatttgtttatttgaccccctcccccattctcgccgcctgctcttgccccccttccgccgctggtgacgtcaatttttccctttatgagagcaaattaatgtttatcatcaattgccaatgtggccgagtggttagtgcgtcagtctggccgcccccctggggttcggatccgcttggtgcggggaatttttggacaattttaaatgaatttaaattcaacgtctttgacctttaagacgtttaaaataatttaaaattaaataaatttaattaaaataatttgcataaagtcgcgcagtcaaaaaagtcgcgcaccccccctgcaataggtttgggtttgcaagaaaaagtcgcgcaataggtttgggtttgcaaaaaaaagtcgcgcaataggttttggcttcagtactgaaaagtctggcgctcaaatggcccgcgctcacttggcggcgctcaaatggctggcgctcagttggccatgcacccctcccacacctatggggggctaccgtaatccggtgaaaatggatgcactaactacttataatattattttgttgctaaatttatttaaagaattttaaccttttcttttttatagaagataagattcaaaaaattattaaaataaaatttactcttatttatcatataataaaaccagaaagttcaattaagaatcatcttttaaccatgtccaatacaagataaaataatgcttgaataaaaggtaccaaattaattaaataaattagtgcaaattcttcttataacgaacgattaagtaatctaagaatttcactatcgaaaaaactgaataatttattaacaatccaaacttttagtattaaattattcattggagcatgattttaatattaaatggaaaaatatatataattgtaatacctgtaataagaaacctaaatctgttgtcattgggacagaggaatcactgttaaatatctattttataataggttaaattggttattttttcatattaatataaagtcctaatttgaatttatcataatattttatgctatagaattaaaaaacgaaagacttgatgaactcgagacaattactttaaataaatatggtaagaaaggcctgactatataaaataaggtattaaaaggctaaataattgttacaattatatgttactaaataattactttaatgaaaatatgagttagtaataaaatttaaaaaataatttttaactccatactataatacctgttgtgtcgtttatcaacaacaacaaatataatcaataacaaataataagtcagaggagaagagagagataaaatgtgttgggtcaaatgcaaaagagaaatggtaaatgaatgaagtccgaagcgaggaagcagggaagacagcggtatttatgggcgatgatttggtgacgtgtcaataaacataatgccaagaaaatatgaaatgacaataatacaacaatacctatttattaagaaacattgaaatatgaaaaatttagatattaaataataattcaaaacatataaattacatatttgtaacttaagcaattaaaagatttatttaccaaaaaataaataaagctaattaaatattaatgattatagaaaaaacgtcatcatagcagttggtatttaatatttttaattacaaatgcaaatctaagtatatgagcaataaaataaaccctctataagttcgtttatctgcaatttaaaaaatttaatattgttaccatgagcaataataaagaaattggccatgttttaatcggtgcatgcgctaagtgaatattagttctgttattcaaaactgcaattggggtggaacggtatgacaaaagtgatttttttaaccaatccttatctccattgcatttcttcaattgccttttgaagaaatccacataccgttcagctgctccgtttgattgcgggtggtacggaggtgaaaaaatgtgcttgattgaattcctggaacaaatatttttgaaatttgtgaaaagaattggggcacattgtccgaaacaatcgtgtttggaactaccaaacctatcaaataaccactgaagtgatcaaatgatggcccgtgacgatgtgtgacggagaagaaaaacttttggtcatttcgaaaatgtgtcgatgaccaccaggtaaatgttgccatccctgcatggaccaaccaggtcaatgtgaatgcgttcgaacacggaagtcgttgttggccaaggttggagtggctgtttgggtgattgtttggctgcttgttgacattggctacacccgcgaacaatcgtttcgatgtcggtgtccattgatggccaatagacgaacgatcgtgctaaatttttatgcgaactatgcctgggtgagccaagtgcagcgccttcagtgtgcgacttcgaagtgacggggggatgacagaacgtccgttgaacactagacaacctgtgatcaatgaaaagttgtgcctgcctgaaaaatacagcttcatttcggcattaaccccttgattaggccatttggtctgtgtgaatttgattacttccttaatcaactcatcctcctgttgtgccgctttgatctttttcaatttgcgagtaggcctgttctgtctttgtcaatgtgcgggccgcgtgctgaaaaactttctcctttccatcgggaaaacgatgtgaatgacaacaaaatttgtttagccttttcaaaagcttgtcggtgtttttcggtccaatctcacttaatccctttctttaacaactcgtccaacggtccacggagttggtgaatgtttttgatgtacttcccgtagtagtttattgcgcagagaaatgaacgcaaagtggtgatgtcatgtggtggcggcatttgttgtaaggcaagcgttctgcatggatcgggacgaattccatcagccgagacaatctgacccaaaaatttgatttccttcaccaagaacttgcacttttccatttgaacgtgaaaaccaaactgttgaattctctgaaagaatttgaaaatttgttgaaaatgttcggtgattgttttggacgcaataataaaatcatccatatagcctaaaactcctgaaattcctgccgccaattgatccatgatccactggaaaatgtcaggtgcgcttttgatgccaaatgctaaacttgacattggtacaagcctcggtgcgtgttcacgcccaaaagctgacgtgattgctcatcaacacaaatttgaagataagcatccttaaaatcaatttgtgagaagaatttggcaccactgagtttggcaaaaagttcatcgggacgtggaagtgggtggtggtgcggttccaatgcgttgtttaatccggtgctgaagtcgaagcactgccggactttgccattggcttttctgaccgcgacgattggtgctgcccatttgctatagtcgactttttgcagaaatcccaactcaatcattctgtccaattcggcgtccacttcactttgaacaccaaggggaacaggccgagagccgcaaaagactgggcttgaattttctttagcttaaggtgtgcctcaaatttcgtacacaagcccaaactatcagaaagaacatttggaaactgagcctgtaactctgctttgagttgtgtcggcgtgcactccgtccctttgatctgaacactgtgcgtcggttggtcaaacttcaatgtcgttgccactggtttgctgtatgcttgttcaaaagctcgaatccatgccaatccgagaaggtcgaatgaacctttttcaacaacataaaaatccaataaaattcccttttcgccgtttaaggctgccttgattgtgcatttgcctgtaaatttgaaaatgtccccggtgtatgatcgacctaacaaattagtgttggaaagctttggcatgcccaacttacgccacgtttccattctcaaaattgtcagctttgatcctgtatcggcgacaagcggaattcattttgttccaatttggacatacacaataatgtttggttccttctcaaaacctgccggggtgacgttgagacattcaactatattt

SEQ ID NO: 9345 - DNA, 1344 bp, Heterodera glycines
aggtccaggtcccaatgtgaaaaaaatccaggtccaggtccaggcaaaacaggaaaaaacctggattttcctggacaaaattttagaatttattttttcaagtgaccgatgttttttcaagttttcaaaaacagattaaataaatttaaaaatacattattattattattaattagatatttttaggtgtttctaagcaattaattaattttttcaaacctttttttgatttttaagatgagtttcaaaaaatccaggtccaggcctggatccaggtctcgaagagcctggatttttcctggacctggattttcctggatttttgtccaggaaatccaggtccagacccaacatggaatccaggtccaggtccaggcttttttcaaaataccgatctctaatagactcaaagcctctgcatgataatattatttattgttttaatattgatttattttatttttatgtaatgaatttaaatttaaattttcttaatcgtatttaattttttattgaagaatttcatattttcttatagacatcaaatataattattacagaaaaactttaactaattcacttaaatttagtatcttttagcatctttaatctttgttcacattttgttaataatgaaagtttaggcttggttctcattttgttttactttgagtcccattaaataaactttttattatatcatatttctccagattctttatacagtcatacctataattttttatatatgtattttgttttatatttatttcgaaaacagtttataattcaattaatcaacatagggttttatcaagcaaaccacttttttaaatatgcttttagctattaggatttgcattcttcattcggaaacgcttaaaatataaattttcaaaacaattattttaaatttgatctcatgtatttaaatatttgaacgaatagaacaattatttttatattaattcaattaaaaaaattataatagttttgttttgacgaaaatatctattaattaagttgtgaattcatatgaaaatgataataaatattttatctttaataaattatattgagaactaatcttacataattcatcaataagattttataagaatgggttttggaattttcatatattttaattatttatctcaatattttaaaagtattaaatgatttttaatactcaagtattcgaatgaattatgattgatctttcagaatcagtggtctttattttgccgtaacatttcaatttataaccccagtaatatacatgttttcatctatataaactaaatattatcgaaattttcttaagcatttaaagccttcaat

SEQ ID NO: 9346 - DNA, 1216 bp, Heterodera glycines
cataaatggcatatccatttttccactggcattgttacccatcttggttccaacaaaagattaattcttctccgtgcgcgtacaacaaatgccagacgggattttcagtgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttatccactggcattgttacccatctttggttccaacaaaagattaatttcaatattctccgtgagcgtacaacaaatgccagaacggattttcagtgctccacacgcgcaaacataaatggcatatccatttatccactggcattgttacccatctttggttccaacaaaagattaatttcaatattctccgtgcgcgtacaacaaatgccagaacggattttcagtgctccacacgcgcaaacataaatggcatatccatttatccactggcattgttacccatc

SEQ ID NO: 9347 - DNA, 1238 bp, Heterodera glycines
aagattaatttcaatgttctccgtgcgcgtacaacaaatgccagaacggattttcagtgctccacacgcgcaaacataaatggcatatccatttatccactggcattgttacccatctgtggttccaaaaaagattaatttcaatgttctccgtgagcgtacaacaaatgccagaacggattttcagtgctccacacgcgcaaacataaatggcatatccatttatccactggcattgttacccatctttggttccaacaaaagattaatttcaatattctccgtgcgcgtacaacaaatgccagaacggattttcagtgctccacacgcgcaaacataaatggcatatccatttatccactggcattgttacccatctttggttccaacaaaagattaatttcaatattctccgtgagcgtacaacaaatgccagaacggattttcagtgctccacacgcgcaaacataaatggcatatccatttatccactggcattgttacccatctttggttccaacaaaagattaatttcaatattctccgtgcgcgtacaacaaatgccagaacggattttcagtgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttatccactggcattgttacccatctttggttccaacaaaagattaatttcaatattctccgtgcgcgtacaacaaatgccagaacggattttcagtgctccacacgcgcaaacataaatggcatatccatttatccactggcattgttacccatctttggttccaacaaaagattaatttcaatattctccgtgagcgtacaacaaatgccagaacggattttcagtgctccacacgcgcaaacataaatggcatatccatttatccactggcattgttacccatctttggttccaacaaaagattaatttcaatgttctccgtgcgcgtacaacaaatgccagaacggattttcagtgctccacacgcgcaaacataaatggcatatccatttatccactggcattgttacccatctttggttccaacaaaagattaatttcaatgttctccgtgcgcgtaccacaaatgccagaacggattttcagtgc

SEQ ID NO: 9348 - DNA, 3237 bp, Heterodera glycines
  misc_feature (689)..(689): n is a, c, g, or t
  misc_feature (743)..(743): n is a, c, g, or t
  misc_feature (775)..(775): n is a, c, g, or t
atttggcagaaggaaaggatttgcccccgggggagcgaaagagaaatgttgaccataattaaggaagagataagggcaacaaattggaaagaacattttaggagaatggcaaagtgaaagaaaattaaatgagtggcaacaaatgaaaaggaaaagtcagtgaatgacggcggaccattcattgtcaatccaataaacaaatgcttttggttgttcgtgttttatcgtcaaaaaagtgccaaactgtccatttcaattggcacttccgctggcacctctcttccttcggcctcagactcgctcagttcggcagcttctcccgctgaatttgtgccatcgtcgccaattgcgagtccatcccccgctgactgttgccaggtctgtaccaatggcaccacttctttctgctgaattggcttatctgtccggcatttcgctgctgtttgggcccacttcgtctcttaggcccgcttcgcagtccaaacattcttccacgcacaattcgttgatcgaagtgatcaaaaaagcataacgcaatcaatgggtcaacccagagaaaacccttggactatctcttcgtttctcatttctttcgaaccctctcatttttgtgtactattttcatttctaattttatttaattttggttcttttgaattggcgcttttcttttgcgcttctcaccttancaacgttgcaaaaggccaatcgaatggtggcgcattgccttttcagctcaactngaagaaaaatttgaatttgaaaatgggacaanaaagaaagaaatgacttcaattttctgcggcatttccgaagaattttggcgtttcgtttgagcgaaaagttgagcaaaagttgcattcgattggacaaatttgctcaacacttttgtggtcacaatgggaacagaaagcgccttttaagtcggggcaaaggcgttggaggtcctcttcagaaaaagcaacaattaaaatggttggaggggggggggggggggaaatgccaatcgactcacccaattcggcactttgatggagagaaaaacgaaccaaaactaacagaagataaattgagtagcggaactgcctagcgattgccatggcaagaacaaatgaaacaattggcaaagattggcgcgaactcacaccgaatgaatcattaagcgctaattataccggagatgcaatggccaaaccccaacaaatggcaaaattttaaaactcagtatttaagccaattcgtggaaaatgtaaaaatcacaagggttgcttataagcactgataattaaatttagaagaaagggtccggagcgacaggacgccgccgggaaaaattttggccctattttaaatctgattacaccaaaaaatatgttttgattaaatttaaataaattgaatggaaatattcatacggaaatggataatctgtcacaaaccccatggatttgcttattctttcttctgtttgtccccctttttatgcctttttcattgtccctttgtctgttttttctcttttgtgtgctcaaatgctttttaattaatcgaaaacaaatcaaaatcatttaaaaaacgaataaagaatggtaattgttttttacttttaaaaatgccaacataaaaacagagaataaataaataataaccttggaattgcaataaataaaaatcaaaaacaaataaataaaaatgatcaaaaacgggctaaaaaatttatggtccgtttcttagttccaatttctgcaaaatcctttaggattcttataattgtcttaatcaaataatagtattgtttgattttgactcttaaaaagaaccatttttacaaaaacagctgataaaatgataaccgaatcaccaaaccctttcagtaataccctaataataaataatatgccaaaagagaaatggtccattagtgtcatcaaaggatgtgccgaattgtggcccctttgtcccgtcgcccttttgtcttccccttttctacagttcgtccctattttcttgcttcttgaaactcgccaccgcatgcttcttcacgaacttggccagatcctccaagtctctgtttccgccgtactttatcggcttgtcctttttcccggaaggcacaaaataaatcgttggaaatccttcgacggcatatccctcgggcacgtcattttcgctcgcatcgaatttggccacgattaaattcggctcctctttggagtgtttggtcgcgaattgtttgtactttggctcaaatgctttgcagtgaccgcaccttttaaagttttttgcctatttaaaatgtttttcgattgctgaaccgaccacggggcgtaaaattcgaccagcgcatcgttggcctcgtcgttcacaatttttgcgaaattttccgccaccaaaattcgcaccggcgccccctttttgtcgccttttggcacgggctgcgacttgacaaatggcttcaccttgcctaaacggacgcagtgcttttcgcttgttcatctgctgttcacctttgccaatgtcctctaggaaattggccaaattctcctccaaattctcgtcgtatttttccgggtccatcggatactttttgccgtccaccccaaaaacaatgacattttgttcaagtccactggtgccgaggccaaccgcatttaattcagttgaaaactcctcctcatcggccaccgcaaaatgataattttgtttgctgtactgaaattcgtcggtgagtatttgtttggccacaaatggcatttggcggtcacctttttggcaatggccaacactttcttctgccaaaattgcgtcccatctctgtaggccaaggagaagtcgacgttgtaataaacggccacctgcgaatgtccaattgggacagcaaatgattttttggtgcttttaccaatgggcggcggtggtaccgcgtggccgaattggcacgggtcatttggccaaccaacggaatggcattgtcgcgccagaaggaaaccaactcttcgcttgtggccgtctctcgtgggaaaatcttccgtttgggctcgtactccgaatggaatatctgcgaatgctttcgcgttgcttgagatttcttttggctaatggcccatttatcatctcacctctggccagaagagtactacttcgccaaattttgcgccaaaaaggtgcgcaatggaaccgtccaaggcgacccaacggcaaaatcaccgcgcgtcctttcccgccgcgcagcaaaag

SEQ ID NO: 9349 - DNA, 2647 bp, Heterodera glycines
tggaaatgaatgagttggtcggcccatcattagccaactttggaattaaactgaccgtcggcttctctcggcccattataatcgaaccttcggccatttcggagtattttgagagttggaaatcctttcacagcgtattcatctgacagcttcttttcaacggtcgaatcgacttttgtcaaaggaatgccatgtttcttaaacaaagcatttgctaattgtcttttgagtgataagcggaaggaccgatcggtcattagccaaaattatttcaaggccaatgatcaatcggagagacttcgaccagtgaccgaaatcagtcgaattccatcgaaacacttttgatcatcaccgatcataactgaaattggttggttctaaccttcaaacgttttgctgcttcttcgtattcgggtgccaattgcttgcaatggccgcacctttaagcaattattaattttgggaacttggattttgtgccaccatggggcgtaaaactcgacgagaacgagcggtttgtcgccgacaaattcatcgaatgtttcgcgagtgagtgcgaccacttcttccggcggtggtttgtaattggggtcagtcttcagctttatccatcgcacaattcctgcaaattattcagctaatccagtcagccattttccttattcaatatttctttgtcatttggccaattcctcccccccccccccctcttacaccttcggcgtctctctccccgtcaaagtccgtcggttccgtctgtccatccttccacagtttaatcgtcggatagccttggattttaaaacgctcagcaagctaaaattaatttgggcacttaatatgcaggggttttcctgctgtggcccacttttgtctccacggtcgcgtccactttggcaaatggcactgaatcggccaattgggcggctgcctttgcatattcgggggtcaattgtttgcagtggccacaccttcaattagcaagtgaccctttgccaaatgatcatttaagacagctgctgaccatggcgcgtaaaactcgaccagcaccgttgggttttgggaaagaaaagaatcgaaagtgccgtctctgagcataaaaatgccgtcctcctgtgggaattgcccactctctctttgcccattcgcttcactttccgtcgcttcatttccaaagtccccccgggcgctgtttaacctcaccaaaaggaaaagagcggagaaagtgacggcaattaaaggggagcaaaaggagggggaggaaacatttgggacgacagaccgtcgccgaatcattgcctttggaaagaaacggggtttaatgatcaatcaattataaattaattaataattaggcaattaattaattacactaaatataaaaaatattattaatgcgttatataaacgagcattattatttttattctttctcatttgtcagcacagtcactgctgacgtgcccattcgatcgattcgttgggatggaattgtaagggaaagaaagaaaaattggaatgggcgatggattattggcgaggggactaaaggaattttaaatttaacaaaatttaattcatgttaaatgaaaatgatatgccagtggtaataaaatgaaagatgagaaggaaagggggacaaatgccaaaacaaaaagtattttctttgacaattcgcactaaacaactcttaagaacaatttggatggaaaagcctaaaaaatccaaataattcggcaaaaaaataattgaatttccaattcatcacgacccgacggagatgagcaattagaacgattgatgagaccagtgatcacagctttggtttcctttgctttgtctgatcagagaaacgcgtcgcattggctgttggtcagtgtcgaagagactgaacttcgtttggccatctccgactgtttgcgactgcaattgccctccgtcccctcaatttggcccacatttatggcattggtccatgcccttttatccgccgcttttattggcgccattgggcaaatgccgacgggagagaagggaattgagtcttgtgaagtgacagtttccgtcatattctctccttcaaagtgatgcttctatggttcaaaaataatcttgagaaagtgtcgttaccttcacaagacttttcgactggagaagttttgctttctccgtccgccaatttttgttgcaggaaacgtttggccaacgaaaaattggcaaattttgaaaatgtcgccgtgtcgcccgtcggctgctgctgctgcaaattggaatgtgtgctgctcttcttcgacgaatgacctttggatttccatttggcattatcagtctgtgccatccatcactcacccgactgtgccatttgttgctccgtttgttcctttggttgcggttgctcctttgccgctgccgtggttggcattgccgttgtgtttgtcagcaccgtcgccactcctccgccgttggcattgcctccgttcgcgtcgcccgtcgtttggaccaccaaaatgcgtttgttgtcgcatttcgtgccgttcacattcgtctgctgttggcacccgtggcattggctgccatttcgtggcgagttgttcttgctggtcatcgtgaccatttgggagtgcgttacgcttgagttgggcattgg

SEQ ID NO: 9350 - DNA, 1915 bp, Heterodera glycines
aaaaacaaattcccggaagaagtcgtgaaccaaatactgcagttgccttctcatttgccgcccgagtcattctcagcatagtgtaaaacattgaaaaaccttgaattaatttaaattcattcgtttgccaagggcttctttctatggcataataacgcacgtgcacacaatgccaaacaatgactgatggacggcattaatatgggccatggcacaagcagaagccatcattctaaaaaattatttgcataaagccaaatacatttcttaagcaattcttaaaatgtatgtagcatagaacctattcaaaatcaagctaataacttagaaattttttaagaggtgcagctaaaagtttcaaatgtaatcaggagaagtctttaaaggttttaaatttttttgcagataattttcaagcaaaaacaatttttttgatgtttttgaagatttttagcgcatatttttagggttttggctatattttgtgtaaaatttttttctttttttgtttagtgcttaatttagaatttttgatatagataattaagtgcttaattcacctttttggtgcttaaaaatcctgtcccaacatatgtagattattaataaaagaatttagaaaaaaacgcaagcaaaatatcattttttaattagaatttagaaaaatgcaaccaaatttccattttctaattgttctgattttattcggtgtttccatttgtacggcttcatcttacacttggaaatcagagcctaatttggccaacaatgtacaaacgtttgccaaatttatggatgatctttatgtggaatacaagaagactgtaaaaatgggtcagttcaatgcaaaatgtaaaataaaaaatatattttagtgaaatttaccagcaaaaaattattatttttttggatttggtttttttagatgtaaatacactttcagacacaattctaagaaatccgtcaacgatattattgactaattactcagacaagcagaaaaggacagtgttcaatttgacatttgtaaaatgtgtggcggaaattgcctatttccgagtgattaacaaaaatgcaaattcgaatttttcatatcaaaaatttaaaatagtgcctggattagatgctaaagatgaatttgttggttttttgcattttgaccaaacacttggccaacaaattgctgaaaaattcaaagacgaaattttttctgagaaaaaacaaattcccgaagaagttgtgaaccaaattctgcagttggccttctcatttgccgcccgagtcattctcagcatagtgtaaaacattgaaaaaccttgaattaatttaaattatctaaataataaaaaatttttttttttttggattttgaattctttatttatattctatataaaaaatgtttttgttggggtaatgacattttttggtgaagtgtggcataacggaaaagtgctaaattattattttttcattttagaaataaaaaattatatttactttttaataaaaaataaaatttagtaatgacgaatactttcaaatgtttcgtgacatcggcggatggcagctaaaaacccttttgagtgcctttaaaaaattgtcagaaaatagaggcaacagtagcgaaaatgggtagaaaatcgggttgttattaaccaggggtggagcgtgcacagaaaaaaaaccgcagtcgcgcattcaaattgccgcggccgcgaccgcggatcgcacaaaaaaagaaaccgcggtcgcgcattcgaattgccgcggccgcgaccgcggatcgcacaaaaaaagaaaccgcggtcgcgcattcgaattgccgcggccgcgaccgcggatcgcacaaaaaaagaaaccgcggtcgcgcattcgaattgccgcggccgcgaccgcggatcgcacaaaaaaa

SEQ ID NO: 9351 - DNA, 4066 bp, Heterodera glycines
  misc_feature (4049)..(4050): n is a, c, g, or t
aattgatcataaagcactcttgattttccacgtaacaaagctgttgccaatggaacacaatgcgtttgtgcaataaatccaaatactcggtaaatctggatgagcatattgaattaatcaaatatattcacattaaacttgataaatgcctcgcggtgccattttgaaagtgccatcacaaacaatcgtttccgttcgtttaaaaagcgccaactgacggggcgaagaaaagagtgccatcacgtccgtacactctagcaaaaaaagttcttggaagtgatcgctttcctcgtgtgcaattcttccacgataagtcagccatagaggcttgcttatttcttgctgaagttcctgtaatgtccggattttcatcgtcctctttgattgggcatagtacaacgcctattgagatttaaacgagcatattattaaaaattaaatggacttaaaatgagttcctaccttctttgttgccactgcattaccacaagcgctgtccctgatttccgctttttcctgagtaggtaaaagtttgtaattttcttccactatgcattcaatgcgcactttcgccgatgcaatgttttctctggacccaagtgccagttctgcttgcactttccgtcgttcctaaaattcaagtcaaatcattctctacatattatttacacctcaactccaagaacttctgtttttcgaatcggttcgcaaaagtgagggtactttgcaccatcgctggcccatgatccattttcaagcacttttctggttggtaattttctgtcgcttggaacatctttccggtccttgattttccggcaaccagcacatacaaagcgttgaccgtcatcttttttgactcctgcagatgtccatttgtagcaataattcggattttcggagcaatcagttgtcataactgttttagaaccaatacgcttgctatataatttcattatggcactaaatataattgtttacgttttttataatcaagaaattatgaattagaaaattgcaggcaaaaaacgaatcgggataataaaaactagggctaggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaaccccaaaatatgtgctaacatattttatgtgccaaaacgccaaaatatgtgtttttatgtgtttataagtcgctctaaatcaaaaattgttcggagataatgctatttttgggcttctctcgccataactaagccgcaaaaaaagtatgttaaaacataaaaatcctagccctaataatcatgcataccaattgtcattcatttttaaatagaattttcccatttcgaattattgatgcaaaaacatatttttggactcagaagttcttaagtggaggagaaaattcaaggaacaaccaaactatagaggtaaataattttaaataagttttctaataaataaaattgagaaaaattttatatttattttttcattcaaataatttttttgtttatttaaaagtttaatttttcttctttaatattaatgttatggccaaaaaatattataaaaaaatgatttaccttttttaaaacgctacaaaatattctttatttctaaaaataaacggaaagaaaaaatatataaattaaaatacaaaaaataaaacaacaatattgttgttgtttttttttaattttatttttttggttgttctcctaatagcctatttaattaaatctattattaaacaatgcttatgctttataaaacttcaaatttattctccgtttgtctaattacacattgacacaatacgaaatttcgaatttcttgagggtaattatgaacacaaaatcccaagagaaaccacctgctgaaatctacacatttctccatgatcattttgtctcattggcatcaaaacaacaatcatcatcaacatggatatggaggtattatggcgttactcaaaaacaatcaaaatgggttactcaaaaacccattcaaaataaaaatatttatattaactgatcggaagcaatcaaagttttaatatttgatttcattcgatagtgctaaattttctctattagcctttaaaatttaaaaaaattttgttgactttcaaaaaagttgtggtcagaaggacgcaaaaaacaatgtttttcaaacacattggtcaaaaaatttttttaaacttaacaaaaattttttgaaattatttaggctaacagaaaaaattaaggcaatcggaaaataaaaatcaaaaatttggttgtttcttaacaaaattatagtcaactatttttatttggatggtttttgagtaacgcccaatttggaggtttatgagaatgacctattaaatacagacacggacacggtggatatgaattgtcggaacaataaaagccacggcttctctaggccaaaattctcataaattttcttaattattttacagtgaaaaaaaagcgcgaaataaactgtgcatttgtcaattttggacgagtgttggcaaaacgtttgaaatttgttcatgaaaagtttaacacatttgctgatggtaaagaaaaagaatgtggtggcagagaccctcacacaacaaattattatgattataagcatcatcatgctttcatcagtgataacaatacaccggcggaagggtaattaatagggacgcgacttttagtgacgaaaaagtgccaaaatagttgactaaaatagttacgaaaaagtgccaaaatagttgactaaaatagttacgaaaaagtgccaaaaaagtgacaaaatagtgaaaaaagtccgcaatagtgacataatttttagccaaaaattgagcaaaaaataatttttattcactgattgcagttgcaagtgagctacatttcctttataaaattctcttagcaaatattcacattttttaaattaaaaattttgtcaagaaaaaaaaatttggtggaagaatttttgaaaaaattttccaattcttagtggtgtatttttaaaaaattgttttgtcgattcttaggggtgtatttttttgaaatttttttagatcgattcttaggggtatattttttgattttattgcatttttgttaacaaattttccaaaaaatgtagaaatagtgaaaaatagtgacaaaacgccaaaaaagtgaattttcatttaagtgacgaaacgccaaaatagtgatttctctagtgacgaaaaatgacgtccaaattaaaaaattttaatgcataaatgcgttttttgagcacctttcttcaaatcaatcgagcaaaaaaaagtttttccactagaaatcgcgtccctagtaattaaattgataattaattaatttgcagacaaggattagggttcatatcttttggcccggaccaggccgttttcgcgtgggcccagtttttgaactgtaatttttttattgtcaactaaacccacgaacttgatacattcgaaagccctaagtgccctctattagccatcatttcaaaaaatttcgtttggttttaaaaaagttaggcaaaaaatggtcgaacaaccagttttttgaagggccatgacttttttgaactttaacaaaatttagaacagatttcagactagaatgagggtnnattttttctttttagt

SEQ ID NO: 9352 - DNA, 1424 bp, Heterodera glycines
  misc_feature (538)..(538): n is a, c, g, or t
ccttgcaaaatatggtgcgaatctgatcagtttaattaaaaatagttaagcgtaaattgtatggcatgtttaaaaagaatcaggttcgaggaagtattggtaagccaaaaaacatttcaaacatttcaaaatctataaacaatttaaaaatgagaattcatgtgagattttctggaaataagcttaatagggcctagttaagctgtaaaaaaaatgtggggcgatttgaaagagaatagaaagaacccggttcgatgaagtgctggtatagccaaaacacatgcaaacatctaaaaatgtattataaatttaaaaatgagaattcacgcgagattttcaagaaataagctcaataggtcctagttaagctgtaaaaataattcgcaacgcattgaaagagaatagaaagacactggttagaacaagtttcagcaagacaaaaaaaatccacccatttacacatatattcagaaaataaaacactaaacttttaacaactaataacaatttttaaacaaacagccccccccccctgccncacgcccttgcccagcaggtgtctgtgggatttccgaataaaatttggttgatggaaaagtgtttatttcccgagtgccaagttatgacgtgccaaagtttttagttaccattgcttattttcccctgttcccggtttccacacattctttttatcagaaaatcaaaaattctttccagtactcttcaaagtaaacagatagtgttcaggattagtttaaaacccgatctatttaagaagcaatcagattgagatgctaatgtttgaagagccgttgtggaactatggccaagtaattggaattgatgccaacgaagcacagggtaaagaattgaacataattaaaactttaattaataaaattcattaattaattccagatgttgtgaaattctgtgaagaccttcagcagaatgttgtcagtgcagcactgaattcacccatacgaaaagctatgacagttatgaaacttacagaattggaggaatttcaatatttgaactccattatcaatagcttaagagatgaggaaaatatggatgaattgaacatttttgctgaaaattatgacaaaaaattaatgattgacaagcaacaatcattaaaggaactgttggcaattttaatgaaaatctacgcggactatagcaatgccagcaaaagagaaataagcaaaaatgccattcggttgacacattctggaaacgaaattttacgatttggacaaattttatatgaaacgttagagaatttggaaaatttgccggaagaccgcgtgaaatatgatgaaaatgaacaattgctaaccattccattattatttgtcaatcatttgcttgagcgactcaatgaattcattgaaaggtttgtaaattagcctatggcg

SEQ ID NO: 9353 - DNA, 1663 bp, Heterodera glycines
tgtgactgatcagggaagacagttcaattctggaatttttaatgatttggcaaaaatatacggttttgagcatgtcactacaacaccatatcatcagcagtctaatggaatggctgaaggggctatgcgaatcatggcaaatattatttctcaaatggtaaatgaaaaagggaataattgggatgaaattctgccgcacgctattttttcatacaatatttcaatacattcagctaccaaattttcgccattttttatcattaatttacgacagccaaaattgccaactgatcggttacttaaactcccatcccccgatgagcttgtgtccgatatttcggtctatacaagaattcagactgaaaaagcagctaaagcgtgggaaattgtgcgaaatgaaattctaaaagcgcaggaaaggaacaaagaagagaatgatcaaataaggaaagcacatgaaagagaatttgaaatcggtgatttagtgttggttaaaaaagaagttttgggccataaatttgatcaacgttggttgggaccaatgcgttgtgtgggagttgaaaaggagaaaaaaaatgttgttttacagtcaattgatggaagcgctaaattaagaaaagtacatcaagaaaaagtgaaacattttaatggaccagcaattcttcctctaaggcagtcagacgaaccattaaattgggaaaagtacgtagatgatccgaatttagaacaggaagaaatcgaaggtgaaagttgcgaaagtgactgtgaggaaacgcaagaaaatgaaaatgcgcagtcaaaaaacaaaatgggattaaaagtttaaaaatatggctttgagagttctgacgatgagaatgattggagtattgttgcgtttgtaagagaaaaccaaaattctgaggatgatgaaggcccggaagttataatggacagaaacccccgaaatcgaaataatgccaattttcacaatactcgaagtccttattgagggttcatttactgaagtatacaccggatggagagaccccgtaacaatctcattaatctcaagcatatctgaaaacctagtaagggaaaattgggaaatttatgttaatggaaatggctcaagatttgttatggcatggatttttggcgaaagtttcgaaattttcattgtcaacgaatttgatcaaataatgttgggaattgatgcgcaaatgttgttgggtgaaagatggcgaataaaaactgaaaatgaaattgagacatattgggaaatctacttcgatgaaaatgggcacgaatttgaaattcccagaattcctgaaatccttttttcagaaaaggaaaatttggaaattgggtatgggccaaactttgtaactctccgagattcagaaggaatgataagtgatcaggatgatttagaggaagtaaatgatttttcaagaacagacattaatgtgataaattatgtaaaaccgtttaaaagtttattggatttttcaaacgaaattgatgaagatgaaggaaatgaagaattagtggaaaatgccggagaaagggagagaaatatgaataattctctagaaattttagggagaatggaaaacgaacagttgaatgaaaaagggcggctaaataaatcggataaaaatcaaaataaaaaatatgcgag

SEQ ID NO: 9354 - DNA, 3845 bp, Heterodera glycines
ttttcattgtcaacgaatttgatcaaattatgttgggaattgatgcgcaaatgttgttgggtgaaagatggcgaataaaaactgaaaatgaaattgagacatattgggaaatttacttcgatgaaaatgggcacgaatttgaaattcccagaattcctgaaatccttttttcagaaaaggaaaacttggaattgggtatgggtcaaactttacaactctccgaaattcagaaggaatgataagtgatcaggatgatttagaggaaggaaatgatttttcaacaacagacattaatgtgataaattatgtaaaaccgtttaaaagtttattggatttttcaaaccaagttgatgaagatgaaggaaatgaagaattagtggaaaataccggagaaagagagagaaatataaataattctctagaaattttagggagaatggaaaacgaacagttgaatgaaaaagggcggctgaataaattggataaaaaacaaaataaaaggtatgagagccattcgtttttcaaggaattggaccgaatgacatcaccggctccattacatttcgagtctttgactgaggacgaagaagaatcgctgagacgtttggaaagacgtctgcaggaacagctgaacaaagtgaggcaaacattggcccaagaacaactagaggagagccacgtgaaggcaagggaagaaaaatgccttgagcaactgaagcaacaaacggttggagtacggtaaaccaaaaaggaacggcggaaaaggaagaaaaaagtggagaattatgtaaaaaaagagaaagtgagaccaaaaaagccgaaccggaagcaaaagaccgaaaaacggatgaggaaggacttgtacaagcaaaaatggagaaagagaaaagtacggtggaggatgtgttgtctttaggagatgaagaagaagactctccttatgaagcagcgaaggtattcgagatggggacgtccttttttgagagcgcgggggtgcgagtgaattcacgtcgggaacttgaggaattgacaaaatcccgaaatgaagcaaaaataaaagccaaaaatgagttagagccgccggcgctgttagacatgccaaaagaaggacaaagtgcccgaaaacgattgcgagagggatcgccaaacaaaggcgaattgtttacgaacaatcgttgggatgagaagatgcgcgagatcgaagaagtgaacaaaaactcaaaagaagtgcgtaatgccttgaatagacttttgacgatgcgtcaaaaaatctttgaaatacaggacgaagcccaagtggcgacgaaggaattgcaaaaagtgttaagaaaaatggagggaaaggaaaaaagtggaaatgaactggaggatgaagttgggttgccgggaaatttgcgtgaagctcggtgctttaaatgcggacgttctggacattttgctcgtgaatgccgtgatggtggagacgggaaccgtggaagcagagtttggcgcaattggggcgacgctcgaggtcgaacgggacgtggaacgtggcgaaatagcgaccagaaccaagccgatgagggcccatccacttcgacgtcatcagctcacttgacggacttcggcacgttcttcaattacatcggaggaaaccaataaacgcaaagtgattggacattttcatttgatcggacattttcattaattaatgctaaattatattactctttaactttcattacttctctatttttgaattgtatcagtcaggaccgatgacggtctattcggagggggccgatgatatacttaatttcttatttctctttttctctctcttatcctctgatcattgttcgcccatcaatgtcatcccgggggcggaccttcttttcactaatcgagaccctttataagtgttcatccgcctcttctctctctcagtcttgcccggggctcccgcccatcagtctctgtccccgagaccgaatcgggttgggggttgcccattgtatcctgaacattggacaccagaataaaggctgtgctgttggtcatggaagagtaagacattggcacttagacctttcgggcacccccttgtccccatctacattcaatcacgagggttggtaaattatatgaatcctaattttttccggagctttggaagggctcctgaaaagcacgaaaaaccccttgtacgagaagttacatatgcatattttgcatatttgtgtttatatttcgcaatttatatgcatatttgggtatttttttcaaaaaatcctctattaaaacgacccatctattaaagcggcaattttgattccaaagaacccaaaaaaattttttcaaaaacccaattttaataaataaaaaactaattttcaaaaattttgaaaatttatctcaaaataagccaaaaatgagaaatttcaattttactttttactttcaacaaactgtgagagccatccggaattttctgccatgtcgagacacaattcatttttggggggggggggggcggggtggagacgacgctgacaaaatgcgattttcgggaaatttaaaatttaaatgcgatttacgggaaattttaaaaatttaaatgcgatttacgggaaattttaaaaatttaaatgcgattttcgggaaatttttaaaatttaaatgcgatttacgggaaatttttaaaatttaaatgcgatttacgggaaatttttaaaatttaaatgcgatttacgggaaatttttaaaattccccacccccctggtaaagctggtccgatcgagcctccagtggaagagacgacaaccagcaccgaagaacccaccaccacatttgaagcgcctgaaatttttgtcgaatttaatgtgagcgtgagcgaaaacggtaccgtaatcaccgcatcaatctccgtcatcattacggtggctgtgctgatcatcggaggtagtgacaaaaaaaaagatttaaatttaaaaaataataataattaatattaatttaattgcccattgagaaaattcaaccaagagttttctttaatatattatgttaaataatgagtttttgagaaaaggattttcggcacaaattttacattggaatctttttgtctttttaattcaaatttttttataaattaattaattttatatttttttgtttagccacgattgtccgttcgatggcattagcataaaaacggaagaaaaactgtgtgatgaaaaatgagaaagtaccaagttaacctaatcacatgtgtctaatttcaaaacatgatcaaatacaatcattaatccacacatttaatatcaaattcatttaaataaatgcaaaattacaatttccaaaaaataataattaaatgtgttaatttgggctgtaaaaaacacctacatataataaaatcaaatttttacaaacaaaaatatgattgactcttgaactcgatcaaacccctttaaataattttttattataatttacaaaattagactttcataaattacaaaaattttttaaataaatgtctcgctggagctgtcgaaggagagaattttttaaatttaatttgagtggaatttcttaatggattttagtcaaaattattcatcaggatcgatttgaaatagtctccagattttttgatcatttaccactttattttgttaaaacaatgactaaatttgtttttctttgggcactcttccattttccggattttgtcaaaaaaaaataataatttttttttacagatgcaatgttttgtttattccacaaaatcattaggcattagtgctacattttattgtatgaattttatttctttgattttcttctttgcttgtct

SEQ ID NO: 9355 - DNA, 1209 bp, Heterodera glycines
aaatcaatcactgtcgaattattgtatacatgaaataatattaatatacaatttgcacatacaaaatttaaaaaacctaaaaatattatccctttaaagatttttcttttgattcactgtttttattttatttttctcttcttcattaacaaaacgctaaaccttaattcaaaatgacaaaaagaggcggggcctcctctgacattgtatagtgtaaggtaaaattataatgcttattcgggaaggtatggtctcaaaattgttttttcacctcctcttaaaatgcgcttctctccatctgatcattttctccatccgtcatcacaccttcagaattttcccgcagacaggggttatccatgttcgggaatttgcagtggaaatcgatccgtttcttgtacccgtcatacattccgattgaaaatcgcgcgactgattactcagatgctttctttaggctgtagaggccgaatttggccttttaagccttcatttggccattattattatattggtgtaaatttgtcgcctttcccacattttcccaccattgacaccaccgcctcacttctttttagtaacgaagttcataaatgagagaaataaaaatgcgattaatttttgaaaaaattgttgttattaaatgagagagacaagacgaacaaacattattttgacgcaatttaattcatttttaaaggtatacacaccgtttcaattttggcctcccagttccaaaaagatttgcgtgtgtggctcagtggtttttgtaagatagtaaagggacaaagggtggtggttcgagtccgttgtgcaacatgaatatttttatttatttttgtccaaaatattaaaaaatgacgaattttgggaattatttttgaagctttttgccaacaaaattggtaaatcttggtatcattcgaaagcccttgatggggagaagctttttctaagcaaatgctaagcaattggattgattaggaaaaagatatgagggttcgaaattttgtttcttgaataactttttagttaaccctttttttgcttttaaaaacccttacattttgttccaaacttttttatctatcgatatgcaaaatttggtgcagattgtatggattgagaaaaagttatatggagagagtgaattcggtttttctctattatagagataagaaatagtacgcaaaagagaagatgtttttt

SEQ ID NO: 9356 - DNA, 718 bp, Heterodera glycines
tccaactcgggggcacctcctcaacggaaggggatgcaccgtacccacttgtttcgttcctcagccaactgtcgcctgttagcgcgattgcatgccctcagcgcaggaccgattgctcggtacctggctttggcgcgacgcctcacgccacattctttagctttgtccaaaaatgcactgatcacggacgggatcaattgaatgatcatatccatgatgggtctgagccaaagaatgtggcaaaaacggggtttcatatgcggtgagcatttgcaatttttgtatgttgtacaaatttagtgaggggggtcagagaactgtacaactatttctcaattcccattctcttctctgttgactgaccactcttagtgatcttgaccagtctgctcctgggaatctatggcattatttaaaaagaaattggaggacagagaaggttaaaacacaaaagaaaacagtacagaggaaaagaataagagaaaattgaaagacgtgataaaaggggtggttgaatattttgttaaaataattcattttaaaagggatatcgggaattagattttatttgttcagttgggccgctactcgtctcttttgccctttcaggtgaattaaatttttttgttcaaacgcacagatttggagtcccattgcaaaaaaaaagaattgaaatcacacaatttcatgtaattaattcattattttattttcacaa

SEQ ID NO: 9357 - DNA, 2070 bp, Heterodera glycines
ttcatgacttttggaaatgggttttcatcctcaaaaagttgcaatacgtggattacatggacgagttggccaagttggtcggctgcaagccgaaattagtcggacgcattttcactgatccatgcctggccaaagttctcctcttcaacggcctcgtgccgtaccaattccgattggatgggccccaccgatgggaaggggcgcgaaaggcaattttggagatggatgcgcggatgtttgagaacacaatgacgaggaagacgcgagaagagacgaaagggaagaagagggcgaagatgagcggggggttggccagatcgatcagcggatacatttgaagggggagaggagggcacactgacaaaccaaaccaaacataacgaacgcacttttcatatttaaccggaaattacatttgacataacccgagaagaaaatatcagtttatccaaaggattgattttcatttacatggggaaatacaattcagtgtaaatatcgtgaaattggtcactttttaccgttgttggactgtctcagatacgttttcgctttgatcagatccatcacccttttgtggccccaattctttgccaattcgtaagcatcttgtccctgcccatttttcacatccaatcgcgccccgtgttgcagcaaaagttgacaaatgtcgacgttgccgccttgcgccgcgtacatcagcgcagtccagccgtgtttgtttggcacattcacacaattggcatcctccgcaataatacgctaaacattcaaaaaactttggctcatctcttttatttactcattttcacctccaccaaatcataaacgcccaaaaaagaggctgatcggatgctcaaactgtagccttttctcggatctttaaatggcactttgatgaattcgccgattatgtctaaactaagctcctgctcaaactcatgccgttcgacctcgtcgttgaagcacacttgttgattcttcttttggtttaaaaactttctaagtgccatttttacaaattttgtagtaattgactaaagcattgtaaaataaaggtcggcgctatatggaaagttaccgttttttaaaattttttcaaacttttttcatgcaattttttttttatataaatgctttttaacttttttttagcaaatggttaaagtttcaagatattctattacaattatggtgaataaaaagtatattcacgattttttatctcaaaaatttttgcaaaacaaaagggtccccctttgtttttgataaaattaaaaatctgtcactttataactagcgccaaatttcttaataggcccaaataattgtcatattcatgatcagcgacctctaaaacccccgggtacttggtttcatgactttttaaacaaaaaaaaatttaccaaaaaaaagtgaaaaaattttcaaaaacggtaactttctatatagcgcttaaagggcgataaaaataacacttgacaattctatcaactagggttgggcccccaaccccgaatttttcaaccccgacggccggtgacccaaccctactgtcaacgaataaataaagggacaaatgagtagtgaagaatcccggtgtaattaatcaggaaaattccattaaaatgttgtgccttaagttttatgtatgaaaattaaggaagttttacgggagcaggaatgggacccacgcaaaactctcgctcccgtaagaaatcccgctagccaaatgaacttgaacggtcgccggattcccgcttcgccggctctaatgaagggacccacgcgtttcggcgctcgtgtttcggcgccagctcgtttttccacttaagcttttttctttggcatccaaatccaacaatcttggtatcattcgaaagctcttaacatgctctattagccttatcaaaaacgaaaagtttttcaagcctgtaaaaattttattaagaaaaaacttcaaaaatttcgacttttcgcaattttcatgcataactgttttgataattgtctaatcgcaaagcaatagcttagaaaaagcttctaaatagattaagctttcgaacgaca

SEQ ID NO: 9358 - DNA, 1774 bp, Heterodera glycines
aaaacgcatgggacaagtactcgaagtaacgaaggacaaagctgtcgttcaggtaaatgcgaatttaacaaattattattccattggtgaaagttaaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacaggttttaaaggcgtaattaatttgcaaattgatatgacctttaatgttttagcctatcaacccatggtccagaatttatcccgaagaaatgattcagaccggcatttccgcaattgatgttatgaatagtatcgccaggggacagaaaatcccaattttttctgctgcaggtcttccgcataatgaggtgactaaatggtgtcgacctgtgcaattctttccccattgtcagatcgctgctcaaattgtacgccaagggggcctcgtcaaacagccgaacagaaagaaggaaaatgaggtggagggtgacgacgactttgccattgtgtttgctgcaatgggtgtcaacatggagacagcgcgctttttcaaacaagactttgaagaaaacggttccatggaaaatgtgtgccttttccttaacttggctaatgacccaacgtaatttaatgtatggtaattcacgcatacataaaaaaattatagcatcgaacggatcatcacaccacgactcgcgctgacttgtgcagaatttctggcttaccaatgccaaaaacacgtcttggtaaggaggaaattacctttaaagaatagctttgtaaacacaatctcggataagaattatttagtgtttcgattgttttttaatgcttttgtattcgttaaggttgtgctcactgacatgtcttattacgctgaagcacttcgcgaagtgtccgccgcccgagaggaagtgcccggtcgtcgtggttttcccggttacatggtaatctccactagtacattttcatgtattttaactttgtcttgttgttagtacactgacttggccagaatatacgaacgtgccgggcgtgttgaaggccgaaaggggtcaatcacacaaattccaattttgtctatgcctaatgacggtaaaagaataattggtggtaggaattttttatttgaccttttagacatcacccacccaattcccgatttgaccggttacataacggaaggccaaatttatgtggatcgccaacttcacaatcgtcagatttaccctccaataaatgtacttccatcgctgtcgcgtctgatgaaatcggccattggcgagggtaaaggacaatgtttcgcttccaactcttacattttgctttgctaggaatgacccgtgccgatcattcggatgtgtccaaccaactttacgcatgttatgccattggtaaagacgtgcaagcaatgaaagcggtggttggagaggaggcactgtcgtcggatgatttgctctacttggagtttctcacgaaatttgaaaagaatttcatttcacaaggtcaacaaaatcctttaaatgcatttagtatcaaaggagttcgttttagggaattatgaaaaccggacggtgttcgactcactcgacattggttggcagctgttgcgcatttttccaagagaagtgaatgaattccctcttacttttattttgaaacgtttcttttaagatgttga

SEQ ID NO: 9359 - DNA, 1402 bp, Heterodera glycines
gcccaagtatttagatggcgtcgtttcgacttcagtacgtgatttttagaataatctagtcaagagctttccaatggtgccgaatttgtggggattcgatcgtttagaaaaaagttagagtgcgaaatctctcaatttttctagttttgaatcggttcaaaatccggtttttttggcatttccgcaactcgagacatatttttccatgcttagctcctagagacgaatcgattggtatatcatttgacccattttttcacggggcgttcactatagttcacccgttaggattaccgtgattcaaatcctcctgattttatcaggatactgacctcccatggtcaaaatattaacaaatgaggcaatagtgtggcaaccgtcaagaattggtatcccacgaaaaaatgttaaaaacttggcaggtgccttttctagggcttaaaaatgcgctgaccacaaacctgagctcagattttgtaaattattgatttaatctatgatttttgatcaactacttgacttttccaaatgtttttattatttttaaaaaatttttacaatgaattttggtttgaaaaagcctgatcatgaattttgcgtccattgtttcttgcgttcgatcaatttgtttatccgccggtggccatgtttggtcagctttccgttgacctgtgatttttttaaattttgaaatcaaaatttttgtgggggacaaaccacatcagccaattttctgaatttaacaaaatttaataggtccacccactaggccactaaagtggtctccttcctctcctggctttgcatttttgtaaaactaggtttaaaatagggagaatatctaatcgaaaattttaccgggtcaacgaaagaactgcggatgatgtatccggtgagactgccccgtccaatctcccacgacaaaccaacagagcacttccacgaagttgtcgacttcccctccacctcctccctctcctcctccctccgccagcgggcggtacccattcggttacctcgggcagtacgccccgctggcggcgttgctcaatcaattcgtctaacgctctttccacctcttcccattctcttgctgaaaattcgttttaaaaacattaaatggtttagtttttacccaagcgtctgagcttctcaatcttctcttttaattgccgatggtatagcacgtaatttaaccgaaccttaaaaaagaaaaaaaatgaaaacaaacagattaactcaatatgtgggatggcatggcttactcattgaataaatcggatagtgaaaagcgaacccttggaatttttgcggaatttgtcctaacactaacaaaaaaaatacaataaagaaaggtcgttgtattaatgaaccaattatgaaacggaaaacaattacgtgt

SEQ ID NO: 9360 - DNA, 2093 bp, Heterodera glycines
  misc_feature (71)..(71): n is a, c, g, or t
  misc_feature (140)..(140): n is a, c, g, or t
  misc_feature (157)..(157): n is a, c, g, or t
  misc_feature (173)..(174): n is a, c, g, or t
  misc_feature (191)..(191): n is a, c, g, or t
  misc_feature (202)..(202): n is a, c, g, or t
  misc_feature (204)..(204): n is a, c, g, or t
  misc_feature (210)..(211): n is a, c, g, or t
  misc_feature (220)..(220): n is a, c, g, or t
  misc_feature (247)..(247): n is a, c, g, or t
  misc_feature (258)..(258): n is a, c, g, or t
  misc_feature (266)..(266): n is a, c, g, or t
  misc_feature (273)..(273): n is a, c, g, or t
  misc_feature (296)..(296): n is a, c, g, or t
  misc_feature (306)..(306): n is a, c, g, or t
  misc_feature (317)..(317): n is a, c, g, or t
  misc_feature (322)..(322): n is a, c, g, or t
  misc_feature (329)..(329): n is a, c, g, or t
  misc_feature (342)..(342): n is a, c, g, or t
  misc_feature (345)..(345): n is a, c, g, or t
gagggaagagagaccgcgaggaacgggagaccagacaggaaagaacacaaaccaccaaggccgagagcggnacccgaaacacaacgcggggaagaacgaaacaagggacgcacaaaaccaacccaaaggacggagcgagnagaacgcgagacgggangcacaaaaccaacgcnncccagcccgaaagcgcncgacgcgaaancncagagnngccgaaacncgcgagcaccgccaacccaaagaagcngacccaccgangaagcgcngagggangggggagaggaagccgacggcanggcggcagcnggcatggcaanggcgnagggggncgccggcgggcgncgngggagcgctcgccgacgcggcggacggcggcgaagcggcggacgaacagccggcgccaccgacgccccggggcgaagacggcgcacagcgcaccaagaaacagcacctaaaaaaaaattcccgaatctttctgaatgggaaaagtcgattggcactgaaaaattgtaagacaacgtgtcaagataattaattggtaaaatttttttttattaatttaatattttaatttttcaatttaatattttagaaattcgcaaatgaattaaaaatttaggcactcaataaattttgataaattctgacatatttttactcagatttaaatatttaaattttttccaattgatattcgcgcattttctcatatccattaatattaaattgtcattgtaattgaaaaactacagtaacacttatgcttaacggggaatgggcagcatgtgactgtaattaagacgattatctgctgatcagcaggaggaagaggagatgtgatgtgagagctcaattaatcaattcttatgcccatttgaatactaattaagtaatcagatttattttatatgcacctgaccaggtgacctaggttcatgtttttgaagcattcacctgtaacctgtgaaaatctgttttctcgatgtttgtttattttaattgaaaaaatgcgtttaaaaaatatattttcattcattagttatttttgtgggattttttgccattaattttgggcttacgacttacgttaaatttaaattgctggaaaagtaaaaatatcgaaaatttcatcaatttttaatccattaatatattgaaaatctcggaattaacgcattttgctgattagcgtctaatttggtactttcaggtttttcaacctcgaccaattccgaattcctaactcaaactctaacagaaattgaacgaaaagttttgatcgaattcgggttagggattcggaacgggtcgaaataggtgtcagaatcataattaacgacccccaaaaactaaagcaactcatttttatgacttgctattttgagaaaaattttgcaaacacaaaagtttaaagatattttaagagggggggggggggggggggggggagatccaacgtggaagtacagaacaggttatagggaagttattcccgaaggattcggtctccctagaaatctgggggcatcgggtcggcgggactgccacgatagaaaaataaagcgattttttcaagtgcgcgaaagtggaactcatacaattatggggagcaaaaatccaaggtatatttaaagtacaggttatagtgaagttattccggaaggagttagtcttttcataaatctggaaagatcggctcaggtaaattgcttagaattttcatatcgaatttacttggattatttctaacaaatagtcatgattggactaagtgatcgaatattattagacattcatatttgctttttgcatgacttttttcgcgctctttttcgaaaaagattttgggaaataaaagcggtccggggatggcgataggcgccgccgacaagagaaattttgaaaatttgagtgtgatttgttaacagattttcaataaaaaaggctggtttttgggattactaggctcaatttgaacggattttctttaaaaaatgataaaaaaaaattaaaaaaattagaatcatatttttgcggaaaggaaagccttgagtatacaaaaagaaaatttaaaaataatttaattttttccc

SEQ ID NO: 9361 - DNA, 3771 bp, Heterodera glycines
tgtgaactagagtgccacgggaccgggaatttttgccaaaaccgggaccaggacttgccgggacctgagaagccgggaccgggacctcgatttttttcgggactgggaaccgggaccaaccgggaaattttaaaaattcaaaaaatttaaaaaaatttaaatttatttcaagtaaaaataatacaaattaattttttcttttgctatttatttaataaaatccaaaagttaaagctaagttaaattaattaaaattttcaaatcgaatttacttcaattatttcaaacaattaatcatttttggaccaaatgatcgaatattaataggaattcagatttgcttttaacatcacttttttcgacgcggttttccaaaaacctttgggaaataaaagcggtccggcagtgccgataggcgccgccggggaaaattttgaaaatttgagcgagatttgttaacagatttttaacaaaaaaggctggtttttgggattactaggctcaatttgtacggattttctttaaaaaatgattaaatacaattaaaaaaattaagaatcatattttgtcgataggaaagccatgagtatacaaaaagaaaattcaaaatattttcattttttccctttaactcaattcttcatcactaatttttcactcagacccccattcttaccagtgcttgtttttcccggttgccctaccgggaccgggacctgagcttttcaaaatccgggacctcggatgaccgggaattcccggcccggtcccgctctactctattcatatgtaatgctaaggatagggtagcggctgtctagctgcagctgaaattccctatcctcatcgaggtgaggatagcgacagaaatgtcaattaaaatcacaaaaataagttaataaattgaaaaattgaactaaaatttttttaataactctaaaaaaaatttttatgatgattgaacaaaaatcgaaagttcgaaattttcgacctttcgagttcgggttaggaattggttgaaataaatgacagattcatgatcagcgaccccaaaaaccttcaggaataagtttttacggccttttatgacaaaaaattttgctaaccaaatttgacttggaaaatttctcttgggcgatagaaaagaaaaaaagatgtgtgacgagagagtagctgcggatggtatctgcagataaaaaaatcgtcagctacagatagttagcgctagcattatgaaatgaatacggattttatctgcagctaccctatccgcatatccttagctgcagataactatccttagcattatgaataccagcaagagaaaattttatgcaaaatttcaaacatttctgaatgtgttaagcgaagaaaaaaaacctgcatacaaaaagtaaatcaaaagcatttttataattaatcagaagttttagctgacgtaataattttaaaaaatttaggaaaaaagtaaaaactaaatatgtatcaataatgattaaaaaacattattaattatggaacgaaagggacagaaaatgattatgacgacgaatggtgatgggtgtgatgatcagcagcagtgcataagtcatttttattatatgtttttgtttgtttgtttgtgtgtgacgtcattaagaatttaaaaaaatggttgtacaatttcaaatcggtttctaccagggcccagggctaaaaatgcagcagaaaaaaagttaaaaactaaaaatccgggccctattcataataaatggaaaaatgaccaattggtacaaaatctgttaaaataaattatagctaatttttttgaaagaaaattaattaaaagtaaaagaaatttaaacattatgaatttcgtaaagtttttcacctttgaaatcactccttctgtgaaaaaatttttttatattggagatcgaaccccattttaggggaggggcacaaatccgacactaaagaataaaaaaataattaacaattcattaaaaaaatttatttgcgtgagaaaatacgtttaattgcataagcggaaggttttgtatataaaattcaaagatgagaatttcaaattttgaagagcacacatttcgccgaaaaataaaaatcgatgacattttttgaggggggggggggagaagaataagttgcattttgacaaatggacaaatggggaagaattaatttttatgtgtttgtggtcacattagttgtaagtttagaaattttttattttggaataaatttttttttattttttacgctcgaaaaaaagttttttttattgaatttgtacgattgatgctcaaaaaattttgcttttgaataattttaaaagaaaactgaattttttctaataatttttagttttataaaattttatggctgcggccattggcatcgcaggcccataaattctttgttttttttaaatatgcccaacaattccaaaattagagatgcttacatatctcgaactaagagagcagaatttacacgaatattcgtggcttttcagctgatgatgagtgatgagatgatgctctcggtgggcttcttccatttgccatggatttggtcgcccgcttttccccgcggggcgccggaggcggaagagagtgacgacccggcggttggcacaatttctgcgctttctctctcgctctttttttcttattgacctttaatgaacacactctctctctctctctcgctccctccctctgtccctgagctttttgtatatatccactctcttgttccatgtttttctcggcctctttcacacttgctctctctctctctctctctctcatttctctctctctctctcatttctttctctctctctctcttatctctctctcactctctctcatttctctctttcctctcaaattgcattttcgtgtatactttttttcgctcctttctcttatgctctctttcttcatattagaaaacgaagaaaaacaacgaaatgagcagaataaaagagaaattaatgaaaaatattataaaataaaaagagaaaattaagcaaaaaggaagaaaatacccaaaaaattgaataaaattgaaagaaaaataagaagaaaattgggtacaaatcgcaaatatattcaaaaatggataaaagaatttgatcttcaaaaaaataaatgccataaagcaaaaattgatgaagaaaaatatgaaattgtacaaaaatttattgcaatgataaataaatttaagcaaaaaaagaaaatattcaagcgaagaatgaaacaaattatgacgaaatttgtaagaaaatcgaacaattgaaaattggaagaaataatttgggacgactaactaattatgtaaacttagaatttaaatagtctatgaaattttaattgtctctattgtttttttaaaatgtgtataagttatccacttatagatttctcattaaaaaaagttaataaagcattccacgataagaggaagaggaagaggaggaagaagaagaagatatttgaggcgtggtgcgacatttgaggacctgacttttgaggagccgacttttgaggacccgacttttgaggattttcccgacatttgatgacccgacttttggggacccgacatttgaggacccgacttttgaggacccgacttttgaggacccgacttttgaggattttcccgacatttgaggacccgacttttggggacccgacatttgaggaccctacatttgaggacccgacatttaaggaccctacatttgaggaccctacattt

SEQ ID NO: 9362 - DNA, 992 bp, Heterodera glycines
tttagttaatattttaggcttttttgccactaaaaatcctattctattcattcttataatttccgtattcagttattaccacaactttaaaaaattcaaatgtcgagcaatttgttggaacggttgaagctgatgttgagcacgggcgatggggcggacgttcactttttggttgggaaggaaaatgaggtgaattgagaccacaaaagttgactaatccaaagttaccagcaggtccataaccagcagcagatgggaggaagtctgaaatttttttttgatgggttttaacgttttttccgttgttcatccagaaaaaaaaaattccatccaatacatatattgtttttttatacgtttaatatgtaaaaagtgaaaacccatcaaaaaaaatttttttgacgaaaaatcatttgatgaaaaatcataatttagatgatttatatgataatatgatgtcagattcattatcagcgctctcgataacccccgaggtttctcagaatcgcaaaaaaatgagcttttttgcctttttatggcaccaatgattgaacaattaccaaatgaaaaactgttccttccatttatatttcacttcgacggcgccacgtttggaccgaggaggaactgcagcgacagcgccggtcgaatgcctttttacggaaacagctcaaggcccagcgcgaccggtcgacaagccttgagcgatcggcttcggtatgtcgccagcgcaaggcactttccgacgtgaccaacaaccatctcctcccccactacaaaattcgtacatcggctctccactcgtccacattgctttgacgaatgttgtaccgccgagtttccatcttttgcatggtgaacaaagcgaattaaaaaacgattcaaaattttcaggcaatggtcagcgcactattgacgccatttgttcggaagcgatgctcgcggaaagggggacgttgttcggaaacgactgtctgatgttcgcgtgcgac

SEQ ID NO: 9363 - DNA, 1144 bp, Heterodera glycines
gcagggacggtcccaggatttcggcttgggggggggggtacccacccacgggcaacgaccttttttctttttttttgcttttcaaaccacttttttgcggccgtttttccaaaaaactcttggggaacatgtgatccaccgaaaatttttttttgtgatttttatgcgtcttgttaacagattttgtccaaaaaatgacaaattttgcgattttgaaccatttttagcagattttcatcaaaaattgtgcatttttgaaaaatttagtaaaattttttctgctttttttaaaggaggtctgattatttggttatttttttacaaagtaatttattcttaaatattgacaaacaagactcgagaatcgtgtaaaccaatgaattcatttttccccaagtgccttcctgcgttctgacaatggaagaactgctcgccgtcttccaattccattgccacccgaatctccgcggtgcgccaggacaatacccaatggcatttccgtgccatggacgcatttccgatcaaagagaagggacattttcgatggacattgagaaattgtcggaatttgcgcgagaggaagtgaacagttgtcgattaagcgaacacttttacacaaaaggattgccatggaaaatttgggcagaaataaggacgaagaaaaacagcactgaaaaatatctgggcgttttcctatggtgcattgctcaaataattggtggaacaaaccaatttaaatttgaaatattttactttatgattaagatgaaaattggagttgcaaatgttcgtcaactcttcgaattgtttcacaaaagagcggaacggaagatgtaacgagaaaatatgaccatattttaaacaacaaagtgaacagatggggatttccatttttcattacttttacggtcagtggcagtaaaaatattccttttcttcgcttaataaaattgcgaaattaagcaattgatggacctggacaaaggaatttacgacaaaaatgaggacaaagtgacattggccgttaatattaaagtggaagaagaaaagggacaaaaaatgcctgaagaaataagcgcgcattcacccacccactcatttttctgtgataatatataaatatcgaattaaacagtttcactga

SEQ ID NO: 9364 - DNA, 3897 bp, Heterodera glycines
  misc_feature (3893)..(3893): n is a, c, g, or t
aattccattgccacccgaatctacgcgatacgcctggacagtacccaatggcatttccttgccatggacgcatttccgatcaaagagaagggacattttcgatggacattgagaaattgtcggaatttgcgcgagaggaagtgaacagcaggcgattaagcaaacacttttacacaaaaggattgccatggaaaatttgggcacaaataaggacgaagaaaaacagcactgaaaaatatctgggcgttttcctatggtgcattgctcaaataattggtggaacaaaccaatttaaatttgaaatattttactttatgattaagatgaaaattggagttgcaaatgttcgtcaactcttcgaattgtttcacaaaagagcggaacggaagatgtaacgagaaaatatgaccatattttaaacaacaaagtgaacagatggggatttccatttttcattacttttacggtcagtggcagtaaaaatattccttttcttcgcttaataaaattgcgaaattaagcaattgatggacctggacaaaggaatttacgacaaaaatgaggacaaagtgacattggccgttaatattaaagtggaagaagaaaaagggacaaaaaatgcctgaagaaataagcgctcattcacccacccactcattttctgttgataatatataaatatcgaattaaacagtttcactgatccaagacaattaattcatgggttctttctttggtttgttgggaaacaaaagcaaaggcctcacttttacactttcgcttaattaatattagggttggaaatgtcggggtcagcaaggtcggggtcggggttgaccaaattgttaggtttttcaatttttctccttataccatatagtcaaaaatctttatattattttagcataaaattttttattattcataataataattttatgtgtttttttatttctttttatcataaatatttttgtataaaataattaaatatgtataggcatttttatggccaatttccagtgaaaaactgtaaaaaatagtcaaattttcaaattttccagcagaccattgacaattcaacggttgggcaagataaagaacattggtcgcaaattttctcaagctctgccggattttctttattttattttatttttcatttgcattacccatcgacaggatggggattcgaaaatttcatttcctttgcggtgaatgccaattcaaataaatgagcaattgacattcacaataaattactgaattactgaaaaaataactaaataattgaattaatggatccgagcaaaggcttttaccttttatgcgtggccacaaaacaaggtgaaaatcaaatgctaattaataataattataattaattgccattaagacaaaaattggagttgcatggcaatttttcgaattgtctcgcaaaagtgcgatgtggcggattttagtttagtattagatgaagatgtttttgacaataaaacaaacagctgaggatacaattttatttcattaccagtgaaataagcaattcgtaactttcagcgcatttggaatcagatttttaaacgcttttttttcgccgcattttccaaaaaacgtttggtgaatgggcgaggggagtatgtacagtacacctctttccaattttttaaaaaacgccttttccaagggccaactggaacagaaattcgtcaagaacattcaaaaagttaaaagcaagtttactgtctaattgcgtacagcaacaaaatgccgaagtcatcttttctgtttcttagagtccggaaacagagttatttagaaaatattattattttcttgcaatggaattaactctggctaaagcagtcgtaaatttgtctaattttggataaatttttaaatgttttttttgtttgaataaaatccccaaatgtcgggtccccaaatgtcgggtcccctaagtgtcgtgtaaatccccaaaagtcgcaccacgacctaagcatccgcaacctagtataaaaatttttttgccgatttatttatttactatattttctggccaattctttttccaaaaaagtcataagcattttagaacatttgccaaaaagccaataaagagtcctttctagagaaaggcaaagaaatgttgtatcaacatatgagtaatacccaactcgtactgtatccttactcatactgtgcaccaacagaatttatctttcttaaatcgcagtacaattgggtaagtaagcgagtgggggcggtagagttggccaagtgtacgagttgggttcatcccaacatatgctatttaatatttatgttaacggatactgtactgtaatgatcattctgtgttatgggacactcatcagagaattgacataactttgccaaaaaaaattgaaattgattatttttctcaaaattactttcaaaattccaattttcctcgtcgatgttaaaaaatggctttaaatcactattaaattggtcatttttgtacaaaatctttttgaaaagccgaaaaagcggtttgaaaagcaaaaacatttttaatgttgttcggtaatcttatggatttacatttattattcagttgttcaaatcattcgaatgtttaatttgttaacaaaaaaaaaacagaaaagcctccgacgatatttttttggcattaattgcttaaatgccatttgttacgtttatttttaggtggtaaataataaatgcacaattaattgagacaaataatatttaggtaaggggccctttttgtgtgtttttcatcgtcgtaagatgctcatttaatatgtacgaatagcgaataaatatttgccaatgacgcacaaaacgtaaattttatattatttggcactcctcacaactaaggaaggacacacaaatgaattcaacaaattttgataaatgttctcaaatgattattattaatattattattttttttagaaaattttgtactcagattattattgtttttatgaattttttatttcaaaattcttatttcaataaccatgagctggattttggatttttatcaattttttcatttaaaatttttttatggaatacgaaaattattattatttttttattttttgaaatacggtcaacttaaattttgaataatttggtgagaattcagaatactttatttcgcgatatttattgtatacgagaaatttcactttgatatgactaaagcttaatttagaaacacacatttaaatgccggacaatttattaaaggatgatttattatctgctgattttgtaagtgatatttattaaaattaagtttggtattacaaaatgatttatcattaagttggccaattatttcaatcaaagtgtaaatgcatccattaaagtgccattattggtgactaatggcatcatttcattttgctgcttggttggcattgtcctcaacgcatcgcttgtttatgtaaccgcaaaaacaccgtatgaatgaatttattggtttttattttaataaaatttattttctatattttaaaattataatttataatttcaagagaaaataatgcagaatggagttccttaattaaatagatttttaaaaatcgaggacattatgtcaaattgacgttttttcacgattcataatcctggtccattttcaaaaaattatccggctccctgctctattccaatcttttttatcaatattaataaaattcttcaaatcagagcctttaacatattattaagaatttaaaaatattttcaaaatttttccgtgtggtaaattttgaactaaaaactaacagaaggtaccaaaggccgaaaaaataaaatctatttctgtaattttaaactttctttttttataagcaatttgnttaa

SEQ ID NO: 9365 - DNA, 1551 bp, Heterodera glycines
tttttattatttttaaatttgaaatattattagacaacgatgaattatttgcccctagaatatttaattcttgtgattcctgacatgctctatttctgcgttgctttgtaaaataatttcttgatttttgtgctatttttaaaatcaatttatttaattaattttttaatttaaaattatatttgccatttaaaatttttttaaattatctaaaaattatatttgaatataagtgatgaaaaataaatttactaaataattaattattttttcagctaaattattattgttaagtaaaatcatattattattttttctgttggatttaatttagagttaaatattttttcaaaattagcaggatatattaaattatatttttgtttccaaattatcaaaaaaggttgtttgcaagcatcaatttaataggtattttgaaaattcaatattcattttgataaatttttttgacttttttgattggtttttctttaaaattatgtaagaattcgagtcaatttgtagatatcgtaaaaaaattttttttaatttattgccaattaattatttaatattttatttttcgtgagattttctttctttttttcaaaatgaattatctttatgggggggggggggggggtccggcggtgccaataggcgccgccgggaaaatttttaatttttaatgcgatttgttaacagattttatccaataaatgactaaattttgccctttgaagccaattctttaagaaaaattaagagtttttcggggtaaaatttggcgaaatgttcttatttttttttataaaaatcaacagttttgtgctaagaatcctattcttaccagtgcaaatttttaccggctgtaccggtataattatttttgaaaaaaacagtaccggtaccgttaccaaagaatccggtaattaccggcgataccgataccagtaccgctctaattactctattttaaaacaataaataatagaaattaatagattaataatgtctaatattcttgcttatgcattttcttttgttttttgtgtatccatatttatatttattatattttttgaatattttttattccatgtgttttaaattcattttaatttatttgttttaccttttgctttttatgtatcaaaaataaataaataaattttaatagaataattgtaatttttaatcaattttattttattagttaaataatttcaaaattagttatattttaagaattgattttattttattactattgcttattatgcacattttttccagtttactcattcacccattttgatatttattattattattttgtttatataatctgaaatatggctcattaaaaagcccaaaattctcttacgaaaattcaaatgaaaaaaaaaaccgtaaatatttaaagtccacattcttaaaaaatcattcctcaaccttatgaaaaataaataacttaagcaattaaagtcttcaacatttgtcaaagaaatatataaagattgtccataaatgagcttttatacttaaaca

SEQ ID NO: 9366 - DNA, 1804 bp, Heterodera glycines
aaaacaaaaacatcaaatatttgagaaaaattttatgattttcaaaaaattaataagtttataaggagaaataatttcccaataatataaaaatttgtggtgggaataaaaaacttttaattatttaaagtgttttattaaataattttctttcagtcaatttttggccccatttgtgattattatgcattgatattaagtaatcgaatcgatttttccctttttatttaattatttttttaaattgtattaatctttattttaataaacattatagtatagtacatgtttattaaaattgcatttttattaaataattgaaaccttatttaaatatttatatttagattcaaattacaaaactatatttaatggtaggatcgtatttatccttctccttgtcctgtaatgcgagcttttaattcggttctttcggcaaactcctagaactgagcggggccgggaattttgacaaaaaccaggaccgggacttaccgggccagaaaagtagggaaagtgtgaaaaacatttaaaaataaaatacattgaagggagccgaactgtcaaaaaaagcaatcaatcattttcacaccttgctacgcaagcaaatcttataacctcatatattcttatatttcaacgaacacaaaaaatatttcgtctaattttttaaagtccaagtatatatatatatatcaggggtgggacaactctcgcctctcgtctctcgcctctcgccaactctcgccatttttggtactctcgcctctcgtctctcgcctctcgttttttgtgacgagaggcgagagttgaaaatacacccctaaagattaaacttttgagcagccagaaaaattttcaaatttacgcgaaaaaaaaatcttaaatctctttctttccttccttaatgttttctctatttttggatagctccaattcaaatatggtctgctggctaaaccttctgcctttcattatttttctctttggttcaattccccaacggtacagaatttttttaataatttctttaaattattttcaattgaaattttaattaataaaaaatatttcaatttaaaaattattattttttctttttttaaacagcctaaaactgcaaatttaaccaaaactttgataattttttgacaagttctgttaatatattacactcaaaattttagaatttttccggcggcgcctatcggcggtgcagattcggcaccgccggaccccgcacccaatgttccaaaaaatttttttttggaaaaacagcgccacaaaaaaagcgacttaaaaacaaaaaattaaaaaaacaagttttggtcattttttgaataaaatctgttaacaaatccgaagacaattttcaaaattttttcggcggcgcctaccggcaccgcccgaccccaactgtccccgaagttttaaaaaacgcaccgcaaaaaaaaaggtggaaaaatggacaaataataaagtttgtttctaaaataaatatatttcatgaaaatattttttaattttcatgaaaaaattttaaagatttttgtttggatttttcatgacttggactcggtttaaaaactaggactcagacccggctttctgtacccggaaaaacactgacccggtatttgcccaaatacccagggccatacccctaatttaatataccaacttgaggcttgttaaaataagaataaagcttcagaaaacctcgaaaaattctcgcctctcttcctctcgcctctcgcctactctcatgttttttggggaatttctcctctcggccaaactctcg

SEQ ID NO: 9367 - DNA, 1628 bp, Heterodera glycines
ggtaaagtaaaaataataaaaaatttgcattaaactcagcgacgaatacaaattaaaaaaagaagttacattaaaaaatgtaattaaataaaatttttgttttaaaaaatcattttaaaaaatatacatgattttagtcagttttcacctcaaagctctacatgttgtgcgttggaaattggtgtatttaaagctaaacatgaattaagaacctttattaaaaaaccggttcagtatccgtaatttatgatgtcttaaagttaattttataacgatgcgtttaaattactttgtatataatttatcttcttcactcatagcctttaaataaacaaaatgcaattaaaatttttaaatagaaatcccttaataactttagcgtccaatttgtacactcacgtgggtcagcgcatttgaaagagcagaaagagcaccacaaaaatttagaaaagacgcttctaccaaatgctaagacaaatttgtcatttttataaaaaaaattgtttttatttaataactcataataactcttcatacattaattgtaacccagctggtactgcgtgatggaatagtgcctatagcctgagctagagcttttataactatataggtcatttattgacgcctaaattgaaccacagttaaaatttaacactttctagatttttaattaaattttttggttaaaataaatgtgagaattttaatttttaccaaaccggtttttaatgcttacacatgcagtcattttttccctttggttttacatgttgcttaaatcgctattttaaaatactaaaatattttaaacattatgttttggagataaattttaattgtattagcttaaaattttttgttattaaaaaatttcttttaaacctaatgaagcactagtcttgctcgctataactttgttttataaattatttaataaatgaatttggaaataattttaagttttcaattgtcaatacaaaaattttttatgaattataattatgatggcgctttattctcggcgacggccaaatgtatcggcgttgccgccagtgagtttcggcgaaatcattaacaatcaaatggctttgtttttgatttcaaattaataaaaattaaaaaataatttcatattttattattacattttacttaagtatatactaatgttagtgcttcataaaaaaattatagaattttgataaatcaattttatttatttttttctaccgctttaacttgtcttaattctattaaaattagtaacacaatttttttgatgataattttaaacaatttcatagaaatatttttatattttttccataaaacattaccaaaaatttaatacgcttacttaattacttaaatttttgttttagcatttcataaaaacagccatttttgatattttttatataaaacattaacttttgagtattttccataaaacacattcattaatttgttttttaattaaactaatttaattttttcctctgtacatattcgaaaagcatctttttaattattatattttaacttgttttaataaaatgattttgcatttgttcattcttaacatttgcaaatcttaaacaaaattggtcaatattattacttta

SEQ ID NO: 9368 - DNA, 1733 bp, Heterodera glycines
  misc_feature (493)..(493): n is a, c, g, or t
gcaaaatatgtaaataaaaatgtataaaaaatgctaaaatatgtatgaaaatatttacaaaaacccagaaatatgtacaatatgtaaataaaattttaaaatggttatttttcgaaaaaatttcttcgtaaagggtgaaataggcacaaaatgccataaaaatgaaaccaaaataggtttagaacccaccttttagtattttaaaatatcttaggaggcattttcaaaaaaataaataaatttttcacaaaaaatttctaaaaattctaaaaatcttcaaatatgcaaaaaaataaaaataaaaatatgtatgaaaaattgcgaaatatgtacgaaaaattcaaaatatgtagaaaaatccgaaaatatgtaaataaaagtcccaacttttgttcgcaaacacaaaaaagaaagtgtttttctactaattaggctatggagaataaaaaaatatgtatttacataaaaaaacaacccctaataatcactgatncacctccgatttgttctgactctctctgtcctcgtcttcgttcgatttttgccgtttctccgccatttttttctcaaaatatttttcggcacttttttcgtcactttcccaatcgctgctgttctgctgctgctcttcttgcccaatttgttctacattttcaatctcaactgctgctgatgctaattgtccaccattttttgtgccatttcatcaaaagtgccgttttttgcttttccattttctttttccgtctccgaattgctgctgctgctgccatttttttcttcacttttcgcttcgattagcacaattcgcatttggggaggaagaggacagcccaaaaggttcgggtcaatgtgaagaagtcggaacagttcgacaattgtttgctggtcgaacaatttgcacaaacccttcatggcatttgtgccatcggccgaacggagcactgaaaaaatatttttggaactgcaaacggacagtgactaatgaagcaaacggtgctaggacgaagtgacaaaagtatcaatgacagtaatagttaaatttaattattatatgtccataaaatatgacaaatttaattcattggtaactttttttcagaatataatttttcctaatttttttgttacatttttttgtaaatttttgctagattttaaaaacattattatatattagaggattcgtagagctagagctttcttctaataccaagattgattaatttgactaagtctaagctaattatgatttatgatttagaaaaaaaaaaattaaaataataattaaatttaaatattaaggtcattgatacttttgtcaattttttgaatataactttttttcattgtcaataaatccaacaatcttggtatcagttgaaggcttaatatccaagctgtttctaagctattgctttcaaaaaagttataaaatgaaaaaagtcgaaatttttaaagttttttctttatccattttttgcatgcttgaacatctttgtgtttttgtaaggctaataaagtatttgaacggctttcgaatgataccaatattaaaacaaaaaattatagcccaaaaatttggactggcgccgaaacgacccgcccctaatttatgttccccatttttggaattataaatcgtcggtattatttgacaaaaataatgattttaaaaatgggaaaattaatgtttttcatgcctttcaattggatccggatatttttatttt

SEQ ID NO: 9369 - DNA, 1916 bp, Heterodera glycines
  misc_feature (23)..(23): n is a, c, g, or t
aaatggtttctccctgcgcttcnctcagtccgacaaattccctcaggtgcaattgcccatccattgccaattttcttccaacatttgcttcggcaggcccatcattttttggcctccttttgccacaaattcgctccattttttccaaaatgcttttgctcctcctccccccttcgtctcccctcggcacaatttccaacaaatttttcgtgtaaaaaaacatttttttcaaaaatttctccgcccgtttcgtctcctcctcgtccccatcaagcaaagggtcgtaaatgtgttcctccacataaattcgcattttgtcgtaaaccgccgtgccaaagccgcgctcggccatcctccgctttgcccatcgcataaacactgccaaatcggcgcccaattttccggcacgaaaccattcgatgtcaagcgcaagaaccaaatcatagtggctcgagaggcgattatcgttgaggaaaactgagaaatgagaaaagggccaattaaaaattaattgccggtaaatatcggtcatagtgcccaaacacaaaattgctcaaaaacggtcagaatcgatgtaaaaaggttcgaattgtttggcactccaattcggcactttctcagcctgaaaaagggcaagcgcgcccctaattcaatttttccaaccatttcgaacatttttacatcgattctgagtgttttgtgcaattttgagttttgaccctatgaccgatattttcctaattgccttttaatttgatcaaaattgattaatttgtatttaaaagatcccttaattaattaatttctttgattttacatttaaatttgtttaattattttgacttctcttcccaccgtctctttcataaaatctgttcttcaattggccatgttcgtcctccaattcgtccaatatttctttactgccgcccatcagttttaacagccgcgttttcgccccgggaaaatttagcattctgagaaatatttccgaagaagttcccttaattgagatttttaatgcattgaatggacaaaaaaaattaaatgtcaaaatggtagcggaatggacggggtcggaggtattcacgacggaagagtctgtccaactgtgcccaaaaaggtaatgcaaggaagaagctgtctgggcgtttataactcggaaacgagggttgctaaggccaataaaataaagagcggatgtgcctcggtagctcaatgaaagatttgcccgtgctgagacgatgcgaaaaaaacttaatgattgataaaataattaaattaattaatgaattgatgtccatgaatttaataatacgattaatattttaaatataaatttaaaaagaataatataaaaagtcaacatttgtataagggattatattttgtaaattcaattttaaccttgtcgaatctgcttgttaggccttaagcaagccgtgtaaaccatgatttattcaattctctaatcttcctgattaaagaataacctcgaagcaaataaaattttattcatttttaaaaattttagaaattataattaaaagtataatatttatatgaatttagttatcgcattattaaatttatttatttattttatcaatcattgattttttcgcatcgacctagcaccgattgcccaaggaatgggtggacgagtgggttcgatccaacccgagtcgaccgattttgcggtcgatcacatttctgttgccgttcccttcccatgccctctactactatcggtgtgccatgccaacatttttcgagatgatttcgttgatggaaatgacaattattttgctgaacacggtccgcttgaactggtcgagtgtgtccgcgcggcgccgttcgtccgcgcattcctccgccttcgcctgcttcttcaccgcttgtccaccgatgcattt

SEQ ID NO: 9370 - DNA, 1057 bp, Heterodera glycines
aaaaataaaaataccaaaagaagggcatatgccacttacactttctggtggaaatgaggtcaaatgtgaagtattgataaaagaaaacaaactgaagaaaacattgtgaaatttgattggaaagtataaagtcagatagcagtgaaataagacaattgaatttggagaaaaatatagtcagacctccaacgaaaagaaaatttttttttttttttttgaggaaaaattttgagagaaattagaagtactggaacaaatgtattttttttatttgaggaaatgtttggaggtctgaaagaactatttattgaaaagatgagggtattgttctttgagtgattgaatttggtgagaaattttgtcggttggtggcaatgattttaatgcttcataacaaacgatgattgtttggtcaaaaacttccggcggtttggacatgtcttcgctggcctccttctggtttggtgcaacaatgggagtctggtcattcgtcgtttttgggagctgggttggaggtgccggtggagctgggttttgttgacgttttcggagacgcgcttcgtattcctctttgagttgttctttggacagcgccggacggacgaacagacggttcaggttctgttgggaacggagccgaacacgctcgcgcttccatcctccgagtgccacatgttggtgtgtgggcgttggcatgaccaccttgagcgggcgtggtgttgttcgctgcgggtcgtatcgtccgagtcgaaagacggccgttggttgggcctaaacttcaagatggtccagtatttttgtgatggcttccctgtcttcctgaacacgctccgatgggcggatggcattgctttccgggaggccaatgaagaccagggtgcgttggcgttcttgctcttcgagtgtggcagtgttttggtccaggtccagtgcaggtggcattgcacgtttggcgcgaggtggagtgatgtttgatgcgttggttcgcttcatgtcgattaattaggaaagaaaatttgttgttttttttgcgatcttaattggactatcactagtc

SEQ ID NO: 9371 - DNA, 5497 bp, Heterodera glycines
gtgctgataggcgccgccgggtaaattttgtaatttttatgcgatttgttaacagattttgtccaaaaatgaccaaattttgccccaaatcttatattttcttgataaaatatttaaattctgccataaaatttcaaaattatgaatatatttaagaaataagaacaaagtaagaacaatagcccgaaatcagaacatttcttacaaataagaacatttttattttgtaagatttggaccctccaaatcagaacatttcttataaataagaacagatccgagccctggtttaaatacacgaaaatggtctgaatatcatcagtgcttcagtaaaaggtcatttaaaccattcttagactaaaaatggaaatcgtaatttttgaattttcgactttttgttcgaactcgggcccgggatttggaattggtcgaaaagaatgtcatattcgtgatcagcgaccctcaaaaccccataaaacgtgttttcatggcttattagaagaaaaattttttattccaaaagggggggggcaccagcttcacaattacccaatttgcaaataatggaatgaatttaaaaaataataaaataaacaactcacctcattgaagaaaaagttcaccgttttgggattcagcttaaaagacagcgttttcagaaaggaaatgaaataagcaattatttcttcgtttgcaaaatcaaaagtatgtgtgattatcagctgaaataagataacatttcattatgaattttgacaaaacattaacaaatgccttacattcactgtgttattgctcagaagaaaatctaaaattgtttttttaggaaaggaatttttaaaataaataaataacttacaaagtgatgtttcgtttctgatgttctcaaaaaggatgttcagtgtctgcagcagttgcacatttatgtaaggcgtggcactgctctgccgcataatgcgcaaaaagtgcgaaaacatttgacgttcgaggaaaaaactgaaaatgccaaatcgaaaaatcgctcaaaatgggaaccaactcaaagaccgtcccatcgttttggtcgccccaaatcaacacttctgtgatcgccctcaaagcctcgacaacaagtgcactgttcgcttctgttattttgtcattcttcatcaaaacgccgtgcaaatacctaacaattgtttagaaataaggcaaaaattattccgacctgagatattccaatgaatggggatttcttggcttccataatgccgaagaaccagtgaattttttaaacattataacaagttaaggtgacagtttcatgacaagggcaagcgaagctttctttacaaggtaataagcaaaggctcaaagctgacttaatgagcagaatttgaatcaaaatatggcattttgttgggtcggggtcacttcggcgcggaccatttcggcgccgcaaattttgaaatgctataacttttttatttgccagttagctttagccaatctggcatcatttgaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgagctatcgaatgataacaaaaatttttaatttggttgatcaggaaaaaagttgttagcaacggcgccgaaaagtcgccgaagtgggcggttcccattttgttagccatcagaataatttttaaaatttttttcaatttttttttaatttaaatttaaatttttaaacatttttttgcaattttttcagtgatggaagattctcttcttgatgctgagacatttttgtacaaatgttctcatcataatgttgcagcagattctattgaatttcatggcgtaaaaacaacacgaactgatgcattgaagaaggaagtggccgaattatttcgtgcaaataatctgtatgggtttttttctcaattaaattaaattcttccctttttagccaccaactgatacaaaattctggcaaagctgcaattcatatgatggtgggtcatccatccccagatattcgtgtgtaattttacttttgtatggcctcgcaggagatgggtcttttcgaggaatgtcaagcaatgattgacattgcgcctgggattgacaacggagagcagaaatacgtcggtcagttaaattctcaatttttggatgcatcaggccaattcagttaagttcttcgccaaagagctaaagaacgcgttcaaaatgaacataaaaatggaaatgcaaacgtcgggcgaaacggacgctggtctaattgcgaagaaagcagtaaattcaacacgaaatgaccacccaaacgtggtttttttttaacgtcagaacatctttggtcggggcgagacggcggaattgactttttcgaagggattacgaaaggacgggggctacagctttggattttcgggtttggtctggacagaattttgaattgctttggctttctttccgtccatttagcactgaagccactcctcggctggcagcgatatgagaatattggcgcccaaattaacaaacgatcagactttctgaaatggaacaaagctgacacacacgaaagtgctgcttctttcacgtttaacaagtactttccggagtatgcacttatgtcttcattcggcttcaactcggtaaagcgctgaggtcgaatggcgcggggttaattcatcagtttaattttcgtaaaattttctttcagaattggcgctcttttttggctcgcagtgacacgcctttcccaattcgagaacactccggacacacaaccaaattctcgtttgattacactcttttgtcggatggacgagaccggcccattttgccaacgaaagggtcgttgttcaaactgcgggcggagtacgcgccgggagcagtcggcgattcggcatttttgaagggcattttcgattttcaggtgcagtaagtaacccacttctcctgatttccccttactttcgttcctttttcagactgccgcccccctccccggtggccttttctgcggcgcgtcgtttcgcctcggcgttgtccatccggtggccaaccgcggcattcatttgctcgaccgcctttacctcggaggaccgtttgatgtgcgtgggtacgaactgaattcaatcggagcgacaaaggaaagtggcgcacttggagggtcgacactgctcgtaagtgaaagacgaaatgcaatttcaatgtgggttaagcattatttgttttgggattttgattgcgttttagcaaatattttgcattttaagagcaccgctgttcatctttatgctccgctgattcccaaggatatggtaggtgaagtttctttttcttaattcattcttcataaaaaagggggaggagggtcgccggcgaaggggaaaagagaagaattttcaatttttgacacagaagagtttcaggtttcatttaaaattcgcggcgcatatgttgtcgattaattttggctctattgaagtttacacaaccataaaataatttgacagtttaatgcaccattttttctaaaaacacccaattaacatttttgatattatttgatagcccaagtcctctatttcagttttttgctcatttcttcgtcaccgctggctctctgtcgccaatgcgctccaaacaccgactttatgacctttgggagttgcagcgcgtttccgccggccttgggctggctgtgaatctcatgaacatggtcaggctggagttgaactacacttttccgctccgaaaactccctggcgatgtttgctttcccggcattcaaatcggtgccggactgaatttcatgtaaccagaaaactgcaagagatttgttttaggctcaaaaaacaaaaaactgaatttttttacaaaattgcaaatgttttgttcacttttctttttgtttcatttgcatttggttttgtttttattgataaacaatttataattcaaaaaaataaaaagtttaaaataggtaattcttaaatttactttaaaaatcccttttcacttttacatcgttttattttgtttggattttacgatggctgccattcgaaaaacactaaattttgtgagtggaaataaacagaagttgcttgagcttcgtcttctgctcggagacgaatttgaggttggatggcaatggatagtaatcatttgctttctaatcacaaatccatggcatagattgctccgttggacattgaccttcccgaactgcaaggtgaccctgcggacataaccaaggcaaagtgtgccaaagcggtggacgccaccggtggcactttgaaagtaatcgttgaggacacggcactctgtttcaacgcattggacggactgccgggcccatacgtaaggaaagtgggctcaaatgtttatcagcgacgactttaggtcaaatggtttctcgcgaagttaaagccggagggattgcatcggttgttgggtgagcggaattgaaaatcaaattttaattgttttttttgtaatttagctggctacaacgacaagtcagcttattctctgtgcactgtggcctattcagagggaaaagacaagcccatccatctttttactgggacaacaaatggacaaattgttgagccgcgagggtcgcgcgagttcggatgggacccatgcttccaagtgaattaatgcttattcaaattaatggtttttatattcatcctttagcccgatggatttcaaaaaacatttgcagaaatgaccaaggaagaaaagaatcaaatatcgcacagagcgatcgcattagggaaattgagagaatttttgcaaaatgagaaataaaataatttaaaaaattttattgtttgatatataagaaaataaatattgttaagtgaaatgctaaaaaagagaaccagtttggttcaatgcgaataatttggctaaagaacggttgtgaagggttagtctcgtcatcagagaattgatgtcctctaacttattcgacatcgcttcgttttgatcatttttgggcgattcttgctttgttatttcgtccgtttgggttgattcggaagtcaattggggagcaaaacagcgactgtctgctcatgttcaatttcctcaaatttaatttaaaaatggtaagacttggactcagcccacccgaaaaaatgacatgaatttgttataaaactgcttgatattgaatattattcacaaaaatgtatgaaaaagtggcgatatatagtgaaaattttttttcatcaacatttgaaatttttcaaaaaacgtcatttttgagtgtaatatctcttaacagccgacaataattggtcaaacgcgtcaaaaccattcttttttacctttctgcgccattgatactctaccaacgtgtcagcaaa

SEQ ID NO: 9372 - DNA, 1546 bp, Heterodera glycines
  misc_feature (17)..(17): n is a, c, g, or t
  misc_feature (23)..(23): n is a, c, g, or t
  misc_feature (1367)..(1367): n is a, c, g, or t
tgtcatcattcatcacncctccnccttatgcttcatccctcattgtatatcgcacatctgctttgacttttgctttatcccgccgaacttgcccattcggctttatttcccttcagtggggcttcaagtttatttgcttcttggcggccaattctgtcattttattaatgccattatttttattggccagtaatagccatttacggccgtccatcacttttactatatgttctaaaaaaaagccgagagtcgagaatgtattttccaaattcaggattcaagggcataggaactgcttttaatccataaactttccctaatttttttttatcacactcgtccaaatcccgagaataatcaaaaaaaaatgcccaaatacttttactaattatcgtaattagggttgaggaactgaaaactccatggttttgcaagtaaatttaatattttcttttgtggaagtcccaaattcagagtccctatccaaccgtattcctaatttatcttacggtggctaagtattgatcaattctgagcactacaataagccaagagtctcgatcatgataagaaattgcccactaactgttacatatattttccgctaatcactccaaaaatgggtcgtcgttcgttggaacaccaaaaaaattatcaccacccctcctcaaccagcacatccaccccatttgctgctgctcccccctcccatccgtccctccaatgttcctccaccaactaccacatgttggcaccggcccaaggcgggcgcaaaatgagtctgattgtattgcaacagcagcagcgcaaaaaatcgctgtgcgtcgtcccccggggcgcgggcggcggcgattatacgacaagcagtgagacagagagagagaaaaatgatcagagagcaaaatggaaaaatgaaaattaacaaaactttaaatatgtacatagtttattaatgagaatccaagttggcataaactattcaaaaatagttaattagaaaatcaaaaaaatttattttaatttttttaattaaaatcgttaaagtaaatctaaaaatatttaatttctcattttttaatttaaatgattaaaataaataaacttaatttttcgattttttctgaatcattttttctaaacacaaatttcaattaaaattaacatttttttaaaccaattttatcaatatatattttttttcaaaattttagtcgccaaagcggctgtcctttcatcgccaatgtttcaacaaacaaaacagcagcaacaagccggcgcttctggcgcaaatgccacggcacaacagcaacaacaacagctgagaccaagtacaaaaagctaatttaaacatgaataaaatatttaantaatttgaatttgctcaccataaacctaattaaattaaatttattgagtttaaatggcagaatacttaagaaataaaatttgatataacaattcgtaatttttacaagaaaaaaatcatattccaataattattaatcattggcacttaataaaaacaaaaagagctaatttaggctgc

SEQ ID NO: 9373 - DNA, 4149 bp, Heterodera glycines
aaggtcacacagtgtcaagccgtggggaggacagtggcagaagaagaagcggatttggcctgaacacgatcagtgttgtcggcggtggtgccatttcggctggtcctggtccgtcagccacgatgccaaacatcaagcgggactcaatggcaatggtctcaattgggagactattagccaatttctctatttttaatgtcagcagattgccgaccttttggccaccacgtcacttggaagcaccaagaaattgccgaaagcaagtgagttttttggcacagagaaagtgaatttggtacaaaaaaagaataaggcacaaaattgaatttgaaaaaacaagtcataaaataatgactatggcataaaacagggatttggcatggcacaaagcaacgaattttgcacataatcgctgttgaagtgtgtgacttagagcagaaaattcaacccaaagtttcggtgttttgcacagaataaaggaggaaggttccaatctctgagaattttgcttattttatagtttttgaaagggtcgaagagggaattttttaaattaagatagtctgtttttgtattttttgaaaaaatcagggtattttgacagaaatcctctaaaattgtaaaatttttacacataactcaataggatgtgtattaattaaagaaaattaattgctgatttaatgaccgattttcaatgtttgtgatcggaattctttcgcctaattatgtatataataatatttttgttcacttagccattctcgatcggcccttggctgatcgagtgctgaaaatggtgtgcttattgtcgctgatcagcgtttgcatgcacaccccgcgcaccctgcagctgatcccgcacttcacctgggtactgcttgtgcttgacgccaatgtggtggccattttcacgtgggaagtggtgctaaaggccaacaacatgggctacttcaggatgattaactatgccgtttagtctaattttttattttattttatttttaaaaacactgtctttttaattagttttttaatataatttccattttttaatttgatcattttcttttgcttttacctttgttaatactaaaattaatcagcataattaaatgtatccctctataaaaatttactattttttgaaaacaattcgtaattggatatatttttaaaaaatttaagtgcccttcgatttttggcattaccattttgcaccattttttttaccattttaattttcctgttttgttttttaagcatcaaaatgcctatttccgcgaccgttggtgccaattcgacttttttctgctccttttccattggatctccttgttgctccacatttaccaactgtttgtacattccgagctgttcgcccaatttgggctcgtctattacgattggttgggcgtgattcgatgtgttcgtccattggtgcgttatgaaatgcctaatgaaaacccaaaagtgggaaaaatgccattattaaaatttagaaaataattaatgtgtcgaaaaataagggtcaaatcagtctatttttaaaaaatgtactttcacaaaaaaaattatcaatgtcaaaaaaatgttcatatttattttttattatttttgaaatttttgagttaaaacttgttgacaaatttcattaaaattttcaaaatttttcccccggcgcctattggcaccgccgggttccatcgcttgaatttttcattttaccaaataaatctacattatttttttgtcaaattcattattaataataatcagcctaatgacttggctgatcaacaagatctttccactctttcttccaggtgattatccgactgatcagactgatgctgacattccaagtgccgcggcagcgaatacaacagctgttgaagtaataaattttgccaaaaacggacacatttaattaaaaataattttttgaaattattttttatttacatttggttttaattaaacagacgatcgagcactcaagtgcaaaatgtgaccgtgttctttttgttttttatggcattgtacgccatcatgggcattcagctgttcggccgaatggattaccattgtgtgatgcccggtgagtttaacaaatgtgcagaaattttatattcaaatgccagaatgattcatttaatgagatttaaaaactgagaaattaaaaaataattgtggatttattttctttttatataatttttattttaaaatgttattttaaacaaaaaaatagtttgtctttaaattcagggaccgacccgaagaatgtgaccattaacgatttggccattccggacacaatgtgttcaaaagaaggccaaggcggttacgagtgtcctgacaacatggaatgcatgaaggtgggaaagtttgtagttaaatcttaacatttatatttacaattttttttaaatgaaaaaactaattatttaaataaatattttatataaatttacaattataaaattagattattctaaccttttgtctcatataaaatatttgttcagctagttctgagtgccaaaagtgaaggcttttacggcatgtttgaccatttcggtaagttttagaatgaaaatattttctaaaaataattttccattaaattcgttttatttctgtaaggcgccagtgtgtttactgtgtatttggctgcctcagaagagggttgggtgtatgtgatgtacgactgtttggactcgctcccgtcacatttggcatttttttattttgtcactctgatttttttcttggcttggcttgtcaaggtgtgataaaaatttaaattttacgaatttcatacacatttagaatgtgtttattgctgtgattacggaaacatttgctgaaatacgggtacagttcagtgaaagttggaaaaaggaggaaatgacgacaattgaggacgattttagtcaagtgattgattaattgatatttattaagccaggagataattaattaatttctaagaaaattgagtcaactgatgacgggtggaggctgatcagactggacacggaggacaagctgaatccacgcataaagcaattccaaacggtaaaaaatggtttagttttaaaatattctgttaggtctaattaagggattatttaatgtgctgaaaaattaaattatgaattgaatagctatcatcaatttttcagattcttcgttcaactggtttccaatgtgccatcatttcgttggtgttggctaatgctgcgataaatgcttcgtttgtttatcggcacgacgaaacggatgcgaaacggcgcaatttgtattatttgattgaagtgagaaatggctggttgagaatttacttaaacaacttcctttgttcttttaagtgtgactttttcattgtttttgggaaagaaaagcttaccaataagccacgttcggaagaatttcgagcaaaatttatgatgcttaaatccgaaacttgcatttgctttgctaaattttatatgttttaccaaaactgataagttcaaaaaatttatttattaaggtgtggaatttagaaaactaaaaagcacataaatttgttagtaaggccatttatgtttttatttgtgggcagttgaatcccttttcgtctctccgcttttcatttttttttcgtctgtatgaattcagcttgaatatggatggcttgcccttacactgattatcggggagatatattttggattttggcgtttatgaatcattgtttcccaattacgcatttttattcgattttattttttatttttagtgtgttttcactgttttattcgatgtcgaatgtttggtcaaattgttttgttacgggcgccaattttttaagcgaaatatcttcaagttcgaattaattttggccattggtggcacttttaacattcaacggcatttgtacaaccaaaattacttcacttattttcaaggcaagtcaatggaaagctgtaaaattattattattcataaaaatatgttttttattttaaaagaatttaattaattttatatttttagtttttcgtctcttccgtctaatcaaagcatcgccaatgctcgaagattttgtgtacaaagtaaaatataaatgaataaaattaaatataatatattttattt

SEQ ID NO: 9374 - DNA, 2131 bp, Heterodera glycines
gtaataccagcagaccacatatgttttccaattcgtatttggacaattttttgccattgcgcagccaattcggtcagtgtttgcccacgccatctgaacatcaattaaagtaaaagtcaagagtctcgaacaatggaacagttaatgagtcacttgagtccaatggccgatgcctccgaagttttccccggtcagaatcaaatccttggggaagccgagcgccgccaattcgccccaccagcgaccgcaagcgtactcaaaagcatcctcttaaagtcaatcaggcatttagtggtattaattagtcaattgcgaactgttcgtgaatgttccgccattcatggccaaattctcgcccgcccagccgttccacgagtgcgaaattgagcatttgttggcccattccgcggcaaatttggccaaattgtcgtcccactccatcttgtgcatgttgctcgccgatggcattttgttgccccccgttttgttgaaagaattgccgagggccaattcggaacggaatttgttgtggcattggacagctgcgtttttgtcttcttcagtcaccggcagagtgtattggggggaggaagggtcggcggtcgatggcacaggcgatgactcatcatttggactgtccgacgatggcacagacgatgactcgtcatttggactgtctgacgatggcacaggcgatgactcatcatttggactgtccgacgatggcacagacgatgactcgtcatttggactgtctgacgatggcacagacgatgactcatcatttggactgtccgacgatggcacaggcgatgactcatcatttggactgtccgacgatggcacaggagatgactcatcatttggactgtccgacgatggcacagacgatgactcatcatttggactgtccgacgatggcacaggcgatgactcgtcatttggactatctgatgtcgcgttgcaattttcgtccgaatcaacaactgttgtcgtctccggttctgtgccgggattgccttcttctgaagaacattcctccgatgattcggacgattcgctgctgctactgctactgctgcttctctcagcaaaagcggcgaatgccaaagtcaggagaagaaacattgagaatagtttcatttttgataattataaattaaaattatgtttttaattttatgatttttctgtgttctgcgtccgctttataaaggattttccctccgctttttgtcaaaattttcaaaagctgagcaaataaaacggtgaattttataaatatttttcacattcttttggaattttgacagtaaaatttaaaaaatgaaaactgtgcaaataaataattaataatgcgtgattattattgggtgaagttgggagtaaatcggcaacaaattaatggattaaaaatgccatcgccacaaaagtgaaaagcggaagaaacgcagctgaaaaaataaaacataaaataatataaactagggttcctccccgagcctcagcaaaatgtcggggaacggggaggaaattccccgaaagaatttgtcggggatggctggagaaatttaaaaaatgtcggggagcaacaccttcgtcggggaggaaattttcataaaaagtctaaaaaaacacaaaaagaaaaagtccagaacaaaaaagtcttaaaaactcatttaaagattcttccatcttatttcaagtgcaatttacgactttcgtaattccccgaaacatgtcggggaggaaccctaatataaaccatgaaactcgtcaaaatgttttttaaaattttaaaaagaaatgccaaaattttgtaaaaagtatggaattacaattttcatttttaaagaagcaatcttaaaacattatataaagtggtgctaggtcgtttcttaaattccgccaggaggtatgaaaatagaaatataaattcataaaacttggctcaatttcaacaaaatgaatagttcatggcagggatggcattccgaggccccaaaaattttcggaaatcggaattccgcgggtccaaaatttttcggaaatcggaaatcggaattccgaccccaaaaacgtcggaaatcggaattcggaagtcggaaatttttcaaaaaacattaaaaaa

SEQ ID NO: 9375 - DNA, 2273 bp, Heterodera glycines
cgatggcacaggcgatgactcatcatttggactgtcggaggatggcacagacgatgactcgtcatttggactgtttgacgatggcacagacgatgaatcatcatttggactgtccgacgatggcacaggcgatgactcatcatttggactgtccgacgatggcacaggagatgactcgtcatttggactgtccgacgatggcacagatggcacaggagatgactcgtcatttggactgtccgacgatggcacaggagatgactcatcatttggactatctgatgtcgcgttgcaattttcgtccgaatcaacaacagttgtcgtctccggttctgtaccgggattgccttcttctgaagaacattcctccgatgattcggacgattcgctgctgctactgctgctgctctcagcaaaagcggcgaatgccaaagtcaggagaagaaacattgagaatagtttcatttttgataattataaattaaaattaagcttttaattttatgatttttctgtgttatgcgttcgctttataaaggctttttcctccgctttttgtcaaaattttcaaaagctgagcaaataaaacgttgaattttataaaatatttttcacattcttttggaattttgacagtaaaatttaaaaaatgaaaactgtgcaaataaataattaataatgcgtgattattattgggtgaagttgggagtaaatcggacaacaaattaatgtattaaaaatgccatcgccacaaaagtgaaaagcggaagaaacgcagctgaaaaaataaaacataaaataataaaccatgaaactcgtcaaatgtttttaaaaattttaaaaagaaatgccaaaattttgtaaaaagtatggaattacaattttcagtggtaaagaagcaatcttaaaacattatataaagtagagaccggacaagagggtcggtcgaacggtttcggttaaaaaaaccgaaaaaaaccgaaatcgaaaaaaccgaagaaaaattttcggtataccgtttcggtttcggtttttttgaatttttttttatcttttcccaaaaaaaacaataaaccatttttatcaatagaaaaagcgaaagatcacctctgagtaaaattgcagagctattgaagctctatcaatggtgtactaaaggtttggaaaatgatagaaaaggcagccaaaaaacatgtgtttgctccttgattctaaaaaaaccacaaagattagttttagcgatttggtgccttttttggcgttttttcccgaaaaattccattaaaaattcaaaaaaatcggaaaaatacacccctaagaaatgatctaaaaaaattcagagaatatacctttatgaattgaacgccaaaattcattttttttttcttgataaaaaattttaggtttaaaaatttccttattgaaaaacattataaaatattgaattatcaataaatcagcaaaatttagtttttggttagtttttacgtattttgctccctaaaaatcattaataaaaaaatttaaatgctttttttcatgcctttttcgggatttttgtgccttttttcagtgccattttgcgctttttggtgccttaattgtgagctctagccataactttagggccggcggtgctgataagcgccgccgggaaattttttttgtaattttaatgctatttgtgagcagattttgtctaaaaataccaaattttgagattttgggctaattttttaagaaaagatagctttttggggggtcggcggtgccgataggcgccgccggaggaaaattttaagaatttttaatgaattttgttaaaaaaatggccaactgatttgtcaaaaaagtcggtcgattgtttcggttttttaattatttcggtcgaacggtttcggttaaaaaaccgaaaaaaaccgaaaccgaaaaaaaccgaaaaactcaaaaatttctcggtcggtttttttcggttaaaaaccgaaaccgaaaatcgaaaaataccgaaaaaacccgaaaaaaaaaccgaccggtccgatctctaatgtgtaaaaatccattcaatttttttttattaaatcacaatcgcaaaatttttgatcatttctcataaatgaaatttgctgacaaattatccactgaccaaattgtccacttacgaattgtccggaccccgttgaaaatagagacaaaagggcaacattttgaacgtaggaacagaaacttacaccaccactccgtgtttccgtacgcttcccgcccatcggcggtcg

SEQ ID NO: 9376 - DNA, 6719 bp, Heterodera glycines
  misc_feature (1743)..(1743): n is a, c, g, or t
  misc_feature (1916)..(1916): n is a, c, g, or t
aaaaaattatttttgaaaatgtacccctgaaaatagcaaaaagtaatttttaaaatactaaaaggtgactcaaagcctatttaagtcatttttatggcattttgtgcctatttcatcctttacgaggaatttttttttccaaaaaataaccatttaaaaaattttatctgcatatttcgggatttttcttacatatttaggtacatattttgaccactttttgcatatatttttggcagccctatttattatatattgatagatccaaaagctgtgatcagaaagctcaaatacgcgtcattattctttttttgtggactattagttgggccaccattgtaaaaatgggatttttctcatttttattctgattttcgccaaattttcgtatatgaaggcattaattattatgtggcttaattgattgataagaatcggttgatttgtgccaaaaaaccgactttaatgccgatgccatcctcctcatccttgtgattcagcggttgcttttcctccccgaacatttccacggcatttggcacaaatgcacaatccacgacgccctccaatttggccaagtccgcttccaatgtgcgcggatagcgctcatagtcctcgtttgcgccaaattggagcggattcacaaaaatggagacgatcaccaggggcggagaggcgcactgatcagtggtgccattttgttccttgtatttgccatgacttttttggcatttatacaatgggatataaaaattagaggtcagatttcaggaatacacagtgtcagcctcaggatatacacggattttatcttggcaaactattgttaatcagacaaaattttcagtatttttcaaaatgaaaatttgaattaaaaaagtttcaatcggcattttgggtgggtttaaaaaattgaagttctgatttaattaaagtcagaaaactgggttctaatgcttcttaaaattttggatgaaattaaaaagttagtgaaaaaatagcagaaataaacattgacttttttgtcattattccattggcgtgcctggtgtgccagtcggagatggccttggtgaagggcacccattgtcggcaccaatgccacgcttaatgaaagggtacttttttcggttttgtacatacaccccaaaattttcaaaaatatgccaacaaaggatggcaccgagttcgagttttttaatgttagaaaaggaataatttgcccattgaaaaatctgaggtttttttttgcaattgcaattttggggtaaattattcattttatgccatcaaaaaacgccgtgcattttgttggcatattttttaaacttttggggtgcgtgcacaaataaatttgtataccaaagattggcgttctgtttacgatgttcgcgcacgaattgtcgcattgtcgcaatggtgttgatcactgtcaactttgaagaggtcgacatagttaagaaatttgttaaatacagttgaaagagttaattttaaaataaaatttatttatttattaatcgaaaatttgttttaaaaataggaaaattatttttgtttataaagaaatgatattgttaataaccaaaaattgtttatcattttataaatttggttcattagaatcaatttaagataacaaattaatagatattaatatattaattaataggatgttcgtgtcatgtgatcagtcagtcagtcagctggggacaactcagccgacagaagacaaactcagcntgatgggacaattcggctgatggacaactcagatttacgagaattaacaaaaatataaaaaaaaatgaaaaatgattaaataaataaaataaaaactaattaaataaactaaaaataatcttagttcaaaataaactaaaaaaaattttaaatttaacagttgtcttccgccngggtgtcatgacaactcgtggcttatgtttaggcctatcttttaggctaggcctaggctgggccttgcttgggcctaggtttaagctttggctttattttgtaaaattttttatcgtacgtctgagttgtccatcaaccgagatattgcccctcagctgagtttgtttcgtttgatggttttttgacaaacgtcataactaggcctccaatttttggttttttaattatttttttcctgagctccctatggcttgaaacgcacgaaaaacatgtttttttttggtggttgttaagctagttttcgagttattttagcaaccattttctagttttttatttgtagcacctaaaaagcctaaaaaatagtgaaaaaaaaactattttcaattactttggcgttttgcccaaaattattaacaaaaatgcaataaaaactaaaaatacacccttaagagatgaaaaatttctcaaaaattcatctccaaaatttatttatttactttcttgagaagaatttttaattttaaaatttattttctcaatactggtttggcttaattttgttttgtttttttttgaataaattttgtcatttgacaccccctaaatttgaaaatttttagcaattattttctcatttttagcacccattttggagtttttttagaacctaaaactaactattttggaagtttttagcaactgtaaatattagagtgccacgggaccgggaattttgggcaaacttattaaaaatttaattttaaaagttataaaaagtgatgtcattgcaaattaaaaaaaaattaaatatttttcatacattttttacacaaatttgttcaatttatgccatggatgtccaatgcttgagcacatttgatgcttaaaatgggacaaacaaaatgcatgggaattagcagtgattttgtgctgttaattgctgcaatttatgctgaacagaagccgagacgaagccaaatttgggaataaaagcactcatttttattggaaaataatcacatttttaataattttattttcgtaataaaattatttattttaaatattaaattaaatgccacaaaattccgatgcacaactctttctggtccaaaattaattgtgtgtatacattacaaaaaatttgtggttccatttttttttgtagtaaaattattaataactaaaccctacccaaaatttcaaataaaacgcaaaaatttttcaaatttttctgttaggcttaggattccgacacgctccaattctatacaccgtaaatatgaaaattaaatctttgaaaccattacctcacctatttaatcataaaatttctcagaagtatactctctctcaaaaatgatgttctttttgtcggcatttgccatcattctccaatgccaaattgctgttggacaggtgccaacgtttcggaaatttttaattttaattaaaatgtttttgctaagctcgtcgcaccgcttcttctccatgctcaaacaggacccgatttcattgttcatccccatgttgagcccgaacatttggatgatgatgatattgatgacgcacctgtgccacactcggcacggcttggccttttggaacactttttgggtggccaacgcactttggaactgattgagcaagagcatcagttccatgaacgggagaagtaaccaaatgagctattataaaattcgacgacaatttcttggcggaatggagggagtgggttaattaggcggcactaattagccagattagctcaattattaaattcaaaatttaaaataatttttttttgccatttgtttgatcatatctgatcaagatgggtctgatactctctcgtgaactggcttgtgacatgatcgatcttggggacagtttttagacccaaattttcgattttttaaaaatgattaacaggcaacagccgaattatttccgaacttgcaacaagaacgacaagttcaaggcgtgctgccaacaagctgggatgaccagcgcaataactgacgttgaccggctgtacaatgacggtaaatttctcattctgttggattgaactgatcaggacgtctttttgatcaaaaaaggcgcgagctgtcagttttatttttaaaatcaaatttaaaaaatttcctgatcaaaaacattttttgattgaaaatattaattaactatgggtgcaaatttggtgtttaaattttgtttttattttttcaagcttgcaaatatccgcctgctgagctcgacacgaagcaaaagatcacattgggctactatttcaacgaggcaaaaaatcgcattttgcaattttaatttaatttattattatttttaattgtgtttaagtacgtgatgtgttatgcggatgcgcaagacaacggcgattgttgcgcaaagaaaggtgtgccatcggaggtatgaaaaaatgccggaaaaaaaaattgttttcacccaaatcaaatcttttaaaggtgcaatatatgttttggagcgccaattgccaggacctttgccgaggcctcagtgccaaattgaatgccaatccggcgtaagaaaagaattaataatttaaaaaaaatcctttttaagttttcgaattctttagaaaattttagaaaaaaaattataattttctctgtcccaaatttaataaatagtagtgcaaattagcttttcccatattgtttaattgagcgctaattaaaaaaatggctaaattgaattaagctgggacaaatgttcgccctacaaaaaaagcatttactactgtaactaccaaaatgtccaaatgaaaaagccgacggccgcgactgtgcgcggcttttgcaacaacgccaaattgtgcaaggtaacatggatgatgatgggcaggcacttcttggataaaacctgttaaaattttaaaaaattcgaataattttttaatcaaatttcattaaaaatttcaaatttaatccttatttctcttaaaaaattggctcaaaagtcgcaaaatttggtcattttttggacaaaatctgttaacaatttgttgaaaaaatcttcaaaagtgtttttttttcttctaagaatgaaattttctaaaaaaaagtctcgattctcgagtcgaaaaatttcaaggattttttcgggtaaataaatataaatacaaaaaaactcaaaaactgaaattttgtgaatttttttttttacaatcttttcagaatccaatgggatggagagacacatgcagcaaggcctaaagagcagtgggtggtcagtgagagagagagagagagaaaaagcaaaaaaaaaaaatgccaaggaaattggagaaaggacagaaacaacaaatggggggatacggtagacagtgttgaaaggatgatacggtaaatggagaggggagaggtactctgtacagatgtattgggatgtggtgtaagggctgtgcgaagctgaaatttaccgagacaagattaacaagaatagagcttaaatattcggaaaatacagtaactggctcggtaattttacggtacagaacaaaaaattacagtatgttttaaaagtttaaattgtaaaacggcggaaatttgatttgactcctgagaaagttgatgtttaagctttcgcatagcccatgaaaattggaaaatatgtaatgacgatggcaattgtttaaaatgggaataaatattattaataaaatttaatgccattggacacgtaatgccaagctttttttatctgtgccaattttgatttcaaatggcacccgttttgattttcccacagctaaatttgacaaaaaaatgttctgcttcaacacgatgcgtgccatcattttgctgacattcgtcgtcatccaatgccaaattgtccaaatgtccggcgggtaatttttttgttaattgaaattaataataattaaattgatgcattaccgttataagccctgatcacttttacttatgtttatcaaatagaaacaattgtgacagtaaactgagagatagttccaaattatttggacattgatctccttaatcacttactgatcaaggcgactcatattgttagtttgatcaccaattcattacttatcgcttattaattaattggtcaattaaactattaagttttgtaattttatagacgctgctacaacccaagcgacaaattccacggatgctgccagcaaattggtatgaccagcacaatgaccaaccttcaatcactgatcagagatggtaattaattgccctgattttgatcattccgatcagtttgcatgctttaaattcctttgaagcttgccgttatcctccggccgatctggcgatgaaccagaaaatgacgctgggatcatacttcaacgaagtaaatgactcaaatttgaaataaatataaaaaattttttttttcgcattaaatagggcttcttcattaaaatgcaaaatgatgcgaaaattaaaaaattgttgattgaaaactaaggatttttttcataaaaaataatttacccagtaatgttttagggttttacagcccaacttttgcttcgctaatttacaaaaatattttaattattttttaacatttaactatccaataattaattaacataattaaccctttaagtatgtgatgtgttatgcggacggacaagacaacagtcaatgctgtgccaatgctggtgtgccatcgaaggtaggacaatttttaaaatttttaaaaatccgaaagaaaaaattgaaaaataaaacaactaatcgtatttatttttataaatttcaaaattt

SEQ ID NO: 9377 - DNA, 926 bp, Heterodera glycines
gctgactgcctgcccttccacccgccgctgccccacgaacacagacaggcagacagtgcactatttccccttccctcttgcaaaggaggaaatagtgcactctcactatgggtacgcgccagtgtcagacaaaattgctcataacgccaaatagcgcatttggcgtaaatttttgcgcgttaattcaaaatttacactggaaaatgccttttttgtattttttattttgatctgccataactcgctccattcccaactaaactgaacaaatttggtatctaaaaaaagattttgaaatggggaatctttttctaagcgaatgttaagtaatttgtcatctcagaaaaaagttgtcggaatttcaaactttatcatgttataactcaagtcttaggcagctctttctaaccaaaatgctaaatttattcttttttctattgattctaaatgttcaaagtgattttgtacccttataaccaaaattattagaatttgcgaatttcatgatttgtaatgtgttagagacatgaaaatagtacgccaaaaggagaggaaaagaaatacttttttattattatttaataatttttgaatgggagtataaacaaaaataaaatcagtatagaaagatgcagaatttttttctctatcgctatgcaaaatttggtagggatttaacataaagaaaaaaaagttagacatagaaaagtaactgttgctttttacatcattaaaatgaaaagaacaccaaagtgagagaaattacaaagaaaaagagaaacgacgagatagtactaggcttttctctgcacagtggggcgtacccatagtgcactctatgcctgtctgtctacctcgctttgaaacatttcgactaaaaaaagaggacccaaacgcaattaatacctgaaaataaaaaaaaaatg

SEQ ID NO: 9378 - DNA, 4104 bp, Heterodera glycines
  misc_feature (4016)..(4016): n is a, c, g, or t
  misc_feature (4049)..(4049): n is a, c, g, or t
gacccgtttcgagtagaaaaccactacccttttgcttttattacctagaaaataaactaaaaatgcattactccacgtccgcatctacacagactgatcacggcccgtcaaccgttccaaaaactcactgctgaacatgcccttgggggcaggaaaaaagaaaaattcagccctggtcaggctccagcccaaccctgggttttgtccatgaaaatccaggtccagatccaggcttttttatcaaaatatcattattttgcatccagcattcacacccacactaaaaaagcgcaattaattcattttaattcaagggtaatatatagtccaacccttagccgattacccatttaatgctccttctatttttagaagtacactgccgcgctcgtcaggcctgttagctgggcagaatgggagctgaggcacaattccatcgcaagggtcgtgagcttggacgcggcaagtttggcgttgtcaaaaaggcactcttcacagaccaacagggcaacgaaacggcggtggccataaaacagctgcattgtgtgaagagcaacaaggaacaggtaaagtgggagtttgaagaagtgcgaccgcgcattcacacattaccccgtttcgtttcaggtcacggaattcatgaatgatgctcggatcatgcgaaagcttagacagaatgtcgtccaattctacggcattgcagttgagcgggagcccgtgatgatcatcatggagtctgtgtcgggcggcagcctcaaggacttctgaaccagagcggcagagagctttatgcccacggagcagctgcaggactgcgccacatccattcgagggcatcattcattgcaatattgctgcccgcaattgtctttacaccgggggagtgaagggcgaggcaaaaagcaaaaaatgtcataaaacaaactgctcatttatttataggtgaagatagcagacttcggcatgccataccaaggggcagtgaagacgatgccggcagacgcgcaactaccgatcgcatggatggcgcccgagtcgctgaggaagaactgcttcacggagaatagtgatgtgtggagttttgggatattgtgctcgggaggttttgccaaatggcgcaatgccattccaattcgccggctacagactcccacatcatgtcccctcgccctcgagggtggagacgaaaagagcgtgagtgaaaagcccaaaaacgtgttttcattttttttatcattttcttttttgcaggtctcaagggacagcgcctggtcttcccgccgaagttcgtcatgcagcacgtctgggccccgaatcacaacaaccgatactcaatgggcgcggtgtacgactggatgaagcgaacaccgaaggaggaagaaggcgccagtagaactagtgcatgtgatcggaatgtgtgtatattgtatatatgtatattgttttttgtaaaatgtttttgtctttttcgtgtcaccgtttagcatattttatttagatttaaggatctctttattttgacaaaaacaaaacaaattggaacccttaaaattcaacaatgcgtgctttgggtgtaagagaacgggttagacacgtttatattttgtaggccgaacccaaaaaacttggaattttttaatggaattaattaagaataccgaacactggttattttccaaaaaagctacaaagggtatcggaaaagggaaggcacaaacaaccaattaccacggaaacgaaaaccaccctgttttttttttgccgggactcccgatttttttttagtctcgccgagggcccgatttcaatccataccaagatgtcacaattaggcgaaaataataaaaaaactaagctgagtgagtacaattagttttgcttatggggtggtagccacaaaaaacagacaaacaaaacggtggggccccaccgccagactttcattcttcccatgaaatttgtacaatttcccttccaccatctcatcatcatcatcctcttcaaatcagcatcagctgaagtcccagtaggcggacgtgtccagcgacgactcgcgcgtcacgcctggccctcgcgcgcgctgcggcgtcgtcagttcggcgaacgggcgcacaaaggcgcgcagcgcgtcgcacagcgagtccaccagcgaaagcgcgggggcaaaaggcaccgccgccgcgacggtcgttgaaggaccggcggcacagtcggcgtcgcgttcggccaacagtcgcagcgcgtccagcgcctgcgtgtcggtgcagtagcggagcagcacaagcgcgcacacattctgcggacaacaattatgaacagacatttttggacagaatggcgctttatttcctccccctcgcgctttcaaattaaaaagaaaaaattttagaaattcgtttttttgtgaaatgttttcggtttttataattctgtataaatacaaattttcgatcaaactctgccggaaaaaaatatcgccataaaacctttcgaagcattaattttcagcaattatataaaatggatttctaattaaaaatcgtaaaaaatggttaggtaaccaaatgtgcaaatttgctttcaccaacccttagtccaccccgtccaaatttttaaatatgtcagaaattttcggattgtatttcttggaactcatgctcgagcagtgcaatataaaaatgatgttaacccgggtttagcgctaaaccgggagccctgaaatcgtcaaaaaatctaagaatgtaaccaaatttgaaaatttgctgctcccaccaaccgatagtccaccgccgtcgccaacggtcggcacactgagcacaagcggcaaaaacagacgtaaagtgtgcccggtgatgaaacggctcgccttcccactctgcagaagatggtccaacaaacgaatgcacaaatatttgtctgccaactgaaaattcaaaacaattgttgatggatgggacgggagcaggacaaaacgtcgccgccgaaacgtcgccggacaaaacgtcgccgcaaaattttttaaaattttatctaaaatttatcaaaaattttttagttacctagcctggttcggaaaaaattctagaaaaattcgaaaaaaaatttttattaagaaattcaaaggaaaaaatttttttcaagtttttttcgatttttttcttagaaatcaacaaatttagtttttattaacacttagattttcagaaaagctaaaataattttaaattttcttaaaattttgaaaaatttttaattttttttgcggcgacgttatgtcccggcgacgttttggggtgtacccggatgggacgacaaatcgaatcaaatggatttgaaaaaaatgaattttgatttgtaaagagaatttttctgtttacaaaatttgaaaattctctttaattttttgtaatgtcgttaaaaataagtgtagaaagcccaattaaagcataaattacagataaaattatggagaattttatttatattacagaaatggtgtgaggaggagcatttttttttttgaaatttatgtatattctaattttgtgtgtattttctcaggattttattcggtttttaatgatttttccagtccatcggcggattgtcgcaacagcaaaacttttaaaaaaaaacagtgccataagcacgaaaaaatgtcgaatggtaattgtaagagggatgctctgtcctaattaattatttttaaaatttcaaaaaaaaatttcacacccgaagcattgcaacacaacattcggcgctgttcacctgcacacattcactttgaagtccacagcctatggaaaaatgctaaaaattggtttaatggattgtttgttgatggccaaatgagtaccaagaatttgacaaattcctctcgactgcagcactcggcatccgcatcaaacacaaactgatcacggcccgtcaaccgctccaaaaattcactgccaaacatgcccttgggggtaggaagaaagaaaaatggaccgatggcatgggatgggaggaaatanaaatggtcaaaaattggtaccatgaaatattcngtgtacgtgcagaggccgtcctttggcacttccgcaacgagtgagccatttgtgt

SEQ ID NO: 9379 - DNA, 1967 bp, Heterodera glycines
  misc_feature (1915)..(1915): n is a, c, g, or t
ctgaaaagtctcgtttccattccattcgatgccgaacagcgaaaagaatttggcgaatcggaaaacactgccccggggcaaacacttcagcagacggaggcaaattcggaggagaaaaatgcgccgtcggcggttgtgccgaagaccgactcggccgatgaccttttgggctgttcctctgcttttgcgaatgaatccgccgatttatgcagcagaaaaccatcggcaattgcaaaagacgaagcggtggaggaaatggcagccgaaaaatattccacggagagaattgccaccctcggagaatcgctgcggcacgcaaaaggacgtgcgacctattacaagcaggaagtgagtttggacagactgtaatgtggcggttgggcattgtttggaatccaaaaccctggctgatacccacttgaccagcgcccatttgtcccaattcgttctaattgattgcctgtggcaatcttgtccatttgtcagtattagaaagatctacaaattggttcggcgcacagtacagtcattgctgttgtgttttgtttcccatatggctcattgggttttgcgtagttttgctttgtctttctcatgggttcggttcccttccgcgtgcgtcgctttgtttgccctcttttggtttccgtgcgaagaaacgtcagctgtcagtctctgaccttcggcttacagtacttactcccttcgcaaattgtccctgcacttttctcgttggccttttctgtcggagatttcctcaaaaaggcctccaataaatgtgcaacattttttttaaattttttcaacatattattttgagattttttattgtttaagtgtgaggaattgctcagaaaggcaatctgtgaccagcagcgcatcgaagcattggagcagaacattttcgagttgacgagcaaatgccattcactgaatgtttgtcaggggatttggcattttcactttcatttgtcttgctttttttcattagccaattttcaggatgctcttgagaccacccaaattaattacgaagcgcaatttcgaggcaaacattaaaaacagacaaatccaacaacactaaatttgttccctttatcagatttacatgagcatttggcagaaaatgaagcaaaaatgacgggccgaagtgatcggacattggcactcaatgggacggaacggagcgtggaaaacggcggagaaagtgcgttttgagacgcatggaaaggggcgaccctaattttttaggcaccacatggaaattatgcaaattttaacaaaatttttcataatttttgaaaaacgcactcatttcccacgaaagtcttacaggtctctcctccccccctccctttccaatgtttttatgggctttataaggcttcgctttttcttcagaaactaccaattgtaagaaaagtgagaaggtccgttcccattggttttcgtcctcgtccaaacagtcgaaggaatgaatgactttccccgtgccgacttctgtgattttcactctttgttaagttcgacttgttaaataacctatgcaacagtggacttagtcgaccgaatcgtcaaaatcagtcgaatcgaatgttaataattaattgtaacgcttgtgccatggaaaacactttttcatctttcgaataaataatgcccatttcattcgaaagtccgaagaagcgaattgtacaaatttatccgggaaacgaagcactggtttatgtacaacacaaattaccatcattagttaattgcgtacactctctttggtcatcgggtggcatttgtacacttagtgatttggcattttgttgtgagtccgatttctggtgcttttctcctccctcattctgccatcggttggtaaaagccggcatttataaaggaaaagcctcggaactcctcttgngcaatcgttttgatcactgcggcttctgtcggcgtcagaatcggctcctcct

SEQ ID NO: 9380 - DNA, 2465 bp, Heterodera glycines
  misc_feature (34)..(34): n is a, c, g, or t
  misc_feature (36)..(36): n is a, c, g, or t
  misc_feature (57)..(57): n is a, c, g, or t
  misc_feature (70)..(70): n is a, c, g, or t
cgagccgacgcagcggatttttcgtcataaactnancaattattctcaaaatggcanttgcttcaaattntatcaatataatagtgctcatttttcggataattagctaatcaattagttaattgccctccctcgcttttgactgacccccttcagaatggagacggcctccctgctcagccacaccgggtaaagcacgtcgtcgtggagtatggcctcgaaaaggtcgtcctcgttgtccgcctcaaacgggggttggcccgccatcatttcgtacatcagaacgccaagggcccaccaatcgacggaaacgccgtattccatttcttggaggatctgggagtgccttggccattttggtgtttgatcattggaaaaatgcctccggcgcgatgtagtcgggcgtgccgcagaaggttgacgtgaggctgtctttggtgatgccctctttgcacatgccgaagtccgccagacgacagtgcccgtcggcatccaacaaaatgttgtcctaaatatggggtgattaggccaatcattcaattagccgcaattgcgcgggactcccaaaaatgtctgctcaaattaaaacattggcaaaataccaatttgaggtcacggtagatgacattgtgccgatggagaaattgcaacgcgcaagtgacctttgaggaagatttgtcaatatggactttcgagaaccgagactctctccccttggcaccctctctctctcttccctctgactctctccccttggcaccctctctctcttccctctgactctctccccttggcaccctctctcttccctccctctgactccctgtcttggcactctcttctccctctcccctctgactctctccccttggcaccctctccctcttccctctgactctctccccttggcaccctctctcttccctccctctgactccctgtcttggcactctcttctccctctcccctctgactctctccccttggcaccctctccctcttccctctgactctctccccttggcaccctctctcttccctccctctgactccctgtcttggcactctcttctcccctctgactctctccccttggcaccctctccctcttccctctgactctctccccttggcaccctctctcttccctccctctgactccctgtcttggcactctcttctccctctcccctctgactctctccccttggcaccctctccctcttccctctgactctctccccttggcaccctctctcttccctccctctgactccctgtcttggcactctcttctccctctcccctctatgttcctttctcgtctctgctgccctctcattttctttctcccttttctccctcatttcccttttcatcccttctctgcccttgctgttgtttctccattttcggtatttaaagcccaagaatggcacctctgccgcatagaatcgtgcccgtggctcttcaaatttcctcgctcgctgaatttggaacatcaaatcgccgccgttcacatattcctgtaatacaacaaaatgccaaatgcatcgaccatttgcatttcagttttaccatcacaaaaaagagtttgtcgggcgtttgaaaggaacagaaaagtgcggtgagaaaaggatgtttggccgccaatgccaaaattctcttctcgcacattgtgcactccacgtcgtcgtcctgcagaatcacgtccttcttcagcactttgactgcgtacacttcgtccgtccctttccgctcggctaacatcacctgaaacagtcgcaaatcaaccgaactaatcgatcggaaccgacacagccaacaatcaatcaataaataaatgtaatcaatcgataggagtaaatcatccaatttaagagtttgacgagtaaatagatcaatcatcggataaaccatcaaataagtcgcgtgccaatcagtaatgttttggctttgcttgtcacttcccatcccattcccacctttccaaatgatcctttgcccagcactttgataaaagtgaaatcggccaatgccgcgcgtccgtccgtgccagagattcccttgggcgaatcgccgccgcgtccttccgagacttcggcagaggcgacgctcgacggcaatcgcgagggggcagtagcggcggaagcggcacttttgggactgctcgtgctcggctcgagcccagcagtgctttcagacaccgacacactcaacggcttccgcttcgctcggctcgacattttgtcgccagtcagtccgagttgggccaactcctcggacagctgaacggaccgaacttggcgagtgttggctgaacacgcaactgaccagcttgaggtttatgccgcagttgttggccacgttccgctggcaccttttgtgcacgttcagcctgcacacagaacactgcagtccctggttgatcagcccgtacagcatcgacccgcaatggtcgcaaa

SEQ ID NO: 9381 - DNA, 1455 bp, Heterodera glycines
ctcatatgaaaggccgattcataccgagaaatgcgaccatttcccccccccccttcccccccccccccccacctgatagtcctcgttccacaccggacttttggtcttgggcctcgtcaccgttttgccaacgtggtactcatcgcagtcgacattcacatacgcatccaccaattggctgtccgggtcgtccgactggttgaatctgaggggttaagggagcgatcaacggatgaagtgattgcgataaatcagagcctttggagtgggagtgatggatgtactatatccctcccccccccccttttagattttcctttttttagaaaaaaaggattggcttttaatcagaatgtttctgaacattttgttcccctttttaccttttcgaccattctgtgggctgaaggtcgcgcgcttcgaccacccgaattttggccgttccgttgaacaaaaccatcgctttttcggcctccgtttggccttttcccccgtcggtccctttgtcctttggccttttgctgttgtgaggtgatcagctgatcaatggaggctaatccccgcattcaatgagcagagaaaaggcgtaagacaacggacgaaagggcggaggaaaagcgacgaaagagcgaaaggaaaggaagcgaaggacgagaggaaatggtgagaatgatcagctaacaaaagacgaagagtcgaaaatcggcggaagaggggaggaggtcgaaatgagacacaatggagaggaagaaagaaagaactgtttgtgatgagttttggaaagggcactcgcgcgggagggaaggctaacaaatgagaaaaagggggggggcaaacgcatttataatgagaggggggggggacattgaggaaagggaaaaaaaggggggacaaacgacggggaaagtgctgcacggacaggcaaagaatgggcaagaaacactcacggagaaaaatgggcaaattattatttgcgaaaatcaatgccccgcgttatgtcaccctccctgctaaaaatttgtcctaaaaatgcttttacaaatttcagaatgacaattcaagagaagaaattgagaaaactgagaaagtgttcgagtcaatggtgcaaaatatgaagagaatgattgggaaaatgatcaaagtggacgattctgactccacagaaattgtccaggttaagatcaaacccatagaagcattttaattttattttcacaaattctgaagaaaccttggattggccaaagatataataaattgttttcttaaaaacagggcacggattttcaaaaaaagattctaaggaagcgattaattcataacgaaaaaaaacaaatcaaagacttcaaagttcacgttctgttcatttccctgcttcatttacctttaaattttaaatctttataaaaaaacatcgaaatttttctttgaaagactaaaaacattttttaaaaa

SEQ ID NO: 9382 - DNA, 3196 bp, Heterodera glycines
  misc_feature (109)..(109): n is a, c, g, or t
cgttctgtccgctcgggtgttgttggattcatttcctccattttgatgattttcaatgaatgccgatggaacgaataataatttacaggtcttcttgccatcccccccnccccctctctctcctctctttttcattctctctctcccatcctcttctctactgatggtcttatgctccacagagtctgcgagatgaaattgccaaactcagcgaacgattggcgctggcggacagagaaaaggcacaggcgggcgaattggggcttcatctgttgagggagaaggagcaattggagctgacccacgaagtctttgctgccctttgcctgctgttattgtcccaatgcttagaatttgctcaaagagttggactctgtcaggacggaattggagcgaacacagaaacaattggcatccattcggtcaaaccaacgccatgcggcggcgaccgaattggaccacgagttgggactgttggaggattcggccaaaatggaggcgcaattcgttgaccgagtgaccgctcttgaaacggaagtgcgccaactgatggaagtcggtggccaaaggcgggggggggggggtaaaggcagcgaaagtaaattacaaatccccggaatgacagtcagaaataccatcccttaaaaaggcttattccttttagcaattgaacattttcaagtcggagtctgaacgattggcctttgaattggaaagtttccaactccgagtcactgagttggagaccgagaaaaggacaatgcgagaagaggtgagccggggaaagcgaaagggacggaaggaaagaaaaactccgccgtttgttaagctcaaagaattgaagcaaagggagcaatttgcgttgaatgaaaacggagagctcgaagaagaaaacgtgtccctccagaagcaggtgctttttggcatttgttttggtcaattcttttgcaaattgtttttaggtgtccagtttgaaatcaacccaaatcgaattcgaatcgatgaaattgcaactcaaaaatctgcttgaggaagtggtcattttgcagacggtggccgacgaggccaacaaggtcagccggggcacggtgttgaccattggtatgacaatgaaaaaccctgtcattttctttattttaaccccttcaactaatttttggttttaatgttccattttcagcttcgatctcttgccgaacgccaagaggcagaagcattggccgccgctcagcaggaaagggaacagcgactggcactgaaaaaggaattcgagcagttgcgcaaccagggccatctgtccacactcaacagcctttacttgggcatcaaaggggcggaccgggacattgtcaaacaggtgaataagggggggggggcaaatggatgggagacacacggaattcccacttttcagttggaaaattcgttcatttccgacaacccaattgaaacgttcgccaatggcaatgcaaagggaccgaaagatttgttttcggaactgaacggcgatttggaagatcggctgaatggtgcacaagcggagaacgaacgactgaaagaggccaaacaaacgcagccaagggtgggcgaagggcaaaagatttcttatttttaaatgaaaatgttttcttattttgtcttcatttacccctccctttatgatgaaaattgcttcagtttttgtccaaatgcttcttccgtttttccatcggttggacctcaatggcaatttcggttggcttcggttttacttcacttttttcatttacattttcagaagagtgtgacgtttccaaactgaaggattacatggttttggcattggaacgttttgacgaacgaatggaactgaaaaaagaagcgaaagagacggagaaacgggagcaacggatgagaggtgagaaacgcgcgttatctgtggaaaaaaaagaaaatttagaagccctcagagaagcgattcttctcgcgggacgaaaggacgcgcatttgaccatcgccaggggaatgatagtcagactgggccagacactgcacactttcttcaccgaactcaacggcacggaggaaggccaacagaaccaaagcgaacgcagacacatcgccaatgggttggccgaccgtctcaacgccgtggcacaacgcattcaaccatttgaaaatgggatgaaaaggtgggcaaaagggaggagcatgagggatagcaaaaaagggagtgaggggggaatacgcgccaaaaatgaaatgttttttattacttttaaatttgcaaatttctcgacacgaaggattttatttttcgtaacattgtctctttcaagccaaatcctgtgttcgttgatgctaaaaatgccaagattttccctctatcttttgccactctcttcccttcttcagactcggttcgcctcctccaaatggcggcggtgagtcgcctcctccgaccgacgtttcgtcattcgtctccgtcgaaacatctgagtccgactcgccacgcgttttgctaccctcgccagaattatgtcggccaatgctttcgcagaatttcctaaaagaattggagggcataaaaattggtgcggatgcgcagaaaggtgagttatggtgccgtgaatacgtaaaaacaataatttgtcagaatttcccagagaaaattgccttttcatttccaatttcccttctctgttgccaatgttgcctttagaaaattttgcgctgaatgaattggtcagtgagggcgacttgcgcgagtgccttttgctcgcggggggcgacgggactgacacggacgactcacagatggcctatgggttggccggagaattgcttaaggcggtgggttgatgacttaagccaattagagatgcgctttgattaaggttcgaaatgaagccgaacagcgcatttcggcgcgcatggcattggaggacaaagacaaagcggacctttaccagaacatcacaaagttgaagtcccaattggccataaaacggttaaacccccacaattgatggtctctctctttgaatgtgtaattcattcagtgaacaagtctcatctctccgttctgttcttcgttccaacaaaagttcgaccgaaagtgtgctccaatgtttgcgggaaaaatttgagtccgaatttcgactgaaagacgaggccaacgaagtcggacagaggcggggggttccagctgccaatg

SEQ ID NO: 9383 - DNA, 3906 bp, Heterodera glycines
ctgcacgctccggaggagttacagcagcaagtcggcaagcggagaatttggaaaggaattgaaatgacatttttaggtggaaagtctgcaggactcattgaaaatggcggaggaagagaagaaaactatcaatcagctgctcagagtccgttgatctttcaatgacataaggaaagtagcatctcaccatcagatgagcatacaacagaaattggcactcactcagcgattggaggagttggagatggacagggaacgacagatgcaacagttgcgcgaaaggggggcgactggggacgcgggggggcacgccaacgcacatcagccacaacagagccaacagccgaagaggacgggccccggaggaggccaacgcagcggtggaggggccacgtaccatcagccgacgacgcgggcagtgcgctacccgggtaaaaaagggggacggagtcagggaacagttcggtaccacccccgcccctcctttttccccggtacgttgtcccctttttaagggtcgtcgtcactgcctaaccatcacaacggcggaccacgggggaagcagtgacagcggaaagaagcagcatttgccttataaaataacatacttaatcactaatggtcggaaaagacgggtcccttaattaaacaaattacaaaattagtcttccaacccatttcccataaccaaaaatttaaaacttgttaaatggtttttgtttctcatattttcatgtgtatttgtcattatttgtttgtccatttttcggaagtaaatttcgttgctttttgtcagtacaattgcagcgacagcgacgcctttgcacttgcgacggtcgtttcgcacgtgcggcgacggctttcgaggcattctttgtgaaaattatggaaaacgagcgaaatgcgcggcccacacagtgcgaatgcttggcgatattcgtcctgggagacacggacacttttgggtagaaaaattcgaaaggcgtagcgaaaaccgatgcgaaaactgaaaattggcaaaagtttggccggtaagggcggagggggggggggatggctaccgttcactcatatggtaatagacgatgggagacactacggtggaactcatggcgagcagaaaaatgacattgagcacaattttgaggcggaggggcgtccatccaacggaaagatcgctggaaacggcgaataactgaacaattggaggattcagcagaaaaagggacgaaaaacgcaccaattcatagggacaccaaagcagcaaaaaggaaaagaccaaaatggcgaagagtttggccatctgaaacgataacaaatgctaattggccaattagcactaattgcgttgcgctttctttgcttcgcccacccttcgctttgccttcagaaatgattccttcggtttattttcgggcgtttgttttttgcacaattcgtgcgcaattcgcccataagtgaaaatgagaatggcaaaaggcaacaaaaattggagaagcacaagcgaagcattgtaactgcgaagggatttgacaattaaaagcaattaaggaatgaataattaatgcgacgcctcacagcaaaaaggcgcccctttttgacggaattacgtcgcaaatcgttcgcgtcgaattgagcacttccctcccacgcaccaaaaaggcattctcgaccgtatctgaacaaatggcaggcactttctgcttcttaaactggtcgtaccataaacgtaaagggcgggtgccccgaagagaagggaaattgtccaaatggcacaaattgttaatgcgcagcagcgattgccattggttcctgaaaaggagtgattggatggagttcatctgcttaatgaatgcattaattgtttagcattcgaattgccaccccaagggcgacgttgcaacgggtaaagaatggcaaagtaactgaagaaaaaagagcgattagctaattgactcaaactaacgaccgatcaatgcttatcgcgaccattgtgaacaccgaagcacaaaactgagcaaagaaagaaatttgcattaaaaacagagaaaagggaattgccggtgttacggcaaacatttggttgaggggacaaagccaatggggcaaaagccaccgattgaacacattgtaaaggccaagaggcaccgtattgaaaacggtgatggacaaatcgctgaaagaggcaaagcggacgaaaagggacgaagtgccaaaggaacttacctaattgccaaattaaacacgagccgattggtcgtacgctgacgcatcacgcgatgacagaggacaatccttggccaaatcaatggacaattaaaatttgaaatcgaaacaattggtcaccaggcaacggtcgaattcactgcgagagcaatcaaagcgagaagaagagtgaaaatggaaaagacaatttggagagcgaagggatagtcgggattggagtcgagagaagcgaacagaaactaagaaaagaaaggggggggggacgggaggagaaatgacgaagacgaagacgcacttgggagttggaacagaccaactgatcgaaggagcaacggttgaaggacagacggagaccgaacgcagcgatcagccgaccgaagtcggcagaaccatcgccggaggggcggacagagacgcgacacccctcaacaaaattactgttcccgacacaaaacgaagcaaaggaaggcgtcgccataactaagcgaagtttgtcattggacaaacaaacgttagccgaagcaggtgtataagctaaaaacggtggatctgacgaaacagagacaattacaactgaagtgggtgggtgaggaaggaattccctccccaattcttagctgtgacattccgaattaaacgaagtgcaatgaatcagtgggacaccttttttctaggaaaagtcacacaaacaaaactcaaaagcaaaacgaaaaagccacattgcttttattcaaattttgtaaaagaaagacttttcctctttagttgacgtccgatgaaatgtgtgaatgttatttggatatgagatgaaaaagtggaaataatggaacaaacaaattcaggtgccatttcggaaaattttggctttttaaaagaactgacgaacacaagaaaaggggcgaatgaaagaaacaatgataagtgagtgagtgggcaatcaaatcaaaacaggcgaaaaatattcggcaatcattcagaatttcggtcccccaaaaaataaatgtttattccgaaagattaccaaatggccgagtatgaaggcaattaaataatcattataagcagcatatttaattattaaattccgtatcagacgatcgtcgctttttgccgccatttcccgagggcccaccaattagcgtgaacccgccaaagtatcccgcggcttcatctgttgcagcgtctgatgagatttgcttctgctgcaatagattctccaatttccttgccgcctgtgcgtggactgaatgcctttgtctgtcgatgctcaccatcgacgcattattttgggtgctgttttggcactgactggtggcacttcgccgaggcaaaggcggcaattggttatccgaagtgaggagagaagaagtctcgaaaagattttgcagagggggagagcccgttttgggaggatcggccgaagaatggacgccgaacggacgttgttgggagtgggcggaagaagaatggaggacatttccacgctgaataaacgtaaaatgataccatacatggaaaggggggacggggcgtcacttcgctttcatcgacgacggacggcgcaatggaaaagcgacgcggcttcatattcggcggcattcccattgtgccgttctgaaggtcgtccaaattctgaggcatttccatcgcatccaaaatcctcctcttaaaggataggaa

SEQ ID NO: 9384 - DNA, 1328 bp, Heterodera glycines
  misc_feature (122)..(122): n is a, c, g, or t
ttcagttataagttgtcagtttattcttaattctatagtaaatccgaaaacatttgcaccattgactttctccggatttaagcccgaatgttgaattttcttgtgattcacctataatttcnagttaataagttgtcagttttattctttaattctataggtaaatcccgaaaacattgcaccatttgacttttctccggattttaagcccgaatgttgaattttcttgtgattcacctataattttcagttaataagttgtcagttttattctttaattctataggtaaatcccgaaaacattgcaccatttgacttttctccggattttaagcccgaatgttgaattttcttgtgattcacctataattttcagttaataagttgtcagttttattctttaattctataggtaaatcccgaaaacattgcaccatttgacttttctccggattttaagcccgaatgttgaattttcttgtgattcacctataattttcagttaataagttgtcagttttattctttaattctataggtaaatcccgaaaacattgcaccatttgacttttctccggattttaagcccgaatgttgaattttcttgtgattcacctataattttcagttaataagttgtcagttttattctttaattctataggtaaatcccgaaaacattgcaccatttgacttttctccggattttaagcccgaatgttgaattttcttgtgattcacctataattttcagttaataagttgtcagttttattctttaattctataggtaaatcccgaaaacattgcaccatttgacttttctccggattttaagcccgaatgttgaattttcttgtgattcacctataattttcagttaataagttgtcagttttattctttaattctataggtaaatcccgaaaacattgcaccatttgacttttctccggattttaagcccgaatgttgaattttcttgtgattcacctataattttcagttaataagttgtcagttttattctttaattctataggtaaatcccgaaaacattgcaccatttgacttttctccggattttaagcccgaatgttgaattttcttgtgattcacctataattttcagttaataagttgtcagttttattctttaattctataggtaaatcccgaaaacattgcaccaattgacttttctccggattttaagcccaaatggttgaattttcttgtgattcacctataattttcagttaataagttgtcagttttattctttattctataggtaaatccccgaaaacattgcaccatttgacttt

SEQ ID NO: 9385 - DNA, 1675 bp, Heterodera glycines
taaataaggaattatttttattaaaaatagataaaaaatcgaatgcattatatttttcagttttttataataaaatacacttttattaatcaaaaacaaattatgaaatgtataataattgaatatttatttaaattgaaatgaaaaaattttgacaaattcaattttaaaagaatagctgaaattctttaattaaaaaataataattaattatgtaaatgaaaatcattattctctaaaaataataaagcaaatttaaaaatttattaattattaataaaactaaaacatttaaatgtattaaatgtaatgaaaattaactcaaaaataatagaaaaataatttacaccgtcagggtccgaacctgcccccccccccctcagaacatgtaccagaatccccaatcacacagggattctgagggcttaacgatgtaataactgaaatctgatttcagatttgtgatcagaaccctaaaatagctctaaagacatgttttgaatattttgggtgaaaaaattttttcactcaaaaatcctggtcacccccctttggtcccgaaaccaaaaatcacttttatttttataacaattcgcaaaaaagagataaaaatgtaaaataaaatttatattatagagaaaaaaattgcggatttttgtagtatattacttttacagaatgacttttcagaagcgagttctgaatttttttctgaaaaatctaaaatttccagaatttctggaataacttctttcatattgaagttagaaaacccaaataaatcccaaaaaattctccttatttttctctatttttaaagctttattatagttaaatcgatgaaaccatcaccgagttatgaattttccaatattagcccaaatttccaagggccaaaaaattgccaaaaaataaagaatttttaaaaaattccaaaaattttgaaacgaaaaataaacatcatattcgtgctcaggaccctaatttaccccagaaaaatatttttcacaccctttttcgaccccaaaaaaatttttgaaaatttctagggggcctagctcgaaaatttttgaaaatttccctacatatagtataccattagatagagcttaaaaagctctacaattttgctctaaggcattttttgtctaaaaccgacgcctgacgagttatgggcccgggactcaaatgtcccgctcaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaatttcaaaaaatcgagctttgaaagctctacaataagttcgctgaccaccccccgctcagatcaaaccctggcgcggtattcacctggtactgaagtgtactttttgagcacgcttcagttgccattttttgcaggccaggggtttgctcaaaaaaaattttaaaaaataccaccttgtagaggacccttaggcggagtgccctttcagcgggcactttttgattcgagttttacaaaaaaagttaggggccttcaaatgcaaacaaaaggaca

SEQ ID NO: 9386 - DNA, 5392 bp, Heterodera glycines
cgtaaaatcgtggaaaatttgggccgccctttttaccatttacagtaacctacaaaaaatatcttctgacaaacatacaaatatgatcagcgggacacttttgtcaccactcctatgaatatatttttttaatttatcactgttttcagtgactttggggagtgtccgatcacttaaaaaggcgtgatctgatcgagttggtgatgattatccttttttgatcagcaataaatgtaaggaagcatgtgttattggtgtttaactgaatatatatattttttaaaaagtaaattgtcctcataaaaattttttgactaccattaatctcgagaacatttctcgagaaacggctcataataaatattgactttatgtatgtccaaaatttattgaaattatcctttacttttgtattttaaattttttaattttcgggcatattttgtacaaaaccataaatgttatgcgggtagggtttctgctgatttgttcagaataattctcatatccataaattagcgagcttgaaaacaaaccccctgctgggaatactggtttataaacaaatatacttttttttaaataataataattttttttttaaattttttttttggagggtgggtgaaaatacctaaataattaaaatgaaatttgaacttgtttgaaaccgtaaaatttttctttataaagtttcatttaaaaagttctttccatggtctatcgtcaccgccggaccaaattttttaaaaataaaacttaaaataaggaaatttcgctaaaatgtcggaaaaattcttccaaaaaaagttgatgaaaaataggctaaatatataaatgtgagctaaatttttaattaccctcatccaatcgtcgtcgattcttttctgttaaattgcttttcggcattttgatcattttgctaatcgccgcggttggcactcgttgtaattgtccaatctgatcaggcttgatcaccaattcggcgacacaattcatgtgatcatccgttttggtacaattggacaagtcctgaaaactcgaaaacatttaaatccacaattacaaaaatcttccgaaaatttaattcccaattttcaaaaatcctttcaactttgaaaacttcattatatccaaaaagtcgccccaaaaagtttgaaataattgttcattttagcttaagttttgaagcttatcaaaaaaaaaaaagtcaattacaccatgttcatcagaacactctttcatggtgatctgaaaactcgaaaatggcaatgccgatcagggatggacgaaatttcgtttcgttttcgtttcgtcctacattttcggcactttttgagtttcgttttcttacggactaaaaacccggaaaacccttactccgtataagtccgtatgcaggaaaatacggacccgtatacggatcagggttttttgaaaagttttttaatcaataaaaccatattttatgaaatttacgaattggaaactaaatagaatttcataaaaaattgaacgaaatgctattcaaaatcgtaaaaattttgagtttttatcacaaaaaacatttttttccaatttcgtaaaatttttcaataattttttgtccttgatgttcttattttgaaaatttttcggccatacccctgtcctagagccacatccgcttttccacctactatgatcttaattccctcagttagaggatacaattttaaagttcttaattaaaattgaatatatttaaaaattttcggttttttcgtttcgtacgaaatggctattttttcgttttcgtgtttcgttttcgtccgtcaaaattttttcgtttcgtgtttcgttttcggttttcaaaatttcttttttcgtttcgtgtttcgttttcgtgtcgaatgccctttttcgtttcgttttcgtatacgaaaattttttttgtgattttcgcacatccctgatgccgatctcacaaatttccaaaaatcctttcaaaaaccctgtgtaatttttcatcaattccagtgcccattttcccaaaaatccttggtatttaaatttttcgaaaaaccagcttcccaactgcccaaaaaatccattgagtccattttttatgaaaatccgtgccaattttccaagaatttttgatcattcaattctccagtgttacccttatccaattttccctgaactgcttcaacttcttcttcttcttcacctgttcgcccaacagttggagtgtgctcgtgtcgttgtccatccgtgcccaaatggacacgtccctacactcgtcgtccaccaccatttggttgacgctcagctcgcaattgaaaccgctgccattggtcgcctcgcggcacgccaaattttctggcgcaattggcaaaaattgaccattgtgctcttcaaaataaaagcaattaaaagggggaataattaattaaaatattgaaaattaaattaacgaattattttgcattaatcatctcaaagttactaataaaaattaaaatatcagcaaaaaaataaaataattattttataaaacagaaaataattttttgaaaacttatctataatcatttaaaaaaataatagattttataattgaaaatatgttgtttttggtggcgtatgcaattggattagataaatttttaaatgattgatttttgcacttactgatcaccaaattgagcggaacttgtggaacgaacatactgatcaccatgaacacagtgaacctgtgctcaaaaacaggggtcaaaatgcatatgaaaatgaatgagaattgagtttgaaaaacgcgtaaatacgtggccaacaaacattttaatgtgtccagcagacaaaggacaaaatttgtaaattttttctatttctaagaaaatttattgaaatttttttccaattttcgaaaagttgagttcggagctcgtcgccgaagaatttttcttatgcatttttttaagtaattttttacttacgagcaacatttgtacaaaaatggcactttcactgttgaaacctatattttgaaatattaaaattctttcaggagaattttcatcaaaagagcaccgtaccgaattttccagacccaggtcgaaaactcggattcctggggtccattgggtttttccgatgtccgatttctccggttaaccgaaaaaactccattcgggtttacggctggaattttccagacccaagccaataactcgagttctttaggctctaccgggtttttccgatttcgggattcgccggcttcccgaaaaactccatcagttaattttctaaatgaatccgtaattcaaatttgtttaaaagtttgattgttgctctaatttggctctgaattgcctccccccaaattcactcacataaattttcccatttttcccatctccgatttcttctttttttccttccttttcctcccattatttttgtcattttgcttcttcggcttctcctcttccgcaacggattttattattttgtccaattttttcccatttttctttctgcgcgaggggctaaattattattaattgggtgcctaattagtcgtcgtttaattgggctggggcatgggcaacaggcccataaccagcggaagaagaagaaaaggcggggatgcgtgggttggggcgtgcccggaaatgcatcggtggaaaatgtggaaaaagctccaatggaaaaatgcgtcactgctatgcagtagtatttttggaaaatgagatagtgcggtaattagataaaactgtgtttatgttgtatgaatttatgaaataaatacccataaaaaatgctatttttacttccgcggtgccaagaaaatttgaaaaattaaatattaaattgagaaaaatgttttgaggcaaaaaagcctccgatttttttccgattacgggcctggccataagtattaatgtatattttttgcttacattgtttttggctctcgatcactctctgaaaggtatttttattttttaaaattaataatgatatatttctaggatttacatttttaatgctaaaaaaaaacaaaaaaataaaaataaataaattaggttgatcaagtcagaattgtttttggtcgggcctcacaattttattttattttaaaatcctactcaaaaatatgtaaaatttcccctaaaaaatttttaatgaaaagattttttacttttcgatatcatttattttttccaatgaattttgaataagtagagtctcgcgatgtcgtaggcaacgcatgagttcattttttttttgaaattttgcgaaattttatgtatattctaaccctcccataatgtttacttgaatagaatcccaaaaaatatgtttatctaagctattttttaaatttggcatccttattaatcacccttcaatgttttgttggcgttctgccgctgctgctgttgataattagtcacgccaatttgctgcagcaaattgccatttgaattcttcggaatgtttgccggcggattttgaacatttgagaggaagacacttttttcactagtcgaatttacgccatctaatttggaattaatcgatgattaatcacaatttttgtgtttgttaattcacaaagctggcaaaatttgaatttaaaaaatgccaattttttcaaattttattgttaggcaaaacattttcatttctacaaaaaataagaaataaaatataaagtcgattttttcaacaaataaaaaatgtaaaaaaaaaagttttgcaaaaaaataaaaaattgttttttttataaagattttggaagattaattttaatgacttgaataatattgcttcatgcaattaacatacattttatttgactttttattattttttaatacctttaaaaaatgcactcaaaaacaacaccacgaacacctcaatgatttgagtaatcaccaccattttttgctgtaaaaaaaaaattaaaaattttattttaatttttattaatgcgtaaaatatggcctttattatttatgtctaattgagcagcaattttttgttaatatttatgctgttaaatggcaattaattattatatgctgcaatcgatgcgcatgttcaacgtttgtttgtttatatttgctgctgttttttggcgtgagatggcattggcattttaaaagcgccacgtgcccttctccaatccccccccccctcccccctccaaaaaggcaaattaggaatatttggatgagtgcaacggaattccgacttccgacgatttttttttgttgagttggaagcatgatttccgataatgcatgaggttggaaataaaacctttgatgctgatcaaaaaaagtcaattgcacacacaacgtgatcagagaggaatgtgcgtctatgtcgaaaa

SEQ ID NO: 9387 - DNA, 702 bp, Heterodera glycines
cccccccccccctaaaaaatgtatgatcgtcagtaaatttcaattatccaaacgacagaaaatgatggtcctaataaaccaaaagaacatgttttatagtttaggctatctggtattgaaaaaaaaacttaagattgagccctctcccgcctttcggacataggcgcaaatgttggggggtttttgcctccaaaatcgcggtttttggtcttctaatgttcccccattttgaaaatcgcacatctggcagcccttttctgaacaagccctaatccaagttttaattttatccgtctgattttcggctggctctgttcaccaattaatcctaaacccggcaaaccctagctgttgttgcgcgatgaacacatgcgcgcgctacaacggatcagggttgttccgggtcacccgaatcccgacccgatatttttctcgtcccggaacaaccctgcaacggatagacctgtgaaaattgggcggaggccgttttacggactgtgaacaatggaaagtgatgtgaaatgaatccgtgatgctcatgcatacatattttttcactggcaaatgccttccccgcccctctcattttttgttcccatgcacttttattggctcccggacaatcggaccagcagtggacattccgacagtaaaatacacaaaaagataagaaaatgccgtcgccgaagggaactgattgtg

SEQ ID NO: 9388 - DNA, 2031 bp, Heterodera glycines
ccagtgattgaaatgcaggagaatgagtcccagtgattgaatgctgttgggttgagtcccagtgattgaaatgttggtgggttgactcccagtgattgaaatgctggtgggttgagtcccggcgattgaaatgcaggagaattgagtcccagtgattgtaatgctggtgggttgagtcccagtgattgaaatgcaggagaattgagtcccagtgattgaaatgctggtggttcagtcctggtgattcgaatgcaggagaattgagtcccagtgattggaatgctgttgggttgagtcccagtgattgaaatgttggtgggttgactcccagtgattgaaatgctggagaattgagtcccagtgattggaatgctggtgggttgagtgccagtgattgaaatgcagaattgagtcccagtgattggaatgctggtgggttgagtgagttccagtgattggaatgctggtgggttgagtgagttccagtgattggaatgctggtgggttgagtgccagtgattgaaatgttggtgggttgagtgccagtgattgaaatgcaggagaattgagtcccagtgattggaatgctgttgggttgagtcccagtgattgaaatgctggtgggttgagtcccagtgattgaaatgctggtggttcagtcctggtgattcgaatgcaggagaattgagtcccagtgattggaatgctggtgggttgagtcccagtgattgaaatgtaggagaattgagtcccagtgattgaaatgctggtggttcagtcctggtgattcgaatgcaggagaattgagtcccagtgattgaaatgctggtgggttgagtctcggcgattggagaaaaagccaagaaaaggatgcgaggccgcgaagcggccgagccagtcgatttatcattcataatcctataatacaatcgtactacctagcgggggatgcgccgaaggcgctgaccccgctagttttataaaagaaatgtaagctcctacgtgcaaagaactgccatttgttattttgttgctactttatgtatttgaatcgactttatagtatatttgaatttgaaaaaattgaatattgttattttattttattttttccattaacttttcttttatgaaatataaaatattacttgaaacttttttgcattcgcctcttcaggactgaataaaagggtcccaactttctttcgtcatttcttccgtccaaattccatgcataaaaatgtttggccatgaatttctcctcagacatttgttgtcagacggaaagagatggacaaagaaagagcttttgggatttatggcactgctgttgggtcgctcaatggcactttgtgccctctacaaacacttccgaaagagactttttggtggaaggaagggaattggccgaaaagaatgcgtttattcaatcttagtcctttacttcgtttgtttggtgcggtgttttttcgtacaattttaaaaattaaattaataataaaataatatttttttggtactgatgctcattttccaaatttaaaaaacatataaatttatatttttttaaatctaagtttggtgtccattttcttgaaatgaaaaactttctctcggtgtcgcattttcaactagccctttattcggacagtttctttttagaaaaccgttcagattgttaaaaaaaaattgctgcctgtcgcctttcctttggtccttccgttcgtccatccgtcgatgtacggctccgtctctcggccgttgtccccttcctcttccccctgctcttcctcatcctcctcctcatcatcatcctcttccaccttctcttcctcctcttcatcttccttctcttcttcatctttttgtgccatcaatttgttgcggttcaattttcttccgctatttttgctgcttttgcccatcttcacgttgtgccaacattctgtccatcattccgccgcttcctttgtttactcaacggacagcgacggctcgacaaaagccgccgccgcggcatctgcagcggtg

SEQ ID NO: 9389 - DNA, 1320 bp, Heterodera glycines
aaaaacgcacccaattgaattgaccatcgattcgggctccatacgtggcgaatatttggtttggcatgccaatttgtcattgaattctctgtctctcccatagacaattggtgccaatgaatttgccgtcttcaaaggcattccgtacgccgctccgcccgtcggttcgcttcgttttcaagtgctccccccccccccccgctccaatttgcatccattcatttgtcagatgcccgaaccaccggccaaatggcgtggtgtgatgaacgcgtcgcaatatccgccggtattcccttggccattgctcacaaaaattctgatcaatgccactgtgcactctttctctttttttcagatgtgtgcccaacggcctcgcgatcggaaagtcgacccggtgaagctgtacaaaatccacgtgtccgaggactgtctttacctgaatttgttcgccccatcccaggtgatgtcattggcaaatactgtgatttctctactaattgccatcaatcccttctgaatttgccgctttcattgtcagttcactaatgacacttatccggtcatcgtttgggtgcacggcggtcgttttcagtacggctccagcgctgactatccgcagaatgccatcctcaacaatttcgtgtcacgcaaagccatctttgtgtctgtcaattaccgactcggaccaatgggtaaatttcattttttaatcggctatttatccaattctatcgaaacaaataaatttttatattaaataaaaaatttaataaaaaaattaataaatttaataataatttttattatgtttaattgaattttataaaatcgcttataaataattaataatgaatttaatttttcctacaaattacttggccaggatttctctccaccggtgactcagttttgcccggtaatctcggcctttgggatctgatgttatcattgaaatgggttcagatcaatgtaaacattaaagcttcgaatgacgggtttagtcagttttgagtggccaaattggcaaatcttttcaaaaatttaacataatcaccgactgactacgctttttatgcatttgcgttgaattttaccaatgccaacatttgaactcttttaggcccatgtgtttggcggagacccaaacaatgtgatgatggtcagtgagagtctgtcctatggaatatttcgttgttattttactttatttttcatttctgatgggccacgggtccggcgcctccgccgtttcgctgttggcactttcaccgaaagccgagggcaagtcgaaacgaatgaatgaaaagagaacaaaacatt

SEQ ID NO: 9390 - DNA, 2244 bp, Heterodera glycines
acgaaaagaatgtcaatatgaccgatgggctgagtgtgatggtggcggagcaattagtggacaatttaacccaggggttctcgggattcaccaaccatcggctgatccgcgagggcgccatgcacgaatacgtgtggacgagggtggacccgtcgctgaaagtgtcggcgttgaacgagtccattttggaggtgcactcgtttaaattttgaatgccaatttcggaacggagaaattgcctttgggtggcgcggggggaggggggacacagcggcaaaatgatcggcttattttttctaattatttttccaattaattaatgctctcttggagatggattaaatgccctctctctctctcttctgctcggatcggtactgattgtgattagaaagactaatgacgggcatttgtcggttaggcattttattttgtattgcccccctcaaaagataagggttttccgatcggatatattcttggggacacaaagttcaactttatgtcaacgtttcaaattctttggacccaattcgcagatgttttcccacttttggttcgattcgcccgccgcccgtttggccaattattattctcgtcaggcggtgcccgtctttttgtattcgtttgatcacgtcagcgaaaacttcgagacccaaagtgatcacagcgttactttactttgtttttttgcaattgactaaaaaataccactcttttggccttcgacctataaatttacctaaaaggcccaattttgttttatgaaaaatttaggagttttccacggatgtgacgaaatgtttctgttccaattggagcggcgctttctcgagacgcgcaaagaccgaaattggcaattggacaaacgggtgaccgaactgtttgccgaaatggtggtcaactttctcaaatacgagttcggcactcccagccgccccccccccctccaaaatcgttcatttttagtgaccccactcccgaattgggccgtttcccattcaattggacttcgtccacctcttcaaagttggactttctgtccatcaccgactctcccacaatgaacgtcggcttccgatggcaggcccacgtattctggaacaaatatggtcattcattttgctattttttgcaattgacagtttgcttactgtaatttgtaatacaatatccattctccgttcaaatggcactttatcttttgtttcagtcgaacatttggactccgtcgatgtgggaaatttgcaaaagatcgcttatttggacaagcaactgggcgattatcaggtgcaaaaatgcttatggcacaaatgagacgacggccaatcggaaaaatgccgaaaaagtcgtaaaagcaacagaacactaaacataggcagaacctattgatatgtacatttgtatcttttttatgatcactgattagagggtacgaaggtgtgggttgtttttatagctcacaattttgcgtttttgcgcaaccaaaaccaattgtgtccctcctccgccgccgctaatgcttttcggtcggttattccactgatcagtgatcactgatcagtacagcatcccttttttccgggtttgagtgggttttctttttatcatgccaataaatgataagggcacgtcccatccatttgtgccgtgccattttctgctcccattttcagttggccacttggatgcttctgttctgttcacttttcttcttcgccatactcgtcggcttggcctgctattgcactcggaaggaaactgacgaggacgaactttgatctttgttcttttttcgtcctttttgccccctccgtttttcttttttgtattttttgccgctttttctcattctttccaatttcaatgtctttcgctttctttttcatattcactgccttttttgagtgtgtatgtcattttataataaacagcgaattatcgcattttgttcatcatttgtccgtcgtccagcccattctttgaactttcgaaaaataatttgtttgcaatatgaaaatcattgaaacgactttctatcgccccgggggaatgtcttggcattctgccaacctttgtctccattctctcacctctcacgcttttatcttagctctgcttcttcacacactcaaacacccactcagccagcatctgttgccttctcaagcggctgtcagcccccggccggggtggtgagggaggtcggttgtcgtgtcccgtggttgggcgccggtgggaggg

SEQ ID NO: 9391 - DNA, 3331 bp, Heterodera glycines
tcttcactttctgttcctcttccactttctcttccccttttctgttcctcttccactttctcttcctcccgtaccccctttaaaaacttggacccggacccggcttttctggacccggaaatatccggacccggttttgcccaaatacccggattcgtctaaccctaaaattaactcattttgagatttataaattatttaaatatttattaatatttgtttatttttaatttttattcgattaattttaatatttaatttagactttattattctattaattaaaaatatttattattttattaattcaaaaaatcattatcattaatttaaaataccataaagttaattaattaaaaaaataaatttaaaaaaacaaaaattagaataatttcaatataatatttgctttaaaataatcagaagaaatgggactctaacccatggcaagccagcaccaaaggaaggcacactaaccacttgaccaccggatcgcttgcctccttttaatttccttttcactttccttcttttttggcataaaatatttataattttatgtttaggtaacttattaatttgtctccatttttaaatgattttgcacaaaaaaggtcaaacaatagatttttgggctaaattagaaagaaagaattattatttttaatatttaaaataaattatttttaataaacttaattaattttaaaaaaataaaatcattcaaaaaatttaataaaataatggatgaaaacacccagaataggtgggacccgaaccgtcgaccaccaccaccaaaggcaaaaactaaaaatttatgctattaaaacagcaataatttagttggaaatatttattgaataaaagtaggagcagtaaaaaactgatgatgtaaatggaaacaattgataatgaactggggaaagaaaaggaggagacattttttgcttattgaaaaggggaggttaaagaccactggcgagcgtgcattacatataaaaaaaggaaagaaaggaaagtaatcaatttttattcaaaagtactttgctccatattttttattatgcctttctttctcttttaactcactcataaaattcttataagaaaaacattaaaaacaaattttaaaacgaataatttatatataatatttgacgggaaaatccaataaattaatgagactcgaacccacaacacgccatgaccaagggcaagcacactaaccacttgaccactgggccgcttgccaccacgcattttaatgcccttttcccttcctttcttttattgcaaaaagctcgaccaaaagtgcataattttatttttctttataaaatatttagattttatttttttttaatgttatttttgtatttatttaatattcaagttattttaaatttaattttaaaaaattattattttataaataaaaaaaaattattattttattttaataaatttaattaattaaaaaaacaaaaaaataaatctaaaaaaaaatgaagtatttaaactaaatattgaatagaaaacaaacatcagaaatgggactcgaaccctcagccatcacagaaccaaagtcaggcacactaaccacttgaccactgggtcgcttgtctgcatcctttttaattcccttttccttttccttcttttttggaagaaatcccgatcaaaggtgcttgaaatccctttttagagcatttcccggacccggacccaaacaaccctggtatcattcgaaagccaagagtttgtagatcatgcgaaattgtttcattttttgatttgaccacttttaaggcatgcaaaaagcgttcaaaaataggacaaccaaaaaaagtgcaaattttgactcgttttccgaacgcagttcgaacaattcttaaccaattgggatgccgatagtttttccttatagccagtccaaaaccctatcgaatgataccactcccgacccgtaacattcggtagaaagtcttaaattagtttttaagcttgaaactggggtatattattcttatatagggaataatgaatttgtggaccgaagtaaagaataagcttatgtttgtttctcatcattcggctcattttatcttttaaatttccaaattaattaaaatttaagtcggcgagtcggcccgcaaccgttttggccgcccttacatttcgggacggccgctgctgttgtgcgaccggcagaaaatcatcaaaatgtaccgggagggacgccgaaagattgcaatcgcacgcgaaattggcgtcacacattcatgcgtttccaaagtgatcagaaggtaagtgagtgatcggagatgaccacggaagagaaaagacggccaattgagacggattcccgcagatttgaagagaccgggatgttggagagcaaaaactcgcggaccgcctcttgcgcatgccccggcgacgcggaagggcacggtgagcgattaaaggcaaattgggaattggcatttgcattaagccagctttttatctgcacattttttgtccttccttctttgattaaatttttttccgtcccttcgatttttacaaattttactgttttaatccatttttttaaaccaaataaatccccgcttagacccgcgcatttgtcggcacgcccgcttcgtccatttcgccgcttcgtcctcctccacccaattgccttcgtacgaaatgaataaaatggcacccaacagaaaaccaatcattcgaagcgatttgccgaagaagttcagcatcgaatggtttttgatcacttgaattgcttagtaattaataacttattaactcaattaatttggcttattaaacgttaaattctttttttaggattctcagtgatcattgagcacctaccgtaagcattggtccatcatattgtattttttgtctcaatttattatttattgcttatcttttggaactttaataaataaaatatgaaactattccaatttggattccattatgaaaattttttttgcatttcaaattttaaaaaccaaaaatattatactgaaatagtagcacattgtttttctgttgtttgaatagcttttaattcagcagttggagaagtaaagccctttcgtcgttctaataaatcctcaatatttaaataattttgctaattaaccaattcgttgactaattatcatctgccaatttttcgaaatgtcttcgaaaggcgcaaaaaaatatttttatttaattgctttactcccaattttatgtttgcagctttttctttccgccaatggtaaatttgttcgttggttttttggctaataattctttaataggcctattt

SEQ ID NO: 9392 - DNA, 2341 bp, Heterodera glycines
  misc_feature (19)..(19): n is a, c, g, or t
aaagtaggagcagtaaaanctgatgtaatggaatcattgataatgactgggaagaaaggaggagcatttttgcttatgaaaggggaggttaaagcccactggcgagcgtgcattacatataaaaaaggaaagaaaggaaagtaatcaatttttattcaaaagtactttgctccatattttttattatgcctttctttctcttttaactcactcataaaattcttataaaaaacattaaaaacaaattttaaaacgaataatttatatataatatttgacgggaaaatcccataaattattgggactcgaacccacaaccaccccatgacaaaggcaagcacactaaccacttgaccaccgggtcgcttgcccctccccgtttaattcccttttccttttccttcctttttggaagaaatcccgatcaaaggtgcttgagctccctttttagggcacttcccggacccggacccaaacaattttggtatcattcgaaagcccagactttgtagactgaggcaaattgtttcgattttcgatttgactatttttaaggtatgcaaaaaacgttcaaaaatggaacatctcaaaaaagtgcaaattttgactcgtttttcgaacacagttcgaacaattcttaaccgattgggatgccgatagtttttccttatagcccttaaaattccacgtcgattgaccccactcgcgccccgtaacactcgctagaaaggcttaaattagtttttaagcttggatcatgggtagattcttcttatatagggaaccagggccctgcgggccctgtgaaagcgccgggggcgctttcaactctggctctagtgggagatataatttggggcgtgcaaaaagcatctattggccgctaagcgatcctcatagtttaggaatatgagaatttggaaatgaacaaataattaatttaaaaacgatattgttttaaatttaatttaaatgcgatatttttatttatatgctttctcttccactttctgttcctcttccactttctgttgctcttcttctcttccgctttctgttcctcttccatttgctgttccccttttccttcctctttccttcctctttctcgttctcttccactttctgtttctctttcactttctgttcctcttccactttcttttccactttctgttcctcttacactttctgttcctcttccactttcttttccactttctgttcctcttacaatttctgttcctcttacactttctcttccacgttctgtttctcttccatttgctgttccccttttccttcctctttccttcctctttctcgttctcttccactttctgtttctctttcactttctgttcctcttccactttcttttccactttctgttcctcttacaatttctgttcctcttacactttctcttccacgttctgtttctcttccatttgctgttccccttttccttcctctttccttcctctttctcgttctcttccactttctgtttctctttcactttctgtttctcttccactttctcttccactttctgtttctcttccactttctgtttctcttccactttctgtttctctttcactttctgttcctcttccactttctcttccactttctggtcctcttccactttctgttctcccgtacccggtttaaaaacttggattcggttattttacccgaagtttccgtaaaaatacacccctaaagattgagttttcaatgtgaaaatgcacccttagagatgggcttttgataaacttaaattaatatatatttattaattttgtgttttcatttttttgtttacacgcatggtcgagtggtagtgctctttgctcttttcattatgtttctttggatcagttcccatccaagtactttcttttcttctaatttttcaaaattattcttttttcgacggaaatttaatataaatttaacaattaaaatcgcaaaatcttttcatttttgaactaaatctgtcactaaaatttcaaatttttcccgtcggcgcctatcggcaccgccggagttccaaaattccctttattttttaaattgactcaaaaactgtgagtattctaagaattataaaaatttagaaaatacattgttaaaaaaaaatcattatatttatttatcgaaaggggttgttggttggtctatttgatatttaaccgaaattttgtgatgaaaaattttttggaattaaaaaaaaaattttgaaaaaacttcggcttcggcttcgaaaacttcgggttttttgggcttcgagcttcggacttcggcttcaaataaaaattgggcttcgcct

SEQ ID NO: 9393 - DNA, 3943 bp, Heterodera glycines
ttttccgaaaaaatttcagcccggattttgagacatatgcctataattttttttttgctaacttgctatggcctaatacgcacgaaaaacgagtttttaatgatgtaagagacttttttgatcattatcaaaagttatataaataggaattttttcagaattttgggtaagctgtgaaatagtttttcaagtttgagtcaagactttttccgaccctttttttggtttcgcgccgaaacgacccttgcgccgaaacgacactgcgccgaaacggctgcgccgaaacggttgcgccgaaacggtcgcgccgaaacggttgcgccgaaacgatacagactcttctctatttcacttgagaaaggagtattccaacgtttgaatctttttcttttgtttcttatgttttgatcaaacgaatttttctcatttttcattaattccttaaattgttcctcaattattgcaaatccttgcgcactaacacgcaatctttcaccacatgactctaccttttttgaattttgatcaaaaactaaagcccgattgttatcatttgacatccaaatacctgggacataagtgccattgatttttgcttcccttttataaacacaagttttttcatcaaaaagatttttaatgtttttcttaatctcccataaaagataaacaccattttctaactggcattgtccatctgagtatttacaattctttgtatcatctgctggtgaatgtattatgtctgaccctggggttccaaacaaagtgatttttgacaaaaaacaattttcggactcggttttttggaacccaattttccaccatgattgttcaatgattaattttttgttggtgtgtttttggccaatttctcctgacaaaacaccaaactcacattttttgtaaattgccatttgatgacaatcttcaaaagtggttggtaaaagaatttgatcagggatttcttcaattttgtacccaaataaatcagttctgtatttttgtgtttgtctagtttttatgcatctccaggcctcaaattgaaaattatctgggtttggccgaaataaatctagcattaaagctcgggtgggttgttcaagaaatctactgatttttccgcacgaagaggtgtcccttttgaattggaccaattttgtttgggctctattatggcaaatcattggttgggtggctacacagaaatttattatattgataatcattaaagcgttgaagaaatatttttgtgaattaagaacccattttcttgacttactcgcactgtccattggtgtgtttgcctcttgtccttggactaattcctgatcagatattaaaattctgttcaaattcaatttttcttcgataatttcgtcattttcctttccttttattgcttctaacagcttttttgggttttgaataccgaattttaatttttcccaagttgcatgaaaagcatttttgattttgctaaatccattttgtgtcacactccttgcgacattgaaagcaccaaacggctctaaaatgaataaatgcattttcatttcctgagcacttttctcccaaaaatcgatttttccttctttcatattcaatcggctctcttcaaaattgatttttgtataaaattcaaaaaatccaatgagcagtgatgaaatgctctgggaattggttgtctcccaaataagtttttgtttcagtatttcaaaaatttgtttctttgtgtatgtgatatttcgaatttcaaaaatttctggtaaaattttgattaaatttggtaaaacgggattaggaatttttatcaaataaaaaattaggagcgatgtccaaccataagaatttaaggtgccgcctccattagcactttgatgaatttcaaaatagtcagcccattccaaaatggcaaaatataaagttttaaatcgtgcatccaactgcacataacatgccaaccatttagaattaattaatccaatcaagttattgcaactaatttgagcattaatttcttggtcatcagaatcaattgtgatttccaaaatagagacatttcgggaagggattatcagagtccgggttaatgccattcccgattctcttaactttttccgcaatttgtcaaaaaattggcaactgtcgttttttgtccaatcattcggtattccttttgagtttatcataactaaatccaaatcactttcttttcttccaaggccattgtatatgctcccttggataaatacattcatgtcccaattttctttgacaacttctttaatccgagtacattgtctcaaaatattttcagttttgaaaacagagattttcctgtcgttttcaatctttttcaaaatttggtctaaatctttttcatttatttgatttgtgggccttttttggtttaccgtacccattgggttaagtttttggcgaatgtcttctaacagacgaccgcacatatttttgcctttaaatccttggtccatgtttgaaaaaattagctgtctttctctaatgtcaattccgatgccccagctaagattgactgaggcttcatataatggaagctttccagtttccaacaacatttgaccaaatttttcgttttgtgtgaattttgcccataaaatagggcgaatgacaccttctcgaactctattccattcatactgatcaaaagatttgggattttcttcaagcgacttatattggtccatgtctttgtctgtaaattttttgaattcactgggttctgtgatcccatttttgaatttgatcatttttgccaaattaaaataaccaaaatacgaggccttttcaaagcaatatttttgttccacattatcccatttaaagccatccatcataaaagaagacggatgaaaattggaaaaaacaaaatttttcccgaaaaagaaagctccttttttgcctgaaggtgaacttaaaacaattggtttccaatgtggctgataaatttccttattttcatttttgaaaaatgttttgacgtccaacggttctgtttttgtagtttcacattttgagtttacccaaaattttgttcgttttgtgcacaaagggccttcaaaaatgtcttcatattcataatttgattctggagattgagactttcgttttactcccaataccacaaagggatcaaaattttctgattggatttttccaaaattttcaccttttttcggcatttccggagttgggaagaacattttagtagttgttggcaaatatgatgaaaaatgtgtcggcacaaatgaattgtgtgaatggcttcccgcggccttctctctgcgtccattccccaattggttccaattcactttctgtgcgtttgttgccactgtctcgtgccatttttgttcgccccttttctcaattggcattccaatttgctccaacttcgttaataaattgttgatattttcttcttccggtactcgaacaattgccggaaaccttttcttcataacatgaattggcactcctttggggacaacccaaatgcatagcagttcgtaacatatttcttcaacttttgttagaactgccaacagttcagcgtccatggtttctctccatatcactatgcattgagtaattgtgccaatttcgatttctgtgccaattgtgttgttgtcccactttctcgggcgaaaaaccattgctttcatttttctttttctcatgatttgcctcagttcgatttccacttgattatccacaataaacaccaaaattgaccgtgccaccacttttggaatgttttctgacacataattccaagctttttgttttttagaatccaccaacagatcctcaggaatttggaattttttggttttttcctctaacgtatttttttgaaaattttgttgatcctctaacgaatcttttccaaaattttgtt

SEQ ID NO: 9394 - DNA, 5477 bp, Heterodera glycines
  misc_feature (24)..(24): n is a, c, g, or t
ttgtgccgcgaagcttgcattacncatcgcgttattcttttccgatttataaattcgatctgattttttcaatgatctgggtttaggagaccgcccaaaaagactcgcattttaaaaatttgaaaaaatttacggaaatatttttgtctgccattaccaattaatcaaaaaccatgcttttcaaattttaacgcaaattttaacgcaatttttaaaatgtttttcttctttcctcttacagttattactgtgagaaattgggcaccggattttggcgagtggccgagtccattttgccggttacgatgaatctcacgcaaaactcggccaaagtgatggccacctcgggccaaatttgcaacttttacatcaccaaagtttgctcacaaattgcttaccgccccaatgtttggccatgccataattttccgtcattcagaacattcagcacccaaaagtactgtcaatcattgtgagtcaggccaactcgaaggcgaaggagatcagacggtttgtttacaaaagcaaaaattttaaaaaatattttaaatatatatttttttcaattttaggacgacaatttcgatggttcagacgataatcgctgggtgggacgtgtccattctcgacaagcattttcctgaactgctgcaatgcgtcaagttggcgctctgcgacgcggactcggaggtgcgggcgacggcgcggcaaacgttcgaaagtctgcaagcgttttacccggccaaagcggacatgcttttccaggtgggcgagcacttaggggacacaacgattggtgccatgggccaacccttataattagctgtagtggaacccttaaaaaaccaaaattcctcggctttcaaaccgacagaagttccattttaaaggagttggagccggccaagcagcgccttctcgtcggctcaagcaccgcatcatcaacgcattcggtcaattctgaacgggacaatcttccaaatccgaaccgcggcctttacaatgcacagaatggttggtttggtttttcgcattgattcgtccgaatatttcatttttatttcacattaagccttcttcaacaaacgctctgcgagtgatttgaaccattccgttcgtcggctgaacctcgccttgccaaaggtggtccatcgtccgaatgtcgtccgctgcggcaaaccgccgcgtacgctttggcactcatttgttttgttatggccatgcaatcccttttttgctttttgtagagccggccacacaatccgctttgcgaccggcttatccccatcatcctccgtccgccgccgccggaacaccggtggcacggaagattggcccgtcgtcgatgggcggaggagcggcgaacaaattgcaaaagtccatcagcacaacggacgcaaaatcaacagcatcgcaatcgcaacgtaaacacatacaattagtcaaaaaaaagagaaaaatgtccggatcaggttgattcccccagcgttgccgcccccctcccgaaaacaaataaatttatctgaaatttttcaaacaaaaaatcttataaaaagttttttgaaaaaagtactgcgattttttcaaaattttagaatgatctactaattttttcaaaaaacttcttaaaaatcgctgaaagtgaaatttcttattaaaaaatttgctaactaacaataaatgaaaaatttttcagggggaagggtgaaatgaagtgctgccaaatctgtcatggaataatttcccgttatattctaaagtaaaattaaatggagggggcgggagggttttgccgaattttcaaatttttactatattataattattgagagaactaaaaagtcggcacatttttcctccccggtacattcttccaacaatgccgttttgtcatttttaagccggcagtcggagttcgtcgccaggccgcgctcgtcacccgcctccacgaccgcctcctgtcgctgctgctgctgctgccgctgcccatcacgcgccgattgcggccgcgcgaaagctgcagaacggacgcgaccaccacgacattggcaatacgccaggcaattttttgttttaaaaatcctagcaattttaaataacgaaattattttagtaaaatcggccgcttcacatggacaaccaattcacaaagactttgttcgtgctttggtcgtacatttttcgattcctttctcttctgatttcgctcctttagaaaaacgtggacactcaggcgagggatgtccgaccaaatgacatacggttggtcatttttggtttatttgggccatttattcctggacatatttcaattaagaaatgatgatctgcccgcagcaaatgtccgttctccgccgaccgtgcaaccttcgcatcattttgcacgtaattctttgtcaaatatgccaatttgattaatttaggatgggataatcttatgcaatttgggttaatgtcttgaaatgggatcactgttcatcggattcattaccacttctgcgttcgaaaaattttaacgattttaaaccggtttttttaaaaaactttcatagctcattaaaaaggaaaatcgcttgaaatttttttttggaaactttgtacatccatcgaagtcccatccgccattttcagcccgccccagcggcagtccgtccaccgatttctacggactctcacaacggcaggaggcggtgctgcagcggatcagttccgaggagcacaacacatcgggcggcagtgtggggccgtttccgcgaaagtcgtcggccaacaattcgttcgtcagcgacaacaagcgcaacctgtctatgcgcgacagtgggggcaacactcttcagaatggccaacataaggcgagcgttttaaacggattgtcagtctgtcacactgcaatttatgtcgaaattcgttttataattaccagtttttagaaatgttttcccatcttttggtatattttgatatttaccgaggtccgaagggtgcacttataaaaaaatttttatgatcggcgggtgggaaacgaattgctccgaggttcgaatgctttttacgagtccattttactctgtttttcatttcttagcctatttactttgacttttttaatttatataagacaccaatttgcagtggtccttcctgagctccgaacagttggccaatgaccacgagcagcaaattgcattcatccaggaaatatgtgacacaattggggccaatgcagtgacgtaatattcacattttgtttcgttttttaatttgtcaaaatttagcaatgaaaaggaaattgaggaggctcttcaagtgttgtcgcgaatggtaaggaaaagcaacatttgtaagcattcacaatcacttctctgttttttaagatccgcgaaggagggattacgctgtggaacgattattttaacacaattttcttcgccatccaacagatcatttctcaagatttggagcgtcactttaacatcatcaaaatctcggcacttaaaacactcaaagagttgtggtgagttggcatttgttgagggggggggggtgattaattagggaccatttgccaaaccaattatgaatcatttcattaggcactcaattaaattaagagaggcggcatttctttttctatcccttttttcagcttggtccagccgaagcgtttggttgccaaaactgaacttttggtgatgatcattctgaatgcgcacgaatgtgaggatgccaccgtggtcagagcgggtaattctcacagtgatttgtccacttttttggtacaacggctcggcatatccgaactctgccccccccccccccgaaaattaaaaaatcaaataaattaggcgaaacgtatttgcttttccgttttgatgccgtaccccattatcctcaaatgcagactttgtgtcgcttataattctctcgccagagaaatttgcataaatatgaatgcgtcaaacgtttgataaaaaaacggggtgtgccaccaaaacgtaaaagtaccgaaacgtaatgcacccattcgtagattggtcaatttcgtattatgattgcatgcgttgattacatttgttccccatctccgttcttcagccgaggattgcggtgctgcggttgccaaccatttgccgaccaacacgtgcatgcaccttttgctgaccgtcatcgacgacaaacacagcaaataccaccaactgtcgggagcgatcaaaatgcttggaagtatgctctccaaactgccgccagaagaagtgagagagggaaacaaagaattgtttattcgtttcattttaacacatatttcaggtggttgaactgctccccaccgttgtgcctcggatgactcaggtaaaaaagaagcaaattggacacaaaaggagcaagcacttcatttaccccacgaaatttttatttttattttcaaaaagattctaaaaagttatgaaattttcagtcacggaattttctttaattttttctttttttgaagaatttctaagtgtatattttttaaaagttttttggatcgggaggggtggaaacgaccggctctgacaaaaaagtaccagcaaaaaaaggggggaggccgaatgggtggaattgccagaagagcatataaccaaccagtggcaaatgtttttcccattttctacaattttttcttcattttaatttattttggaaacggaaaactcatttacacttcccatttgatttttatgtgaataattcgttgattttcctccaaatgctctctcagtgctacgacaattcccagtcgatggtccgacgttcggccatcatttgtttggtttccatcagtcattcgattgggttgaatgtgttaaagccacacctaaacgcagcgacggttcgtttttagggttggggttaaatgagtttctattttaattttatttttgattgtgtccgttgttgttaagcttaaacttgtggacgtgtaccgcgaaagaatgcttaagcgatcggacggcggtgcgaacgcatgagaagcgaatgaatggataacaaacgaataatccgaacacagcaaaaccgtccaatcaaatcacttaccaaaagcacccaaaatatatttattttcccaattgcttttcctttttcttacgttgtgttgtattaattcaattcttgcattattttattttttggtgggaatgtccgttgattgtgagccgtgctcttcataatgataatgaccatcatttgtcttcactgttttgtctggttgaataaattttggaccaaagtgaataatagggggggggggtattttgctccgaatttaattattaaattgtccaacccaaaacactcactgctaatcccttgaaaatgtgccaattcggttcggggaatgtcgaatttttaatgcacaattatgttcaaacttttattttgacaaaaacaattttttgacaatactggagaattggtgttccggcggaaaataa

SEQ ID NO: 9395 - DNA, 3629 bp, Heterodera glycines
tgagcacaaaacctgaaagaagggtttgccttgggctcttcctcagaggctgttttctggctgccgcttgagatggcgctgatcgcctcatccgagatcgatttataagattgcagggcattgggcggtcatttcggttaaaaaaagaatgccgtgtcaatgagggtcaaaattacattcttcccgcttgcattgggctctgttttgaatttttcgtatgcattgggctctgttttgaaccactgagctgacaatgaggccatggaaatgtagcagtaaaaatttgccgctgagctctgtctccggcggaccgatctcatccatgttgcgaacttttctcattttcttttttttatataaattgtaaatgaaattcgttttcagtaagcgtcgtcgctctcgcagtcgttcgccattgcctcgtcggtcgcgcactcgctcaccaccgcggcgctcgcgttcccgttcgcgttcacctcgacgccgcgacgatgacagtcgttcacgttctcgctcgcctctgcgccgttctcgctcgcgcagtctgtcccgttcgcgttcaccacgtgactgacagagtgaacagccaacgaattggagagaaaagtcgaatgatgaatattttcgattacaaaccactttatattattgtttgcatcattcgaatgcattcatttccgtggtttcctttaattgtggacatacatttttaatgaattaaacgaaaatgaatcagcgcaaccgaaaagtcgcatttaaatttctttgttgatgtattttatgtttcaattaggccgtgccttagtcgggtagaaatggtttcgaactgatgaagacggtacttgtctgatttcgttgggtttcgaaatggttaattggtgctgcttcaaattttggttttgctttcgacttttgcttgcttccatcgcgcacttcaattggtagaaaaattcctcaatttttgataagacgaccaattgatgagtttttttaggtttgccgccatttatgtcaattgcattttctttacattggtctgttttttgttagtgaccggtattattttgcacttcagtggaaatcttatgacattttgtggttttggactcatttggctctttgtgtttgttttcctgcgcttcgaccgaacaataatttaattgtcttcgtcaaattggttagagcaaaatgcacggatcactccagcaaaaacggggttttgaagggcaaatttggagtggacaacaaaccgatcaaaatcacagatttggagaaggctcgcgcaaaaaaggaggaaagtgagcagaaacttatggagaaaaaggagcggagagaacgaaagaagcgacaaatggccgaattaagggaaagagcgcggattgaaagacggtgagcgaaaaggagggggaaaaggcgggcccaaagtggtaatttaaattagggatttaaatacattaaatgaatcacagacatattgcaaataggtcggaatttgaaaattttttcttagccgtaaaaactttgctggtgccgttgatttgctgctcacttattgtcgtctgatcacttctttcgccgttttggtcggcaacattcacaaaacgttcattccccgctatttggcccctccgctggagaatgtctacgacagtcccgaccttttgatgtttttcacgtaggcgaaaatcttggattattcggaatttaaaattttctttctaaagcataacacttctcatcgacgtcggctttttctggttgctcgtcttttggaggtgctaattacttttcaccctcttaattggtgtctctctctttttcagctattgtcagcagatggccctctgttgtcggctcggcttttgccgttttttgctttggtgcgttgctttggtttttgttggcggtggactgatgctttatccaatgcattttgttcatgaacaattgggtctgttgctcatcctttagtgggtttcgttattttttgcccattttcttcagatgggacgtggtgcgaatttgccgagggggaacccttaagcgaatattttgatggataattttactaatttttgccatttttaatgcccattgcttctttttttttctcatattgtacgtagtcaagtcaagttgccctcctttaactttcctaatttgtgattttcacaatgatttgttcagctcatttgccctttcgcgctgcttttgcctttttaattgtgctagtcaacctcactaaaaacttaatttagtcttccattagcttgccatttacacattttttgctttgattttcaatcccggtaaagttttatgtattctcttttgaaaaaatcggcatttttttttgtctgttgtatactttcattaaaaaaatgattaatttatttaatcttatgttcgagatggcttcttcagtaaatggaactgaatctccaacatcggtgagaagaaataattgggaatcggacggtgaagagggcgacaattggaatgttttggcacgaacggaagccgaagaccggcaatggcgtaggtcggtggtccatttgctgaacaatgggtcgatgtggtgttggcttttaccttggctttcccttcagtcgtcgggaggagcgcgaacggctcggggcggtcggagtacggcacatttggggctattcgccaactcacaacgaattggagcgagtgtttgaggaacatcgaatcgcagaacgaatgctcaaggaggagctgaagcgggacgtgatttcggaaaagaatagaagtgagaagaaaaggaagcgaaaggaagcgagggaagagcaaaataatcagtccacgaaagaggaaacatccgacgagacgacggaagagtcatcgaaggacagcgaatcgtcggaagacaaaaagcgaaaacggaagaggggcagaaaagagagggggaagaagaggaaggaggaaagcaagcggagaaagaagcacaaaaagtcaaagagaaagcgaaagagcagcacaacgaggtgagagagcgaaaagggagggatcggtgacatcaaaggggtaattaatggacagagaaaggggttatcagagggaggcgatatttagcataattgaaagataccacctaaaagtgttgaagggattcctctcctcttttagcgggtcttctgacgaaacttcaaagggtggaggaaaaggcgacgaatgggtcgaattcacaaaggaaatgcaagtgaagaagagcaagaaagaggaggcagcgatgattggcccccaaattcccgaagatttgctgcagaaactcaacccgacgatggcacccgaaatgaaattggacgcgaggtgaaaatggagcgcaagttcaaccaaacattgctgttcagtgcccgtaaccatatgttgcgcggggaggccgcagcgatggccgcgtacgcggcgcaaggaaagcgcattccgcgccgtggtgaaattggactgtcttccaatgaaatctccacgttcgaatcggtcggttaccgtatgagcggaacgcggcaccaagccatggaaagcgactcggctggaggaaggaagaccaaattctgactgcggaggagaagcgattgctcagcacggtcactgacgaacagcggacgagg

SEQ ID NO: 9396 - DNA, 3570 bp, Heterodera glycines
  misc_feature (59)..(59): n is a, c, g, or t
tttcgcgccgatttcagcgggaacattcgatgcccttttgacggcactgttcgtcggcncaacggagtgcctaaattaaaaaaattaattaattgtaattttaaatatttattttaccgcattccaaatttcgatttcactaattttcagctgatcactttcgagaataatacataacaaatcttgattaatttgcaaaaaggcttttgatttgatcaaagcactaatattttgatcaatgtaacgcaaacagcggagagcaaaatcctaaaataaaataaatataatcatttagggattcatttttttaggcaagtgccgaaaattactgcttacttattacgctcagataaacaagcaaagggctttccgcttggtttgggtgtttacgattatgacttttataatgcttatttgtgttattggctcagtacttgatcctttcctacccgggctctaattattaatcacattgtctttttttctcagcaaaacatcaaagtctcattaatttgcgcttatatgttactaataattaaaattctttcttcacctccatcttcagcaacaaagcctgttcaaaagccacaaaaacatttggcaacttttgaattgaaaatttggcacattcttttaccaggccactgatgttatatttgtgtgctataattaaaattccaatttatttaaaattcaattaataaattttcaccagcttttaaaacttccaacaaattattggcatccaatccatcaaaactcttcgtataaataaatcttagcatcgttttgaacgcgccaatttcaatgtcggggatctcaatttgaccttcattgtaacggaacattgcttcaaatacatcggaagcactggagagaatcgctctatgagctgatataatctaaaaaaattccaaattattaaaaattttgagaattataattttagtacaaaaaaataatgagaatatgttaggactcgggtgggaatcgaacccgcgcctacacccaatccgtggatattcaaccattgagctactgaggcaaaatcaacttttatttttctggttcttataaatccagctttccactttttacctcgccagtctgcttcttcttagtaaatctataaaaaaagcttttccataaaataaaatttttatttcggttgatttttcaaatgcccgtctctatttgaatcatttgatagcaataaatgtttttcattagatgaaaaatccggaaaaaatctttctagctatttgaaattttttgaaagtttttatgtattgataataaatcattcaaaatttgcttttattaataaattttagaaaaagactcaaaaatcgcaaatttggcatttttcatttgaattggatattttttggtctttcaaaatttttcaatttttttttattttcatttgattctatcggttttttagttcgaaaaaacgattttgcatcatcgatagttgtaaatgtcgtcaattaaaaaaaacaaatttttttttgactcgcctcctttttgtcgtccttcccaaccaaaaactcaacatccgtatactctcttttcttaaacactttctccaattggtccgtcaacgaattgacaatttgtccatcgcttgtgccttaaatattttaaatcttttattaattgggagacatatattaatgagtagggatgcgatttttaggcaaatgcctaaaatttttgcgcacttaatacgcacagataagcacgaaaaaagccctttccgcatggtttggggtgtctacgatgacttttataatgcctaactttgcctatttcggggtttttgtgcctaaagtgcctattttagggtttttgaaaaaatccttaacaaaaatgcaataaaaacaaaaaaacccaaaaaaattttcagaaaatacaccctaagaattgtaaaatttttcaaaaaaattatccctaaatttaatatttttttcttaataaaaattttttggtttaaaaatttgttcatattcgaaaaaaaactttaaaacattaataatttcatttacaattgaaatatttaaagttttaacgtgttttgttacctaaaaagcgttaataaaaaattttatttgcctatttttgtgcctattcgggcttttttgtgcctatttaatgcctttttaggtgcatatttcgcgattttttgtgcctaaaaatcgcatccctataaatatcttatgaaatttttatttcgtgtcaaaaaacttttttttttaaaaagatttcgtgtcaataaaaaattcgaaatatttgtgacacacatacattgcaaaattaatatattagatagataactaaaaatttgtcttttggtgaaaataataaataatggcaaaattttcttatatattgaaatttttaaagcgaagaaattttttaaagctgaaaactttttcgtaattaaattaatatcttatttacacattcgaaagccacaaaataaagaaaaatcattaaaaataacatttttatggatacattttgaaaatttctattttagagcatttttttggcatttcataggggtgtatttttcgttttttagcattttatgattacttaactttgattaatgcaaaaaatatttaacaaaatcgtaaaaaagccgaaaaattatatatttttaaattttgaagtatattgatgttaatcgaagaattttcgctctaaaaggctgtatttcggcgtgcatataacaggcaggaagtatacatatttaaaaaatattaataagttcctccccaataatggtcattttatgtgtgtgaataggtgaatcatataaatgtcgtcactaaaacagaataaataaattataatgcaattgattttggttggcataattcccaaatcattcaattcattcaatattttcaaaagaaatttatatttcttaagaaaatggctaattttaaatgccttttccaatgcgctttttgcttcttttttctccgattttccgtaatcgctgttgaacacaatgaaaaggatttatttgatgaaatttggaagaatttaaataataaaacgccaaaagtgaagggatttgagaaaataaaagttaaaatggaaccacaaatggacaatgaacaaatgataaatatggaaaaatatggccaaattgggaagacaaaagtgaaaaaagaaaaatgcgaaaatggccaaaccgaaaaagcaaattattcgacacgaaagcaaatcaaaaaggaacaccaaagtgaggaaggaacggagattaatcgacaaacaaaaggtgagataatccaacaaaagcaactccctcacgagtagggctgcaaaaaatatggacatagaattcacggaatttaaaaatgctgattttcctgttcgtttcgtaattgccagaatgacttgaaattttgcaggaaaataccttggtataagggctttctctctgcaaaatttcaaaaaatttcatatattagaaacttttttacaaaaaccaacatgtttttaaaacttgaaaatttcacgaaaaaatttcgccatgaaatttacaagttt

SEQ ID NO: 9397 - DNA, 1709 bp, Heterodera glycines
ctctcttctctctcccccactctcactcattctctttctttctctcgatctccccctctctctctctttctctcttctccctctctctctcagtcatacatactcttactcacatttctcgacatcccacctcaccgccttcacccctcccacgatgtcacgatgtcattttcacaaaagttggagaattagggtcagtcgaaaccgatggcgcctcagggagcttttttgaaaattttgttcaagtttgtaaaccatcaaaacaaccaagaaaacgaaaaatacggtgaaaggttttacacaaaaggtatatcaaatgttacgattaattttgtaatggcattttacaaaaagagaatggcatttacaagcagcgaatttaaataacatttcatattactttcatattacgttggtcatttgtttgtttccatttaaggcataaaggaaaagtgtatttaatcacacggcaaaaacagttggcaaagtgatgggagccgatcgataggattggctcctccaaaatgctcgtccaatggatttgccaattgtgggctttttcgatttaccctgccaactcaatagaggcctctcattttggcaaagtgatgggagccgatcgataggattggctcctccaaaatgctcgtccaatggatttgccaaaattgtgggctttttcgatttaccctgccaactcaatagaggcctctcattttggcaaagtgatgggagccgatcgataggattggctcctccaaaatgctcgtccaatggatttgccaattgtgggctttttcgatttaccctgccaactcaatagaggcctctcattttggcaaagtgatgggagccgatcgataggattggctcctccaaaatgctcgtccaatggatttgccaaaattgtgggctttttcgatttaccctgccaactcaatagaggcctctcattttggcaaagtgatgggagccgatcgataggattggctcctccaaaatgctcgtccaatggatttgccaattgtgggctttttcgatttaccctgccaactcaatagaggcccctcattttggcaaagtttttgaaaatgtaaaaaaaaagtggaaaaaattatattcaatttgcaattgcattttaattattttttaatgatttccgtggtaatattcatacattttagcaatgctgttttgtaaacagaggatgatcgtttaacacagcaagaagttagaggggcatatttaagcaatttcctcttttctatttttatcattttctaaaaagaattatagaattttttccatgtaaatccataaaaaacgcaaatttctgagtttgtagggatcaatttttgaaatttctcccaaggaccgattccttaggctatattttttcgttttattgcatttttgttaagaatttcgaaaccaaaatagtgacaatggtattaaaatgcggaacccgctcagttgggcgccggcacgtttgggcgccagcatgtttttagctataacttttttctttgtcaaccaaatccaatattgttgatatcattggaaagctctaagtgccctctattagtctgcaaagttttaaaaaatttagtctaggttataagaaaagttatggccagaagaattcaaaaaaccaaattttccaacttttttggccataaaaggttcaaaattaacaaaattttttggat

SEQ ID NO: 9398 - DNA, 3080 bp, Heterodera glycines
aaaaaaattgggcacggcccgaattaaatgaagaaattttcggatgcggaagactttttaagcagcgccaaaagcattgattggaaaactgatagtgcggagagcagaaaaatctgcggagattgaaaaaatttggcacgaatgggtggacaaaaaggcattggaaaagaaggagacagatgatattttaaaattgctgatgcaatatgaaagtatttttgcgattagtgatgaagaattgacacaaaccaatctgatcaaacaccaaatcgacacaggcgaggcagaaccaattcgctgtaagatgcgttttgtgccatatgcctacagggagaaagtcgcggcaatgttacaagactatttgcaacgagatgtgatccgtccctcccattcgccgtggtcaagcccaatcgttctcgtgccaaaacgcgacggaacgttgcgattttgtgtcgacttcagagcagtaaattcggtcaccaggaaagacagttttcctttgccgaacatcgacaatacgctactaatgctgggagggcgtaaatttttcacgacccttgactttatgaccgggtattggcaaattcgtatggacgaaaattccatcgaaaaaacagcattttctaccgaatttggcctacatgagtttacggtaatgccattcggtttgtgcaacgtcgtagcaactttccaaagatttatgacgcacctttttgacggatacataaacaactttgtttttgtatatatcgacgacgtccttatcgcttccgactcatacgagcatcatttaaaacatttggtgcttgtttttgaacgaattcaggaggcgggactcaaactgaagctgtccaaaagccatttttgtgctaaagaattgccatttctcgggcatattctaactcgcgaaggaataaaaatggacgtcgacaaagtgcagccaattacaaaccttccaatgcctcaaacgcgaaaggaattgcattctcttttgggctttttcacatactataggaagttcatctattcctttggtaccatcgcagcaccactttttaaactcctgcaggaaaacgtcaaattttccattggtgaagtggaaaaagaggcaataaaaagtctaaaagaaaaagtcctgaaagacgtagttttgtacttccccaacttcgaaaaagcgaaaaatgacccctcgcgttgctttatcatgatgaccgatgccagcaaagttggactttcggctgttttatgtcagcatgacgatgagatgaaactgagaccaatttatttcgcttctcgacaatgcagcaaatatgagagccgttatgccgcaactgaattagaagcgttagcagtgagattcggagcaaagaaatttgctcagtttataacaatgctgccgacgagagtcctcacggatcacaaatctcttgtgcccatgttcaaaagcaaggaggagactggaaatgcgcgagtcgacaaatggctcatggaattgaattcgagatttatcttgaaagtagaataccaaccaggaaaaatgaatgtgattgcagaccttttatcgcgatcatttcaactaaacaacgaaggaatcgccgaaccgctcctggaggaagataaagcattaattggaatgataaaaatactgacagcggaagaagttgaagcgtcaattgaggagaaaagagaaaagtggagtcgagcatccgaagaaagtgaaatgaagcacatatatgaatttttaaagaaaaaaatcttcccggacgatccaagacaggcgcaaaatttgaaggaaacgtgccacaaatacacgctgctcgacggactgctttatttatgtgaagataatggcaaactgcgacttttcgtcccatccgaatttcgtgaaaatttggtaaagcaacgacatgaaggaaaatgcgcagggcacatgagtgacaaaaaactctttcttcaattggcagaacagtatttctggccaaatatgctgaaagattgcatgaaaattcatcaacactgccgaatttgtgctcatacaaaggaggcgagagcaaatgaacctccactgaaagtcgttagaacgtcagaaccattcgaattgctatgcatcgacattttggacgttggccccagtcagtcagagttcaaatatatctgtgtgatggtcgaccatttttcgaaatatttaatcgcggagccgatacgaaataagtcagccgaagcagttgcgaaagtgttggttgagaaagctattttgatatacggcacaccgaaaaaaatccattctgacaaaggaaaggaatttgtcaattcaacgattgaagaaatcgtcaaaacttttggaattgaacgatctctcacagctgggtatgacccccaggcgaacgggcttgttgagagagtaaaccgaataataatcgctatgcttaaaaagtcgacggcaagctgctggacatgggatgaacgtttgccgtacattgtgttcgcttacaacattacgccgtctaaaacgacgaaattttcgccattttccatgatttttgggaaaatcgctcgatttacgatggatggggaagtgcccttacaagtcaacccagcatacacaattgacagcgacacatacctccaattatttcgtgaaaatgtgttgaatatgctgaacgaagcgaggaaaaattctgatgaagaaagaatgagaagtaaaatttggtacgattcccagccgaaagtgacggctaacaaatttgaagcggggcaacgcgtaatggttgcctttcccggactgaatcgccgatctcggcacaagaaatttttgtggtctcatttcgggccttatcttatcctagaaattaacgaatcgtcggcatttttagtcccaattgacaacagaaatgctgagcccataaaagttccgattgagcgtctaattcgaattcctccaggaatcccggacatttcaacacttccaaaggggaaaaacccatttaaaaatgcgttaaaatcattaattgtcagcattttatcgagttttgaagtctgtgaatcagatggacaaatggccccattatgagcaattaggg

SEQ ID NO: 9399 - DNA, 1149 bp, Heterodera glycines
  misc_feature (1104)..(1104): n is a, c, g, or t
cgttcggttggaatgccaaagtgtgaggtcggtcaaggcgaacagggattttggtgccattctacatgtcgcagaactcgatccagcgcttggaaatgctgaattgggctcaatcacagtgaagacaccactgcaggcacttttggcggtgttccttttgaaggccgggactgtcaaatcaatgacagccgcaagaagtttcgtcaaatcaataattgaaggagcgccaaaagaggaactccatctgttcgtgaccaaaaagggagactatgtggcgacaggacaatgtccaactgaagaagaccaaatgaaggcgctggagtgttggttcgaaaagtgctccgtggcaaagcatgctttggaagagagcggattcaaaaaaatcggcatgtacgaacccgtcggactcaatcatttagccgattctgagaagaagaaatgggaagaagcgatgggagagacaccgtgggtgctggagaaattgagggccaaaatcattcacaaggccacaaaactgatcgccttgccacgtgtcataatcggagattcgacagcccaccaattggccgaaatcttggaccaaacggcggtgatcgggccaaaaaatggaacattggcggagacagtgcgaagcctgaagcccgtggtgctctccagcaaagtgaaggccgcactgatcattgtcggacgagattcactcttgggcggagaaaccattgcagtgatgatggagcaatacgagatgattgccaatttgtgccgccgattcccgcaagtgaagttcttttggacatgcccaccgtacgtgcacgacaaacacgacgagtacgaagaactgatcgaaagcttggtgccgatgatgagccaaaaaccttttcttcctgtttgggtgacagaaagtgacaacggatggactgatgaaagaggccggtttgcgagcgctgaaggcatggctgttcacccaatccgacttcccgggcgatcagaagctgaaaattcggtcaattcgatcgaccgttcgtgccgttgctacgataggtctgggggaccatcgccaagcaagcacttcgtctttggccgtaaatgactcgataggtctggggnaccgtcgacgtcacacaatggatcagttggacatcgcgatcgtga

SEQ ID NO: 9400 - DNA, 942 bp, Heterodera glycines
aacattcttcttatttatgaacataacatttacataatttttttgagttcttatgtttttgtatgggagagagaaatgaaaaaaatgaaacaaagttaaaaatcgatgtcaaacacaccgtttcaaaaaacgagaaatgtgtcaataaatagagagtgcagagaaaaaaatctctcattttggcgtactatttctttatctcagttaatagagaaaaactgatttcacttcatcctgtttaactttttttctacttattaaatccacaccaaatttgtataccgatagagaaaaattttctgcattttctatgctgaagttatttttgtctatgctctaattcaaaattacaacttttgaacatctatatctttttctaactcaccaaactgtctaacatttgcttcgaaaaagtttcggctctcactttatgagtccaatcaattgactttatacaataactttgttcatgtttgaataacccctatctttttggtagcattcgaaagcagaaagtctaatgaagctaaaatatataaaatctcaacgtttaggcaattacgaaaaaaaagatttgattaattaaatattgttgattattttcgtttgtaactttctttagctgttcgaattctcttgttttcatattattaccttattcagactttgtgctttcgaatgataccaaaaagataggtttagctcgaacatgaacaaagttattgtaaaaaaactcggtctaagattaaatttgcagatttttatttttacagtcatttggcatcaaataaaaatggctctaaaaaaatttccttatatatttccaatcctttggatgactgacgatttcttctacaatataatttttacaaatatctttttctaaaatattattgaaaaatttgttactccttaatatttttcatcgcctttcgcctttaa

SEQ ID NO: 9401 - DNA, 4178 bp, Heterodera glycines
  misc_feature (4066)..(4066): n is a, c, g, or t
tgcaggtcatgggaaataaaaattcagttttcattgtgcatcatcatcttcatttgctgctggtggtggtgggggtgcgttgaaaaagggcttttccgctataataattggcattgggcttcctcctgaaatgatcgcctgcaacttggccgagtcgggcaacccggacgcaactttgttcattgcatccagcaatttgtccttaaaatccattttgatggaattaatttttaattttttttggcatcattttgaaatataccaaagctcaacttgactttttatcataaaatattatttattgaatttaaatttgcatttacatacacctaattaactttaattttttaaattataatttttatttaaaaaatgtgaaagttttatttaacttaaatatttatttaatatttgaaggtatttttcggtagtaatttaggaaaagtttttaaagtgcggcctaataactgaagtctatattttatttccgattttcttttattatttagaatactttttatttcccattgtttttttattgctttcacctgatattccccgaccaaatccttgtccttccgtgtctctttgaattccatcgaattttgaatcaattccaatgtgcccatgaagatttgcttctgcgtactgttcatcgtccgctgtccgtcctgcccagcgccatgccgagcttttatttgaatggcatttttttggaattaatcccccaaatacttttttaaaataaattaatttgtgcccaattatgaaatataatttaatttttcctgtaaaaaaattcgtcaaaaattgatatcgttagttttttttgttcgttaattacttgccaatggcgcaaagtttgacaaaacattggccattcccaccaattctttcgtggacactgatttttgcgcatttgccatatgaattatcagacactaaaaaagggaaaattatttttaaaattaattagcaaataaattaataaattaattggtgttttttatgcctggagaaaaatttcgattttcacttcactgcatcccgcaaaaattgacaagaaaaaagtggtcccaaattcattcggcaaaatccaatgttgagtcatcgtaaaatattttaaaattgggccaacaacgaagctaaaatcaaacggaagagtgaatatacatttaagcatataaaattaatttagctattatttatatatattttttacttcaattgtccatttttcacccgcgatctttccattaaatcgcgcaaaaagtccacatacaaagcgccaaaatctatgggctcagcaattgagaaatattcttcattcacttcaacatcgccattatcctcttaattaaatttcaaaaaaaaattataaatttaaaaataaatattttttattgcttttttggcaaaccaatcaaattacctggcacttcaaataattcgtccaaaaatgacagaatcaatttggtaagcatttcggcaccccactgactgttgttgcttttagggataagctgcagtgagttgaagccaacagctgaaatgtttattattgactttcaaactttgaagaaaaaaaatatggagggcaaatgatggcccatatattaaacggcattaaatttggaatttcaatgggattcaaaaatgaagacttattgttcattctcgtgttaaaatctagtctcgaatcaccagctcaattcatccgagtcacaacttggacaaaattgtggaatgttagccaatttcgaaacaatgttcgcaattcagactcttcagtaatggaatgccaacaaatcagggatcggctcaaaattacggggtcggctgcttgagagtcgatccgcagatttactcaacctttttttggtctcgattctcgggctttgtttctgtcttgagttctcagaaaacacccactcttaagcatccctatcagaaaaatgccgctaaaacaactccatccacctttgattgcgttgaaggcgcccagtcgtcgagagtcggcatttgcgcgtgccatgcatgccatgaatttgggggtcagctgattgtacatttggcacatgctttccgcctcgtggtgcaggtcggcatgccgtatgaacaggttgaaacccattgtttctagacggtattcgggctcgtcaccgtctgcacacaccttagcaaaaaagcacagttagttatgcgccaaaaaaattaaatttaaaattaatggaattgtaaccgccctccaccagcgaaatgaccatattaaaaccctgtaaaaatgatcacaccatgtagagcatggtcgatttactattgccaattttcggcttttttggccgcgatgacctcgaaacggatcagcaaaaactggttaaatgaaaaaaacaagcaaaaaatatcttattttaatttatttaagatggttgtttttttcaaagtttatcattctagcatctttttcagttatttttgctttatgttgcatttgttagaggattttttggtcatctaaaaacatttcttgttctcggttatttattttttatgaattatttaaaaaataataataaaaaaagcagactggagccagtcttttaaatacaaataatactagtcaaatcagcaaaatttattggctttttaaaacttccctaaatgtgatcacagattatattctttttaaagagccaatttggccatttttgggtcataaacataaaaacatgcaatttcattttcccaattttatcttcctaaattgaatttgttttttcgtttattctcaccaaatgtttgaccatctgtagacaattgtccaccaacactgtccaactgggcgcacgacgacaactctccaacaacaaatccataatgttaacagccacctgttttttgagtgattgaaagataagtttgaaaattgatctgttacttattaaatgacattttggtgattagattcaaaaacgtagccctattgttcattctcatgctctaaactcttttcatcataaacaacttattcagaaagtacaattatgggtgcaatttgttaaattggcattttccattccctgctaaatccttacttttgaaaattacggtatcgttatatatacagtaagtatgtacaatgcaaaatgcaaattttgcagacggattaataaactcatctcacatttgattattacatgttaatttctaattattattaattcacctcaactcgtgtgtaatttttcttgtcaaggtctctgaaaaagcaaaaatttataaattaaatttgacaaaatctatttccattacctgttcaaatgttggattaaataagcaccaattccgctcagctcttcagggtgtgcgcccgaatattcaatcagtttttgcagctttttgtccttcttcagccattccccgtccttgtgcttctttctcgtgccactgatcgcgtccgcgatgccatcccggggtggaaatgccgctttacgccaccgctgacgggagcagcaggcgcccatgtttttgtgagattagccaaataatgcgcgttgatactggctgataaatgtggaacaatggataaaatgattcaaaacagactcatataaagtgatcggattaagatagaagcaaacaactgataaattattattatttgtatccgaattttgcaaaattttcacaaaatctttaaaaaaaatttctgtgcaatggcgtccaagcggctcgtcgagtttgattttttaaaaattaaattaatgtttctatcggttttgactttcattttacgtgttcaaacactgaaaatgatgaatgaagttaaacattttgcaccgaaactaccgttttttctaaatgaatatatttccgagagtaatctttttggtgctagtgcgtttcttaaaactgccaatgggtttgaaaacaaaaaatgggtaaaataattaaattaatagcttggctcaaattcaaccaaattaatatttcgtggtatcattcaatatcattcaatagctttaattgttctctttcagaatataatttttcctaaatttttaancttaagtataaaaagaagttaataaagcattgaaacaggcctatgttttttttgcaatggttaatgcatatataataaataaacattttaaaaattttaaaggtctttaaaa

SEQ ID NO: 9402 - DNA, 2355 bp, Heterodera glycines
  misc_feature (2279)..(2279): n is a, c, g, or t
  misc_feature (2317)..(2317): n is a, c, g, or t
ctaaaggagaaggaaaagaaagagcggaaagcggcgctctaaagacattacagtcaaataccgaagaacgagccagggatttttgtctacccaagtaaaatggcgaaatctgggaaatttgactgcaaagttatgacgtttcactctcttttggaatataataaggtgatttttgttactaaattgactaaattgcctatctatattaattgattaaggagcatgacaacaaggaagcctcattcgaagttcaaaatacaatttatcacaattgttagttttgtcatttaggtttttctttttgtggaagcattgaaggaaatgtttgacagagcgaatgcttttgttatttatcatacagtttcaactgctttggaaagggaagtggaaaagaaacgtcgaaatgaggcactttctgaggcctgcaaagacgaggagattgttttgctggagggcagcacttctaaagaagagaaagctgaggcgtcaaagtctcctaacaacacagaattgcgctcaaattttaaagcattggtccacaattttgaggtaagtaatattccctgaattcgtcccatattattgcattctctatgatttagcctttcattgcgtttgcccactttgatataaacatttgcgggtttgtaaattatacacaaaataacatttatgggtttgtagattatacaccttatatgctgtttttttaagatatattattgacaaagacttggaggacataattttctcaattgggcttgatgtttcaagatgggatgtgcaacgcctggtaaaaaagttactgtccaaggaacgcatcaattatcgtgacctcaccgacaaatgggtggacaaggaggtttttggtagcaaaatggcaaattaaaatcattcattcttacagggaaaagtgcgatatgttccacttccttcgtatgaaaatattttccaaagtttttccgaacacgcaaaaggtgggattaagaaatcgcacttaaaaattttattaattgtcaggtcacaaaacatctggcgatctttttaacagttcttcgcagaatattaatgaaatgtccgatccaaaactcattagcgaatcggaatttgcttatttcgaaggtgtttttggagtttgtatttgttacgaaaaacattttaggctcgttgattaacattaaacagagtattgagcgacaatacgcactggaaaaagagcgacaagaaacagtggaccaaaacgagaagctgaccctccaacttagtgagtttctaagcagatggtcaaaatgttcagaaaatttattttttgaacttttctgggcataacttttttgatacacaatgaatttctgaaattttgcaagctaataaaggacatttgggttatcgaatagaaaaagatatagcgcattaaagttgtcaaattattttatggtcatgttaactgtaatagagtccaaataatttgtttgttaaacgggtacttatcttattttttttagacaacattaatgagcagcgagaacatctggaaaagaaaaagcgacgactcgaagatgacgttgatcgttacaaaaagaaattatacgacagtgaaaagctgctgaaggttcgataaatcttagtcgcccattcctagaaaaaaactcgaggggggggagtcttaagagcgcatgccaagtcgggaatacaattcatgtaattttaatttaagaaggagcaggaggacaattcgtccatgaagacttctttattggattgtaagcgctacggggagagaatggtcgccgttgttgagaaagtattgcccccgccatcgaaaaaggaagaaaaagaaaagtcgtcgggatcggacaaaaatggaacgagcggaaaagaaaaggacaacgaagttgcgaatttgaataccgaagacggtgtggagaagggagacgaacaacaacaaaaggtggcattggcatagttcaaactcactcattctgggaatttttagctcttaattgtggatgcaatttctgcttctcttagtaaaagttcttgcgaagagaaaagcgatgggcgcgagaaccgtgcggggagtgtttgactttatgccgatttggtttccgtgttatgatttgtgtttctggttcttataaatttttcattactggtccattatgttcaaaatttaggcggttaaaaaattttaatagcttaaaacaaaaacatataacacactcaaaatccacatatctgttcttggcgatgaaaatgacacccattaaaaacgatanaactattctcagaccgattaaatcatgaaaattgccanaaaaaaatacgtcacaaatttgggtaactctaccgatg

SEQ ID NO: 9403 - DNA, 3883 bp, Heterodera glycines
aatcgaccttggaattggcatttgttcgttgcactctttcactgaaactgacgggggacgtcttctgctggtgaaccttttggcccatttttgctccttttccctttcacttttttgcggattgcaattattttaacgataagctttaattgttaaattggaataaaacaaaagtggcatttttaggtttctttgtcagacagaacccaagtgattttgcccctccaaggacgtgatttttcagttcgggaaacgttgattcgaattacgccttcacaaatccatcgaattgacaaacatttgtacattttccctcaattaaatgagtccgtttgtgtgttggattcttccaaaaagcaggttcattccattcctttctccatttgtttgtttgttctgttttcctcctttttcagctcgccctcttcgattcgcttctctccgtttggtccgcttcgcctcgcttttgcttcgaatgctttgagtcgggctttgtccgtcaagtgatttgcacttcgcaaatggtcgtcgttttgacgcctcacaatctctccgttcagttccgctctttccaagtgaatttgccctttaaataaccgtcgttttgcttcttcgtttagtcaaatggcacttcacttcgctatgctccaatggaagtgattttgccatcgcaattctcctgtaaaacgctccatttgattattgcgtccgcaaattccacccaaaaaggggaaagtccgctccaatgtttctcagcacttaccgaaaagggtcttttcgcgttgcgaactcaaaagtgacattttcgagtttgggcgattgttcataaatttctgcttccaggcccttcaatgacttcatctttgcccttctcgattcgcagttttactcctccaattgtctctcatctttcgccgtttctttgcaaatttcccctgccgaactttgcctttctctcctccgccattcccttcgaaatccctccaattttcaaagtgttcaaatcgacgggattatttcactcgcctttaaatgcaaagtatgaatgaatgagactcacttggcatttattactttgattttgtgagtctctcttttggaatatttccaaaaagtgccttcgaaagtgtttctctaaacaattgtttttgttttggtctgtattttttcctttcagatcgatccaaatgacattctttctgttctccgcgaaagcagtcgggggcacttccttttgccgtttctccgaattaaaattgcgagggattcgggcgatgattcgttccgccaattgtttcttggggtaattttgggtcgaattacccaaataaccgatgaggaggccaaaaatggcgaggaaagtgaacacggaaaagaattggaagcggaaaaaaatgcactcgaaagcgaactgaggtagcggaagaaaagcaacgaacggttggcatttggctctattttcaatgccattctttgcaggcattttctgaataaattcgacacggatgcgtctgaccttcttctgctttccctccgccattctctcttctcttgcgtttgtgtgcttctctgtcgaaatgctccgctgcacagtcccacggttgcgcgttctttgctcgaattgtccgattggaacaaccgaagggtcggaagtttgctcaaatgcctttccctcgtccattggccttccgtcgattccttttctcctgcaattgtggccaaattgttcactttggtcccctcttgcaatattgtccagcttaaaatggtgaatagaattgccaaacttttggcgcaaaggtcaatttgggccggggaccgacggacggtccctaaatgactttccttttcagatccatcgaattggctcattccctccaattgttctgttctctgcgcctctcccatttggctgcgggaagaaacgaacttttgaatttggcacaaaaaatggacagaaattccgtcgattgcgcctcaaattgtacggttttacttgctgaagatgtgtgcggaactgtgaacagctgtgacctttctgaccgtgaggagtttcagccgttcttttggggagaattttctgccggaattcaacgtttgctaaaaaatgaacgggcgaagtccgacggggaaaagtgcgcggcatttgccattggcagtgccattccgacagcggaaaagaacggagaaaatggaattgtcgacaatgcatcggacgctgtttcggcaacgaaaaagcgattgctggggaggaaagaacgaccgaatgcgttttctctttgccctttccccggggctgtaaaagtggcaaattccgatttaacggtggtttttccattttgcttggactgatggaaagttcagttttgtgcggctgcttgtggcactgaacatgttcttctgttgaccgatgacggccgtcttttcagttgggggattaaccgatttggacagtgcggaaacggcacggaagagccgatccatgcgccaattgtatgcctcttggaaaaagaccgaatttgaaaattgccaggaaataattggcaaatggggccgcattgtcagcatttgcgcgggtcattaccattcgggatttatctctgaaaaggacgagatttacctttggggctggggactgtacggacagctcggaaatggcagaaccgccaatctgaaacgacccgcgaagagtcgtccattcagtgctttgaattgtgtcaagaagctttggtacaaaaaacatttccattgcttcaatgtgccattctcccccccccccccctctcagtctcggctattcccactctttggcactcctcgccgatgggcgtgtctttggctgcggtgcgttctctcatggccaactcggcatcgaccctcacaatttggaagggtgcccaacgaaggccttggcccccgtccaattgccatttccaatgccaatttctctgatcgcttcaagtagtatctttactaaccatgactgatgaggacttgttttagaatatttccatggtattgctttgggcgtggaccatttgaggagaaaagtgctgtttgagtggggcgactccccccaatctttgaaaatgaacgcatttctgcaaaagcgtctcaaattgaaacagaaaagtaaacatttgtttaaaaaagtgccgaacaaaaataaatttagaagcaaaagacaaaaatttgaaaatggatggacaagaaaatccgccgacggcggagagaaaaggcgaagcgaaagtggcgaccattgcgatagacgaattggaacgagtccatttcaacattcggacagtttgcgaatggaatggcgcggcagtgaaggcgcttagtgccgggtaaaaaacaaaggcccggggtattctccgattggccattgcttcagattcaaccactccgctctgctgacttcggatggccaactgttcacttggggaaagtccttggaaatgcaattgggccatcagaacagaaaggaaaagggcacaccgaccaaagtcgatgtgcccgaaactgttcggtggtccgaagtcgtttgtggttggtccgcatggacttccccccccccaaaaaaaaggcccttttcagcccgcaatttcaccactgccatttcggtcgaaggcaaagtttttgtttggggtcgaaacgacaaattccaattgggacttgggaaaacaacgaagaaagggacggcatgccaaattcggacgattgcgcttaaatcggacaagggaaatgcgcaacggagcgtggagttgccggtggacaattgcgtcgagagtccgacgatttacacggactgcgggcatttgtggaaagcgaaacgcaacgtgaagggaagtgctgacgagggactgaagacattgatggttta

SEQ ID NO: 9404 - DNA, 4199 bp, Heterodera glycines
  misc_feature (3568)..(3568): n is a, c, g, or t
tgcatcaaatatgcacaaaaatcgcaaaatatgcaccaaatatgcacaaaaaaacttgaaatttggggtgcaaattaattttaaaaaattttttcctcacaaattttatcggctgtttttgaattgcaaatcaaaaatttctcaaaattttcggcagtgaagctcactgttgatccactcgtgcatccattcagatttggatttaattttaggcataatcaaattttttccaagggatattcaactcatcgaaaaatggcaaaatatgcaaaaaaaaaaaatctgaaaatatgtacaaaaaatggcaaaatgtgcatgaaatatgcagaaaaacccataatatgcaaaatatgcataaaaactaaaatatgcaaaaatatgcaaataaaagtcccgctttttatacgcaaataccaaaaagaatgtgttttcctactaattagactacgtagaatccaagatatttttgacagccctggtaattatatatcgaacaaaaactaattaattataaaagaaaatttatctatgcaacattttaaaagatagttccatcagttgaagtgaatgaattcctttttccatctgatgaatagggttgctcttccaattcccaatttctctgcaataattccatcactaatttcaacattacttgccttcattttgaaatattgtttcatttttattaatttatcctcattggaatagttattttttgcttaaatataaaattaaataaaaactttaaaaattcacttacttttataataatttggcaacaattcatttttccattttattaatgttctttcaccaatgcccaattccattacaaattctttctgttttccgtggccatataaacttttaaattcatcaattcgttcaatgaattcccgctttttctgctcataaaaactctttttcttttgtttattttaaatttatataaatttaattcttttttccatttgtatattttatggcgacttgcacctaaaactctgccaattttgaattcaattttgttctgtatttgttttgaattttcctttttctctcaacttttctttaattgcttcaaatttttgaatcatttctctcttgttggtcatttgggtgtattccattttcttcattcatccatttgatcagcttcatattttccatttagctggtttagttcaatttttatcatttggtcttcttcttcatttttgtcccatcgttcgccgaatatttcatcgaaatttggttggattttgccggactcaattttataaataataaaaaaatttataaatattaaatgccaccaattcattcttttcagatatatttttgaataaaataatttttttaaatgattaagaaaaaattcacaaatatattttttttacatattattgaatcagttttttgattttattgatcagccaaaatttggatgcatgaaaaagacatcagcaaaacagtattttttagcttatttcctgtccagtacgggtttcaatcattttcgttccgaaaaagctccaagattggtgcaaatggtgtaataaacttttttgtttgttgtccgatatagctttttatatgaccacaagtaggttttttttgcataatattaaatcgctctaatttaaaaaattgtgctgaaaaatatgtttttcatgttttcgaaaatttttcaaaataagaacatcaatgccacaaaataagattttagggccaaaaataagaacatttcgcaaaattgcttaaaatcgcttgtgtaacaatttaatcaattaatatagttatcaaatttcatatttttcgcctcccatgatcatttttaacaatttgtaggaaataagcaaatcgtaatttttttttagtgtattcgggatcaaaaaaagtaagatttttaaaatttttgcatttaaaagccatgcgacgacttttttcgcttttaaaaacgcttttttttacgcggagcgcttccaaaaattttgggggactggggcgtctggcggcgccgataggcgctgacgggaaaaatttgtaatttttaatgcgatttgttaacagtttttgtcaaaaaataaccaaattttgagctaaccctatattttcttgataaattagtgacattctgccataaaattatgaatatatttatgaaataagaacaatggcccgaaatacggacaaatcttacaaataaggacatttttattttctaagatttggaccctccaaataaggacaaatcttataaataaggacagatccgagccttgtgtttaccgcgtaaaatgctatccacacaaaaaataggtaaaaaatttagaaaatggcccgtatatttgggttattgcacttgatatttaattatttgattttggaatattttacaatttcttaaactagaaaatggtatagcaatacaacatatcaaaataacacaaacaatttcaaaaatcacatgtcagaaatagatactaattcctgtttccatcttttcagcgtggaatatccaattctcaaatccttagcaattctttggtcggtaatttttggatttttttctttgattttaaagtattgcttcatcttttttaatttgtcatcgttggaataattattttgtgcttaataataaaaatttaaaataatacaaaacaaattctcttacttttattataatttggcagcaattcttttttccatctcgtaaatgtgtctttggaaatgcccaattccttcacaaattctttctgtttgcgttggccatataaacttttaaattcatcaaatcgttcaatgaattcattctttttcccctcataaaaactctttttcttcgttttatttagatttaattcttttttccatttgtatattttttggcgattttggcctaataattttgcaattttccactcaattttgttattgtttttccattcatattttcctttttgcttcaacctttctttaattgcttcaaatttttgaattgtttctcttttttgttgatcatttggaccatttccattttctccatccatttgatcaactgttgctgagttttcattttgttcatcattttttatcacttgttcttctctttcatttttgttccatccatcgccaaatatttcataaaaatttggtcggattttgccggattcaattttataaataataaaaaatattataaatattaaatggcaaaaattcattttccaattttgaaaatgaataaataattttttataaaatgattatcattatgctatgaagaaattattcacaaatttttttttatacattattaaaaaccaatttattgattttggtagtattaaaacattattaaaaacaaattattaaattttgcttaagattaagattatttcaaaatattaattcataacaataattatgaattttttttttgtttaagcaaattctgattttactcggaaaatctgttaaattatcgggtgggttaaagttgattccgggctgggataaagcacttctgcggttttggagcttcgctagaaataacatntaacactaaagcgagttggaattaaaaaaatcttagtctttctttcaatttctatcacttatatattatggctagggctatgattttaggtttttgcctattttttcctgagctctccgtggccttaaatgcacgaaaaatatgttttttttctgttgttgttaagctacttttcgagttatagtgcctattttctaggattttatatttagagcctaaaaaacctaaaaattttgaaagaaaacctatttttgcctattttggcgtttgatgagcaatttgttaacaaaaatgaaataaaaaacgaaaaatacaacccgaaaaattttcaaaaatgtacccttacaatgaaaaatttctcaaaaattcattttcaaaatttatttttttattttcttgacaagaagttttattttaaaaattatgtatcttaatactgatttggcttaatgttgttatttttttgaatatattttgtcattttacacacataaatttgaggctttttagtgtctattttcccatttttagtgcctattttcgtggttttttatgacctaaagcctacctagtttggcagtttttagagcctaaagcctacctattttggcagttttttgagcctaaaaat

SEQ ID NO: 9405 - DNA, 556 bp, Heterodera glycines
atgcatgaccattgcaaaaaacatagcatgttcaatgcgttataacttttcttatacttaagtaaaaaattttgtaaaattatattgtgataaagatcaattaaagctgttgatgataccatgaaatattaatttggttgaatttgagccaagttatgaatttatagatattacccattttgttttcgagcccattggccgttttacgaaacgcgcatgggtggccttttttacgaaacgcgctagcaccattcgaatcactggaaccaaactcgactcgggaataaaaaaaaataaaacggtcaagatacaaatgacaacttttttggacaagattcgaaagcagcatgaagttgattattttcgtttgtaactttctttaaatgttagaatttttttgttttctcgtattattacattattcagactttgtgctttcgaatgataccaaaaagataggttttattcgaacatgaacaaagttattgtataaaaagcagctattatcaattaattggactcactaaagtgcattaaattataccgaatattattt

SEQ ID NO: 9406 - DNA, 2169 bp, Heterodera glycines
agcgctcataatgggatgtataaaggcgattgtagaaggaattgacagcgctaacattgtatgaaaagctttttgagcgtaattacgattttacttacatcatttttttataggcttagatcacatgcgattttcggcactctgataattttagcgctcataatgggatgtataaaggcgattgtagaaggaattggatgcgctaaaattgtttgagaagctttttgagcgtaattacgattttacttacaccatttttttgtaggcttagatcacatgcgattttcggcactctgataattatagcgttcataatgggatgtataaaggcgattgtagaaggaattggaagcgctaaaattgtttgaggagctttttgagcgtaattacgattttacttacaccatttttttctaggcttagatcacatgcgattttcggcactctgataattttagcgtcataatgggatgtataaaggcgattgtagaaggaattggaagcgctaaaattgtttgaggagctttttgagcgtaattacgattttacttacaccatttttttctaggcttagatcacatgcgattttcggcactctgataattctagcgctcataatagtagttagagactccattttcaccggattacggtagccccccataggtgtgggaggggtgcatggccaactgagcgccagccatttgagcgccgccaagtgagcgcgggccatctgagcgccagacttttcagtactgaagccaaaacctattgcgcgactttttcttgcaaacccaaacctattgcagggggtgcgcgacttttttgactgcgcgactttatgcaaattattttaattaaatttatttaattttaaattattttaaacgtcttaaaggtcaaagacgttgaatttaaattcatttaaaattctccaaaaattccccgcaccaagcggattcgaaccccagggggggggcggccagactgacgcactaaccactcggccacattggcaatggatgataaacattaatttgctctcataaaggaaaaattgacgtcaccagcggcgggaggggggcgagagcgggcggcgagaaggggggagggggtcaaataaacaaatcaattattgaattcacaattttctcttttaaaagcaaaaagaaatgggggaccgtataataaaatataatttagaaattaaaataattttaattaattaattattattcctaaaataaaatttttattacttctaaaataatataaatatttttcagtgaattaacaaatacatttaagtttaattattgatttgtctgttaattatttatctcctcaaaaataattacagcaccctttcaggtgttgggcatttgtttatttgaccaataatttttaatttcacatctttgcgttgcccctccctcacacctgctcatttgtgtaatttgacaccacttcttttttcttttcgttaaaaattaaaaagattgtctggaatttgtcttgcgccacaccgctgtgccattcatttatgtaatttgacaccagtctgataataatttcgacaaaatttatttttatttgtccatttattacgaattatcttatatctttcgatccaaattttggacatattgttttttcttttcctttttagcaattttgctggtttattcaattaaaataaataaatatttgttcatctttaaagtaataatttttataaaatttagacacaaaaacaaatcatgagccaaaaccgtgacgaaaactcgcagccacatgtactcgatggtccatacccaccggcacaagagggtgttgagtttgtggaagatgaagcacctttgatgcttgaggtgttggagcgtctgatacaaggagtgagttttgttttgaattctttaaaaaaattttaaaatgtttccattttggcttatgctaattgttgattttgcttaggggatttgccaacccgtgggcccgttttcgtttgcacttgccgactgtttggccacatttcatacatttgccatactgttcgactgtgagacacgtgtgccatttgacgagcagcacaagcgatacgtgttcgaacacagggacaaaccgcggctgatctacgtttcggaagatggaagcgctatacaagttgac

SEQ ID NO: 9407 - DNA, 3390 bp, Heterodera glycines
gcgggcgtcgcgaaaaattagggggtcaaataaataaatcaattattgaattcacaattttctcttttaaaagcaaaaagaaatgggggaccgtataataaaatataatttagaaattaaaataattaaaaggttaattaattaattattattcctaaaataaattttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaattttttattgtcccaatttttaccattttgtgttttttcaacaaaataaatatttgttcaaatttaaagaattaatttttaaaattttagacacaaaaacaaatcatgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaattttttaatttttccattttggcttatgctaattgttgattttgtttagggaatttgccaagccatgggcctgttttcgtttgcacttgccgactgttaggccacatttcatacatttgccatactgttcgactgtgagacacctgtgccatttgacgagcagcacaagcgatacgtgttcaaacacatggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaacagcccaagagtatgattgtgttctgccggttccacggcttgggtttgtcacggaaaattttcttaataattttttttaaaatagctcaaggcgcgatgagcacctggatgcctgtgttcttatggaatcagtgggctcaggccatcggctctacattttcgagtttgaggattgcctccaggtatttttaaaatatgaggtcaattaattaaataaataaataaaacaaaaccccacaggtgaaaggacacatcgaaaacgaagacggaacaagtacacgcgtgatgattgagcactatgataaatacaatgggttatgtggatttgaatcgtttttggcgtcatgtgcttttaccttttttggattttttgttcacgtttcctatgaagatgatgattgatttaattttaaaataatttttattgtatattgcgtttcacaaattcataaacaaattcatccgaattacttggccttttcaaaaattgcataataaactcaaaatcaaatcctaaggacataaaataaataaaaactaaaacataatgaccacaaacattagagaaaatcgattgaaattttcttcgattaaaataaattttccgaaaattatttgccaaatattttttgatcagatcgtttggcatctcgccataggagtcaaaaaagtaggccacccccggcgaacgcgcccatattgcgcaccaatgggttcccggcattcccgacgggtcctgaagtggcaaaatttatttaatctattttttggcactcaccaaattgacaattagactgcagggaaatttcgtgcactttggcaatcggtcggccggaaaagtgccaacaaaatattttctcgtcgcccggttctcaaagagagctctgtcgatgaaccgattgtccattcctgcgacgaatccgcctctccctcaaaaacaggtaaaatcccgcagccgcagtacctgctgcaccaaacaggtagatgaggcagagaaaaaagttgattggcgacttctcgatcacatccggaaaacacagtacaatcccttcgtgtgcagcattggaggagggcatttgaacaaaatcggaggaataattctcaccattcatactgtaaggtcactagtgattgatctgttccggtcaatcagaatgagcccgtcagcctcggcataggctattaaagtgaccccctcgttcggaaccgcttcggaaaaccgaatgttcaccgctgtacagccctccttgatcagctcaaagcccggcgagtcctcctgcgcattggtcatttggaagacatagaggcagtaggcagtcttgaacatgctgtagctgatcccgttgctctcagttgtacaggccatgccaaggtgctcctgggtgtcatggtacgcccttgcgtacctgttgttcttgtagtccaagttgtacggaaactgtgggtacgtcctgccagaggcggtcagttcaatatcccgcacctgaacattttttctgccagaaatacatgtcaaagcggcacttacgttgtggtggttgaagtaaaaggggttcttctgattgtgtccaatgtaattttggttgggcaccagcccaatgatgaccctccgtggcacttcctcggtgaacagattggcagaaaaatcgtatcgtccaccggtaatgaacagcgacttcatcagcgtattccggatgccgtatctggcgggctccaggtccaacttctttgcaatgtcaaggctgagtccgtccatcagatcaaccgtcttcactatcagcctgcagtcgacaacttcaagcgtgtacttgtccctatttgcggcttcctgatgtatcataaaatcgtccgactgcagggcgagctcaatgtcaatctcaacattgctgatcatgtacaagtcctggttgaatatgtcggcgctaagcttgcttatcgcttgaaagcccttgctctcctccaccgcctttttccttcgatcgtttactttggtcgggtcactgtcacggaaatagcctgccacgccaaagtatgatcctttccgttacag

SEQ ID NO: 9408 - DNA, 1079 bp, Heterodera glycines
catgtataattgcaaatataaactcataaagcaaaagaaatggcctttattatgagcaacttttttgaaatacaaaccttaaaaatagggcaaagaacgaaaattctggaacaaaattaaatctccgttttattagtttttgtacgacttttgcgttagtgaatttcataaaagtcaaaaattggcctactttatgcggttttcttgaaatttagagctctaaattatataatcgttataaaattatggagcaaaagtgcatgtataattgcaaatataaactttcataaagcaaaagaaatggcctttattatgagcaacttttttgaaatacaaaccttaaaaatagggcaaagaacgaaaattctggaacaaaattaaatctccgttttattagtttttgtacgacttttgcgttagtgaatttcataaaagtcaaaaattggcctactttatgcggttttcttgaaatttagagctctaaattatataatcgttataaaattatggagcaaaagtgcatgtataattgcaaatataaactttcataaagcaaaagaaatggcctttattatgagcaacttttttgaaatacaaaccttaaaaatagggcaaagaacgaaaattctggaacaaaattaaatctccgttttattagtttttgtacgacttttgcgttagtgaatttcataaaagtcaaaaattggcctactttatgcggttttcttgaaatttagagctctaaattatataatcgttataaaattatggagcaaaagtgcatgtataattgcaaatataaactttcataaagcaaaagaaatggcctttattatgagcaacttttttgaaatacaaaccttaaaaatagggcaaagaacgaaaattctggaacaaaattaaatctccgttttattagtttttgtacgacttttgcgttagtgaatttcataaaagtcaaaaattggcctactttatgcggttttcttgaaatttagagctctaaaattatataatcgttataaaattatggagcaagaagtgcatgtataattgcaaatataaactttcataaagca

SEQ ID NO: 9409 - DNA, 1287 bp, Heterodera glycines
tgactgaatttgtcggctcttcatttctctcgtcttttttgatcagatcggctaaagtgtcctttctggctgtttctttccctttactttccttttcggcctgatcagatggctttttcggcgcaatcgctgcacctttccattcgcgttctttcgcgaacatttcgcgcaatgtaaaacgctgaggtgacgaactcccgccgaactttaatagacacggccattttttaacgtcaccagcacaaaagcactgaataaagaacacggaaatgaagacacattttgcaaaaattttgttttccatctgttttttgttggaattttaaatatataaattagcaaaaaaagaaaaaattaaaatgaaactgactttttacaaaatgaattaactccagcagcaggggatttgcagaataaaacacgtagcattagccaatgaaatcaattaaatgtttgattttacaatttttttatacatattatcaaatgcggctatgcaaatctaaaataatatttgtaaaataaaaatgaagaagtttctccaaatatgtatgtgtatagaagaggtacaatccagtaccgatttcgaaatttaaaaaaaaaatttgggaaagccttcggcactaacaaataagctgtaaaaaattaaaagaaaaagaaaattaattaatttaaaataaatttatttttaaattacaatatgcatcattatttcgattttcaaggttggcatttttcatattttaaaacgcgtgaatcggtaattttttcaaaaatttctttaacttaaaaaccaaatcacaatttttgaagcatttcctaacattctttttggttttttattcaattgcttattgatcaattcaactttcatttaaaaaaaactgtgaatagtcaccgtttaagtcggaagtttttttctcttcataatttaaattcgcctgatgaatattttttaaaggcaccgacgttgccaatagcgctgccggggaaaataggaaatttttgccagttttgttaacagtttttatcccataccaatttttattttttgaactgaattataaaaattctaatgagatatcatgcggtgcaaaaaaagagcaaatgtctcgaacaccaagattgggaccgaaaacccgagagcaagaccaaaaaagcctagacttttctcgaaccgcgactcgaaacagtgatcgcttgaacagcacaagtatttattcgaaatttgaaaagtctaatttccagatttcctgaattttgagggctgggaatttctttttaaaa

SEQ ID NO: 9410 - DNA, 2542 bp, Heterodera glycines
  misc_feature (42)..(42): n is a, c, g, or t
  misc_feature (121)..(121): n is a, c, g, or t
ttttttataaatattaacatttaattaatcggaagaatgtgntagacaccggaagtgaaattggtggagcagcgcactcatgtggcattttaaaattttgccaaatttttcacatgaattntattatttattaattattttttttatgaaatattcctttattacaaaaacattcataatttgattataaaaacgatttatttattcttaattcgttattattttattatttttttttaaatttaattctaaactatgaattttttgaaaacaattttattaatatttatttatttttctctgaatattattgaaggtaaataaaattcttgcactaaaatgtattcaaaattaccggtttcagttcatagtatgttatacagccagcagacggacgcagaaggtgaaagttcaaataccaatgaattgccaccgtcactcaatcattttggtttattaaaataatttagaattaattattaatttaaatattttaaagtcatgcaaaacgaaacaaaagagatgattggacaggaatatgcaattgcgtatttgaaactgttttatcaaattttggaagaaaccgattacgcagtgaattacgtaggcattttccaataccttaataaattaatattttaaatctgaattaaattaagacacatttggaagaccaaattgataatatggtagaaaaaattaacggtaaatttctacaaaaaaaagaaacttttggcgatcatttgtggcgagtcgtcgtgaaaatgtcgcgtcaatgccaacaaattggcgtagacattgagcaaacaatgcaacatggacaagaagtatgaattaaatcattttttaatgttaattaattttctaataaaagtttgaaagaaatttcggcaaaaaaatgtgccgcttggcaatgttcgtttcgctggcgcaattcataagcattgaaatgaaaaaaattttgtaattttaacatttaaagaaatgtatacattaactattgaatatattaataaaataataattactgccaaataccggtaattaaggaaagaatatgccaaaggaattatcccacgcgcttgcgcaaaaattcgtcgtctttttggacgttcggctgccattcaaactgctgcagatggtgctggcacgggctcaacaacaactccttctatggtacaacgagaatgtaaagcaaaattgatggtcatttatgtaagtaaaattaaatataaaattagaataatcgaagatattttaaataaatctttatttataattaataaaaaaaatttcttaattaattttctcagatggatatcaaaatgaatgagatttactttgagaagatatttgattttatgattgtcgccaaagatttaatgataaaaacaagagcagatgtcggtgatccgcgtcacatccaatcagcccgagtgataagaaaattaaattaaaaaacacgcaaatcattacttaattattcggattatttaattttatttatttatttattttctaattttcaatttaagattaaacaacaattagaagatttaatcaaccaagaacaattgctggccattattgaaacaaaaatcgaattcgaaaaagttgtcgaatgatgatgataaggaaacaaacgatcatcggacttttttgaatttgtttttttttctccatttaggaattatgttagcctatcagtcattgaaatatttatatgtatatcatttggaagacaaaaaaagaagacaatctttggccaaaagtctcattttttcaaacatgtttttaaatgataaataggcaaaaatctaatattttgggttacgttaagaatgtagcatagtgacaccaaacaggtttatataatgtgcgagaccagcaggctcgggggacgtggcatgtgctcccccccccccccccccgctgaaatgaaaaatgaaaattttttcaagaaaaaagtataatttttttgaaaattttgcataatttcttaccatatattaaaattcccaaaaaaaattttccggggacgcctatcggcactgccgggtcccagtgtatcattattttttgaaaatttgaccacagaatgtcaaaaagttatcatttttggcgcaaaacgcttcaaattcttgctttttggccatgaaaaataatattggagaaaaaaattttgaccctaagaacaaaaaaagctcttcgggtgcccttcctgaaaattatttctggatacggacctggtgatgccaatacttatcattgcaaagtgacgacaggtcttaccggaatttgttaaattttgtcaaggtaccgcaaaagcttaacttatttatgtaacacaaaaatgctcattttagtcgacttttggaacggaaacggtcaatccctgataataattggatgaattttgtaagaaaataataatattacaatataacaatttttattaattttttatgcacgaatatcgataattgattttatatgaatttattcatttcatcatttttaatattttcctacttttttaaca

SEQ ID NO: 9411 - DNA, 1714 bp, Heterodera glycines
ccaaacgtgccccggggcccaactgatcgagtcgggaaaaagcgcatgaaatggagggggggaggggaaagtgatcacccgatctggaagaagtcatctcgtcgattagagaaaaagctagacgaattggaattgtgttgtgctaacaacagagagcagagagagggaaatgtgtaagcgctaaaatttaatttgacgaattttttatttaggaaatttgaattgaaattttctataaaaatttaaggggagggaaaaccatgcctttttagattaaaattgcttcaaaagtttttcggaaattttatgcattgttttacattatgtaggtcgaaattcactcccattgttttccccatcggtcgattccttatcctgctgctgtacaatacaatccctaatccccgtcagttcttttttaatttggagataagtgcctaattttattaaactggttcatcaaatctctccttacagcgattgaaacaacggaatacataaattagtacagtaacaatacacagatggcacatattcagacattgctaacatcgcatgatggcattatgggtgaaaattatacatatacaaacaaatcggatggatttgatgggggatcaatttcattgcacaattatccgtgatttaattagtatcctctgcaaaaattctcgtccatttcgtttgccatttttctccatgccgttgttgttattgttgtaccatttctcatccgaccaggcgtcacgtcattcagtcactgtcgctgcttgaggggcttctggtcgcattcccatgggtcgtattgttggtggcattcgtcgtcgccgccgtcaatccctccagtgccgcgatgttggcattcaatgccgtcgtcaattccgtgcgcgccgcggcattggcatccaatgccatcgtcaattccgcgcgcgccgccgcgttcgtcactgcaagaccttgaaaaacaggacaaaaatttgttgcttcaaaaaaatgcatatattacgttcaagcgccatcatgacttctctctgctcggcctcggtcataggggcatcctgccgcgtacgcgcagtactccgtccacgctgtggctttctcggacgtccacgctgcttggtcgacttggaccgcttcgttggcgttgctttgcgcgccacaatccggcgacgtcggcgagacgctttcctggcggacgacgcacggcgcgacactcggcgagacgctttcctggcggacgacgcacgacccgttcccctgtttctcgttgcccttcggctcgcggaacgacgacccgtatttcgtgaacgactgcgactacgaccagcagcagttgaagtcgtacgacgagttcgctgaacggtggggaggaggggaaaatgaatgaatggtggcggaaaaagcggatgaaaaatgaatgaaaatggaggggaaagggatcaccgatcttgaagaagtcatctcgtcgattagagaagaagctgtagacgaattggaattgtgttgtgatagcaacagagagagagggcaaaaaatgtgtaagcgctaaaatttaatttgacgaattttttatttaggaaatttgaattgcatttttctataaaaattttaaggggagggggggggggggggaccagtcattttaggtgagagttgctcccaaaaatacgcggaaatttatgcatggaaaagacccaaaatcagagttttgctg

SEQ ID NO: 9412 - DNA, 932 bp, Heterodera glycines
tcagtgttagtcgccaccgccccatccgcagtcgtcgtcaatgttgccggagttgtcgtagcagtcgcctcagcgttggtcgccgtattcgtcgtcacagtcgtcgctccggttgtcaccgccgccccatccgcggtcgccgtcgttgtcgcagcgatcgcatcgaacgcctccatcacttcctcaatggttgccaagtgcgcgtcagtgttggtggctgccgcatcggcactcgtcgtcgtcttcttccgctgggcagcagcgctcttcccccgtcggacaccgcgtcgcgtggcaccgcgtcgagtcacggctgccctcggacgtccacggccacgcttttgtcgaatgcccggcgctgtcgtcaatttgcgcgtgcccttcggtcgtccgcggaacggtttgagcgcgggcggacgacgcattgccaagccccgcttcttgttccgcttccgtatgccgtagatgttgcgctcccgctgtcgacgtaacgcgcgctgctccagtcgtatctcgcggcgtaccgctgcaagcgctcgatcatcagcgtcgagacgcggacgacgacgacgcactgacgcggtccgccgtctgcggatgttggttgagacgccatatcgtcgacgagttctctgaacaacggcggaggggaagacgtaaaatgacggaacgaggaatacacaaaaataatgcaaaaaaaaaaacgccagggactgaagcgggcgcggctctattgcagttcacatacgaccataaattattttggcaaatttaatacacaataactttttcttgaagcatccaaattaaacatttttagtgtcattcgatagccataagcttcctctattagtctgcaaaatttcataaaattttgttcggtttcaaaaaagttatggctagaaaatttaaaaaaaactggtttagaagca

SEQ ID NO: 9413 - DNA, 2815 bp, Heterodera glycines
  misc_feature (985)..(985): n is a, c, g, or t
atagttaaaaatcactatttttggcgttttatcactattttttcactatttcgacattttttggaaaattccttaacaaaaatgcaataaaaccaaaaaatacacccttaagaatctacctaaaaaaatttcaaaaaaatacacccctaagaatcaagctaaaatttttcaaaatatactcctatgcaatgaaaaaaaattttctcaaaaatttactttcttggcaaaaaattttaattttaaaaaattttttaggtaactattttgggttttttggtcttaaaaatcccagtcctactcatttgcaactgcaatcagtgaataaaaattattttggcttattttttggctgaaaattatgtcactattcgtcactattttggactttttgtcactattttggcatttttactcactattttagttaactatttcgggatttttcgtcactaaaagttgctgccctagtcataatgcaaacgtaatgaagaatcgttaaagttaataaggtgtgtgttgcaattggtgtcaatccgatttgattatgaatgggaggcaattttcgggaccatgatttggccaatttttgctgttatttgaaagctctatcaaaaacacacttaaacagtgacacattcattgagcatatcagtgagaaaatatgtggaatggtgagcggtgcacggtgttggttcagcacaacggcggcgccaagttcagccaggtacagtgcctcctcaatgcgcagaaagtcaccgtccgctcgccgaacgcccatcttggccacgtggtgggtctgaggaaagaaaaaaacaataaatagtaacgaatacaatgcgattgtatattaatgttggaaaacatattcagagtagaacataatgtcatcattggacaagttttaaatcatttttctatttaaacaaaataaacatacttggcgttgtgcaagatcgctaattagactcaattagcttgggaaatntaaaaagttacaaaaaaatataattaattgcggctgttttcggtgtctgattaaactccaaaccatactcatactcaatttatttgaataaaattaatgaatttttatttgttcgagctgcaagagttgatgcaattctaatggattttgacaaatctcgtgtccaaataatttctgggctataagatgaaaattcgaatttaacaaaatcttctattcgtttgaattcgggttagagtccgaaattacccgaaatgtcacattggtgaccttgagaacacttcagacataagaaaactcactgcttttccaatggatctgagcatgggtttgtccggccgatattccaatgtcaaatggtcatttcgaagtcgaattccattcgccattggactctgattgtcgaagtccaaacggcgtttcatcaatttctcgaaaactttttttcggataaaatacttatgaaaaaatataaaaataaaatggaaataaacaaaattcagaatcctaagaaaatttgccggcgtttatttattcgaataaattgttgaaatagtcatggaggaagtcagtcaaaaaaataattaatatgagtataacacataaaaaaaaattttgtagtcctgccatttttattactgtacatcaccttcctgtagtgcgcaactgaaaattgagccaattattaattaaaataaaaaattttatttaatatttttcgcaaccatttatctggtttttaaaatagtttatatttataaatttaatatacgtaacgaagtttccgaataaaaaaaaaattaaaatgaaaaccagaaaattttttttaaatgtaagtaagttatgaatagagttcatatgcaatataaagttgttcatttggcatcaacgtaaaaaataaaataaataatacataaatttaaaaggcacataaaacaaaaaaaagattaacaatttaaaaacgatcattttttggcataattagtttccaacaatgcattaatttttcgttcattttcaagcatattggcggatgaacgtgccaaatgttcacgcacttcgcgaatgtcgttgtccaacgcgcgcaacgttgtgctcaacgcaacaacttccgaactgacgccagtggagcgttcttgcaactttcgttctaccaccagcgactgcttacgacactcctccaactcgcgcaacattgtgtcaaaatcgtctgcagcaaattccatggtccgtaccaagggctgaacgttctgtgtcgcccgttgcagaacccgttgcactgactcaatctcaacgcgaacccttcgctgctcttgcaaatcaggctcatccgcttccacaaatgggccatcctcctgcacatttttttcgggggtttaagagtcacacaaggtgcttataatcggagaaaatcgtttgatcaataaaattttttgtggtcaaaatttctttgaattcaagtatataagcataatatatgctcagttttaacctgtaaatgcttctcctcaagcatgcgtgtgttctctacaattctgttcaccaaaatgccgtgctcatcaccctgtcgcaaatttgtaacatttgcgccctcagcagcagcacccaaaaacagttgatcatcatcatcctctgctatcaaaaaattttcagtctctttggtcgtttccttttcagcattttcttccagaattaaggcgacttgttgttgttgctgtttatcagtagatgccaattgatcctcctcctctgttaaattgttatttgttggaataacaattttctttggctttggcggtgccatccgagcaaccgcagtgccaggccttc

SEQ ID NO: 9414 - DNA, 2120 bp, Heterodera glycines
  misc_feature (64)..(64): n is a, c, g, or t
tgttgtgtaaaatgatgttgtcgtcattcatctgttgtgtttctgctgatggtttaggacattntcatcaagcacagcagcatcgttggcatttttaattgacgatgctgacttcttttttggcaacccctcagaccgcttcttccttttctcccggtctgttgaaggcttcttctccgccgcagtttcattcgaaattcggtggttgccatttgttctgctgattttgctgctgctcactttgtcctttgatcgatgctttgttaatgatgaacgatgatgctcttcctccttcttctccttgtccctcctgctgctgctctcttttttgcttttccttttctcgtcatcatcatttttactctttgatgcggatggagaagaagccgcttcaacagtagtcgatttggactttgatgaagcggaggaatgggaagcacttttctttaccgctacatccccctgctgctgcttgttgttgtcttgcttcgcgtacattgtggcctcagtggccaatgactgtagcaagaaattggtcatttctgcttccttgccggccacaatttttgctggcttcacgtcgtcaaggtgaccgtccatgttcagcgcgtcaattaacttttgtagaaaggccattttattgtcgcgcgacgagccggcttttgttgagtcaagctcatcactcgtgaacagaccgtccaaaaagccggtcacacgtaatgtctcatgcacaatgtcgtggatgaatttgaagggtggtcgctgcaacagctgatcagtgagagttggccgttggatgagcgtggaaaacaatgccttcgtttgatcagttgagcccatatttttttaactttttttttctggcaacaatgattgatcaggagctatttttgtagaattttttggataaattaattatggctgaagcaaaaaaaaaaattataaaaagggtgtaatttaatttcaaaattaatccggtgtttaatccaaagaatacaaggaaattataatggaagaagcggtcttaaaatggatttatcaagagattaaggatcatccccgacggattattagattacaattattgtattttgcaacaatgattaattgggcattgaaaagatcttactaaaaaaacccccatcaaaaactgaaatgagggccagattaaaattccccagggggcactaacagttcaattgtgataataatacgaagaagcaatttgtgtgttcagccgagcggagggaggagggcaaagggttgtcatagagaaaggaattaatgaaaaaaatttttttttcaagtgtgtgtgaattgcgccgctgctgtgcggacgtgtatgtgcaatgatggcattttcattcatctcgccaatgtgcgtgatgagtgccgtcgccctttttgtattacacttattttttgatgaagaagccaactaacaatgcggccctgtccggtcggttgcctctctgctgctgctgcgtgagcggtgaatgaatgaatggtatgatgaatgatggatggacggacggacggcacggcacacacgcgcacactcacatacatacaaattttggcaccatgagtgagcatgcgccgagagagaacattcattgtcctcccccgttttcgctctactcttcgcttaaatttcataaaaaatggcacccatccatcatccatccatacataagcaaccataaaacacataggttcttctcggtaacacacccacacagtgtcgaatgtgccgccgtgtcctgtgcgaacccacccccctccaaagagaaagaggacaagacaaatgtgtggggtataaatagctcacatgtacatgtaagacagacagtgcgcaccaatttgggcaaaaatgagggcggtggggaagggtacataaagacggtcatacttttggcacacatgtgcctagaaaaaaaagacagagaaaaatgaaagaagaaaatgccggaacatcaggcagcacacagaccaacaacacatatgtgctgctgccagatataagtaagtattgccatagcaacaaaaggcagtggtaatgattttggctatgtcagcagccagccgaagaattttgggaggggggggggggtgttttg

SEQ ID NO: 9415 - DNA, 1656 bp, Heterodera glycines
ttaaaaaaacagtctgcccccccctctatatgcacaccaaaattggtaagagaattaaataaacaaaagtgtataaatttgtttttttgtacaaaaaaaacaacaacaaaaacaaatgaaagtttaagtcaatgaaaaaagcaagcaaacgaccaatattttcaatttgtatttgatagtgtaaataaagcatacaatagatgccaaatgaacaacattttctattaacaatctatattagaatttcaatgatgaaaaatatggtaaatataaacaaaaaacaaaactatattttaaaaaaaactaaattatggtgcacaattttttttccaacgtgtatatatttatttatattatttatttagcatacttgaccataactaattactttggaaaattataataactcacattttgtatattggtgtgggtggtgaatgatgatgatgttagaagatatgagcaattaattgtgtgggcgttgtttgtgttccgtccgtcaattccttgtcctgccaggctcctccgcttcattgccgctggacggttcagcaacagcatcgttgtgttgttgttgttgctgctgtttgtcttcgtcggcggaaggcaaacgtggcatatcctttaaaagcaaaatagtttatatttttaaatattaaaattctaaaattatatatttttgttcgattatttgttaatgttcttaacaagaagaaattttagtttttttcaaaaaatattttaaaaaacatgtacttctggcaatctgtttaaaaattcctgtattttaatgtcattttttaaaatttggatagggaatgtgaaggacatggatgtcttggacaaaataggaaaatataggtcctgaaaaaacccaggttgccgaaaaacggccaggacctggaatccaggaagaacccaggcctgaatcaaggtccacaggtcgtagtatcccaaatagcactgatgactgacctgcacacagtgaatgacaaccgctccagcaacccatgtgagcaaatgggtgggcagttcaagtcgcctgcagtagtagaacaggttccaaaaaatgattgggtgtgcaatgcgcatcccgggccgtgccaacaccagtgcaccatcggcggcattagtcaccagcgtctccagctcacggcgcaacaccaacggggaaatgtaggggacggtaaaggattggacaatctgcacaatagaaaatagatagagaataaagcgaaatttcagcatttaatggtatagtggtctatgtgcttgactagaaaaaaccagctttaaggttcaatcccagtgagtgcgggaacttataaaatttattttttaacctacaacattcatgagcaaagcaaattttcttaattaaaatttttacaaaaaatatttcgcacctttcccccttcaaccggttggatggatgaggatgatgagacggccaacgtgtcgtcatcagaactattgttcaactcttgttgtgattgaggcattcgcgttcgaatgcacaccttcagcgagggcaaaaatgtgtgctgacaatgggggcatttggtgttcaaattgccatcatcaattgcccatccaatggtcaaatccacatcatacaccagctggtcacagttggaacatggcgacgtgaacaga

SEQ ID NO: 9416 - DNA, 3065 bp, Heterodera glycines
ttccatgcgtttcctgaaataaaggccattcctaaaacggtgttagagttggagttggggagggaagtgggactgatcaccccaggaccccctcacaaaaatggttggatttctaagggttgggagtcccaaggcctaattcagcgcgttccactggcatgtgtgttactggtagcaccggatggttaggcatttggcctgggcggctaagggacaacccataggaaaatgttagtgagggaaaagcatggaaatgatggccatcagtgagtgcttcggcaataaaaagaaagtcctccggaggcggtaaaaaggagaaaagaagagagtgaaaaaagaatgccccgataaagtcagtgaataccctttgggatgcccttttggatgaaaatgcccattaggatgaaattttgaaaatttgggatgccccttaggatgataaatagataaaaatgactttcgggatgccctaggatgcccttcgggatgaaaaaaaagaagaatgccccgggatgcccttttggatgattaaatgcccattaggatgaaaataagtgaaaattttggatacccttcgggaagacaaatacatgaaaaagaaaattcaggatgcccattaggttgaaaatgtgaaaatttgaaaatgcccagtaggaagataaataagtagaaaaataaattatgaattaggaatgcccttctggatgaaaaacgagagatacccttcgggaagaaaaagagaaaaatcgaaaaaaaatcaaaattagtcagttaaaaaaaaaaaaaagattaaatgtgaaataaaagcaaaaaaaaaaaaatgaaatacaaatatacaaaaaaatacagtaggtccttcgggaagacaaagagatgattgataaaagatatattaaaaaaaaaaatacatagaaaattaattttaaaccatatacagtatacaaaaaaggggaactacagtactcaaaaaaaaaagggggggaattttgccggatatgttgatgaacaaagtacgctcgcagtcagcactatcgctctggcccatctgctgagaacattgctcgcttaacgttagcaatgcattttctctcctcctctcttccccccggcgctgttttccctttgtaatcggaagatctgttgcaattcacacatcttttcacagtcatctcttcccttcttcttcttagtcttcttccccccccggcgatgatgggcggaggatggcgtcgcttggccgtttactcataatacgccaataaatatgcggatttatacagcacatttcattcttcccatcatcattcgttttgtgtcactttattattgtcccatttgctagaaatgtttattaagattttcaatttaaaattaattttttttccacattcctttagaaactcaatttcaatttaatttaatacaactcttcagtgcaaattgtggacattggactgtcaacgaaagccttggcaaggacaaatcgctttggcatttttctgtgagtttactgtaatgggtactgtagcagttaagatgggtaggatttttgaatttttgggaccattttggggacaaaatctgttgaacttttgtcaattattttcatggtaatcctgataattcaaaatattggccaaacaaaaatgcggattatttaattacttgttggtgataattttactttcaaattataattaatgggttcctaaagggcttaataaatcaatttattttgtgttttatgagttataggagtttttaaattacggtaaatcatatgtcaaatacatgacatttgttaacattttgagcaccatttcaggctcttccttttgctgtggattttgttggacttggactgaattactggttgtttatctgcttgaaaggacaattgcaaatcgcttcggcattttctgtaagtcaacagtatactgtaatttatgggttaatttttcaaatgacatggctaattaatgcaccgtttgcattaattaattattacagattcctaaaaccacagtaatcaaaattgggttaatcttttcaaatgtacagtaatttccctatgcttttggttttctttggtcaaatttgagtattattggttcaaaaacgatgagttagcaataaaaagagtaactgttgacattttatgattaatgttttacttttaaccacagactcattaattcgaatgtgacattaatttcaattattaatttctgggaataatttcaggtttctgttcgcatctgactgataaatcggactttgtgagccttggcatctgcaaattgcctttgaagcccaattaagtgagtccaattaatcaatgacatccaattatttcacacattgggggtgagtgattaattaattaaattgttcgtacacatgcattttggcttcaaattaatgcatttattaaatttcaaaaatggtaattacagtaatttttttttcttttcgataaaatcaaatgtgtgaaaatcaaatttaaaagtttgttttctctctctaattaatcaaccaatccaaaaaaaaataattttgtatcaatgatatgataatgcttaacatatatgtctataatcttttgtttttattttggtgcatttctaataataattgaagtttattgggataaccttaaatagtgttttcttcttaaaatttttttggaattattgatcattggcatttttcaattataattaattgcttaaataattaaagttgtaattcattcagatgaacgaaatggttatactgtattacaattaacactgtaactcattcaggttttggcattgtgtttttgctttggaatttgtcgtcgtcaaggacctgagcagcgtttggattttggatttggaatttgacgcaacagcctttgaacactttgatcttctgtggccaagggttggtcaaatcactgattattgacttaattattcaaattattcaaaataataatacaagacaagacaaaacaaaataaataaataaacaaacaaataaacaaaagggaaagaaataaaattaaattattgcttcgg

SEQ ID NO: 9417 - DNA, 1576 bp, Heterodera glycines
  misc_feature (1558)..(1558): n is a, c, g, or t
attaattataacagattcttaaaccacagtaatcaaaattgggctaatcttttcaaatgtacagtaatttccctatgcttttgattttatttggtcaaatttgagtgcattattggttcaaaacaatgggttagcaataaaaagagtaaatgttggcattttatgattaatgtcttacttttaaccacagactcattaattcaaatgtgacattagtttcaattactaatttctgggaataatttcaggttttctgttcgcatctgactgacaaattggactttgttgtgagcctcggcatctgcaaattgcctttgaagcccaattaagtgagtccaattaatcaatgacatccaattatttcacacattgggggtgagtgattaattaattaaatggtgtgtacccatgcattttggcttcaatttaatgcatttattaaatttcaaaaatggtaattacagtaattttttttcttttcgataaaatcaaatctgtgacaatcaaatttaaaattttgttttctctctctaattaatcaaccaatccaaaaaaaataattttgtatcaatgatatgataatgcttaacatatatgtctataatcttttgtttttataattttggtgcatttctaataataattgaagtttattgggataaccttaaatagtgttttcttcttaaaattttttggggattattgatcattggcacttattaattcaaattaattgcgtaattatttaattattataattcattcagatgaccgaattggttatactgtattaaaattaatactgtaactcattcaggttttggcattgtgtttttgctttgggatttgccgtcgtcaaagatctgagcagcatttggattttggatttggactttgacgcaacagccttttaacactttttgatctttgtggttcaagggttggttataatttcgaattaattattcaaaataataatatacatataaaaaagggacaaataaaataaacaaataaatagaattaaaaaataataattttttaatcttgcctcggcaatacaaagcggaatggatatgtttatctaaatatatttggtaaacactaaatagatgcaaaagaagtaatttaaaaaaaaatacttaggcatttaattgtggattttattgatcttggcacatttaactaagtaaaagattgagtagacttaagttacatttatgaaccaaaaaataaataaaactttttagaacttgattttaaattgagggcatacctctcgaatgcattaaaaaaaatatcagtgtcaattctctcattagtctataaagtggacctgaagagatgatgattaggtgccttctagaaaatgtcggacagtcaacatttttacaactttcagaaagcaaatgaaattatcaaaatcagtcacgatggcgaactctatcaaaattttcatcaagggacacagttactcaaatgagccaaaacatttagacataagataattcagagtaatgagaaaaatgaataggaaattacgcggggccattacgcntcggcaagccaaacaaaa

SEQ ID NO: 9418 - DNA, 918 bp, Heterodera glycines
aaaatgtttgcaatttttttgtttgacgtagacataaaactttgttacattttttgtttacctaacttgttcggatcgaatgttggatgtaattttctctggttgaatgtttggaacaaaatgtttgctacatttttgttcaggtaaacatgtttcggtgaatgtttgccacaaaatgtttgcaatttacgttttgtgctacattttttttgtttgacgtaacttgttcgatcgaacgtttagcaaattttgtttgacataaatttgtttggacaaaatgtttgttacattttgtttgatgtcaaacttttcagtgaatgtttggcacaattattttttatttggcaaaacgaatgtttgcacgcacattgacataaacttaacacatttgcaacattttttgttagaagtaaacttgttcggatcgaatgtttgaaacgtaaatttgttttggttaaatgtttggcaccaaatatgtttggcttaaacttgttagggtcgaaagtttgtgcgcgttttatggtttaattgttttgacttgaataaaacatgattcattcggcgctactgtaaaagtgggtctttttgaaaattaattcaaaaggggggacccttttgttttgcaaaattttttttgtgatagtcataaaaatttattctctggggtttttggggtccccgatcacgaatccttcaattattttgatcaattccgatttcctaatctaaatttgaacaaaaaatcataatttgaaaaattcaaaattccgatttttattcgagttcgggttagggattagaaattagtcaaaatacatgtcagattcgtgattagcgacctttaagaccccggataaaaaattatcatggttttttatcacaaaaaaattttgcaaaacaaaagggtaaccgcttttg

SEQ ID NO: 9419 - DNA, 2619 bp, Heterodera glycines
tatgatgtccaatttgtttatttactgtttaagataatttccgaggttgacaaagaccgatgcatcgcattgttgaggacattttacgaccgggaaaatccatttgcgccggaagagaaaagaaaaacaaaaaatggcggccaaaatttcgtgacaaattattgatgaatattaattatttttaatggttcaaattattctgaattgattgatgcaaaaatggattaaataggaattgttatacatattcatttatatatttttaataattatccaattttaattttgtagtgcttaccatcattttattttttttgaccaatggccaccaaaaaaagacaacaaaaaatgtcggaggaaaagcaaattgggcgaaaaaaaccaaggagtttggaggtaattcaatcctttttctcttttgtatttcttaccgaaaaaaactgaatagtgatcacaaattccttatttttaaaatccattaaatttagaaggaaaatgtcgaaacaaaaattgacgacgacgaaacattgttgaaacggttggacaatgtgttcatggtaaagcatccgccggaattgctcaatttttggcgacacgcggtcaaactgaagcccaaaaatccattgggtatattatttttcaataattaaaaaaagaattaaatttgcaactttttgtagcgggggttggaaaattttttttttttttctattttgttgcatttctccattcttgggataccattggcctacctacacatgtccccctatacagatgccttttcggaattggactcgttggaattggtcggcccttttttgctgcttgccgccgcccacagcgaacggaacgccaaaaataccaaaaatggcgccacagcaacagcggacgaagacgcacagcaacagaaccaccttttgttgggctcacgctttgccaccgatttgcccgagatggaaactctgctggtgcaccggggcggccgcttttgctattggcgcgatgtgccgggggaaatgccgaacattttggtgcatgtcgccggtggaggggagggacatgaccatcagccgcaacagcacttcccggcgatgaccatttgcggggagcgcgacctttttgcggcactccaatttgtgttgaacaaattggtggacacgggtacaacgacgacggcaaaggcgaagagacaacagtccaacaacaccggcaccaccaccaccagcaatactgggtaataatgaagcaactaattgcccaattagaaagggtccggaattcaatgaaaatttcaacaaaagtttttttagcgattttttcaaagaattctaatgaattagtatttttcaaaaaaattttcccaatttttttttgtataaaaattttgtgtactttcactaatgacagttttatttacttattttttcatccctttccctttcaatgcgcagcgtaaaacctgatcaaaaattgtcacatttgttccccgacaatttcggcatgtccaactatgggcccgactatttgcaaatgttgaaaaagcgacgtgccaaagagtctctcggcatgccattccatggcattggcatcaaagtgcccgtgaacaacaaaggcattggctaccgaccgctgtcggacgacgccaaggaaaatggtaaaattttcttggtacgcccattttaacatcgtaaaatttacgggtttttttcaaaatttctcacagtaaatttagtcaacatttcagcacaactgaagcgaaacatcgaaacaatgggcacaactgacaatgaagagaagaaagctgagctgaaggagaagttctaccagatgtattcatgggttcaggtgcgttttatttttattcggaaaaaagttaccgaatttttgcttggggtgtaccacacccggcaacaaatcctttttttttgattttcacattatttttttgtcgcatatttttaaaaacaactttcggtgaatgtgtcgggtctggcgtagacgtcgccaagaaaaatttagaaaactacggcttttgtgacgatttttgtgattttttttttttgaaaaaggcgaagttttgttttcttttaagttcgcaaatgatgaaatggacttcggcatgggcctggaatttgggcacgacctgttcatgtccaattacgcgtgctttgacggaatggccaagtctgtgctgatgacttcgtacgaactgttgggccgcaaacagttcgccacactacttgagaagcacatggaagtgaggcgtcatgaaaaatgtttttgaatgatcgacggaccagaaaatgaccgacgaatttgtcacatttattcattcatttatttttaccaaatcgatctcacacacattcaatgaatgttctctgctttgtttgcccttttcattttgacatttatgcatttgtttaattaaactattttttttacagttcggagtgtgcttttggtaatgttctgtgcttggcacaaccccaccccagggtttcgaccaaattcgaatcccgaacccggattcgaacaaaagtacaaaaactcaattttaaaactgcattttaaattcaaaacccggctaaaaatgcggaatcaaacagtaacgcatta

SEQ ID NO: 9420 - DNA, 2545 bp, Heterodera glycines
ttcgaacttttgttcgagttcgagtcttcgatttggtctttgtcgaaatggatcctggattcaaaatttttttaaatttcttagtgtttagagcacctaacttgaaaaccaaagaggtaagtagtcagcttgatatttccattaacaaactcgcctaaatttttaggcatgtttcccatgatagatcaaatttcaattctgttcaacattttgtcatcaacatttataaacgatcaacaaaaaaaaaaacggtgtaacaaaaaacattctgtatttcctcaaatgtttgacgggtacaacatcacacggattcgcttgcccatggcggtcggcggcaaattgtgacgaaacttggcacgcaccactcccgaattcccatgcacgcgcgtaatacgtccccaaattgcacgaacacgcgtcttcggcccaccaccgcgtgcgattgttttgtgccccttgtacatgtagacagcacgcttcccaagatagaaactggcatccgactaaaaacggggcatttattgcacttacaactatctaattgaagcgccgaaaaatttggaataaatgcgtgaacagaaaatagtcaagaaagggggctaatctttcgcggatttcggtccaacatgaaaattaacatttgtattcagggaccaaaataaataaataaaataaaacacaaaatgaaataactttcactcactactactaaaactacaagcatagcaattccaaattaatgcaaacagaaaccttgtcattgaccccgtcaagcttcagcagggacgtgttctcgtgctgagaacggtgtccgcgtttgtacccggtaaacaccgccttcacataaaggcgacgtgccgacttcggtccggcacggcgacggatgggctgttgttgcgattgttcggcggcttcgaccattttcccttattttgaataaattcgcaaatggctgcaaaaacagtttgaaaataaaaacataaatcaaatatgcaaaatattaatgacacagcatcagactgtaaaaacaatggatgaaaaacgattgtaggaaaaaatgatcaatttatgcatcaaataaaaaaattaaaaaaaaatccggacgaatcacttttttttcttcaaaataattccgcttaaaatcgccgcctgcctattttttcttgacgatgtagttggacaattctccgccttttcctgctccaccgcctcgtcatcgtttaatcggcgctcaattttaccaccgtttgcccgcccaaccagtcgttccacttcacgctcgtcctcctcctcctgcacacgaatttggtccgcaaatgacatcgcccgttgctgctccgtctcgttgatgtatgcaattgcgtcaatcttctcatagcgacggttcgactcctgcaactcctcaatgtgtcctaaatttagagaaaaattcgggttccgatgttatttttattggactcggaatatcagactaattaaatgacaatcccccgttttaataaccaattgaataccaaggtgtgactaaacaatttttctcgagtttccgggtttgaattgtgtcacttttaagcattggatccggaatttcagacaaatcaaatgaaaattcccgatttaaaaaccaattgcatatacttttgtgatgcctttgacatttttggtggctgggaacggtttctgggaaacctaaaaaattcaaaaaccctaacctaatgcctccatttcaattttgctcattttggtccgcttctccaacattttcattgcgtccgccttctcctcctcttccttcacttcctcccgcctttcctgctcctggtagaacttgaatgcatcaaagagccgtgttgcgccatgttccgcttggtagtcgacattttcaatgtccgtcttgaaagttatttcggctaagcaattcggacatctaaaacagttggatgagtcaaaaggaacgtaattttatgattttaattgttgtttcatgtactcgaagattgcaaattgcataaaacaggaccaattctgacaccttaaaacacgacacacggattcgtcttatgaccaaacaacttttgtgtacaaaatttggtatacaaaatccgtgaaaaacgctgtaatttaatgattgtgattcattgtaagaccacaaaatgactccaagccagaaatacagttaaaaattgtaaaaataaacctgaaatagaagcggaagatcttcaagcccaaatagttctctccctcggctgtctcgcgtcgcatgttgaacttcttgcccttgtaaatgtactcattgcaagtgttgcaccgcatgttgaacggtgtcatcacacgttggatgaactgacggttccgtggctgtttggcctttggaattttggccgggtcaaagtccggcgggtagtatttctgcaatatgttacatgttttaggtggtgtgaattggtttgaaaaccaaatttcaagaacttgcctggaagacttttcgttcggttccagtcattttggacgaatattactagaacagtgaaatttgtttatctct

SEQ ID NO: 9421 - DNA, 1175 bp, Heterodera glycines
aaattgtgctcactttgcatttcatttggcaactcatttcgcgtcaccgtctctacttcacttgatgcaaattgtgctcactttgaattacgagcaatttgctcacgcattcatttggcaactcatttcgcgtcaccgtctctacttcacttgatgcaaattgtgctcactttggcattcatttggcagctcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgatgcaaattgtgctcactttggcattcatttggcaactcatttcgcgtcaccgtctctacttcacttgat

SEQ ID NO: 9422 - DNA, 2148 bp, Heterodera glycines
  misc_feature (32)..(32): n is a, c, g, or t
gcagaacagcgactgttttccagcaaattcancccgctcccccccgtcgcaatatttcatgcgaccaaatgtgtcgaatacttagagacaacaacatcagcagcatcaaacccagacactttctgctcccattctgactgtacctgaaagccgttttcgggcagaagcaccaactccgtcagtgtcctattctgcttatggtgtaacacaccaacccttgcgggttggacacggtacaatacaaaattaataattatatcgccttactaccatatggtaataattatatataaaatcgccttatcaccataagggtttggattcaacaaaaacccactatttaaaaaaaaatttgagtatttagttcctccaccatccggtcttctcactgcgcatcagtttccgattagtggcgctattcctttcgcggttgctcaccctcatagtcagcaggcagctgcttactttgttcaacagaatagagcgcctcaaatcatttaccaaacattacagtaatgatgatgaaacttatttggagagtccttggaaaattgaggaatgggtgtacttcaccaaaccctctaaatgataaatgccttcgggactgagccgtaaaatggtttaaaacacacaaaagtgcactatgggtcaagcccagatcgtgtcaaaatgatgtatgaggtacagtcattcctcaatttttagtgaattattttagttgattaaattatttatttactatttttgaattatctaggcccatctcttccgtgtcgtcacaactttcaacacaacagcaagctgaccacgatggtagcctttcccatgcgctcgctggtgcaatgaatcctgaggatttatgataatcttctcaatttacctaatttttattttctatttcatttataaataaattggtttttgtagcgcagtcgacaaaagcttaaaaagaaaccaggctttattaaattataacgacaaaattgtttacataaatatatcgagatattgccaaatataaatatcgaaaccacaaaagttgagaccgatgctgtaacattgcccagtaaattctaaatacaacaacatcagcattcatttaacttattccaacctcagtgggttagccgaatatgtgacaaatgtatttccatcagacattacgaactcattcaaaaaaaggtcaacagctccgacgtatttccttaaaactgcaacgctcttcagtgccaatgccgtttttaggccgagttctttaagtttgccttcagtattcaagttcaaaatagctttgaaactgtctctgtggtttggatgtccactgatgccccattcgtcaaaagtgatcagtccatcgggtttcagccgtcgaatgtaagagtaaatcagcgcagaaaggctggtgatattccaatcgcgaaaaccatccgggaatcttcgctcttctggatccacaaaagagatgtatttgggttggatgccataaacagaagcagacgaatacaattcatttcgcctaatcgttccaagtccctcagaattccccgacgtaatgcacaacaaatgcaattgaacaccgatagatgaaaggaacaacagagttggtccaaaaaacatcctgtgaatttacccaataaatttgaagcaaattctatgcccatacgtttcatcatccgggtgcgcaatgagaagaagccatcgttcgccaaatttagcgggaaaaattgttttgttgtcaaaataaaaatggagagcaactgataacaaactgactaagaaagcagtgaagaaaaatttaaaagctttttgcatcctttctttaacacgagtggtttaaattaaaatatacataggtgtattaaaactaggacagtctcgaaaataggtaataaatggaacaagcatgacaaaactagacttcgacctggacccaggcctgaattttctttgatccagatcccgtaaagaaaaccaaattcattttagctttagtgctgaacaaaaaatcacttaattttttcccttcccctaccgtctgctaccctaattatcgcttccaattgtaccctaaggcaacaaagcaaattttgagagatatttgggtatctattaaccagttttgacccacataaattttttttgttttta

SEQ ID NO: 9423 - DNA, 1503 bp, Heterodera glycines
gcacatccaatcagtgaccagctgggatggacatctttgaaggccaaataaaactgaaaatacagttgtaaaattaaataatattttaccaattaattaccgtattattattgttgttatttaaagtggccatttttagaatctaaattggcttgacaatatatcggacgacgacctaaattttaatttatttaagcataattgcggtttataagccgctttataatttaaattcagtgtgaaaattttgtaaaaatagatattaaaaaaatattgttaatattatcatttaaatgtttgcaataaattgaaagaaaatttaaaaagaattatgcattaactttataccattttgtgtaagttaaaaatattttctgaatttttttttcttcttaaaagtgtggttatttgaaaaggactgtttggccgagttgttagttaattaactaaatatgtaatcatcaaactcctaacatctaattaattgaaataatgaatacttgtcatcaatgacgcattttcataattataatttgatagataaattttttcttcaatttaataaagcataaaaaaaaaaataataaatgagagaaaattttcaaaaatatttcttttatgagttaaaaatggttgatatacttattagagctctgtgtggctttttgccagaatttaaaaaatcactttttttctcaattatatcaaattacggcttaaataaaaaaattaacaactaagtgttagctctgtatgtttcgggtcaattaatttatgacagattgttttttctcttattacgaaaagatcatttaatattaactttttcattagttctttgtatgatgtcaactcattcacctgctatatgactttcctcacaatgtacctatgtacaataataataaagaaaaaaatttttgtttgtcattaatgcacgcgttttccgcttggtttgaggtgtatacgatgacttttataatgcctatttttgcatacacgtttttatcattaaatcaaaactttttatgtgggtcaaactgtataagtaccgaccgatatttgtatgcgtttttttgttgcatcaaaaacatcccccctttccgctcggctttagccattctttttattttacaaaaaaattgtatccgacttaaaatggctggttgtttggatgcgctcccacatcaggcacacttcgactgggataccaaacggaacacatattcagccgttgcatctgggtttctggtagttttttttctggttgtttgttgccaattttataatattttcagttctttttggcttggtggcttatgattgacacagcggtcactgcgcaaaaagcacattggacaaattggtaaaaatggtaccagttaactttggggggtttttgtcgtcttttaacatgaatttggtattcattttgaccgaatccctaacccgaattagaaacatgtcgaaaatttgcaagattagttttccgaccttttttcg

SEQ ID NO: 9424 - DNA, 1574 bp, Heterodera glycines
atgtttatgtaaatcccataagttgtcctatatgtaaacgagttgagtttaagggttaattctgtctccaacagcgcaatccaaggcaattaccttgacgagggagtcctcggagtgaaaggtaatgtttattatccaaataattatgcgaaactcgtcacaattaggtgctcgcctttggcttatgttcggttttatcggatcgttcgcctgtattgtggccggcgtttgggtcatgtaagtccacttattattttaaataggtaattttctttctttaggttcggtgacttcgtacttaaagaaggacaaaatgacaattggccgggaatcgcgctttttctccacacattctttatttttgtggcttcattggtttacaaatttggacgcaccgaagaattgtgggagtgaaaaagaaaagaaggaagacgtcttcagaccatttcgactttttccctgtaaacgatgtactcttgtaatttcccattgatttccaacttttacacttgtcaaattttctttaatcaaggaatgacattcaaattagttctgcataaaacaatttctttctacgaattcgaaacaaatacagtattttatttattctgcctaaaattacaatttctttatttattgttagtaaatgtttttcgtttacctccgtttagtctccgcttatgttttctcatcagtgtgtcctaaaggcatctctcttttctcgacgacaatttatacgattctcaaactctgaggtggaatccctttttgtccctttttcctgtatgtttcttatcttttaaattccgcagttgaggcgttcgacgcgtttatttcgtcatttccatgccttacctccctctggtgttccagttaatgtaagcgaccaagttaagcttacaataagattttaatttgcaaaacatgggttcggattaattgttctttcggattgtgattatgtttaattgaagattgttttctttttatgccttttattggtgtagggcctcggtggcgcgacgcccagtggcttggaaatggccaaacgactcgcgcgccacgtttggcctaagggacagtggcgcgtgaagggccgtgtacttttcgccttttccttgctcatcgctgctaaggtcggtgatccatttagttattcaaaatacgttttctccagcttctgaatgcgaccgttccgttcgtccttcgcgacatcgttgacttttttaatgggaaactcccggcggagctgtcgctcggattcgcattgcctggcgaagccattctgtcggcgggaattgctctgataattgcctgttagtgtttttgacaatgaccaaaaattttttttttaattttcgatggcgccgcgaggggcggcacttcgctcttcaacgaagtgcgttttttcggtttgactccttcccgcaataggccgttttccagcttcgaaacgctgtttttgcgcgtgtcgcccagcggtcaatccgcgacatttcccgtaacattttcctgcatttgcacagcctcgacatgtcttttcatctcaatcggcagactggcgcattgtctaa

SEQ ID NO: 9425 - DNA, 2498 bp, Heterodera glycines
gtaagcaactgaagggaaagcgcggatcaaacgaacccccccccagggggagggcacctgaatgaagcaagtgatcagaccgatccgagtcactccccgcttttctgccgcgaaatgattctctcgcttcttcctttcttggtgagcagcggcactcagcagactgttggcctgcacttgtgccttctcattggccaaaagatgacgacggtgtctgtttggccaaacccaaaggcgccacacaatcattacggtcatgaaaaccttacaaattaaggacaaatgaatgagtggggtggggatacggtagcaacggcacagtatggcaaattgaatttaaaaaacttaccaaaagtgttaatggaagcaaaatggagaggagaaggtcggccaaagtgtgcactttctcgaaaaaacccatcacaaaatctaaaaagggaaggcacaacagaaaaagggcaacactttggaaggactgactttgggaagtgtttattttgacaattgtgcgattgcatcggttggacagcgaaacggtgcgattgagtgggtaaatggaggcgaggataagcctaattagggggagggcttcatgaaattgccccgggaaaagacatacgcggcgaagaaaatgaccaaataactgcgccaaacggtctgtttagtgcagagagtcttcgacttggaggggaagaaaatgtggatgtaacactcagctgaaatgggaaaaaggttcagtcgaacagaatgaggagaatgaatcttctggggccatcatcatcattagccaatttcgcttttaatagcgcactttaaattctgagagaaatgacttttcatagtgccaatctccgttaattgaatttgagtttattatggcgttttcgtctccaaaataatgttcaatttgattttctctggctttcaggttgggttgaataatatgtactttggctttgccaattggcttatgatggtttttcaattcccttcggtgcgttccatgcccacctgtcattagtacggtcagccacatcgcacagaagccgaaaacatttgtcaggtaagcctgtgcaaattgaacatcacttagggagggttcacgtccatatccgctacctgatatggccaaaatgtccagtagagaatgtcagttgagccaccgatgtcccaaaagcgaatgacgcgtagtgcctgcggcaccatcaccaccatcatgcacgtgttcatcagctgatgggcaattcaatcagtgagaagccaatcatttgcatgccaaaacagaccaattttgtgcagagcattcgaatggcaatgaaaaagcgaatttgatccgagttgtaaatgagcagattgatgcaattgccaatgagcgcgaaacaaaacaacaccaaaaagccgtggcccatcagcgactcccacaaaggcttctcatcacagcgaacctgagaaagaattttgttgtccgacaaatttataatttgatttattaattaataattagcatttgatcaattacagtgtttttctcaccaaaatatccgtgcaattcaccgcaatgtttctgccaagtgtggaagtcattgcggactcgagaaatttgacggacgccgctgggcccggcaaatggccaaactttgcgttcggattttgttggaaacggttgatctgagccataagaattcccaacgcagttttgttcaaagtgttcggctaaacatttggcgaagtgtccttttaactgatcgctctttcaatgctttcccttaccaaagcgatttctccgttctctgatccgtcttcttccgcctcgccactgtcgtcgaaaagctcttcaaagagttgacccgcttccatcgaaaagtcaaatattatttttaacaattaataataaacctaaagaggagaatttaaaatgtcgaacattggggaaaaagacagagagagggaatggaggagacgaagaaaggaagagagagggaagggagacgaaagaaagtctgagaggggggggggggagaaaaggagggagcttttgaaatttgcatttcgaagacacgggggcggaccgattggatgttacgctatggagtttgaatgtgccaagggtcgtcttggctttatctgctcgccccgacaatgccttgtttgtaaattgttattattttgtacaattattcgtatttttccctctcaattattttccctccatttgtgtgtctttacgaaagggcggtgggcgcaataatctcaagtaatgggcctcgctttcttttctattgtacagccctttgaaagggcaaattattgtgtggttggcacggcactgcgcaccggcggatggacggagggaaaagcggcgagaagccacggaagggtagcaggaacacacaaatccattcattcaaaataaagccaacccatgtcatcgaaccgccgaatgggatgggatgagggggcaatgggagggagggggggggggggggaaggggagggat

SEQ ID NO: 9426 - DNA, 3828 bp, Heterodera glycines
atattaaaacgtttgctttgagagcattctttgaattttgtaaaccgaaaaagataattagcaaatggcaacaaaatattcactttgctgtgtttttctttgcttttatgtgcccaaaagtcgaagacttttctgtcattaaaaatagccgaacaaaaatgatggataaatgaggagattttgaagaaaaaaataaataaagaaaaagaatttgcattttaaatttaaaagaaaaggggaggaagaaaaaagaatgaatgaatgaaccggaaagggaatgaataaaaaaatatttgccaaacaaaaagtgcaaatagcgaaaggctaagtgtgggaagtgccggactattggtttatttcaatttaaatccatcaaacaataaatgttgtgggagaatgcgcaaagcgataaatggcaggcatccatcactgatgggagcgaaacacacgcgcgatggggcgaacggagttgggccatgggatggaattggcccttggtggataaaacggggcatgggaaggtcggcccttgggacagagtcggcatgggaaaattggcccattgggacaaagttcgctgtgcgaggctccttaacttcaacgagcatgagattggtcattggagctgatcaatttatctgtttgccttccgcaaagggtacaaactgtcttcttgaaaagctgataccgttaagcatctgccgtaatgacaaagcaatgctctgacggaaagggacggtacagaaacggtgacaaaatgatactcatattgaaacttttatttaattatttgttgaaagagggaagagaaattgcattgctgggtttcttttggcatttgttttggcgttcttttggcattttgggcgcgcctttgaaattttgccgttttcagtttatttttctgctgatcgtaaagtgacgagtgaaatgccatccacccaaaaaacttaatgttttaatccaaaagcacgagaaagatgcagcagcatgaatggatggatgagtgccgacggacggaccaccgccctcctaaaattcgtttggatagtgtcgaattacccaattgagggcgaagaaaatggagaaagaataattttgtaataaacataaaatgaaatgaattataatttaaataaattgaggacgagcagaacgagcagtttcatcaaaaaatataattctctttttgcgcccgactgacctatcagtgagattaaacagcttaagaagtgcaaaatgagcaaatggggagaaatgccatttgaagattgacaaaatgggagaagatgaaaaaggcacgggatatccgaagtcatgcgaaggattaagatgaaccgacccgcaacgaacggcacttttgcaaagggcggctaaaattgaagagggggggggggaagcacaggtgggacggaattaaagaaaggagcaaataaaaatgggaataaaaaatgaaatatgttctttaattctggtttttaaaaaaagtaattttcatttatatgtttaattcatttcggcttactttttggaaacttcgcttcttaagaatgttttttcctgaatttttttgttaaaaacttaaagatgaatataatcttttatatccgtatgaggacaaaaaaaggataaatcctgaaattttatccctaatcattggatagacaaagccaaaaacagtaatataattttaattgtattgtttgtgcaattaatttgggaaatataattatacaggaaaagaaaagcgaagtcgaaaaaaggaaaaagaaatgaggaaaaaagcatttgaagaaaaagcaaaggaaaaagcaaagatggaaggagagataagcggaagaaaggacaaaatgtgccaacagaggaaaatcgttgaaatttaaatttatttacaaaaaattatattttgtcgcatttaagcgtggtatgtttttaaaatgttttttaacttatttttaatgaattttggacaagatttgttaaagatttaaccatgaattgaaaacgatttattctgagttttaaaaacatttttattttcgtggatgaatttacaagattaagcattttcaaaaagttatgtcatccttagccagggctcgtaaatcctcaaaattgacctttttggataaaatctgttaacaagtcttagaaaattccaaagttttccactttcggcgctattatcaccgcgattcctttaaatttttcttggattttctccaaaaagataagaaattgatgaattttgatttaaattatgtttcctatttcaatgattcttcgagcctaaaagtgaccttcctgggttatataaaatgcataaaaccagtgctgccattgggaaaaccgctttccaaggacgggttttactgatctacaaggacccaatgggaaaaattcgtcgaataaaaggacacttaaagttttatcatatgcaatgaaaatgattaatttttattcaaattgtttgtatttttcgccggaattattttttccaatattttttttccgcggatgattttcctcatttcacctcacgtgactttttgcggcgtgcttttctcaaaaaactttttgttgaacaaggggttccggcgtgccgataggcgccgccgggaaaaacgaattatttttgtgcgatttacagattttgcactgaataatgccacaagttaataaaaatattgatttaaaatttgaaaaaatgataagttttgaatgttttttttcgaatgatcatttccaaggacatccttggaaaaaggactctttcaattttccaatcgatgaggcctaatccaaggacgaatggcaactaatgaggaaaattagcattttcataatgaacagtcaattcgttcgtttgtttgccattgtctatgaattttggtcacgaaaacgggttgaatgaacaagcaaaaatcggctgatttgttcagtgagtcacccttcggccggcttcatccttcggcttcgccgtgtcactatcactcacttttcgcccctcccccgcggcgtttgccctttcctccattggtcccttaccattctctcattccaacatttctcaatcccaagaataactaatttgctccatatcgcgttctcttcctaagacatgtcaatacataaatgacacaaaacaaaattggcttattcggcgggagaaagtgggcgaaggggcgggggaggggagggggggggactggcaggcagggctgcactaaactggcaatttcaatccctaatccgttattttatctcaaaaccccttagtttcagtaagccgtacgtaatgcttcatcccttctgctgctggtgcggatgaatggggtggtgaggtgaggtgacctgatgttttaggccatgacctccccggccgagtaatgttttgtggggtggggtttctccgcctccccctaataattccgctcatcagcagcccttcctcacccattgcatttccttccattcattcattttgcattctctgaaaaatggccagcggcagtggcaaagacggaagaggaggaaaggggggggcataaaaggcaccgtcggcggaatggctgagaaggctatttaatttcattaaaataatgcgaggaaagaaaaaaaattagaagaggtcaaataaaaagacgtaatgaatgaatataatttatgtaaaattataaaaaataaaatattttaatggaaaatgagcttcaatttactaaatggcctctcaaaagaggacatttcaaggacaacaaattagtcaacggctttggagttttaaataggagatctcttttcagcaatttgtcgtaaaagtttgctcat

SEQ ID NO: 9427 - DNA, 5273 bp, Heterodera glycines
cagcatgcgtttgcacattgttgcagtggctgcaaaccgtgcccatgccgtactcttcccgtttcattatgcacaaaaaaggcacaaaaaagtgagaaaaaaagacacaaagtgtgattttatatgggacaagacaagacaagacaaggatggataatgtacgtttgtacgtggtgattggccaaattcaatcaagtaaaagtgccaaaaattaacttcccattcattgaaggagataaattataattttttatgaaattattgtacatgttttggtgcccttttgatggcatcactataaatgagaaaaaataactttcaaaaaacccgtattttttatccagagtcattattgattataatatttttcgaacactatatatatatatattatgaacagggaaaccgaaacaaattaaaatttgaagaaaaaaaacataattctttcgttttggcatgtaaatatttttgtttaacgtgaaataattagcttttgttacaaatttaaaataatttactattgaagaacaattaattaattttttattatatgattttcaaaattttaaaaccttcaatatattttaattgttattgtttttttcaagatttttgttacattacatttaatcaattgttccaagttttcttcttctatcaaaccagcgcccgatgggccctgtgaaagcgccgggggcgctttcaacacttggcaacagaatgaaacatccctaaagattaattgtcataaatcatttaacagctgtgttaaaagtgtgttttataataaaattcgatttaatcatgtaataataagaaagggacaaaatgttaggtgccgggtgggaatcgaacccactcaagcattctttcacttggccaaaactctaccattgagctaccgaggcagttcagcatgtaatcaaccccgcttttacaaactggagaacaattttttttaattatacatttaaaagtaggaaaaaactctctatgaattaaatatataattttttgatgcttttcctatttttgaaaaatttaaaaatttttatatttttttgaaaaagtgttattatgaaaaaattaaattgggggggggggtgcaaaaaggctcttctcggcgtctcatttttcgcattgaccgagaccgaaaatccgagactcaaggccaagattcttgtccagcaccaagaatgaatatgaaacgaattaattattgctgcatttcgcatttgcctgtcccactttatgttaatatttttttcaaaaattttcataaatttcctttttaccaattccttcttttttcaaaaaaaatgatgaataaatatttcagtagtatatagtcccaaaaggttgcgggttggttgcgggtgtttcccgcacgagcccgtgcctatgggaggggtgcagccctttgaagttgccgccccataaaaaatccacgatggggggtgtttcaaaaccaaaacctattggaccactttgaagctgccgcctgccaaatccgatttcccaaattgttgcgggtgtttttttcccgcgccgcgcagcgccgcgggaaggtcatcaatcatccacctgtcaccaaaagtgacaggtgaaggaaattcttttgccaattaattcctttttgatcccaaaccttttggggtattttctcaaatcctgagattttttatatgattttttatcctgaaattaaaactcattttgaaaatttgccaatgtgcgtttttttttttttttgcatttcctcaacgccctccctccccgcgcacgatgccgccgccgcgcaaattaatcaataatggaattgtagaagtgtaaatttaattaataattgcagcaaaataattcagataaataaattaatgaattgggcaataaaattaactatttaaatataaattgaaaatgaataataaaataggatgggaaaaaaactttcaaaagtaggtcatctgccaataaatttgattgatggtttttccattatttagcaatctgaactgactttttttttttgtttttttttcatccaaatatttcgcaatatgagaccaatatttttgaaaacctgtcaccaaaaaatgattgatggttttcttatttaaatttaaccattatttttagttttttggtcaaagtatttcgcaatagggcccctaattttgcacttgtcaccaaaaaatgattgattggtctcttatttcacaatttccccgttcatttcgccatatgcacgtgacttttttgtttttttttgttcccaatatttcgcaatctggaccaaaattaggtaacctgtcaatcaaaatattgacaggtccaattttgcacatcactcgtctcgtataaaagccgccccaaattcacccccaatcagttcaaccaaaaagttggatttttgctaaaataaaattgtgcgtaaatatttagaaattattaaatattattaaaaatggctgcaaaacgcaatggaacctctcaacaaagcggaccgtcgactaaaaaatgggatttccgatcaatcgggtaagtaatttttaataatatatttaagagacaattttaatcaataatttttcaggaacaattttactgaagaaatggaaacttttaaattagtggattatcgttcaacgatttgcgaaaaatttggatttacgaagaatattgtggaatttacgatcaacccggacgtgggacgccccgataaagcgatgcaggatgcggtcgacacaatgatacaggtggcttttaaaaatacggaagaaaggatgatgaggaaagtacgaatgtttggagtggccattacgggcgccgggcttgctttcccggtgtgggtgccgtacagggcgtacccgcagaacaatgcggaagttattatgcaggaaatcaacaagctgggacagagcggggatggagaggagaataagaaaatgctgttgctctcggagccaatcacgatgaaaataacgtgtgtgacaatgcccagtggagaggggccgaggaatgttcataaatttgactttggattcaaggaacaccagcggatagggtaagtgtttttaataaaataaaactaaaataaaaaaatcaataaataaaattaaaagaaatacattaaatttatttaatgaagcaaaaattctttaaagaaaaaatgaaaaaaaagcaacaaaaaaccgaaaaataaattaaaaatattaaaaaataataatttaatgagccaaaaaaaaaataaaaattaaattttaaaaaaatcaaaaaaataataaagtaaaaaataattaattaaaaaatattaaataaataaaaaataaaatttgaaaaatcaaaaaaaaataaattaaataataattaaagtaaagaaaaaaagaaataattatttttaattaagcaaagcagcaaaaaaaaaaacagaaaaaaaatttaaaaaataaattaaataataaagaaaaaataaatggaaataataataataataattttattaaggattacaaatgcggataaattatgtctgttttacgcgctcgtagcctcgaaattttatctggaattgcatgtggacagcttcaggagatttatgaaaaatattgtgagacagagggatgcagctattgagcttttacataattgtggaattgatattaacgaatatagctatggtgtggagcaattaccgaatgttcagaaatattgggtgggtttaaatgaaaaaaagcaaaattaataaatttttcaggatgagatttaccccggaaagtaccgggttgttgcatttgaaaagtcagctgatccacggaaatcaatccgtgttttgtggaagggccctatgggacgtgaaaatgtagtgccgatatttttggagaatggtcactgggatggtctgaagaattacgtctgcttttttaatcgtgggagaaaattttgtattgattgtgagtgcttttttgacaaggatgtcaaacatactttcgagtgccgggcaaggtgttattattgcaatagagtgaggggaatgccatgtgaaaaggagagtggagtgaagattgaatgcccaaagtgtcaccgttacttttacaattgggagtgttataattatcatcatggacatcagacttgcaaattatggaggcgttgcgttatctgtgacaagacttatcgatttaacccgaagaaggaacatgaatgtggtgagacttattgccaactttgtagtgtgagccatgaccccaagcgggggtgttatattatgccgatcgaggagaaggaggaaaaagatgtctacagaattgtagtttgggtaagatttaataaagaaaatcaacaaaaataagtctttaactccaggattcggagacttcgcaggattctatttacaagggggaccagaaggagcatgttattaattatatttcggtgagagtgacgtgtacggaatgctgtgatgacaaaaacaggacgaattgcaaaatttgtggggaggagaggatcaaggattggagcgaggcggagggacatgagccgaccaaggattttgtggagtggattttaactgcttttacgaattacgatacgtacatatttgcacataacgccggacgttttgacggtaatttcaaaatttaatttttaaatcctaaatttttaggtcattttgtttttaattacctctgccgtaccgggaagaacccgctaccgctcatcaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaggaaaatagaaaaatttttgaataaaattcttttttcaggtacaatgagaacaagggggcgcccttttatttggatgaagaattgagaaattattgcagaaacgacacggagattttattgttgtcgattattgagtttcgaaggatattgattaacgacattactaagggatttgacccactaccgaggagttgtacgaatgcgggggttgcgatgaatatttttaaggcaatgtttttgttgacggagcagttatcgattgtgccggagaagggatatgagcg

SEQ ID NO: 9428 - DNA, 571 bp, Heterodera glycines
ccattaaattaacttttttctttcctttggcaatggccacacttttggtataaagccaaaagaacaacaacaaagggctaagcttaaatatcggtggaaattcctcgcctctgtcattgaccagtcagtcatttttcccatttttcatttctccctccaaaaagcgctcttcccttccccttctcattccccccccccgctcgttcttacatttcgtcttttattctggccaaattctcccccccccccggcccgtccttcccacttcgcatattcgcttttccttcccatcctgactctgttgctgctgctcctccccaacctctccctgctgccattccgttgtttatctgtccccccccccaattgccatttcaccaaacgagctcattctgcccgtccatcgattttcagatctaaatattacatacatttgctgtgctgttgttgcctctgctccatcggtgcttacttttcataccgtccgacccctcttcccccccccccctctcttccttatctgtccgctgctgctttgcttgtgcttgctgccatggtccgctccttctcc

SEQ ID NO: 9429 - DNA, 3943 bp, Heterodera glycines
aagtttcattgacagtaagcaattctttgtcagtcgttaggactcaatttatggctgttcttcagaagaggagatgatctcgcctggccatcaccaggaccacttctccaacccgtcctttggctctccgtcttataattcgagtccggacgaggaagagcagaaccgacgccaggaacagtcgtcgtcgccgtcattgagcgaaattgaagaaaaggaccacactttcctgaaaatcgacgttgagaccgaaaaggaaagttcgcctcaacaaatgcgaagtgcgggcggcggaatattccctcaaaactcggccaatttccaccgatacaacgtcaatgatcatcgcgcaacggtcaaaatggagacgaccgcggaaatgggcggagacggagagaaatgcggctgtattggcgaaatgccaccgacttcttgcgcagagaatgccatccccacgtcggcacatgcacctcccatctcaatcccatcgtccatgccgccttttccttccaatccgtcacagcaaccacaacacaccgtgagcaccaccatcttccaacaacaatggttcacccaatggctggccaacaatccgttctttgcctctgctcttgatgggtacttaaacaacaacaacagcaatatcagtgccattggtggaggcggtggcattaaagggctgctgacccacactcagcaacagcagcactcaaacgtcgcttcacacaaccacagcagcagtcagatggccatgctccaagcactgattgcggctgcaacttcgtccacttccgcttcgccatccttcgggaattactcctccgtcgttaatgcttcgacaccgatgagcaatggcgggttcaaattggcaccccaacagcagcaccaaccgccgcctaaaaaggcaaagacagcgaccggcggagggaagggaaaagcttctgcaaatgttgccgccgctgacgcttctcatcaccggcgtcagcagcaaaaggacacgaaaattgacggcggaattggagcaacgacggacaacgatctgctgagtgtgcatatccctcacaatcatttccattcgccgttcagcagcaacggatcggctaacagtccgacatcggtgagaaaagtgtaaaaagtaaaatggcggagggaatcatttgaatcccttttaaagaacgacggcagtaaaatgtgcgccctcatcgattcccttcttcacataaaaaaaagcagcggtcagaacagtccgattgatgagcagatcaaaacgaaaggaggacgaacgatccgagaggagacggaacggaggaacaacggaagacgcgagtgcccacacgagcgacggaaatggcggaaattgtttacggagacgagccggagacttatttcgaaaagtcggaaaagagcgagttggcacaggcgagtgaagacaaaattgaaacggtggtactgattttaaatgcattcccaaaatgggattagcattgatgggcactgtttatcgcaattccccttttaggctgcttctcccaacattttccccagcatccaaaggctaatgttggcccattccgccgaaaattgctcttcctcccttcattttccttcttcctcttctgctgatcatcaacaactttcgccagcggtctccgattctcagacgagcggaagcagcaacggaatgacgacgacgacaacggaagcgccgcgaggaatgaacagtccgccagcagcgacaaatccaacgaagtgccatccgacgggggaaagtgatgtgagtgatgagggaaccaattctgtggttatatcaaaatcgaatgggacaataatgactcaataattgcatattcggagactattcgcgttactaagaatggcttcagcaggacacaccgacaacagtgaccagcaaaggcagtggcgaattctcaggcaaaaagtcgcggggaaaggcggagagaattcgtcaaattgtcactcggatcaccacagcagcggaagaagtggcagaggaaaaggttcgggaagagctgatcgactgcgcccgtcaattgcaattggttacttcatctgccgaagaaaaggacgaagaagcgtaattattccgacaccaacattttgacacaaacaaatttatttcacataattgcagaatgtcatcccttttaaatactcattattttgcctgcgttttcccaaaaatctcatcttttttatgaaacgaaccatccaaaaataggcacaatttttttcgtcggatcgatcattcatccgtttatagttcaacacatttgatctataatactttgatttttttgcgttccattgttgttactttaaagaaacattgtatacttttccggcacaatatctcactagaaattttactgtcagcggatcgacccctggctcaggaaacattcaaatcacttttttttcttcattaatatttgtgactttaatatagaaaaatgctatcagattaatttacttctttttatgataaataaacccaacaaaggtttttcattaataatttggcatttattttatacggtttttacacttcaaaatgttagagttcgtttcaataaagctgttgcgaattgtgagtttgggaagggcaatgttggggaaagggaaaatgaataaagtgttttgtgttagtgaatcgaaatatattatatatcgggtcatattctgaactagacattccacaatttgggtaagccgaaaatatcgactgattcagtagccaaattgattcttgcgcttggcagcaactaattggacatatttagaaacgaatttctcgactttttcggccttcagtgaatggcgtttcttcagtttcgcgactcctttaatcataatctctttgtattcgtccttcgttattcgtcgccgcctaaaattgttacaagtaaaatcagtcagcaaaactataatattcaaaaaattgctttcgaatgacaatagataccgtaagtttaaagggataattctaaatcggtatgattcggtttctttaactcatttgattttttcctcacttaaaatagggcctcaatgcgcgcttcattagttcatcggccatttgtacttttttgttgcgcccctttttctcgcattcctttgcatttctttccttttcgcttgtttcgacttcatcttggtcgtcttcgatgtccatcggagagtccgccaaacattgggaattttgacaagcctaaacagtccacaatttatttggttttcatattaaaggaatgttgtcctaattaaccaccacaatcacataaaagcgaaacggacaaaccctcacaggaggcggtggaggaggtggcaccataaatgtgtccatggaagaagtttctgatggaagtggtggcacgggcaaaggctgctgttgttctgccgatggtgccaaattcgccgttagcgatggcacattttcgctatgtttgtttgtcagctgactcagaatagtattgttcagaggagcggttggatttttttggtgattccccaaaaaagcattgacaatttcgatgctctgctgctgtaccagcaagtgattcggtaggaaagtttgctgctgatgatttgcgaagaaaccgacgaaaccattcggcaaaggctgcttttgctcatgcacgtcaaagaggcgaagtggcggaatgtttgggggcacggcaaaaagctgatggcctcggtttttgaggaggctgggcacttcaccgagcaaagattgaagatttgaggatggcaacagaccttttagtgatgacacaaaaattagcaggataaaatttgcatgaaggtaatacgcacgacaaaaaaaaaggggagaaacctgctgattgcgttggtgttacatttaatagacttggtaatgccgcggtcgaccgaagaaggggcgcgggtgggaaaacatttggat

SEQ ID NO: 9430 - DNA, 5334 bp, Heterodera glycines
aacgacgcgatgggactcctcgagagatgcggcacggagtcggcgcgacgcagaaagggatgcacgacgcaattcgtacacaaagacgagtcggatgagcagccacacatcggcacggcgcaagaagcgggcggaagagcgcgttatgacgacgacgacgacctgaggacggacaacgaagtggcgccgcgcgggccttacactggtgggagcaatggtggcccatgtttggcattccatcttattttggcatttctcctcccttcttggtttctcgtcatgacaactcacacaaaggcactcgtacataggcttaggctaggcctaagaataaaagtatataaaaaacttatggtcattccaaagaagtttgagtcctaatttttggccaaaacttttgaactcaatgaaatttattgaaattttaatgcttaaaaaattatgcaaatacttttcaatttaaaaagaaaatttaatttagttgcttcttaaaaaagttatataaatcataaactgtccaaatattccattgttgaaaacgataatatgatctgataatgttcgagcttttatttgaatgatttacgggttcttgtcgcaacattctcagaattaattgtaaattttgtagggactgaaagtgaatacagcggcactgaatacgttggcaccgactcggagttcgaacacgcccacccccggcacagcgttggcaggtatttgccgagtgacaccgaaactgtgacgacggatgaccagcaggaacgctttatgtccgagtcggaagcaagcgaatggagtcgcgggtacaaccagcaggagcagcggcacttctcgtcagcctcgtcatttgcaagcagttcaaactttggcgcaccgacgggcgcagcgccggcggcgccattccgcgggtacgcgtcgacaacagaaacagagaaggcaagtttatccgtgccgcccagcagcagccgcagcagtaaagcgccaccgtcattacccactgtgccaaagccaaaggattcccacggatatttcggtatggtgttctgttgcggccgcgaaaaagctgcgtgcaattgcggattgtcgaattagcggctttttgggccccggaaatacaatacataaattgcgttgcgcgtttttcgcatttacatttcggaaatttaaaaaaaatttaattaaaacaatttaacgatggaatttgcaaattaagcctcatctgttttatggcatacaattagtttatggatttatccaaattattataaaaaggaaatcgaaatgtttttactaagttaaaattattttttattaagttttaattgtttatgttaagccacagattcgtcttctgctggtcctttgccaaaaaaaggcggcgctaaaatcgatttggcgaaaagcagacgcacaattaacaatggcacgggcgacggcaccgatgcaaaattgcgtaaaccatgaaaagatttgttggagagtttttgagggacaacaaaacatttgagcaaatcgaattggaaattttgaaaaaaaaattcagtttctgtctaattttgaattcagtaaagttcttccgtttgtgaatcaaaagtttctggtccgaattcactacaaaatcatacggaattagggccctaaacccggcgtgggtcggatcgcttgtctctctgtccctgttcgggctctccttggcattatctgagatatgatttaatgctttagctaagctaaactcactgttatacgcccggatttatgcttatgcgttgaaattaaaattgcttcaaataacggccaattaagcatcaaagatcaaagatttcttcggcccaatccgacgtaaatgatgatgccattaaatgtaaattcactttaatctccagcttttaattgatccgaatgaatgaatgcttcacattttcattccccccccccgtcgtttttccgttttgtctttgtcccttccctttccatcgtttggtccgtcgaatcgcagcaaaatgcaaatgcttcgactgctgtaaattcaatgaatgggaggccacactgacagcaaaaaatgaatgaataaatgaatgaattgaaaaaataaatttaataaatttgatggcaccggggaaaggcgccgtgccgggcgatcgtcgcttttgtcctcggcttcccccgcccatcgcattttatcgaattcactcgaacaaattgattgatttattcttaattaatattttccccaaaaagcgatttgtttggtattttcctaaactcttaaattaacagtaaccattttatcaattttatttgcattctgttgtcaatgcctttttttattatttggtcatttttggtgcctttttcagaaattgagaaatttaacgaatttactaaaaaactttcttcttcttatattttaacttaattgatcaaaatttctgaattgtaaagtcgaaacttttacaatgttttattaagactttgatttcttctttttcctttccgatttgctcaaaagaataaaaatgagttcgaaatgggaaaaaatatttttaaatgattttgtaagtttagaagaaataaaaattgccaaatttttacaatattttcatgccttttttaccgtatttcccccctatttgaaatggtaaattatgccgaaaaggggtgcgtccgtccgttccgttccgttccggtcacttttcccttccctccctttctttttatccgttcgttcattttcatttgcctttttctgacctttcggccattttccctctccaataaatgcgaaaagcaaatactcacaaacagaaaatgataagtgataacaaacatatcaaaacattggccagcaaaatcaacaaataaaaaggcacataaaaatatatgcaaatttatttttgttttatttggcgatttattggcgagaaattccaatggcatttttctatttttggaattctcccgttttgaagaagcacagcaatggaggaaaggcgtacggcttctgcccccccccattcccttcccggccatcaattcgcatttgaaggaaaattccaaatttttatttctttaacttctaaatttgtttcccctgttgaaattggacctcacctgccgttgaccgtttggctatgtttttggtttttccgatgaaatcccgtcgtctgagatgagggagttctcccgttgttgttgccgccctcccatttcctaaagcccatccgtgttgttgttgtggtgccattcggatgacagttgcctttggcccatccatccctttaagcggtgtgattggaaagcaaagggaaattgacacatgagaagtgatcgatgagtggggggggggcttttggggcttttgggttttatccattgctttgatttggtggtggacgctcaatcactgacagccaaagggaagaagcaaaggatttgcaaaaaacaaatgctatcacagagaaagaaaagccattcgttcgctttgtccgatggcatttgcttttcggtgcctgctctgaacaaatcctttaaacttgtgtccaattgtctgtttttgtgaccgcattttctattccgtttagtttattacaaataaatgccgggggattatttttctgaaaaatattttttagccaaaaaaccaaattttaattttaaattgggatccctccccggcactccatcggtggcaaagatggtgcgaatcggtattttgggtatggaagtccagggtctgatcagggacagtaataggccgagaattggagacccctcccgccggggtaatgagggatttcaaattattttccaaaccggcaaattataaatccggcactctaattaggtatcattcattttttcatgatattttatttttaaattaatttcgacattaaagttaatctcaattttatttctttaattcaattgacatgggaattgatcagctaaattttcacctttttccttcaatgttcgtcttcttcgcagttctgaccaccgcatttatgtgattaattaacaaaaatattttatttatttgcatgaaaaaaaataaaaaattaaatgttttaattgctcaaattaatttttagttttggcgtcggcggatatgaaccgatgaagtgtttagtaagttaatgtttttccaaaatgggatgtgagcttcgtttaccattcgtttccgcttttcttttctttttttggcttttcccatcgcttcaaattttgcattttgggcattctcaccgctcttaatttatttcttcttttagcattcatcaaaaagcaaaaccgaccattttgggttcaatgtgtgtgaagtgctcaatgaggacggaacaacacaatcgaatcaccaaaacaattcagcaatttttttctacgaggtaaaaatgattaaaaaataaaataaataataatatattttaccaattttgctttattaattttacctcaatttgttcagtttttgccggtaatgctgcttatccaagcggcacttttctatctgccaaaatggacgcaggaaaaattgcttcaaaaatgtgagtgattttaagaaagggcaaaaaaaataaatctttgaatttaaaatatttaaatttaagtttataaaattcagcttgtttgttgacaaatgccgtggcacaatttgccgtggttaacgcattgaccggccgagggcaccgctggtggggcattgaagtgggaaaatcattgctcaatggtgatgaaataaaggtgaaaattgaaatatttcagcaaatttatgtattttcaaagcgcataattttatctaagtaaaatttcttataaatttcaaagataaatcgcgaaactttatcaagttttcagtagttttactctatatgcaattatttgccttggttcgaacactttcggcactttggtttaaattttaattagaaagttaattaaattcgtttttttgtcgaagacaccgaaagaaactctcttaatcactgcacttttgcccttttaaggatttgcccattttcccccgtctgatcacttgtgattctgtccttgctccgaacgtgttcgtccaatgccatctgcgcatcgcctggttcaacgagaagattttcttcctcatttggtaaattaataattccattttcactttttctaataaaataatttaatttcttaatgattctcattatcaaattgcctctgtaactttgctcatttgtcaggtgggcacttttctgcgtctcccttttgactctgatcactttcgtttccgcattttaatccaggtgcatttttattaaaatgaaattgttttaaaatttttatttt

SEQ ID NO: 9431 - DNA, 2003 bp, Heterodera glycines
ccttaaaactaatttaaaaaattgacccatcccctgcaaatgtatgaatttggaaaatttgaattttcgtcatttaaacatcttttgcgacttttaaacaaagtttttcttctgtgatttgttttagcttattgttttggcctcttcactgcgtttattgtgcaatttgcaccaaaaagagacgtggcgaaggcattcatccatcgtttgtggaccttctgacagaaaaaaggaaagcaccgcacgcaatgacggctcacttttggctttcgaagtcgagaccgactgattttcaaaattgaccaaatcattttgatgtatattcaattggttttacgagtttcgcaacttttcatgttccattatgacctcatttcccatctcttgacaaattattcagctatttaaacatttgaggcccaaaaaattgtttattctcacattaggccatgtaattttaaaaggcaattgaaaaataaatttgttcttttgaagatgacaaatgtggggacggtaagtaattttcaaaaaaaattacgctctgttccctcctcattgttttctccgttttctttaatggttttggatggccaattggggaagcggtgcctcgacggtgagaacgccgtcagtactcaaagttgagctgaaaaaattggaggggaaagtgtggccagatgagattgtggagatgattctgcccacctgatctgttcagggttggtgccgcgggggagcataaattcctgcaaattgttttggcgttccgttttcccactctccctcataggcttttcccgggttaaatccaattattttcctattactttgtccccgttccgttcccggtttcattacaactcatacaaaggcatcttgtacgtaggcttaagctaggcctaggctttgtacgggtgccattgattctcctctcccacgccgtcgctccgtttcattttggactgttcatggcgttctgtcccctccacaattccccccccccccccccctctttatctcttccgtctttcacctgattgtactcccgatagaccgtgcggcttggcgttttctcctcgtgtttggcatggaccaacaaacggttgtccaccgttttcaccgtcacttcctcaggtctgtattgggcgacgtcgaatctgaccatttggggagggaagggtaattaattgcaaattacgtccatttttatttgtacctgagcctcaacgttttcccgtcactttcgtctttgatcagtgggctctttaggttttccaagtacgggtcgtaagtcggcgaatggcgcgccatcgccccgccgcccgcgccattgctcagtgaacttcctccaccttggggggcacaagttgagtcggggtgacttttctgtgttccaaaattgccattttcttcccttccttttccacttttggttctttttaagtatttctgaagattgacgagcggaaatattcgaaaatttaatttcgctttcatttttaagccgccaaaaataaatgtttgtggttaattttaaaatgcggggaatggccgaatgaatttgagcagagcaaatccccgaggggacaggcgaaaagccatgccaagttaaggggccgggggaggggagagaagtgaatgccctccctcccggccactgtttccccggggcaacaattcgccctccttgggctgtgttgtttagtgcccgcgggaatttacttgggaaatccgcttcccccccccccccccctcccaccttcaacccaccacaatatttagtcaatttaccataaatgggctgagtgcccgccgttgtataaggcgaagaacgcgaagcggcggggcggtacccctcgaactcgtggcgaagacgctgaaatgaaaggggccgttgcttatcgtcggaatggcacaaattgttcaaatgatagcaatggcatttctctcccccccccctccaattcacctgcatttcctcgtccactcggcgcatttccttc

SEQ ID NO: 9432 - DNA, 1976 bp, Heterodera glycines
ggggggggctgcctccggcggctggcagaaatggggcgaatgggacgaaaaaatgcgaaggaatgggaagggtgaggacgtaaaaaaggtttgctcaaggggaagggaaagtcgtttaatggggggggggggggagacagaaacggaaattttgaggggaatgagaaaagggaatcgaatcgagcggagagagaggggagagcaaacacaacggcgcaacagcagagcaacactcatttgtcagcacaatttgcactaattgttgttgccttttagttaagctaaacaatgtgtgaattcgttgcctccgctgctcgtcgtggtaaaagccgaggtgaagccgagaaagggggggggaatgcaaattgggcccattgagtgacaatttgataggtaatggagacggaattgccttggaaagagtgatattctgtcattaaaatatccgttttgtccattagctaattatgaaagcatatgagcgggaagagtgaagctaaactaattacgtaatcggaggaaatgtttgttaatattcttcaaatggaaaaaataatgcccaaagggaatgcatgggctgggcgaagcggaaaagctgtgaaaaaggagaaagtaagcaaaaatttgaacaatagataataggagatatacatatacatacaaatgaatatgagtttcttttttattcattttgaaagaacgaaccgccaaaaacatattgcgcgtcaaaatgggataattggggttaatttgggattattaatggcttcggatggttttctgtcggctcttccgctgcgttttcttctgctgcaccaatcttcacagtttttacattcgtcaatcctttctttatttttgctttgatcggtccatttagttccaattgttcaaaggcggcaacaacgcatacatttttctgattctccgtgcccttatccgtcgtccttcgtccgtccgtctggccaatggtccaaaatctgccaacgacgctctttttccttcaaaatgccttgctcagtcccaatccttcccccctcgtgccatcaaacctggccttagctgccatcgtccgttggccaacgatcggatgtctctgctgcttccgccgctcaccgtttgcttttctttcagcggagagcccacaaacaatccaaattcttcgttcgcttttgtttggccgatcatttgcagtgccacgagaagggagaagagaatgggcaggggacacaaaggcattgggcagggaatggagggatgagccggatttggtggtggaattggatttgaaaatgaaatggaaatggaccgggaagagtgggcacgggcggtgatgatggagcagagccattcatcccctcatcattgccaaaggaaggaagaatggcatttagcagggcgaatggctgatgcaagcaatggcacgagcagattgacccttcccaataccagcccatttcggcactcaaattggcttccaaatggaaaatgatgggcggatgatgaagacaagctgaaaggaagcaaatggagaagcaacggggttatgggaaaagcattgggggacatacagagataaggaaaagcatcctctgctgctgaaatgggatacgacgtggagagaggtgggcaatggcgtacttttgaggttgcgtaaacgccatggacgaaattggcacagattggggcgggggaaggatgacggaacggaaggagcgaggggaagggatcggataattaattatgagaaaaacaacaattaattaattaattattttaattattttctagtttttttcttttcattttacatcttatcctctatactttctttgcttgattggctttttcagagtttcatctttcaaattaccttctaaataatataggtatatattttttgcttttaaaaaaatggaatttttattagtttttattaataattctttttgctttattattttttgaatattttt

SEQ ID NO: 9433 - DNA, 849 bp, Heterodera glycines
  misc_feature (820)..(820): n is a, c, g, or t
cttaattctttctatcagcaaaactatgttctcgtctactcattggtccgtttgagtccgtccgtttaggctttgttcgattccgtgccaggcacgcgatgggaggccaaaatgctcacgcaaagcgttgagccgggcgaggagcctcagcgctccaagtggagtccgcgcgcggttctgctcacgcgctcgtcgccaaccgaaatcttcttgaaagtgacgccgcgagatgaccccacgcaggcggacgccttctgggatttgccggcggattacgaggattggccatggggcgtggacttgcagtatcggctgaccaggctgggcagttgtcggaagctgtccaaagcggacacggagccggtgatcatggaaaatgttcaggacaaacaggtgaccgatcgattgggcagccaattgggcactttttaatgggccaatgccgctgaaggtccttctcgacaatttgcatcccgggtcggaatacgaagtgaccgtcactctccgacaaccgcccggcgttgaccgccgcgtcgcgcccaaaaaggcagtccaacgcttccaaacggcggatcagccgccgagcggcgcaccgaacaaattgcgagtggagggacgatgggataccaaattggcattcggatgggaaccgccggagtgcttagagcagaacggcgagatcagtcagtacgagtacgagctgaacgggttggacgagtggaaccaggggacacgccagggcgtcagcccacgcacacgcgcagacattggcgaactgttgcccggctcactgtaccgcttcagggtacggtgcttcccncagaaagcgctttgtcctatccattccca

SEQ ID NO: 9434 - DNA, 1248 bp, Heterodera glycines
cggtggactctcttacgatgaagacgggcggggcaaaaaattacacagtgatggtaccgggcaattccatcaaattcaccgaattgcaaccaggtcagtcagtgccagttggttgacagaccaaagggccaccaaaaataccaaaacaaaatgccattgtctttcagataccatatacaacatcaccgtccaaggcggaacggacagcggatacggtgctaccgtatggggctcatgggcaacattgtcgctcggcaaaacgtggattctccggctgaaggaccgcacgccgggctccctgaccgtggagtgggacccggtctggggcattgcgcaccgcggatacatcgtcagtgattggtttggtggtggtactgctccaacttccccgactttttcagctgaccgccaaggctatccattccacccatccgcaccttcgcatcggttccatgcgcaccgtcgacgtgccctccaccgccactgagctgaccattcgcggactcgagcccaccagcacgtacaatgtgacgttgcagctaaaggaccaaatggatggcgcgtggtcaatctactcgacgctgcagccgggctgcttccttcccggcgacattcggcactgcgaccagacaccgcacgccacctcaatgaggtgaagaatggtggccacggcgccgacataattggattttgggacgggcacttgtcagattccttaattactgtgattctttaaactgaatttttccaaagactgagatttcccccgggtcagctgaaataatgagggttcgaccagactcaatgcgaacaaaatcagggggaacgacccccccccccagacatttccatgatttgatagactcaaacccgagaatcaaaactcaacattttcggattgaaaaacttgatctgtgatccgagcattgtttgtcggcacgaacagctcatgagcttgcttcttcctttgcttcttctttttccacagtgaatgaatgccccccccctcgttcagttgggagcccgtgttgggtgcagcggcgacgcattaccaagtgcggtacattcatttgcaccaaattcgcactttgtgggtggaggagccggaaaggcaccgcaaagaattggtccgttctttattcttttatattcgatctgctaattgagtttagctgtgccccaaagatccgtgtaataggctttgctatttggtgttcaatctggcaaatcctccggaggaatacgctt

SEQ ID NO: 9435 - DNA, 2266 bp, Heterodera glycines
  misc_feature (2147)..(2148): n is a, c, g, or t
  misc_feature (2164)..(2164): n is a, c, g, or t
aaatggccatagaacgggaaggaaatcaaaaagaaaaggataagccaggccaagttgggactgaatgcaagcacaggatggagacactaagcccaaaaaaggtaaaaaaaaactgaatttaaaattataaaaatggtaatttatggaggaaataatacgaaaatagaaaagcaaaaaatgaaagggttaaaagtaacagaaatttgataaaataaaatatatctactatacaattattaatcttaagactaaattaataatttgggtagcatattaggctcaaaaatcataaacacttaaaaacggcagagaaatagcaaaataagatataaaagggcataaaacgcttgaataggcacaaaaaaagcaaataaatttttacattgatccaaaaaaatctttgaacaagcatgaaaaaccatttcaaaatgctcttaaaaaatctgtaataataattattatgctgacttaattttgaagctggtcaaaagtattataaaacaacttgatcagatcactccttagtgttgacctggacactaaaaaatatattgaaaatggggggggggggaaatgggggcaatttgggagccaaatccaacggatgaccgaccgaccattcactacgaccactctttcaccaccactcatcctttggttgttctcttgtcgttctttctcattcacgcttttaatccatggcttacaacaaaaagatcagagccgacggtaagccaaaggttaattggggggggggggacggagcttatttgttagttggtccaaaatgtcactctttgcattcccttggctttacagtattctatcgtatttgcttttcctttttatcgtatttcttttactgtaccccctcttctctctgtgtgcttcttctttttcttgtcatttcaatatcttttcttgtcccctcgggcattcctcttcttgtccccattcctccggccattccgtcccctttgatctctccgacagaagttgccgcttcgtccccgccgtctccgcaccgtttgtcccttcggcatggctttgtgctggttcttcccgttttgattgtgctggtcttttgtctcggtttggtcttctgggcacttccgtcgtaagttgttgttgctgctgtttccgtttttgtaattggcatttgcccacaaatcacttaccaaatcacttttccatcggtgccattaaacaaagttaacccaatcattagcacggaatttcttcgctccttaagaagtgcaaatggtccgccgttcttgtctttgattctgttttattttccattccataatacttatcgtctctatcatttttattggttttgtcccgcctctccctcccctcattatccctcattaaccccttaattacctcccctctcacagcaactccgttcctcgccgcaggttggccctggtggtggctgttgctgctccttctgctcctgcttctttgcctgctcctctgctgtctgctcgcgtggcttttagcaaagtgccgtcttagcctttgattgatcctctcactgtcccctcactaattacccccctaataatctttcacttttcctttcccaatttcccttttaatttttcttttgtttcattcacttctctcttcagaaaacgccgccagcgatatgtgaacggaagagaaagagaacgacttttgagggacgaaaagacggaacattacgaacgaagccgaggcgattttgaggacggatacgcacacgggtacagggcggcgagggcaggcggacgcgctgaagaggactaccggggcagggacgaggcattccgggtaggaacagcggatcggcacgcgtaacccaccaatccgatgtttaaggaggggtacgcaaaagggttgcgcgacgcgggagaacgcgggatgagcacatccatggccaacttggcacaacggcccacccagcgcctcggctactcctccggatacatgcagggcttccgggacggaaactcgggcgttttcggtgatcgcatcagcgagagtctgttgcgaaggttggaggagcagtatccggacaacgaggagttcagagccggttacattgacgggttcaaagacggagtcagcggaggacgcgtgagtgaatgagtggttannacgactgtccaacggngacatattttggccattataatcccccagtttggccatttcagacctttcgagactcccgccgcattcagcaaagtctgaccgaattgacagaacgactgac

SEQ ID NO: 9436 - DNA, 786 bp, Heterodera glycines
  misc_feature (12)..(12): n is a, c, g, or t
gagctgttggcncagggccaacagttggtcagcgagttggaggagttggccagcggacagagccgtcgcagcactctgcggcggcactatacgcccggcgactatttgcgttacgaggacggcggttccggcgccgagtaccacagtctcggccgacgacgcacaatgagcgcgtcggcgctgggcaggggtaagcacaactgagcttggacgagcttttctaacgctgcacagatgctaaagggtgtcctgcactaaggtccgaaagagggaattgaaaatttaaagtttcaaaatttttcccagcgggcctaacggctccaccggtcccaaaattcccctaaaatttcaaatttgatcttttcgaaaaaaaagcgcgccgcaaaaaaaggtataaaaaaaagcttggccgggaacaatctggaccgtcgtatgaaaatttggttcctccgtactcacccccctgcgccacacccatcgtaagggccaagggcctcgccctggcacaccccgtgaactgaaagtgtgggaccattgccgtgtctaccgaattcataagtcgattatacaatatccacttcccccgagtgaatgtgtttttctcgcttttccctcttcgttctcggtttgccgtgtgaacctccccgtttcccataacttctccagaaagcgcttccgttggccgtgcttttttcgctgaagagcggcagcgccactattcgggcgcttccctcgagggcatcgccagcgacgagcgcgaggcggtgctgcgagagtcgtacactc

SEQ ID NO: 9437 - DNA, 2490 bp, Heterodera glycines
ctcaaatgtatacctaaaaatgcgctaaaaatgatcactccacatggttagccgaatatcctgtcaatatttccctattacatacgatactgtgaattctttcgcctctttaattcattcgtgctttgcttcggattagtctaaaaatttctggacgccaattttacatattagccattttttattttattagtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttattagtgaccgcaaatttttacatactagccattttttattttattgtgaccaagcatatctttcctcgtatttctgggatttttttcagaatgtggtcatagaataggtgggttgaattatttgtatttttatgagtattatcttatataataaagttgagtgtctgtccggatgtgtccatgttttgaattagtgtggcgttttgtttagtttttgcgttcaaaaatgatttgaaaaaagtagagggagggaaaggtaagaaatagtgcactgtctgattgtctgtctacgcgggcagcggcgggtgagaggggcatacagtgaacagacgcgtgctgctgtgcagcagcagtctgttggacgcgtgcgtgtgtgtgggagaaggagggagtgggaaaaaaagatagtaaattgcaatggaaaagaaaagagagtaaaagaaagaaaagggagagataatgggaaatttctctcgcatcccttccttatttataacccatcttttattatataaaataattaataaaagaaaaaggaaaatggctttccacgattttatgagaaaaattacttttacttttctacattatttaatgatttttttgttcgcgtttttcatttgaatttgttaatggtataaataaatttgttatttgataaaataatttgatagttaaagagcggtgtgtttttatttgtttgcattgaagaagcataggattttgaatttgttttcattttttaatctgaaagaattcgacttgaatttgatttgtgattttattaataaatgactatttgtttacacttatttttgtattaacgtttgccaagtaagttttaaaatttttttgtcattaaatattaagaagaaatgtctgaccatatgaaaatgctaaaaaggaagaaaaataagtgcgaggccgtgaagcggccaagcccgtaccttccagcaagaaaaaagacaaagtgttaataagaaatgttaggaagtgaggcgccgcttccgagccctccccccgcccggtaaaacatcttaaggtgggttgagtcccagtgattgaaatgctggagggttgagtcacagtgattgaatgctggagggttgagtcccagtgattgaaatgttggtgggttgagtcccagtgattggaatgctgttgggttgagtgccagtgattgaaatgttggtgggttgagtgccagtgattgaaatgctgtgggttgagtgccagtgattgaaatgttggtgggttgagtgccagtgattgaaatgctgtgggttgagtgccagtgattgaaatgttggtgggttgagtgccagtgattgaaatgctgttgggttgagtgccagtgattgaaatgttggtgggttgagtgccagtgattgaaatgttggtgggttgagtgccagtgattgaaatgttggtgggttgagtgccagtgattgaaatgctgttgggttgagtgccagtgattgaaatgttggtggattgagtgccagtgattgaaatgttggtgggttgagtcccagtgattgaaatgttggtgggttgagtgccagtgattgaaatgttggtgggttgagtgccagtgattgaaatgttggtgggttgagtgccagtgattgaaatgttggtgggttgagtgccagtgattgaaatgttggtgggttgagtgccagtgattgaaatgttggtgggttgagtccagtgattggaatgctcttgggttgagtcccagtgattgaaatgcaggagaattgagtgccagtgattgaaatgttggtgggttgagtgccagtgattgaaatgttggtgggttgagtgccagtgattgaaatgttagtgggttgagtgccagtgattgaaatgctgttgggttga

SEQ ID NO: 9438 - DNA, 992 bp, Heterodera glycines
gaggcatcactttcattcttttctggtcctgcccaattgtctcaaatgtatacctaaaaatgcgctaaaaatgatcaaaccccgtttttagccgaatatcctgtcaatatttccctattagaaacgatactgtgaattctttcgcctctttaattcattcgtgctttgcttcggattagtctaaaaatttctggacgccaattttacatattagccattttttattttattagtgaccgcaaatttttacatactagccattttttattttattgtgaccaagcatatctttcctcgtatttctgggatttttttcagaatgtggtcatagaataggtgggttgaattatttgtattttttatgagtattatgtacggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttattagtgaccgcaaatttttacatactagccattttttattttattgtgaccaagcatatctttcctcgtatttctgggatttttttcagaatgtggtcatagaataggtgggttgaattatttgtatttttatgagtattatgtaaggatattttcgactaaacataaccaattccgagtttcatgaggcatcaacttcattcttttcttgtcctgcccaattgtctcaaatgtatacctaaaaatgcgctaaaaatgatcaaacccgtttttagcggaatatcctgtcaatatttccctattagaaacgatactgtgaattctttcgcctctttaattcattcgtgct

SEQ ID NO: 9439 - DNA, 875 bp, Heterodera glycines
  misc_feature (841)..(841): n is a, c, g, or t
gggagaaagaggggtgccttataatagagaagagaatataagcagccttcgctgcaaaaatcccttccttaattgttcattctgtcttttttatgctgttctttagcttttcgggcacattattagaataacataattaaatgaacttttaacttttaccaaaataattattatacggcaaacacagtaattttgtttggcatttaatttgccattcttttctttggctcgtcattttctgccgaaccctctcgccgactgattggcaagtcgtgccaatagagaagctctcttatccgcccaaggtgtttgtgtttctgttgggataaatcgctgtgtccctccaaggggggaaaagcggaagacaaacggagcggtggcgcggaagggaggcgaactctgatgcagttgccgaaggggaaactgaattggggtggggagggaatggcacgcggacacggccaatggcaccctttgtttgccttgacaattttgccatttgcttttcatgcccatccgcccaccttctgctgcgttgttccaaatgggcttgtccaaatatcattcaaagacatcagcgcttcgttttgtttagctggtgcccacaacaaagtgccgtcggaatgcactgccaaattggctaatgccattgtcgcaaatgccccgaaaatgacgcacaaacaagaaatatttgcgttaaaaagttgcaccattctcattaaaaatgcacctaataaattggctaaattttgaaaattattagtttgccatttattaaagaatttaaacgcttaacccaaaaaacttttttaataatccgtgagatttgcaaatgggcggngggggggggggggagcaaaaagtaaactattttt

SEQ ID NO: 9440 - DNA, 3953 bp, Heterodera glycines
ctactcgaatttaaatcatattattatttaatttaattctgaaatttattttaattaatagttttcaaacgtaaagaatttttcatttttcaaggaaatctttctcaaaccactgagtttcgctggataaaagagaggggggggggggaatttctgaaaatctcaattcacaaaatgtgccataataaagccaagccaatagcaaggacaaaagagcactggcaaagtgcatttcgtttcttctgattttaattcattttacaaaattgcgttcatttgcggcgatggtaattgcagcggcaaatttgggcacgacgtctaacttttgtcctatttttattctcttttaaatccatcaatcctatttgggttcatttaagtcttttaaaccgaactttcgagaaatgccagcggtgcaaagtcgaacccgtaaaattaattattattcaaagcaaaatttaatataatttttaaaattctcggatttcatttttcgggatcgatcctctcggggttcagtctcattctcagggccaagaaaggcttttgaacatcaaatcgctttcctttcctcgtcttctctgtatctttctctccgttctctcctcctttccctcgtccctcgtccctcctcccctattcccctctcctcccgtttctctctctccctctttctctctctcccctttctctctctctctcctttctctctccccccctcctctcctctccctctttctctctctctctccctctttctctctctctcccccttctcttctctccactcttcgccccccccccatctttacgtttctttacaccgacttcctcgcttaactgaactcatttctctcatcagttccgctgctgttagccttgcttctcctatcccttcgttttcatcccattcactttcttcttcttctgctgcttcttctccccatggtccctcctcctccgatcactttttgacttctcccttcttactaattaattgtggccagttccatggatgttattcaattggccaccccctctcatttcgcctcaaagggccaaattgatcgggttggcctcaaccgtaacaaattgttcgttgccctgcgaaatgcgcgtgagttggagctttggtcagtgcactgtttggtcccgtgctcgtggaagtgccttttctcttacaagttccacgaacttttctatgctcattgtgcactttcctctcaacaaaatgcaattttttcgatggtcgcagcattttttgtgcgcttcgaattttgtcgctttcaatttaaccaatttcagaagaaggatggcaattcagcagaggatggcggcatcaaaattcttcgctatgatttaacttacgaaaagctatccgaattcgatttggacttcgattgtgtggacactttcgagggagtcactctcgaaagagtggcaatgggctgcggacagacggaaaatcggctgtttttgtacgaccggacaatggttaccggcgaaatccctttctggcaaatttcgctcgattggacaaaagtctgagtgccattggtttttgctggcattgaacaaaatccgccgttaagatgaccttttccatcaaatcagtcccaattttggatggtcatcatttctgtgctcattgcattcgctttcccgttgttttggatggcgacagaagaattattttgcgaattactgaagactttcaagttgtcgtttatgaaggaaaaagtgaacgatgggaggagctaaaagcggacgacggcactcaattggatgttcgtttgtagtggtattcgagaccgaaaacttctcgagaccaagacttaaaagcccgcgactcgatataaaccaagacccaaaaaccgagacttatcttgagtcgaaaccgagattctcgaacattagtgttctttctgcctctctcagaattctaattcgcttttagctttccacaataactgtcagagggatttccgaaacatttggtcacaattggcatcgcttttctgccatcgagtccaagctgtctatttttgcagacgaagacatttgcgtgttcaaagtgttgtggaacggaaaacaccacttttacaaatttagtgcttcattcgaacgaaaaagttacaggtgcgaagcagcaaaaaagagataagattgatgtccgcttttccggtgtacaatttcctaccctcttgcgtttgggattggtcaattggacccacaatccaaaacataacccaaaggttttgttctcaatcccttcatttagcctcgagcatcgttcatgtgccagcttggggaagccgcttgagactctttgctttgtccattgtgccagctcaaaaatggccttttttaacaaacacttagttgggtttgtgttcactcagcccccttctctgagggagctttgcttttggacggtgcagcgacaactcgcgccttggtgccctcgggggaaaatatggaggggcggaaggacgcagaaagaagtgcaagcgatgttcaaaataagtcaagccattcaaattgttcagtgaaaaggcatggatgtacggacccataaatcaaggctgtaaactatgaggttttaacatcaaagttcgttattttttggtcaaaatctgttaataaattacacctaaataatgtggcaaaaaattgaatggctaacaataaacagtgaattcgatagcgcaaatgaaaatcaattgcgctttttcgtgctcaaaattttaaaaatattgatttctgacaaaatgtgctcagcaatcatcatttttttatttggaataatttttaaaaaattagtcttcctgaccagggatggcatggaatttcgacttcctacttccgatttatgacgttttttgggtcggaactccgatttccgaaaaattgttgggcctcggaatgccattcctgttcctgaccttaaatgagactttctaaattttctcctcctcattaagagcataaaatgatacaaagatagtccagttttccaaaaattattaaaaaaaatgcttgaaaaagtaaaaaaaaatttttgtacgaatccatgtaagaagcgcctattgtacgaacaaacaagtgtacatactgtattaatatccaaaaggcaaaccaaacgcggtgagtagagactagagcccgaagcaggaccggatcctgcgcaggattttgcaggattaatccggccggatccggtccggaaaaaattttgaattccaatcctgcaacaggatccgcaaatttgatttttgtgcgggatccggcaggatccgcatacattctttgaaaattttaaaagacggaatgccaaaatttttgaataaatttataataaaatcaatcaaaataaattcaattttcatctcaaatttcacctagaatttgcaaaaaaaattcccggcggcgcctatcgacaccactggatagacattaatcctgtagattgagtcaaaaggtgtgacatttggtcattttttggtcaaattcagttaattattgataaaattttcaaaaaaaaagaaattcggacggcgcctatcggcatagacggacctctttgttcctagtttttgaaaaaattgcgccgaaaaaaagcatttttgaaaagcaaaaaatagtcaaatttattgactattaacagatttgattccgatctctttttaccgtctgacccattcgaaaaatcttaatcgcccttttttaatgcatcccgccagcccctaaaaatttctttttcaaaatgtcaggtattttttcttttttggaaatttaattgaaattttttcaaaatttctaagaatccacaatcctgcgcgggatcctgcaaattaaaaatgcaggattaatccggccggatccggtcctgcaaaaatttttgaattccaatcctgcaacaggatccgcaaatttgaaatttccgggctcta

SEQ ID NO: 9441 - DNA, 4138 bp, Heterodera glycines
  misc_feature (486)..(486): n is a, c, g, or t
agccaagaaaaggatgcgaggccgcgaagcggccgagccattcgattttatcattcaacaatcgtactacctagcgggggatgcgccgaaggcgctcaccccgctagtgaataaaaaaaatgattgcatttggacaaaaaaatattcaaaaaatttatttggccatgtgttcgtttggcactttgtgcctgtttttcgcccgtaaattctcagatagcattcaaatttcgcataagaattttatgcatgaaaattgttttgtaaaaatgtttttaatttctatttattcatttatttttaaaaattgagaaaatattccccgccgttaggaatcaaataaatataatttctaaggttgaccttttaggcaaagatctttttgtgattttctgaaaaagttttttcactaataacagtgatctgatctgggtgaaaatattgaatgtgatttacagtatgtcaaaaaatacattttttataaaatgngaattaaaattcttatccaaaatgctgacttgaattaataaataattacaattttcactaaaagtttattatttacaattattaaaataaaatctttgcaattgtcggtagcaaaacaaataaatattttgaaaaacttaataagacacaaaaatatcaacattaaaattccttaaatttttaaaaatttacaaattaataaaaaaaaaacttttttttctttatgatactagggctcggatttttaggcaaaagcctattttttttcctgagctccccgtggcctgaaacgcacgaaaaacatgtttttttgggctgttgttaagctacttttcgagttattagtgcctttttttaggcttttatttttaaagcctaaaaagcctaaaaaattttgaaaaaacctattttggcgttttgcccaaaattattaacaaaaatgcaataaaaacgaaaaatacacaagaattgattttttgggaattttaaaaatacatccctaagaatcgaccaaaatttttttcaaaaatacactgctaagatttttcaaaaattcatctccaaaatttatttatttattttcttgacaagaatttgtgatttagaaattatttatctcaatactgatttggctgaatttttttacttttttgaatacattttgtcattttacaccccctaaaaatgaggttttttagtgcctttttcccatttttagtgcctattttgggggtttttttagagcctaaagcctacctattttggcagtttttagagcctaaaaatccgagccctacttatgcccatatttgaaaaaaaatttccaattaaatatttcagaaagtgatttattcgccaaattgaacttacaaatgaccatcttttacgaaattaccaatggagaaaatccagcagagggaaacaatagaaaattgacattaaaatggcttcaaaatgatggtagtgcaattttatgcaacgaaaatttccaaaaaattcatgaaaatctcagaatcaaaaaaacaaatggagatgaagcattcattgagaaagcagaaaacaattggaacaatttttgcgcaatgtttaaaaatgggaaaagcatcagaaaaattgagacaaatttggtggaaagagcaaaagaatccgtgctaaatttggagacaatgccccctgcattggtgaaaaatatacgaaaaattgcgcaaaatgaaaattttaacgcggaaaataaacaaaaaatggccgaactattggaccaattcatcgttgggctgaacatcttccgaaaattggttggaggtcaaaagcatttaccaatttgtaaataaaaaataaatgcaaattttagacacattttggacagataaaatcgtgaagcaccagcagcagctgcagttggcacgacgaaagcgaagagcgaacttaataaagtcggcggagtgcctcttcagcattgggcttggggcccttgcggccactttgggcattgtcctcggcgcagacttgggccaaaagaggcacaacgacgtcgaatcctatttcgaactgaatgaacggctcgaagtggccggaatattcctttgtttcttccttttcgtgttctgtatcgtatacatttgcaaaacgtgccgttcgtgagagaagagacttttcgaaatgatgaaaggaattcaacacaatttgttggtctagaagggttttatgtaaattgttttttatctaagataaataaaatttatagattgtgaagaatgtatccgatgctcgaaacggccctcccgacccacctaaagtcacgataatctccaaaaaatcgactaaaaaggtcataaaaacccgccaaaagaaaaaaaacaccaaaaaaagcacaaaataaatgcaaaaaagtccagaaaaattaggtaaaagtgaggaaaaatgccaaaataatgacaaaaagtctgaaacagtgacgaatagtgatataattttcagccaaatattgagcaaaaataatttttattcacttcgaattctaaaacatccgactatcgctccgcccagcggaattggaggagcgcaggacaatgcaaaaggaatgcacggaacgaaggaaggccgaaccaaatgccgactggatcatctacgcgggaaacattgtcaagcgatcggagataccggcaacgcaactcccacaaacaaatgccccgcctcccgtcgagggaaatggacctgaacagaagaaggctaatgaaaacacatccaaatcgcaggttgacatcagtaccaaggaatttttaagcacccttaaccgcgaaatgcaagccattaaaaaacaatatcccgatcttgatcttttcaaaagacagttctgccaaacctccaacaattaaaaaaaataaaataaaaatctaattgtactacttcaaaattttcttaccaaatcttccaaaaaagaaaaaaaaatttattcacaaattttgtcttttttttatctcactattatcatccatataatttgtcacttactctacgccactttatttgaacagtcgtcagagtaagtggtgttcgcccttctgatgacttttttatttttatgaataaataaataaataataaaatttaaatattacatttttatgtattttcttgtcggtgtcaatggaacgcaaaacgaactcagaaaaaagagaaacaatttgcactattgcttctgtgatattattcacacagctttgtaaaattttggatttttcatgtgtcgaaagattagcgaataaatgtttcgattagagtccggtaaaaaaaaattccgggagcgggatcgggagttcaaaattttccgggacgggagtcccgaacgggattcccgtaaaaatcccgctcccgttaaaatcccgtccatttttaacgggagtcccgggcgggagcgggagtaattcgaaaatttaattaaaaactcacaaaaatatttttaatgcacaaatttaaaggacaatcaatttattaaattaaaaatatatagaaaaatttataaaggagaaatttgaaataaaaaaatcttatttttgtgtcaaaaatcagaaaattttttcaaattgcttaaataaattattttttataattaattcgaacaaaacatttattaactttatatttttgactccctttattaattttacaaacttttttgcggtgtatttcttgaaaaaactttttggtgaccaaggaggaggagggaggccggcggtgccggtaggcgccgccgggaaaaaattgaaaattttaacacaatacattgttagattctgttcaaaaatgaccaatttttgcaaattgagcaagttttttaagaaaattaaggattttaaggatccggcggtgccgataggcgccgccgggaaatttttttgaaattttggatatatatttaacagattttcaatgaaaaatcattatttttaccaaaaaaaatcaattcttaccagtacatttttactcccgtttttgggtaaaaatttccgggagcgggagcgggatcgggagttcaaaattttccgggacgggagtcccgaacgggaatctcgtaaaaatcccgctcccgttaaaaatcccgttcaccgaaaaaagcgggagtcgggagcgggactcccgtaaaatcccgcgg

SEQ ID NO: 9442 - DNA, 4029 bp, Heterodera glycines
tgaatacaaagaatttgagcgcgtatcatcaattggaaaatctatcgaatcacagggccgtagccagaacaaaatttcggagggtgaaattcgaagacacttacttttttactcttcggacaaaaaattaataccccagcagtgctttagttttttttaatttctgcgccggtgtgaaaaagcaaatatttctagtcttttgcgcttaaaaatgataaactaaaagttataaaaaaaatgttaaattgggggaccggcagtgccctataggcgtcaaccgacaaaatttctgtaaatgttaatgaaaatagtgaagaaaaactgtgccaattctcaaaatgcccacccccccccttcccccggtggctaagagcctgtccataaaacaaatcataaataaataaaatgatcaacactcatcccttgttcttcctcgcatcgctttgttctttcaaaagccttaaacgccctaaagcaacagatttgtcatcatttcccaatttgagtttgggtgtttcatcatccgcaaacctaacttttcctaaatttgtaattgcataaatttacattaattagtctatcgtttgcgtgccattttagcaccgaacacattaaagaaccgtgaaaaataaagttttttttctttttgcattattactttataaccaatactagttatttatgaaacataaaatttaatgaaaagaaaaatcagggttcggatcagtcaaactccattcccaaggacgcgtataccggtttccaaggagatacgggaaaatcccattaaattcaatgaaatttaaaatttttttatcataaacgatgaaaaatgattaaattttatccaaattgtttatatttttcgccataaaattctaagaatttgttaacatattttgtccaaaattgatcaattttaacgcttttttggtgtgtttttgaactatattttaaaaaatagaaagagggattccggcggtaatgatagacgccgccaggaaaattttgatataaaacaaaaaaattgtaatatggaatttttttcgaatgctcatttttaaggggttcttgaattcttggatattttcaaattttcaagtgagggcctgatttccaggacgaccttgccattcaaggacgaacccgaaccctggaataagttaaaagtttagtgataaagtcgtaggcaaaaattattgatgcaaaattgcaggcaaaaaagaaatccaaattcaaataagtttagtattatgttcataaaaagcatagattttcttaaatttgcattttaattaatatgaatagctaggattttcaatattattcatattagtgacccaacccaaggtcccaaaaacacagagaatttcggtttatgatttaaattttaaaaaatttaatttacgttttcctttttgtactgatgagctgttagcagcaaaaactgagcttgatgatggaccgccgtcttaaatgccatttttctttctgtttgtttgttaaattttaaatttaaagaaaacaaacgaaatgaatttgaagaggcgatttgacccgaaaatgttgactcatttaatctgttagcgcgggaagaatttctgaaatgataaatcaaatgaaacattggagaacaaacagaaaaaaagagaaaaaataatcaaaaacagtgacgcaaagttgaaccaaaaaaaagaaaaaaattctaaaaagcaagacttaaattaattgtttgaccataattcttttgaagttttgaaggaagatagacaatatttggactattgaatgataatacgaatgttttattagtttgcttttatttaatagcccaaaaatttttctattgatatacaaatgttttgataaaaaatttggaaatctcgattttaaaatttaaatagtcgataattattagagaacaaattttgagacatatgcctttttttctgcgcattagttccgttatattaaacataaaaaacgcagtttccacttggcttgaagcttctacgttgacttttattatgccaaggtttttgccttttttcgggatttttcttcccttaaatggctttttttgggatttttgggggcttttttgggggggtttttcccaaaatttccctttaaaaaatggaaaaaaaaacggggaaaaatatccccaaaagggccccgaaaaaatttccaaaaaaaaaaacccccccaaaatttggaaaattttttcccaaaaaaaaatccccccccaattttaaaaaaatttttatatttaaaaaatttttccttttttcaaaaaattttaaaattttttttaatattttttttatggggcccaaaaaaagtttttttttttaaaaatttttttttgggggtttgtccttccctcaaaacacacaaaaaaaaaaaaaaaaatattaggggctttttttcttttctccccttaataaaaaaaaaaaaataaaaaaaaaagcgcttttcttcccccccccccccccccccccccccctcttttatattttaaaaaaaaaatattggggaagagaagggcccccctttctttttgggggtgggtgggcactattatttaaaaaaaaaaaaaaaaaaacaaaccctccccccccataacaaaaaaaaaaaaaaaatattttttttttttttttttttttttttgcggggggcccgcccccccccccccccccccccccgccccccccacccattttttgtgggggagcaaccccccctttccgagaaaaattctccctccccctatcctttttttttttttttttttttttgttttttttcccccccccatatttttttttgaaacccccccaacccacgccactgataaaaaaaattttttttttttttttgtggggcccccccccccccccaaccccttcggccccacatttttttgggggagaccaaaaatcctctcgggaaaaccttcccctaaacccccttttttttatttttgggtttgggtttttttcccccccaaaatttttggggacaccccaaacggaccctggaaaaaattgattttttttttttcggggcagtccccccaaaccgatgcccccagatttatgggggagaccgaatccttccggaatagcttccctatagcctgtacttttaattctgcgatggatttttgctccccataattgtttgagtaccccaaacggacacttgaaaaaatcgatttttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacactcacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacact

SEQ ID NO: 9443 - DNA, 4309 bp, Heterodera glycines
caaaaaattctaagaaaatttataagcatttgtacggctctcagcagtttccctgcaaaatttggtgagcttccgatcagtctagaatgttgggtgataaaatgaaaaaaataattttcgaaaaataatgctggactggtaagtgtgaagaactgtgttcctccaggcaaaaaatttatgaaaatttatatgcatttgtagggttttcagcagtttccctgcaaaatttggtgagcttccgatcagtctagaacgttgggtgataaaatgaaaaaaataatttaaaaaaataatgctggtgtgctaaggtgaagaactttgttcctccaggcaaaaaattctaagaaaatttatatgcatttgtagggttttcagcagtttccctgcaaaattgggtgagcttccgatcagtctagaatgttgggtgataaaatgaaaaaaataattttcgaaaaataatgctggactggtaagtgtgaagaactgtgttcctccaggcaaaaaattctaagaaaatttataagcatttgtagggttctcagcagtttccctgcaaaatttggtgagcttccgatcagtctagaatgttgggtgataaaatgaaaaaaataattttcgaaaaataatgctggtgttgtaagtgtgaagaactgtgttcatccaggcaaaaaattctaataaatttataagcatttatagggttttcagcagttcccctgcaaaattgggttagctttcgatcagtctagaacgttgggtgatcaaatgcaaaaaataattttaaaaaaataataatttaatcaaaaaggaacaaaatttaagagtatcacaaatagaaaaatttaaaaaaatgccttgcatacgtggagaatcgaactttagacctattcaatgcgaagtgacaactctaccgactccaccattgtgaatgtaagatgttccaactctcactttcttaatccgttatgcaaaaatgtttacaaaattaattttattttgtgacaagtgtataactttttattggtaagtgatttcggattttgaattacaaaagaacaaatcccacggcccggttaagctgcacaaaaaaagaattaaaatttgtcattcgaatgctcaaactttctcgaaactaggggaccggactggctagaaacggcactgatactggatagtctcggttacggtcttttttaggagaaaaatccggtccaaacctatttattattatccggactcggcgacggctgcataaatgggacatatagttgtttttaaaagttaggtctcaaatcccgggacggtccagtcgccgggatagacacctggcttagtccggcactgatatgaagccgatgccatgacaacttgtacaatggcatctcatacaaaaggcaaaaaaatcaacaaaagagcgcgcagctgatccattttacgaaattttttctgaaattgctgcatttatgcctttcattagtgttacgcgcgccttgtttattttgcgcgctcttttgttgattttttaaattttttgggtgctgataactccactcagagaagagctaaaaaaatctgaataggcttggactaccgtaccaactattatttttataatggatctgttaaatgcaaaaacgtcaacaaaatttgttataactccattcatagttgagatagaaaaaaaaacaatatgcttggagagcgcttgaagagctgcaccggatgcgagtgccgccgttgctgtacgcttagcggttgctgtgcaatgacggaaaattgcttgaaaaatatacatcagaaaaaaggaaataaaatcaggaatacactctcccgtatcgcctgtagacaaaccgaagggtatatggacgaacggcaagtggactgtttaaacgatgcatgtggatgctaaaatagttttgtttttttccttttccatctctgtttttagcgaagaaatttttattttaaaacaaatttaacccatattttacataagagtttttcgggcggggatataccataaattaggacaggtaaaggagaataaaattttatcttcaattcacagagttgaaaaaaatgggcacatattaaacaggaacagtagtcaataataaaaacattcaaatccatcgtccatccatggatctgagttgtcggaggaatcttaaaaaagaaggaattcgacaacaacaaaaaaagcctttgtcgggaatttggcatttaaaacacttttctgcaactgttcgaattttcaatcgttttcagcttcaaaaaattcccacaaaagtcaaattccaagcagtgagtcaaaaaattcaacttttaattgtgaattcgtaattttaacggtgtaccagggccaattcaaaagttaacagaataaagaaaaataaaatttcagtgcttccggatggttttccatcaagttaggaaatccttgaaaatgtgcaaaaataattataaatgatgatctgatcaggaaaccatttccaatcacaattcttaaataatttaattaaattttactcagtggcgcgggcggtggcgttgagtcttcacgcgggttgaatttctgttgggctgggttcattggtaacacaggttgtaatgctgcaattggatttgatgttgacatagcctgttgaccattcttaaatttttgatgcaattaattaattaattaaacacttttttaacatggtttattttttgattttattttttttggaaaaattttaatgggcgttttttaattaattttttattttggacttaaaaactaatcaaaaagtaatcgataaattaaaaaatgaattatgtaaaattaattaaactaattaaaaaataaatcaatttttgaaaatcaaatttctttttttttcccacccgcccaaaactcactttggccgcgatccgacgagacctccttggcgcatccgatgttgaaggcagcaatgcgtcagtgccattctccaccaatgtttgcaagtgatcgggtgggatcacattggccaatgttgtcccgtttgacacacggcgagtaattgagcctgtttggaaaaacaatcaaataaatataattttttgagtttaataaaaacactaaaaatttttttaacaaatttcgttaaatttgccaaaatttccctcctgctgatgtgactatcggcaccacagctcaaaccatattttatttaaaattatatgaaaatacaataattatttaatttgaaaaaacttaaaagaataatttattttgtttaatgatgaattaaatatttttaaaaaattaaaaaacttttttaaattcaatatgtgaaaatattgtaaaattcttgcaatttaaaaaaattttaattttgcttcctgataattgaatgaggaataaatgatcaaattcattattgtaccattcttgtccttggcagtgatcatgtctgacgggtcacttggctgtcctggatcggctttgtttttggccacaatcgctttgtccgcctcaagtggttccgacttgccctctgctttcagctgtaaaagggggatgagagaaagtaaaatttgtaatttatccaaaaaaaaattcttcagcattaaaatgaaatttaaaaaaaaaataaaaatgggaaaaaatttgaaaaaatttgaaaatgctgattttttaacccaaacttaaattttggatggaattattaataaatttaaaatacttgtgtggtaagtgtgaagaactgtgtacctccaggcaaaaaattctatgaaaatttatatgcatttgtagtgttctcagcagtttccctgcaaaatttggtgagctttcgatcagtctagaacgttgggtgataaaattaaaaaaataattttcgaaaaataatacttgtgtggtaagtgtgaagaactgtgtacctccaggcaaaaaatttatgaaaatttatatgcatttgtagtgttctcagcagtttccctgcaaaattgggttagctttcgatcagtctagaacgttgggtgataaaatgaaaaaaataatttaaaaaaaataatgctggtgtggtaagtgtgaagaactgtgttcctccaggcaaaaaattctgagaaaatttataagcatttgtagggttctcagcagttcccctgcaaaattgggttagctttcgatcagtctagaatgttgggtgataaaatgaaaaaaataattttaaaaaaataatgctggactggtaagtgtgaagaactgtgttcctccaggcaaaaaatttatgaaaccagtgaacatttgtagggttttcagcagtttccctgcaaaatt

SEQ ID NO: 9444 - DNA, 1519 bp, Heterodera glycines
  misc_feature (20)..(20): n is a, c, g, or t
  misc_feature (41)..(41): n is a, c, g, or t
  misc_feature (1418)..(1418): n is a, c, g, or t
  misc_feature (1442)..(1442): n is a, c, g, or t
aaaatgatcgcatctccgcncagttcaatcggttctttgcnaattcctccaatggcttttgccccaacgaattgtccgtccaaaattggtgatccatccaacgcatccaaacggaaatgaaaacggacaaattgccgaccacgcgggtggccttggaaaggtcaaaaaaggcgtccaaataatcgtccatcagccgccaattggagaacactaaattaacaaatattaattgcttactaatgaaccggcaattattgtgattaacacacaatttcggtctctcagttccatccgaaattcgtccataaatccctcttggccattgaccaatttacgaatccgcgtttttgccccgcgcttttctctcacaaattcttttaaactcagcacattcgttctgaagaaaattgtcaattgtctgccatgagtttgaatgagtgaaagatgagcattctaaactttattatttttacattatttttgttataaaataaatcctttatccacctgataagctctgatcagtccctcctccgtcatgcaatttcgtcctgtgttccaatttcgaatttcttcctcagttggcatttccttggctccgttgggaagtgccgaaatggctgatgcaaactcgtaaaatcgttgcaaaatgcacacacttttgagcagctcttcccgcatcagttctgtctgccgaattccgaccaattccctccgaagtccgcggaaggcaatccgttggactttccgcagcttttcccggaaaagggccaacactttcccttttaaggtgggcgttttaacaatgagccatttgagtcggtggaaaagcacaggcaaagcgaaacgacattcaattcgcaaatgctgatcagtgcccgatttggtggccaaaagacgcttataaaggaccgtctgagtccaagggaggagcaaatctgaaaaagagggaaggagcggaaaaaacttcggaaaagaaatttaccaatctgcaaaatttcgggaaacatttcgtccaattggataagatattcttcgtccataatttggccaactcttattttgactttttgcatggcttttgagtcggacgaatcgcaaaaaaagcgccgcacttccaaagaaacatcgatcagatcgcaaatgacaaaaaagatcatgtaattggtgtcgcttttgctcccgtacaattgtaagaaagtgaagcaatattcctctgctttctcttcgtcaaatttcggcttcacccaattttccgttcgcttcgtctcctcctattaatttggtaattaattaatttaattaaataattaattaccaattcgaccattttctcactgatcaatcgcttttgccatcgttcgctgttttcccacaaaattttgttgttcacaaagtgtttgccgaattcgaacaancaaagcagtctgccacacttcggntcgcttccgtccatcagctcctccactgcttcttcagcttttccattccatccaaaaagttcgcccgcggagcgatc

SEQ ID NO: 9445 - DNA, 2412 bp, Heterodera glycines
  misc_feature (36)..(36): n is a, c, g, or t
ctgcctgcaggtcccaaaagagaaaaacgcacaaantcggctcctaatttgctctttccggtgctcacgcccttttcactcagcagaacgaattggtaatgcgtccacagaatgtcgcttcggcccaatgctaaaattaggaaatgccatggcttttcgcctctttttctctgctttttacttactgatttctcgtaaagcttcgcccaatccgtttttgctcgccaattcggtcattctctgctcagattccaccaattgcttaagccgtgtctttgccccaggtattctcaaaatgccaatgaaatgttcgcgtcggtaggccacgacgcgttcaatcgctgccgtgtatatttcgccaagttcggcaccgacaaatttatccattattttggccctttccgtgccatcttcacacaattcatccatccgtaaatcccacggcaatttttcgctccctttttcgttcctttttttactgataagttgggcgaattcgttcattttgattaacatgcacagattttgttcagaccccaaatcggtataagctgctgcaattgcttcggccatcgcttccctccaattcgctgtaattcgatcgctcgaatgggcgccttttcctccgccgatcagtaacaaatccgaattaaacgatcgatcgatcagaaatgccattgtcagtcgactgaattccattcggtacgctgttgaaaagcttttgtttgtcaataagctttgcaatcgttcgaatagtgacgaattgagaattatgtctaaacatttagcaaaataaaattgaaaagcttaattaatcctcaccaattctgaatatgttcgggaatttgtcctcaattttggtcacatattcactctttaccaatttgttcatcgcttctttcgtttttcgcattttttcattttcgaatccgttgaaaaattcccgaaaattttcataaatgtccaaaagttccataaagttttgtccatttatgtggccaatttgttctaataaattgttgtacatttgctcagtttgtccatttatatcgcaatttaaaaaaatggcctcatcgaccttaaataataattcattttaaatttcattaaaattatttttccacccgaaaaatttctaaagaaatttcttttctcaaatattcggccaatgcttcgcaactcttcgcataataaaccattaatttgatgaaataaatcccgaatttgtactgcgtgcaaatttcccgctttttctgcgcattttctctccaatttttcccaaatgtttttttccattcgcgcacaaattcttcgataattccaaccacattttcgtcattagcaaataaaattttggaaaaatttagcaaattaataatttttcgacgaataaaccaaagcatcgaattaacattaagcgttggaacaatttcttttgctgccgcatcgtttgaagccgactttttgaaaaagagaacaaaattggccatcaatttgttgcattcatctgccaaatttcgattcgttttcaagtgatttattatttaattattttaaatattaaaaataattaaataattaattatttctttgtttgtttttacctttttctccattttcttcttcttcttcttcttctttttctgccaaagtgtccacattttttaaacattcatttgctttttctgtccattgttttgccattgaaaattcgccgtttctttcccaaaatatttttttttcctcaaatttttgtgcgcttttcatcggtttttgttttaactttttatttttgccgccgtcatttaaatttgccaaaaataacaaaaaaagaaagcataaagaaaaggaaatcatttttgctctgacaatttttgacattttatacactgaaaatggcaaaattaaattatttaatttttagaaaaataaaagcaaattatttaatattttaaactgatgattaattaataagaatattaattaattaattattcttatttggttttatatgttggctataaaaaaggaaggaaatgaattcactcgttgcctatccatgcgactgccttttttcacgtgaaaactaatgaatgtatgatggatagagagagtggattcataaatttagatttatgttgtatttatttggaaaatgaggaagtaaaaaataataaaataataataataataaataataatttgtaactagagttgtacgggaccgagactggcacttaaaaaaagtacaactgagtacccaagtcccggctttgaccgggactatttcccggttttttcccgattttcccagccaaaagggtcccagtttttcaacccgaaaagtcccgggtccccggtttttttcaaaattccccggtcccgtacaactctatttgtaactgacaaatg

SEQ ID NO: 9446 - DNA, 3868 bp, Heterodera glycines
atgtttttcgaataaggaaaaatttcaagcctaaaattattttgcaagaaaaaaataaaataaattttgtgatcaatttttgagaaaatttttcaattcataagggtgtattttctagaaaattttcgggtcatttcttaggggtgtattttgccgactttattgaatttttagtggaatttttcggaaaacgcaaaaaaagacaccaaaacggcaaaatgccaaaaaggcatttaaaacacgaaaatcccgaaaatggcaaaaaaaggcacaataaaagtcaacgtagacgcctcaaaccaagtggaaaaggtgttacctatttatgcttaatatatcgaaactacttcgcagaaaaaaggcaaatgcctcaaaatgggagctctactaattagtgtcttaaattttgcttcatttattctcattttcttcgcgctcacaaatttccctgctgaaattcatttgctgaagacgaatattgtcaatggcaatgaaatgattccggcgcacttttgagcccaaaaagaacaccttaattcgtccaatttatcgactaacattttttatatttttttaatatttttattattttaattttattttttactctttccgtcccccggggcaaaagcactttttgtccgattagccaatgtttgactttgtcgagctttgcggggttttcatatgaacaattgcgcagtgtgttcaaacagacctgggttatgttgatttgaaaacggattgagttaattgacaaaaaaaacccttaattgaggcccgacggatcgttggaagagatcgaatagcaaagtgacgggtcggtccacgcgcagttcgggcgaaacgaacacaaaaaattcattttccgactctttcgaatcgcttccgacgaaggcaaacccttctcaacacagtcagtcagttgaatttcgaacttgattttgccattgttacccattttggcgttctgtcctctgctgtccttgtgaatgcccgtgtgcgcatttcccaccggacctttcgcaattttccacgccgacctaaacaaagcgtaaatttggaaagcattgaaaaaacatttcgaacattccgccatttgctctgagtttgtatttgcacgcttctccattgtcaaaattgcatttcaaagcttcgcaaagggaagcgaattggggcccaaaaataagtccgaaagtttcgtcctgaaaagccatggccaatgaaattaatttgtgggcaaaacgagcaggggaaaccttcgttctgcggaggacacttctgaagcgaatgccgcctgagtgttggccaaattctttccccctttgggacaatggcatttttcgttggggttttccctcgtggtaattgccttcgttttcgttgatgaggccaaacaattccaaatgcttatcactgaaaatggtcgaagttcttcgggttcgcccctccttttgccggtcattccttcccaattagcaaattctgatcaccaattcattcgatcgtgatcagaagcacggagtgccgttcccatttcatttcattaccctttcgatgcgttcgctgtttcgtcttcttttgctcctttctgtctttcttcttcttcttcgtcttcttcctcctcctcttctttttcatctctttcagtggtatcaaattccccccttttcgtcgtcggcaatttccaattgttgctttttgtttatcagaagtccatcgacggcattttttgtcacaacttccggttcatttaacttcataaattaataattaataataatttaataatatttcatttaatattgtttttctgaaaatccaaaattgattgaaatgattccaattgttttttggcattcgttttgccatttttatttcttgtgccgttcccccttcccttacacaattctttccaccattcccgtcgtattttatgttgtctatcaaaaccatgtcttctctcccaacaatattatcgactccaatccgaatacgaaatggcccccaattttgggggatttcaaatgtcagcggattcacgtccattttggattccttaattgttgcgtttttaggttttggcatttctacgtggaatgtcacaacctcacattgcggtgaatcaaaggctttttctggcacaacgcaaactttcaaagttggcgtttcgttaatggaccaataactttcggaattggttaattctctcagtgcccttctcctttggcattttcttactcaaatttcagcgtcgccttctccgtttgacacggcactttcgcttcgatcgccgccgtcgcctcaacggtcgccgcgtcacttccgccagccaacaaaaagaatccgtctgaaaacgaacaatttcgtatttaaatttggcttatttactcaatggaaatgccctttcgccagtgcattcgaatttgtcccaattgaattcggccgaatcgaaccgtcccctcacaaatgcttcactttcgtgcaaaaattgtgccgatctggcattatgccaagcgcaattttccggttgctcaaatgaacagctgagatttgtggcaccttttacacattgaaagcataaaattgcacaaattcagcgattcttttcccactttggtcttcataaaattggtacaaagtgacaagccgacgcaattctaaatccgagaagtgttgtcattttctgtgaatttaccatttgtccgatattcgcttagtgctgcgctttggcacttttgtgccctcttttctccaatgtcttttgatggcgaaaaggggacatttggcacgcctttggctactaaatgcgaagtgccaaaattagggccacaacagaagtgataatagggcgaagcggacaaagaggagaaagcggagaagccaatacagcaaaggcaatctgagggggaaggaggtgagaaaaggtgggaaagtgcccaaaaatgccaaatgtgcagtggagcaaggcgaagacgagcaacacgagccaacggggagaagggacgcccggggcattcattcggcagactttggcattttgttgagcaaattcaaacaaaaatggcaggtcaatcccaatgtacacacgcacaattaatgctttgtgcttccgcttcttctcatctctttttcttctgccaattcttccggcggatcggcgcgactttctccgttcttccgccccattcattcgctttccttcccaaaattacctcacacaaaggaaaaggtttctttcttttccgccaatgcggcggcgttggaattaggcggaaaagtgcggacaaaaaaaaggggggaggcaattagaaattgctaattgacagaagaaatcaaagagaaaccaatgaaaaatgaacgaacgaactgccaaagaatgggacggagaaagtccgaaacatttgaacaatatctgcgaatgaaatgcttcagcttatataatctgtcaaacacatgaaaatgtgcccattcaatcgttgcttaatttgttcgggtaatgagtgaggcaatttggcctttcattgcatcaatgactgctggtggtactcattttgccagtgccgaatgggctttcctccttttaatgtttaagcgaaaaaagcaagaaaagctgaaacatgggcccaaataagctaaaattccacgtttactgaaatgatgcaactcattgggctaattgcacaagtgaatttcctttttaaaagcaaatgaattctatttggaattcgtcaattgcattattaaatgcttttcatattccattaacaaataaattactataaaattaacaattatttttatgtttccgtttgcctttttcattttgccgaactttgtttttctttcatttctctcttggccaaaa

SEQ ID NO: 9447 - DNA, 3714 bp, Heterodera glycines
ataatttcttccaattgatcaaaattttcaaaatctttttcttccttttccagttcagaaattagtttctttggccgacacagtttgacgtttatttggattttttttattaacagtacgatcacaaagattaactaaagtgattgaaaatttggtattggatgtttaattttattgctccctagatttctgaccgtttatttgtattttttcaaaatttcttttcttttcttttcaaattttttaatttagaggaatttgaatttctgctggaaggactttcgagtttaatttgtataatttttggctttttactgtttattttattatccagccttattattaattgtgatttttctcaacacaaattttttattaacagtatgatcacaatgattaattgaaaaattgttatctgatcgcctttgaatacacctagagtattttgaactcgtcggttttgttttcgtccttctttgtgtgttttagctccgtatcgggctttgactcagcctttcgtttcactgaattttttgtttatttatttgtttgtttgtgattttggtcttgattagaactaaacgtctaaatcagacttttgattgatgaagaacaggcacaacaattttctatttaaacagatgaccggctttttccagttctcagatcagtgatcagcttttgttgttgttgttgttgttgttgttggtctttgtcgtttgcacttcccgggtcttggcaccaaaattgatgggatgcactggtcgatccaatcaattaatttaatattttatttgggatggggcgacaaaggacacaaagtggaaaatttggtagatttctgatcacaattgatcaatatccgcgatgcttcgaatgcccgagttgtgatgtattcagagcgagttgttgtccggcttgttgagtgaagagaaccgataggctaacagagtgaattggttgaagcatgcctaaactgaaaacccttcccctttttataccaaaattttttggttatttaatagcattcaaaatttccacattatcattttatggttttttcatttttaaattattttttatcgttttagttttttcttcccttttatttaagaaaggaaaacttttcataaacaattttaattgcttttacgttcaaccgttttattgtggaataaatttatttattatttggggcgttttattagattattttttagtttttattgcgagaagcattcgcttcgttttttatgaattcattttgttttatttatttattttattttacttttattttatattcatttatttatttaatttaattttaaaaataaaaattttatgaaatgtttattttattttggatttatttttattaatattttgtattttcatgtaaaattcttattattttaatttagttttgtttttattaatagttttatattttttcggatttaatccgacactcccaacagaggaagatttaggtttagttttggtcttccgtcggaagattattcttatgattagaggccatactattggacccagaaaaactgcaaatattaaaatgactattaatggtagtatgaaccaggcaatccataaatttgactttaagaaatttataattttagaaccgaaattcttaatattattgattatttcatcaaaggttataccagtttcgggattttgaatagtattattcaaattcgttttttgttcttcctgttgttgtacgtaaaataattttccttttatttctacttcactattacctcctggacatattagcgagcatttttcattgatttcttctatattataagttagttggataatctgttctttgtcttcagtatcacaatttatttcaaccttttgatttggacaaactagttgggctaatgcagatccaaattctgatttacatttaaatttccagtctgcacctttacatgcgtagcacccacttaaggatattgattctacagtacatttcgttttatcataaaatggagtagttttaaaaccttttaaagtaatttgcaattgtaaagctgttgtctgttttaatttagcctttatctgattattctcaaaaaacaaatgacttcctttaaaatcaattggtaatttctcgttttgttgttcgaacatttcgggtaaaggatcttttgtacattcgcaatttacttgtgtgtctccgccattacatttacatgcttcaggtggaaatttacagctaaatgttttagcggaattttcatcaggacatcgaatgctatttcttagtaaatcttcattgttaacaataatagcatcattattaactttattgattataaatttcgaaccaaagattggtgtaggtggaatagtcatagtagtaagagtcatttctatattgtcttttttatttagtattcctggttttaataatgttgaatctgcagttgatccgtcatcagattctatttcatatttgaagttcagttctattggccattgattgcatttggttacttcaaaataatcattaccattttcttccatatatgttctataaaataaacatccatcagtcgcaataaagcattggcaatgccaaccaccgcatgagggcacgcaatacgaatatcctggttttttgtttgctttgtcagaaatttcaggattcgatgaatcactttttatcttttcacaagttgaaccttgacactgtcccatggttggacatcgtttaaccgattctgacagtatttcataattacgcataaaatattctgactccctttcacaggttaaaattaattcttcagttgaaaatttaattgttttaaaagtagtatttcgtattttatcttcaagcttaagacaagttttgtgttcaggttttatcgatattaaaatggtttgatcaaaagtacattctatttttccattttcatctcgagggcaattggttgaattagcaattaaattggtaatttcgtcacagctttttgtcaggtgaataaaatttagaatcattagtaacaaaatagcagttcttgatttcagagtataactacggctttttgactttgtttttggttttaaattctttttcttattacagaaaaacacgaatttaaaaatccattttaaagttgagtaaatgaatttaattatttgcattgaaattgacagaatatagatggtaaataatactaccgagattattataataaagtgaaagtgttctatgcattgtggagctcgtaaatattcaatacaaattttacattttatcatttcacagatcggagaggcattacaatttgatttacttacttctgttattgtattattcaaaatcaatttaatctcaaattcataattgtttttgataatttcctgtggaaaaataattgtttcttttaaatttggtttgtttattgttatacaataaccttgactacaaaccccaataatatcaacgggattaattatgtttagtgttattccgccagtaatgcattcaattaaaaagttagtagatcgtttatttctaaataatgtatctcctatttcgttttgttttttcttctcaattttcggataagaatttgaaatatgtgaattatttgaataaaaaaatgaagaatccatcaatccttttagtttgttttttgctttttgatggctctctgtataattcga

SEQ ID NO: 9448 - DNA, 2289 bp, Heterodera glycines
  misc_feature (48)..(48): n is a, c, g, or t
agatggtaataatactacgagatttatataaataaagtgaaagtgtgntatgcattgtggagctcgtaatatttcaatacaaattttacattttatcatttcacagatcggagaggcattacaatttgatttacttgtttctgttattgtattattcaaaattaatttaatctcaaattcataattgtttttgataatttcctgtggaaaaataattgtttcttttaaatttggtttgtttattgttatacaataactttgactacaaaccccaataatatcaacaggattaattatgtttagtgttattccgccagtaatgcattcaattaaaaagttagtagctcgtttatttctaaataatgtatctactatttcgttttgttttttcttcttaattttcggataagaatttgaaatattatgtgaattatttgaataaaaaaataaagaatccatcaatccttttttttttttgctttttgatggctctctgtataattcgaattgaaaaacaaagaatccaatgattctttttgtttatgcttttttcttttttggttgtcttccgtgtaatattctgtttcaattataccccattctttaattggaatttcaattttacctaatataagataaattctttctctttgatcatgatagcaaaattttgtcccttttttatcacaatgaaatagttcacaataacctggagatccaatcgttagattgccctcccctagacaaaggtaatcgtattttgattcaatttgcgcataacggatatgtaaattttttacaaaatatatgctattgtcatatagacgaatggcgtggaattttcctttggttttgttcatacacctaggattttgtttgaatgcgcatatactgggtccggcttgtctaataagtttctttacaattttcttgttatattttttaattgattgatatggtacaaatgaacattgttgtgcccattttgaacattcacatttaggtccacagtacggtgtatgattatagattaaatgtctatttaaacatgataacatgtcagaacagaattcgttattttgtaaatttttacgaacaataattccttcttcaacacaaaaactggttaaaattgttgtatagtttttaaggtctttaggacaattataattagaataagtattcatggggactacaaataataataatgcaataaaaagtaatttttgaagtaatgtagagggagttgaattaattgtttgagataagttatttcttttctttgataataagttatttagatcatcattatttgaagagttttgatcgtaatgttctcggtaatttaggcaaatagatttatgtattttacatttatcacaaaaattttcctcatttttacaatttttaatacggtgtccaggtttaagacatttataacagagtgataaattttttgctctcatttttctcattctataacctttatattttgtacaatgaatttgaagatggtcattgctgaaacaaaaagagcattttttgatttcagtatggatagaatctcttgagtttagaattagattatttatttgtttatttatttcatcattttcatcaatattcttcgaaagttcaagtgggtatattaatttaaggggtcgattcataattgatttatttggaaattcaatttttgctccccgaattatattatctgatccaattattaattcttttattattccagttttccataaggctcttggtaattcttccttaattaagactatatcatttatctttggaaaatctttaacacattgttttggatttttgtgatttatctgatatctttctcgtaagctgggtatatattcttctgtccataatttccaatagtcatctagaagttttgatgttttcttccataattctacagttttttcataagaattaaatttaggtttatatgttggatcaccaaattcattttcttctaatattggtggaatacaaatattttgatggggtaaaagaaaatcgattggccgtaaaatttgatatgaattaatatcatcataaataaaagttaagggtcttgaattaactaaactttcaatttcagtaatcattgtgtgaaatgtgtcaaaatcaattaattttttaccaattgtttttcttaaggcagatttaatgtttaaatttaaacgctcgactactccattttgccatggggctaattctattgaaaaattccaattaatattttcagttaaaaaataattt

SEQ ID NO: 9449 - DNA, 4886 bp, Heterodera glycines
  misc_feature (6)..(7): n is a, c, g, or t
  misc_feature (19)..(19): n is a, c, g, or t
ctgcannggtcttttttanatcatgcaccagccggcaacaaaatgacattcttttttcttttgactgatttcccaaaatcgttgcgcttttttctcacattccctttgaatttgccagtaaaaatgccgttcactcatcccatcctaaagtgccattctctcattccatcctaaagtgccattctaataattccttctaaaatgccattcatatcattccatccaaaagtgtcattcttataattccttcaaaaagtgccattcatatcattccatccaaaagtgcaattctcttcattccatcaaaaagtgccattctcttcattccacaaaaaagtgccattctgtcttccatcgtttgcgcgtccttttctatcgattacctatttttgtatttttctgctgtgctcagacgaataaattttggcttctctcctttcttccatggaaaaatagcacatcaaaacattttgaagaaaaaaataaaataaaaattattttcactttttaaaatttaagttttttattaatattctcgaaaaatttcctagaaacttatttatgaaattttcggtcgccgtatataattactcacacccttaaagcatacacaaccattaaaattatgacataaatatttaaaataaatcctacattgccattaatctggtttttaacttgttattttatacaataattttatgcttgtgttgagcgtatacattttttttcggtcgcattaattaagtttattgtacgcgattctgccatatcttctaaataaaagggcaaaatggcaccaactttttccaaacaacattcattcacggcactgggctccttcattacatattgcggcacaaggagaagcgcacggattgcaatgaaagcacgcaaatatccaagaaaaatgtattattatttttaaaatgatgacaatgttaataggtttaataccaaatggccaattgatagtgttctgggcagattattaaaaaaatacgatatatttgacccgttatcttttacacagagctctgttatactatctgccaccgtataaggataccgtattagctgaactttcaagtgacaccaaacaattgaaaaaatcatttccttaaatttgatgctgataataaaaaaataaataaattggaaaattttcgaaaaatatcttagctaggggtaaatgttttttttttaaataagtattttctaccgaagtcttttgaatggtgagtttaagaaattccgatttggcttttagctatgtttgcagtgacatttggatgcacatttttccgtggcttaaccctgagcaagtctcgcggaaattggcactgctttctgcccgatttgatggccttgtggacacacatttcaaatcgcgaaaatgggcatttgtatggatgcttatttattacagcaacaacgtgaaccgtagcggtgtgagcggcgtcgatgtgtatgttcaacacaacagaaaaaggcaaaatttacttatcccttatagaaattttaaaaaaatttgaataaatatttcatagcataaattcagaaattctaaattttaactcttattataaaaatttggaaaaatagttgcttcttaaattatataaaagaaataaaatgctatttaatgtacttttttagaggtttcagaggtttacgaatcgatgaattgacgccgtccaaaaatttaattgattttaaatgcatcgagctccggtaaacagtgttatttttatattgtatagaaatttatttctactttaatcaaatctgttttcgttggtaaaaatgtacagcactctcccacccattcatcttttcagtcaaaaatttcttacgaagtataaacatttctttaaaaattacacattttaattttaattattttcttgaaattttcaaattatttttaataatttttctagaatttttctaaaattggggacattcgcaactttatgaaaatgtcagcacgagaaaaatcgctcaaagtttttgtaaattttattaaatgctaactaaataacggattttgaggcatagcctttttttctgcgcattagtttcgaggtactagtacggtttgtatcccctatttttcaaatttttttaattgtacgaattgctttaaatgacaaataaaagatgatttatgtgtttattgggtacaattcagcgatttgtgaccaaatccggtcccccaaattgcttacgccacaaaaaatccgaaatatatgtggaaaaaagtgatctgtgactgccaaatctttttttgaaaaatagaggatacaaaccgtactaataccagtttcgatataataagcgtgaaaacaccttttccacttggtttgaggcttctacgttgacttttattatgcctttttttgactttttctggattttcgtgccttaaatgcctttttttggcattttgccgttttggatgcctttttggcgtttttttgcgaaaaattccattaaaaatgtaataaaatagtgaaaatacacccctaagaaatgacaattttaaatttttttactttctaccaataatcgtttaagaatatttcgttaaacaatacgcaataaactcctccaaattattttagttactttgacagctctgtgctctcattgcttcatcgctttaagccacttttcctaatgggcatcactttacaactaatgggcaaagggatggaagccccgcggggttgggcactgcgcatccaccaacttcttcctctgatcggcatcaccaacatccacaagttgtatgttagcaccgggtacgtgagaacaaacatccaatcttaccattcatatactcacattttgtaaagtgatttaatattttattcaattttaaataccgaatatggttcaatcagtttaatattttagaatagtttaagaggttcccctacatttgcgcacctgctggacatttgcgcctatgttcaaaatcgggtttaaaacttgaatgttttcagtcccggctgatggcttaaacagcctttaataaaccatagaaagtgattgtatgcgataaattgatcataagaaaatttttgaaaaaaaattaaatatttctaacaagataaccctaatttaatatcagtttcatctgttggaattaggactacggtttttagcttctaaaaaatcacaaaataattactaaaaacaagaaaataagtgccaaaaagtttcagatttagggaactaaaatcgttaaatattgaccaatttttaacattattttttaaaattattttgacattttctttaaaattaaatctaagaaccgatcggtgattttcaatattttcttacaacaattttttccttattttagtggctatagtcgactgtgcggactgcttgtaagcatttcagcaacatttctgatcgattgtcccaatctccgactaatttattatgatgcgattatgactggccctgatcgtccctttgacaccgccaaaaaagtgcaggaatggctccagtggccacggggagatggccgtccaaaagtgttgtttcgttcataccagctaccaattgttgatgagttcaaacaggcgagaagggcacaagcaatcgggcgaaatgcatatgcaaaagcatctaatcactcttaattgactgtgatattagagaaagtgttttaaaacacaaaaagtatgtaacaggacaaaacccagccgggaataaaattcaaaaaattttcaaaataggaaattttacaacaaaaaaaatcttaaaaatattcttggaaaattctaagaaaaaaaaattaaaaaaatttccagcgattttttcaaaatttaatggtgaattactaagttttttttcagaaaaattttaaaaaatcgctgggaattttttgaaaatttttttcctttctaagattttttcttgaaaaatttctgtttgaattcccggctgtgttatgtcgggggctgtgctttggggtgcactgcaaaaaaggaccaataaaaaacggtaaattccctcctgagtcgtgtgaccagcaacatggacttccctttacgaagggaactttgccaattatgagtacccaaatcagtttttaatcatgccaattctgtagagcaccatcaattcattattatttaattttggcttttttggccctttaaaaataataataaaaaaaacaaaattaaataaaaagaaattaaaaatgttaagaacattttttcgaatattaatgtaacaaatgataattaattattatggggctgaaataagaagaaagagctcaaaatagcttttcagcatatgcaattttaaattttttgcgcattaaatttttttctgtccaaattttttttaatgttgatttttttttcttcaaattttcccttgaagattcagtaaaaatctagaattttttttaaactgtatttcttttagaaattcattaaatttttatgaaatttcttatttccaatttgcaaataatggataggaatgtgagacgaaatttttgatgaatccacagtttttggctcatttaacccccatttttgttcaggactttctgactgcaaccataccggcaaattacatcatctgttttatatcgtttggtattcatccggagaatgttgagcagtttcagctggacaacaaacgcaccaatgaacgattgaaaattgaacgaaaagtgttggatcagcaacagcagcagaagagcaaagtttgcatgacgagggcaccgatcggaagagacgagcgacagtgggcggaatggatgcgaaaagcgtggcaggaggaggaaaagcgaaatttgctcatattttggatatcggaagcgaacatggggccggacatttgat

SEQ ID NO: 9450 - DNA, 1208 bp, Heterodera glycines
tttgtttacattttctgcactttcatttctttgctttatcattgttatttctgtacaaatttgtcgcaaaattccctaaatttttgttttaggaaatcttttaaatatattattaatcaattatttaattaatacgttctcattttgatgcttcaattcatcaattccagtttgaattctcccaaattgggtgaaaatttcctgcattttctaaatatttttttattttaaaaatttttaaccaaattaattattttccttttatgttttgtggctacaatttaaataaaattttaaacagcaaagggcgcgtaatataagcaaatgcgctgaccaattaaaatactttggtggcataaatgcgctttgatgtagaaatgagtactggatgggaccggcatccagtcggggttttgccgggattcccggcctatttttgggtcattaaaaaaattaaacactgctagccccttgtttctctcctttttcaagttttcataaattatttgtgtttttaaatttcaaatgattacccattcactgttttgctttatcattgcaatttctttgtgtaattgcccgatttgttcacgcattttctcaatttcttcacttttcgctttgttaatttggtcaaccattttccgtaatttctgaattttttttaatttaaattaataattgcttaaatacttgatcatattcttgttttgtctcctccaaaaattcctccactttctaaaatataaattaatctttaaattttatttattttttacttttttctcattttctttttgttttatttgcgctatttctgttcgaattccattaatttgctgcaaatttttaaaaatatttcgttgttgttttttttggtttttctcactttttcgttctgttgatttgtctttattattttttcttgaaattctttcaaattctaaaaatttatttttatttttcctttaaaatttatttccttttttaccttctcattttgttgtttcatttgcacaataatctcgttaccaatatgatctattttgttcgacatttgttctgttttctgcatattttattttaatttatttttcattttaaattatttctcaatttttataattatattttatatttctggtttttttattttatttcccttaatggattctgaaaattgaacatttcattttgtcgcttcatct

SEQ ID NO: 9451 - DNA, 2326 bp, Heterodera glycines
  misc_feature (2309)..(2309): n is a, c, g, or t
cccgtctctttctcctcccccacaaatacaatttgggcactttcctccgtctgtgtacggtaagtttgtcactttccttcatttccttgccatattatctccgcaaagtacactttgtcatcattttgccccaacggtggcaaaatgcgcaaatggaaatgatttgagaagcgaatctgatgcgtgtcaccgttcgcgactcgaatggcacgcgcaacgaattcgggttgattcacctggggaggggggaaatgtggatgccgcatttgaaaggaaaaaccgcctttttcccaatgacctgctgggcctggcatttttttcaagttaccagacccatgcggatgctttgtctgcggtggtggtcgattgggccccgccgattgggccccggtacgattgggccccgccgattgggccccggtacgattgggccccgccgattgggccccggtacgattgggccccatggggcagtcacttttttagtcgacttttggtttactttcactaaagaaaaattattacctatgtatatttttaaataaaaaatggtttttttaatcgttaactttgttgcacattaattaaaatgtatttttttcatgttgggttcgaacctggacctccgaaaaataggaatttaacccactgatccaccgttttttttaattttccccacttcaccaccaccaccttccctgaaggggaaaacacagtcaaaattttgatttttgaggtccaataacttttctatttggcttcaacacaccgctaacattaaaaattcagagtagccggccctgcactatcaaatagttatgatacatgcattttctgacacagttctgacggttcccttgttagatttggcccaagctataagcttaattttgtaaaaaaaatgtattgtacgaactgctattgtacgagttattgcctttgtaagaatggatagaatttcatacttaataaatttatgaataatttaatttttttaaaacatgtgaaacgaaaaaaaagtggctgccccatggggcccaatcggcggggcccaatcgtactggggcccaatcggcggggcccaatcggcggggcccaatcgacccggtccgtaaaaaatgggggtgtgctctgagagaaaaattattatttggagactgggagaaaaattttattgaaagaaaataattaatctatcccgctgaccaaaatcctaaattttatttaaaaattgccaaaattgcaaaattttctcattttacggacaaaatctattaagcggcgcctatcggcaccgccggccctcctaccctaaaaatttgggaaaaataatgcggcaaaaaattgaaaattcgtaagcagatcacaccataattaaggaattttaggagaactttcaaagtaaaaaaataataataaacttctaaattttaagaaattatgataaaaaaacgatgaaaataaattgatttagaatttttgattaattaaattttgagaatgattcaaaattttagaatttttcactaaaaaattttgcggttttttcagtattcgtatttcgcattttatttttcgattcgaaacactggtgcttattgttagcagggaagtaagtgtgccttcgccttcaaaaaatttggaaattggtacacatccctggtgcctaccgacctccctcactttcaatctctctctctctttctcgctctctttctctatctctctctgtctaatctctctcttatctatctatcactctctctctctctttctctctcttatctatctctttctgctttctgtctcttaccctatctctctctcttatcttctcttctctctttctctctctctcatatatctatcacttatcattctgtctctcttatctatcaatctatctgtctctctcttattactatctctctcttctctttctctctctcgcttgtgtctgtgcctgtccttacttttgtccttaattctctttcccatgccttcttcactattctctccatctttgtcatgctttttctcaataatgctcggcttctgttccgcttgccttttttcttctaagactttctcgagtttcacatattcttcttctccaatgtgttctttcaacccattcatcgcctcttcaattaactccgggatctgaatgaaaatttatgtgagtcaccccccaaaatgaataaaataacaaagaaccattaagcgactaataaatggaaatttttgaagtcttttcgcaaatttgcataaatggtaaaataaattttgccccgacgctatcctctctngcgcaaaattgcatgac

SEQ ID NO: 9452 - DNA, 1855 bp, Heterodera glycines
ggcttctggactagtcagctgaggacaactcagccaaggacaactcagctgagctgatgagacaatttggctgatggacaactcagccgtacaataaaaaattacaaaataaatcataagcttaagcctaagcctaggcttcgcctaaagcttaggcctaagcctaagccattgtacgagttgcctttgtaaattttcgtaaagctgaattgtccatcagccgaattgtgccatcagctgagttgtccccagctgactgatcctgacgcgggtcatttagcaggttatttgacattttttaaaaattaggaacataattcattaatttgatttttttttctttttttaatattttaaaaaacccacacaaaattattaactaaatttccatgtaattaccgaaggttcccggtgatttcgtcagtgaaaattaatagtcgcggattcaaattgccgcggtcggaaaaaaatcccgcggtcgcgcttacattttatttaatattccgaacgaatttatgtgttaatggaacactaaaatgttttttttcgtaaaaaagattatttgatgaaatcacatgtcatcattagggctggcaaaaacatgtaaaaaaagttgtcagaatatgtacataaatatgtaaaaaaaaaatcccgaaatatgtatgaaaaaacaccaaacatgtaattaaaaatttttaaatggttatttttttgggaaaaatccttcgtaaaggatgaaataggcacaaaataccatagaaattacctaaataatcttagattcacatttttgtatatttaaatattaatttttggtatctccttttttgaaaaaaccgatttttaggggtacattttaaattaaaattttcacaagaaaatttttataaattctcaaaaaaaaattaggaaaaaatgctaaaaagtccaaaatatgtaccaaatatgtataaaatcctgaaatatgtaaataattatgtataaaaccccgaaatatgtaaaaatatgtaaataaaagtcccgatttttgtttgcaaacataaaaaagaaagtgtttttcctactatttagagcatggagaatccagctggataaaatatgtatttacataaaattgccagccctagtcatcatagccgaaatcttttaaacagaattaaatttaaaaaataaacatttactatttttaattgatttcattttcatgaaatttcaaaaatcttactttttcctatttgttaaaaaaagttttctcaagaattagactaggttgccgaaaatttttttgcattttcgatgccgttttgtcccgtcgacgttttggggtgggttgtacaccgtccccgcccactttccgccgaattttttttttcttcgtaagatccgattaatctttttgccttacatctcgctttatggtgttgtcattcaatatcaacaaaagttcctccaacttttcatcattttcatctgtatggtgcttacaattagctgctttatcaattcttgaagaagaaggagaatcattttgtagtgataaaataaatgcaaaacggagcatatcattatcaatcgatgtttctaaaaagaggaaagaattttggctttttagaaaaatataaaaaatatcctaaatatttaaataggctaattcttaaccaagaaaaaggtgattaaataatgttttttggtatatattgaacaaaaaattggttttttttagaaaaaagattcaaaaaaaatttccgaaaatgtccgactttttatcaaaaatttcggaaatcggaattctgacatcaaaattttttcagaaatcggaattccggccccaaaaatgtcggaaatcggaattccg

SEQ ID NO: 9453 - DNA, 1570 bp, Heterodera glycines
tcgtttaatccaaacacaaaatagaaacgtgcaaaaaccatttaactttgtgcgcggcatttctctttctcacgttaaatgccgtcatttgccaaaaatggggacacaaattggcacagttttattttaatctttgttgcatcctatttgtccattccattcctttttattcggttctattttaatttttgatcatttcccattttggcccctattttctcctaattgtccctaatgacccttgctaattgtcgtattccccaactttgctttattctgctctttgcccttctgctgctgatcaatttggcgcaaagtgaccaacaattgagcaaaggcattcttttaattacctttaatcatttcatttattactttgccatttttggcgaacaatcgccgatggacgccgaattagacacaaataatgagcatgagcaacattacggggacggagtgttcgtcgacgcggtgccaatgtgtggcggtggtgccaacatgccgaaaagggcattcgtcgagggacaaaagatcaacggggtaaaagcggcagataaagtgccaaaagagtaggaatgaattacttttcactaattttcagaaaaaagggcccatttccgacggcactttccgccctttcagtgtcgccatttggtcgcctcagtttttgccgcgacggaaatgaaactttttagggatgaaaatggacgaggaaataaggaaacgaacgaacggcgacagatctttcagcacatttttgtctgtccataaaacgcttaaaaattgggtggaaattgccatttgatttcaaataaatatgcgggatcagtttttgtcttttttctttatctaatgatcagagatcaagttcaacaaaaattgaaaaaaatgccaaaaggcaaatcacaaattaattatggtaattaaagaaggaacaaacaaaacaaagctcatcgaagggagggagggcaaaagtgttttggtaatagaataataaaataattgtcaaaatatatataaattgaatggctctttaaaggaacaccaatttttggggtcagcagatcaatgtttgcacggcattttggatggcaccccgaattttttttggttaaacccatcctccccgaatccccctaatgtgggcattcaggccaacattcttcggcacttttatgccttaattgatgggtcggagtgtgtcgccactttccgtttgatcagtaaaattgcgattttccaattaaaatgttttgcgtcaaaatatatattaaattttagaattagagtttcctgcaaacactgtttttgagatcggatttgggaatttggacgggtggaaatgatttctttggtttctctgccttggctttttttctctgtgctctctcgctctctctatctgcgcgtgccaaacagtgtctcgtaccactctgctcgtctggcactctcctcaaatgtgcgcacttttcccaccggcggtcgattccctttaaattatcggatgatcaaacttgtttatttttcaatttgcccatcgcttctctcacctgctgtcctttttttgtgg

SEQ ID NO: 9454 - DNA, 1844 bp, Heterodera glycines
ttctgctggttggtccgtgccggcttctgctgctgactttggaaatgttttcggcatttgaccacgctttcggtggattctctcaacagtaataaaatggcaccaatttgcacaaaaagaaggcccaatggcattttcacgtaaaagcaattagtcgcttaattatagcaaattaacggaacaattaaaaaatgaaacggaaaaaatcttccgatgtgctgctgaaaagtgctgaatttcagtttcgcgttttgtgtgctctttctccgggtggcacctttcgctttgtctgccgattgatttgggccaaatttggagacaaaaaatgaaaatgataagccaaccaaatgtgaaaagtgaacattgcaatcaatgtcagcacatttttggaagggtttctttccacgttttggtgattcaaatagtcaaaattattacgaaaaacgggaataatttattaattaccattcattaattaattactattcccaatatttgttttttgtaattgtattttattttgtctatggagtaaatgtgataaattcatcacaatttaatatgtacgggaacctcttttggcattggaatttgctaattagggcctaattagggagtgggtgttcatttcctttttttccatttccatttcattttgcctttgcgaatggccaaagttttgcaaaggatgggaatgggaaaggtgccaagaaagggagcgcccaactgactactgtcccttccatttttgtccttgacaaaagcgggggggggggggggacgaggaatgtcgcattatgtgaacaaattatttcatcacgaggacagtttttgcaaaacggcaaaaattgggggggggggagacaatgcaaaatggggataaaagaaagaataacacaggaaagatagacggagaacgataaagataaagataaagcgagagagagaaagagagagaggaaaaagggggggggggagagacaatgcaaaatggggataaaagaaagaataacacaggaaagatagacggagaacgataaagataaagataaagcgagagagagaaagagagagagagagagagagaggaaaaggggggggggaatttgtggcatttggccaaaacaattagaaggaaggcgtaatatgattggttctaacatttccactgatttatttgtgccaaatttttcggaaattcagtctcaattttcaatgtcccgttgctttggggtattttttattttggtgtttaaagcccagggaaaaattgaaaaataaacgcggaaaatgggattaaaaacggaaaaggtgatcaaggcgaaagcatagggtaaagggccaaaactggggtcattttgggcaatgccatccttcattcattcgttggcaaagtgtcgggggaatgacccaaaaatgggacgcgaaataatcggcgggggaaggggagcgattggggtttgggcggaggggtcctcaccgcaccatcgccgtcgtcatatccgctgacccctcctccctcccagcccaaatgtgctcattttgccccattcattgtgccgtggcacttcgtcccggtgggctggcaccgatggactctgaccccgacgcctcaaagattcatccgatgagcggggtcagcagcagctcaacgccaaacaccgcacaaacgatttggggaggaatacggtgagtggaggtcattggttactgtagctgggagagaaaatgccggaagggacaccaatagatgaataatgccaatgccaatggcatttaatcgttttttaaaaatttatttaatcaacaacaaaatttggcatatgccaaaaacaacaatgtgg

SEQ ID NO: 9455 - DNA, 432 bp, Heterodera glycines
ctccccctccccgcctttcccccgccccgtcgttttactttccgttgcgcaacagtaggggaggaagaacacaaagcacagacagcttcagggacagggaaacaaaagactgaacccaaagaacagcaccaacaaccccccccccttccccatccaatcccatcacttttaatgattttcccttttggactcttttcgggccgaaaagtcacacaaaaggcaaacggcgacgggggaaggggagacggagggggggggggatgggtgttcaattgaccggacacaatttcgcaaccgatgggaattttggagaggggccaagtgaaggtgagaggggcaaaggtggtgtggagaaataaggaatagggctgaaaatgatgagttaccgagggttgacacgatgaaatgagtcattgggtggggcggtagaca

SEQ ID NO: 9456 - DNA, 3265 bp, Heterodera glycines
ttattcttttttcatctgttggctaatgagactctcaataattgagcaatttatttataacttaaagacggtttttcattcttcaatccctccgattcgatcaaagtgtcggcattttcgtcaatttccttttttcaatttttgaactgccgaatgcaatcacaattttaaagcttattgaacatttgaccggttactttgagaaaaattgaaacttgccagcaatccgctttgccattaaaatgtttgtccgccagagcattaaaacggggcgaaagcaatgccaatttgaggccgagttgaagatggtcagaaatgcccatccaaagtgttgcaaaaaaccagctgaaaaaaaacaaaaagtaaagagagaattatctaaaatgtttgaaatatagattaaaattctatacaaaggaaaaacttaataagcattggtagtttggtgtttttaattatttaacaaaagggaggggggaatcaataacaaaatttatactgagaaatgaataataaaatataatcgatattcgtcgctgaaaaaaaaggttttttgcgctctagttatttaaaaaatggggaaaaaaagctacaacagtgatcagaagaggtacaacagtgattagaagaggtacaaagcacacagggattctgaggtcataaatcgaaaaaatttctcaaaaaaaattttcaaattaaattttttaaatgccgaatccaaacaaaagtagagattagaaaaattttcatagccaatttgaaactgaaacttacgccttcagccgttgaaatgtttgtccactggagcattgaaacggggcgaaagcaatgccaatttgaggccgagttgaggacggtcaaaaggggagaatgtccatccaaacaccatgcaaacccagctgaaactttgaaaaaatgttagttaaatatgtaaatttgttcatagaaaatgcatttttaggcttaattgaataaaaagggccaaaaaactaaattaaaaatgtaaaatttccaaaaaaaaagattttttaatgaataaaaagggccaaaaaattaaattaaaaatgtaaaatttccaaaaaaaagattttttaattttaagaaaaaatgttctcttaagagatggacggtcaaaaaggggagaatgtccaccactttgatattctgaaaagtgaagttcgtttttttggaaaaaaatcctaaaaaaataatttaaaaaattgaaacattctcatttttacacacaaaaaaaacaaaaaaaacttgcctacttggaggccattaaatattttatgcataaaatccttcaaaaaaacacataaaaactattcacttttacaaataaattttcttgaatttccaaaaatttttattttattttgaattttgaaaatttggggctgttaaggcttttgggaccataacccaaaaacaaaaaaaaaaaagaacagaaaaaaacaaaaaaaaacttgccgaaattataaaaaaattcgtcatgtcatcaaaatgtttgtccaccagcgcttcgaaacgggccaaaacagttccaatttgaggacgagttgaaaactgtaaatatggaaaggctggtgaatataataattttataaaatagtccgaaaaagattcggacttattttaaaaataaatttataacatttttaaatttaaaaaaatttactgcattccacattgaaatttcttcacggatttgcaattcgtcgcgttccaaaatttcgcacaacattttttggtcaatttgcaaaaatccctccgattcgatcaaagtgtcggcattttcgtcaatgtaaaataaacaatggcaggcaaaattctaaatttgaaaggaaataaagtattaaaaaaattggctcgattgagaataaaaataagtgaaaaaaggaacattatgcaaaaaaatcgatgcgataatttccgcttttaaacacaatttggaaatatcaagttaaattgagagaagattaaagtgaaatcacttgggtcagaaatgtaatagtcatttcacctgcctggtggcgaagtggtgaacccacctgcctggcatggaccgagggtaagttcgagcccccttggcggagtagcctcctgtcgaaagcccgatgggcaagtagcaaacagttaccagtgttcggcctaataaccgactctgggggtgcgagggaggagcatggttctctcgcaggtcagctgaccagcctcaatcccggctctccgggagttttcggggggttacagcaaccccccctcccaagggaatttttgcacttttttgcaatacccgcctttatccgtttcatggatatctcttgaaagggataaatccccttccctttaggtcccttcccttccatttcccttcctttactctaattgcatttcagctctataagctgggatagggttgtgtcttaattggcacgtgacacaacttttggtccacattaaaatatctctatgcatctttggccaaaagtattttttgcattttttaggttacagcaaccccccctcccaagggaatttttgcacttttttgcaatacccgcctttatccgttccatggatatctcttgaaagggataaatccccttccctttaggtcccttcccttccatttcccttcctttactctaattgcatttcagctctataagctgggatagggttgtgtcttaattggcacgtgacacaactttttggtccacatttaaatatctctatgcatctttggccaaaaagtattttttgcattttttaagtgtcttttaaatgttcatgtgcccgccgccgagtggggaattatgtaggcctagaaaaaagagctctttcgaatggtaccttcaaatcaaaaaacgactgtcaggaagctgagctacagaaaaaaattccaagccaaggccaaaccactatagcagtatagtgccaaaaattaattgaaaatattccggttattcttccgtcaaaaatgacgccaccttagccattaggcctagaaaaaagagctctttcgaatggtaccttcaaatcaagtgccaaaaagaagctgagatacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaataaagaaacgactgtcagggagctgagctacag

SEQ ID NO: 9457 - DNA, 1871 bp, Heterodera glycines
  misc_feature (1806)..(1806): n is a, c, g, or t
  misc_feature (1817)..(1817): n is a, c, g, or t
  misc_feature (1828)..(1828): n is a, c, g, or t
  misc_feature (1839)..(1839): n is a, c, g, or t
  misc_feature (1843)..(1843): n is a, c, g, or t
agctgagatacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaatcaagtgccaaaaagaagctgagatacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaatcaagtgccaaaaattaattgaaaatattaatttgtattccggttattcttccgtcaaaaatgacgccaccttagctacttggaggccattaaatattttatgcataaaatccttcaaaaaaacacataaaaactattcactgtgcccatacctcagcgggtataagtcgtagagtagaccattttgtactctttctaatgggcccacttaaaatttccagaaaaattttcccaaccccctaggaattttttcgaaaaattttcccaaccccctaggaattttttcgaaaaattttccgttttgcactgtatattggggtgttcagatcaccaggaaggagtgatcggaccaagttgctgtaaaagacttttttgatcagcactcaaagttaccttagcaggaattttttcagaatttttggactgcaaaattgtgccaaaaaataaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtataatgggcgaaagtatgaatgcttgcttattcatctgattattgagttcattcgatagccttaagtgtcctctattaacctgcataatttcgaaaaatttcgtaaaatttcaaaaaagttatggtcagacgaatgcttaactcagaaaaaacacatagaaaaaatatatttggtttacataatatttgaaaaattttagcttattttcttttggcagtttaatccaaaaataataatggtacgcaaaagtcggctaaccaataatttatacatcaaatccaatcacattttgttgtataatgggcgaaagaatgcttgcttattgatctgctattgatggaactctttggtgaaaacgaaataaatccgcagatatttattatttatgctaatttngaagtaattangcaaaaataantaataacgaanaatnaaattataaaattcgagggataaaatca

SEQ ID NO: 9458 - DNA, 3090 bp, Heterodera glycines
gtcagaagtaaaataataaaaagtcggagtaaagacgagcgaagagaaaggaattgaataatgaaaagcgaagtcaattgatgagtgaaaagagatgggtatttatgaaagcgagagaaaggaaaaagaatggaattacagtaatccgaaaatggcgtaaatttgaatatttaacaatgtactctacagagatttttattttatacccaataatttaataattttggttttactcattattggtgcttattttaaaatttaatattttcactttgttttattgtttaattattattaaaagaaatattattaaattgctatatgagctatgattttgtttatagcacatgtgcaccttaaacgattgcaattaatcaatcgtcttttagcattagattgaatattatctattttaaggagacatcttttctgtaataatctattgaatatttaaatgttccatttggccacaatcttgaagtcgtgctgaattttatccgtaccgcatcgagaattcgtctgcaggctgccaccttaaagttcaaaaaacctaagtattgtgtttcgaattttgatgatatattatattatcaaattaatttttaaattattcataaatatatgttggtattagaatctaaataaatttaatgcattatttgtatttaatatagcataagactgctgaaaatcgtttggtgcctgtatcgagacacctcaacttaaattaaaaaattgaaatatttcatggtaaatcattttaaaatataataaatattaacattaacattaattgcttcatcgtttagagtaaaaatttttttctttctgaatatattttaatttattgtttctttgtaaatgaaaatataataattcaaatcaggttttgaaatttataattagctttattatttttttaataattatgaaatatttatttggttttatttgtttgttttgggtttttaataataaagcaatgaaatactattattcttatatgccatcaagctgaacatttaatatctcgaattcactgacttcatttgaaattaactagtcatttttatttagtcaaggaattttttgtctatctaaaataaattattctatcaattaacttttctggtaaaattgttaatgttggttcatatatttttataattaataatattacttattttttgtttatattttccatttaatattgtgatcaccaagaataggatttttaggtgcttaaaacttgaattttgctcaagttttggtaaaactcttttacaaaaaaccgctaattttaaaactttacttcaaaactattttgaacctaccccccgatgatcattataattgttattaaacaaattaatcttttgcacacggttcaaagataaataacaaaagattatccatgcttatttattctgtatttagaattaaattgacggaataggagaatgaaaaaatccattatttttgaatgtaaaagacaaataaaaatattgagaaggagaattttgtaaataaaaggtttgaaaaataattttagaatattaattgcatgatttataataaaaaaaacgggggggggggggggctcactgcaaatgtggtcgggaaattgcgaatttgaaagctattgactcaattctttttgcgttagccaactgatctccccatacaactttctaacctgggcaaagactacaaaaaaatttgggaactgagatatgctaacctgtgtttgctaacttttcgaaaatcggcgcatagcgcctggcggcgcagctgtagcgtttcggtgctgcttgcgaaaagttgagccatggcatggggagcattttaaaaaaaaaatttggcgcgattcggcaagtccgaagggttgcaatgggcgcgcgcccgagccggctttgcgccgtggagagccaacttttgcgccgtcaatgctaggaagacaaatctttttcccccgcgcgtcccgcaccctgtaaggtttggagcaaaaattggggtctctcgccgggcgctttgcgccgagatatgctaacctgttttcgctaagtgttgcgcagcgcccggcggcgcacagatagcggctcggcgccgcttggcgaaatgcgtgccatgccgtggggagcattttaaaaaaaaatttggcccgatccgaccacttggcgccgagattgctgtctttttgtggaccagctttgcgccatagacagcaatcttttgaaccatcaatgctagggagtcaaaatttttttccccgcacgtctgctgacctgtaaggcttggaaaaaaaattgccgtctctcgccgggcgctttgcgctgagatataacttttcactctccaggccccgcccaacacctcccccgatggctaagtgttggacgggccaaacaaatgtcagaatcgtgttccccaccccaaattacccccggatactgattttcagaccattcggatgaatatgaaaatttcgattttgcttatcattatatagaaaaaaatgggggggggctcactgcaaatgtggtcgggacattgcgaattctgcacctatcgacccaattctttttgcgttagccaactgatctcccgctacaactttctaaccgtgcaaaaaaaaaatgccatccctttgcgctgagatatgctaacctgttttcgctaagtgttgcgcagcgcccggcgccgcacagatagcggctcggcgccgcttggcgaaatgcgtgccatgccgtggggagcattttaaaaaaaaatttggcccgatccgaccacttggcgccgagattgctgtctttttgtggaccagctttgcgccatagacagcaatcttttgaaccatcaatgctagggagtcaaaatttttttccccgcacgtctgctgacctgtaaggcttggaaaaaaaattgccgtctctcgccgggcgctttgcgctgagatataacttttcactctccaggccccgcccaacacctcccccgatggctaagtgttggacgggccaaacaaatgtcagaatcgtgttccccacccccagagacccccggatactgattttcagaccattcggatga

SEQ ID NO: 9459 - DNA, 2392 bp, Heterodera glycines
  misc_feature (41)..(41): n is a, c, g, or t
gaaaacactcatatataaaaaaataatattactaaatcctntaaagtaaaaacttaagttttgataaaatttgatttttaaaattattttgaaaaataaaaattaaaaaaatttttttttgggccaaaaggggggtaaaaaatattttatggggtattttgaggtgctgagcacgaatatgatgtttatttaatcttcatacaataaagcactaaaaatagcaaaaaataaggagaattttatgggatttatttgaaatttatatctcaaaaaagaaaaaagttattccaaaatttctggaaaatttcgcattttcataaaaaaattcagaactgggttctgaaaagttattctggaaaagtaaaaagctacaaaaatccgcaatttgttgctctataagataaattttatttcgtatttttatcacttttttgtgaatggctacaaaattaaaactgatttttggattcgggaccaaaggggtgagcataggatttttgagtggaaaaaatttttcatccaaaaacattaaaaaacatgtccttacaaaggagaggtacccaagtgaccatgggacttccgaatgaaactttcagggtaggtagattaccccccctttgtattataaatttttttttatttttgctaaatgaagcttctggccgagatatgaagcttttcctttttgccttttcaatatcactttcaaagaatgtaaagccaatgtgagcgtcggtggcctggtggttgtgccttccatacttttttcttcttctaaagttcaattccccaaccctgtaaataattattttgtttttttttcatatccaaattagtttttaagctttttaatattaataaatttgaacataatatttttttcatttttattttatatgagagaataatttgtctattgacctattttgcttatcagtaagtgttgaaaaattctgtcgttgctactcttctcggtcctctcatctactctcgtcgcattaataatcattgtaaaaatacttcccaaataaatgccaataaatccaacaaacgttattcttttattgcaagaacattatcatggtaaagccccccctcccacccaattaacaccagaggaaaagcaactggcaaaggattttttgaacacattggaattttgtgcaaaacaagggtcagaaattgagactttggaagaccttattgtggatgaattggccgtttttgatcaaaaagatcagcaagattctgacgagcagtttgaccttgaagatgatgaaagtgaagatagtgaagggagtttttcctctccagcaagtacagtattccttttttccttggatcagtttttgcattagaatcatcttcatcgagttatgctccctccccaaagaaattgtgttccccgcatgttggatttgccgaaaaaatcagtgccctacgacatttttttcctgatcactgtcaaatcactttttgttcggaatttataatgattagatgtgcatggtgtgacaaattcctttgcttcactcatttctaccaaaattatcacatgtgccaaaattaatgtcgaataaaaatgaaaaaaatattatgttcaaatttattaatattaaaaagcttaaaaactaatttggatatgaaaaaaaacaaaataattatttacagggttggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgtaagcaacgaatgccaaagggcatccgacatattcactggcaaaactcaccgttttttgcaatagttcgcttcattagttgaatgagataagctatccgatgctgttgacggcacagtttgtttgtgttcatcagtaacatctttttgcgagagcagggacgaagcttcttaaaaaattgaaaatttagaaccttgaaaaaaatttaattaaaaaattggaaataatttttaaatttatttacgaggttctgaggcttgtgatgatgacggactttgaggttcttgtttaactttttttgaaccttgtccttcctgtttcgatgttgttggcgcttctgactgtttcactttttgtttttcttccttaagttgggaaattcataattctttttcgctattttatttatttctaaaaatttctagattcaaaaaaacaattataaaattaaaaaagcattttctcataaatag

SEQ ID NO: 9460 - DNA, 2274 bp, Heterodera glycines
  misc_feature (10)..(10): n is a, c, g, or t
agcagtttcntggcagaaacagaagaacccatttacgggttggccaacttagactatcattggcacggagaaactgccgacccaaattgggacggtggcgaaaaaggtgaagcgaacgacccgaccaaagtttgtctctattttgcgcccgatttgcagttgattttctgctgaatcgatgcactgctcgccaatgtgtgctgctgggctgtcccttcagaacagaaaatggcacattcgccgcattcgacggacgcaaatttaaatgccattccatagacgaactgagaaacaatggcaaattgaacaattatccctccgggcatgggtatgattaataaaagcgaatttgattgattatcacttccaaatgctcacacacaaaaagaaatgatgatgatgaagtgattgaaagccatcacattttgttggactccgaccagaaaactgtcgatggtttccgtttcaaaatgcccgcggcggttgggcccttttccacacgaaacggcgtggaaatcgcagaagcattgcgacgggacaactgctcgcgctgcgaaagcaaaagaagcggtgcgcctccgtgcgaatgcttttaccataagcgattccctcgggggaaaacaattaaagtgaaattgacaaaggcaaaacgcgcgaattttggcacttcagataaccttcgttaacaacgatagccttttcggtggtgccaatttcggcatcacaaatgccttccgccgttccctctccgtccatttgcacggcgttcgcttcgaagtccttcaaattgctctcccccaaatgatgcgcaacggcacagtgacaattcccaggccggacacagccccaaaatgtgttggcaaagaatgcaaagcagcgaaaaaggagcgcaaagacaaaccgacaaaagtgcggaaggacaccgtagtggtaccgtacggaggatacaccgtaatcaggtggaaaataggggatacggtaggggagcgacgcgattcgatcatcagacgaaacaaaggagggaatgtgaaatttggaaagggagggagagagagagaacgaatagggaagagagtggggagggggaggaggggaaagaaaggagaaggggaaaaatgttttttaaggttttacgcagaaaatccgggctggtggatggccgaaacgaatcaatatggacggacaagttttgcatttgccatcggcgaagatgaccaaatgcccaaagcacccaaaaaacacccttccgattgcaacagtttcgacccgggcaccgacatttacgaaaaattctaatatgagaatatctgacttaaaatctaattgatggagtaagtgaaatttatataaatcaagcaaaaaaaaacaagttatatatgcaacgaaataaaagggtaaagtgaagaatcaatggaataagtactgttttgaggtgaaaggcagtcgtttatgctacacattaaataaaatcggaaaatgcgtcgtctgtcattcgtttatattgcccaaaatggtgctcctcttaaaactgggaatacgcgaaattctcaagtgaagttgggagacgctcctcctaagctgggaccgtctgcgatggatcgtgcccgtcgaactgaattcagccgcgattgaacttaaaattcgtcgttaagacgtcttcgcccttcggggtcactgcctaacttttgctcatcattttcagtgagtctaaaaaggcgtaacttacagcgctttgaggatgccgtccacttcttcgggtcggttctcgcgttgctcacggatttgctgctcagtgatttcttccatcacaatgtcacgggtcgacgtcgttttgatctgaagatcagtcaaaaagagaatcggacggaaagggtagaaaaacgaacgcgttggatgagattctcgaaaaagtcgaaggcaatgtcaaatgtatagctaaagaaaagcattaaaaatactgaaaaaggaggaacaaacccatttgtcggacagaagaagcacatctcatcggccttttggtcgcgaattctcagaatgaaaacacctaatttgaccattttaaaatgaaatctcaaatgtcgttgctctttcccccttttctcaccctgttccctttccatttccaaagaacgaaagttggcaaatcggtacagttcgatgtgtttgtaccggtgccggtccttcttccatgaggcgcccctccgcagtgtgctgagtgacaattgccgcggcaaagtgccgccactactgccactgctgctgttcccggtgaat

SEQ ID NO: 9461 - DNA, 2574 bp, Heterodera glycines
  misc_feature (2552)..(2552): n is a, c, g, or t
  misc_feature (2569)..(2569): n is a, c, g, or t
tcaatttgcctttagaaagacgataaacttaggccgagttgccatacaatttcaagcaccgccagcatttcatcgtaggaatttatgtaaggcggataatactgaatggacgagatattgtgggcacaaggaaatggaagtgaccttttcgagatcaggcgcactttcagcccaaattttaccaactaaatttgtgttcctccaatcagaaatcctaaaaataaattggaaaacagaaacagaatcaaaaaacgaaactgttttcgcaatttttgaaggatattctcgtgtacatggattagaggttcgatcttacgaaacaaagtgttcagttcatttgcgttcagaagatcccgctccccctcactttccatcatcgctttcaatggctttttgaaggtctgaaacgcaaatagacaatgtgtcttgaaaagacgcactcacatcgataatcacatttaaaatggccaaataattctgttcagtgtccaaaatttcgtgacacaccatgaaacgccgctcgtttttcttcggcgtgccatcgccttgcgtttcacccgaaggcccactaaaaattactattcactacattttcactgatagccactcaaatggtgcagtgtcaaaacatacaaaaataaatttcgaaacctagtgacgtcacctggtgttgctcgtttcaagtgcttcgagagcagacctgataattggcgaacattgaaaggatatcacaaaaaatgatgcttgcctggaattgttctttttcttggccaccaccaatccctcgtcggcgatcggagaacaatccttaacacgcttttgcatttcaacgcttaataacaaaaaaggcgacatcaaagactgaatgaatgagtaatattgtcagtgcgctttaaaacacaaatgaaaacgataaaaagaaaagatggaaaagccgaaaaatttatagaaagacatgctctcaataaaataaaaatataaatttgcatcaatgtccatctctcccttttctctctctccgatcactgcttatctttcgtctgttgcttcttattgttagtcggcatattgcgcaccacgcaaatcccacgaaccgcatgagaaacacccgaagccttggcagccgaaacggtgctacgagtaacgggaccgctgctgacagtcatgccttcgttgctggtcctacatatttaaagaactgattgcttcatcacgtccattctgtcccccccccaccgccctcccgcgcagtgaacgcgacaaatttcaaaagtatttattaaaagaaacattcacccttttgagatgacggttcggcgcgaagtgtttccaaaacgcatcggtggctgaacgatcgctgaggtttgctcgcgcacttgcgacaacgaacgacgactgactggacgctgtttggcctggacttcgggaaccgtcaaacgaaccgcatgagaaacatccggagcttttgaagccgaaacggtgctacaagtaacgggaccgctgttgacgggcatgccttcgctattgatcctagatttaaagtcgattggttcattcgtccattttgccgtccccccccctccctttcccgcgcggtgaatgcgacagatttcaaaaaacaaaatattatttattccaagcaagttcattaaccctttggtgaagacggatcggcgagaagtgcgcattggtggctgaacgaacgtcggggtttgctcgggcacttgtgacaacgaacgacggctgaccgggcgttgtttggcctggacttcgggaaccgtcgaacgaaccgcatgagaaacgtccgaagccttggcagacgaaaaggtgctgcgggtaacggggccgctgctgatgggcatgccttcgttgctggtcctacacatttaaagaatcacgtatattgtccccccctaccgcgtggcgaatgcgagatttcaacaaacaaaatattatttcaaaatccattaaccctttggtgatgacggatcgtcgagaagtgttaccaaaacgcatcgttggttgagcgatcgctgtttgctcgcgcacttgcgacaacgaacgacgactgactgggcgctgtttggcctggaccttgggaaccggctgttcaacgggatgtccagctttaggggactgctgctctaaagttactctcttatttttattaggaaattcaattaaaagtcagttgaccttcaaagaatcggtcacaaatggagtcattcaaatcgatctcctttcgaaagtcgcgatacatgggcacagaaggaatgaaatacggatcatttggatcaggaattatcgacacaggcattttgaaaagtaatttgctgaatatcttcgataaaagaattgaggatccaaattcaactttttatcttaggctcaaaatcaattactgcggttatagtgtgttggtcacgaagtgacctcagatttatcccattccgagcccggagccgaatgaattcgaatacattccaaatttcattttttaaaatccattttttgaaatattggttttgttaaataacaatttttttcgagantactaatattttaaaanttaat

SEQ ID NO: 9462 - DNA, 1630 bp, Heterodera glycines
tttcttcactaatttttcactcagaccccattcttaccagtgcttgtttttcccggttcccggttgccctaccgggaccgggacctgagcttttcaaaacccgggaccgggaaccgggacctcggaggaccgggaattcccggcccggtcccgtggcactctaaatttttctttaagcaacgcttcgtcgcctttttcgagaagaaggaaatttcgaaccaagcaaacagcactgggataaatgagtcccggtgactcgtcgtttcagtatccatgaaataatggaagaaaataaacatttaacagtaaaaaaaacgaaaaaaaggtcttcaatcagttttgctcatatgtttgagctcaatgaaaatattctggttgttgattcccaaaaattatgatattttaatcgaaaaaaacaaacaaaatttgatgaaaatcgtgagcgcaaaatcttaggttgtataaaaaaagaaaaaatgtgtgttatttttgcaatccttgcgcaagaattagactccattttttgcgcttggtgggcttaaaattgtgcccaattttgaaggcgatcaccaggcggtgctagagcaacgccggaaaaagatgatggtccagcaacaacagcagcaggagcaacaccaacacagcggcagcaaaaggcccgcctcttttccgaccggcggaggaaaagcgaaatgatgccaaaaagaaagcgaatgttatttctgttaccgattgatcatttgggttttttgaatgtcacaggaaaaaaaattgttgttgtttgtcaacacacggttctcgagcagtacaccactgctcaagttgtgatttgtccacacattttttcatttaaattcgttctttttttacagaaagtgttgaatttgcatttgattcaatgacgaaaggaacttcttcgtttggcagcgccacaacaaaacccacacgttgtgccgtcgctgtggtcggtcttcataccacatccagaagcacacctgctcttcctgtggctatccggagaagcgaaagcgcacattcgatggtgggttttgcaaatgcttcattgttttttccctacgctagtatacttgaatcaaacgcagctttttaaggaggttggcaacgagaccaaatgtgcacgctcatttttggtcgagtatggcgtcattaatcaccatttgtagcgcatttttcggacgatgtggtattgtggactggcaaatatcggaattttgtattttaattatcaatccagatctttttcaaccattcttaattctgataaaaaattttttcatgttttggactaattacggttattctagcttgtccccaccatttttcgaaaaaattctaagtcaatggcaaaagcaatttactaccattttttttttttgcttaaaataacacattccctctaatgtttcttcgatacgaaatatttaacaagtgtggaaatgtaaatgtcagacaagtaccgcttcaatgagctggtaaacattttcaacaaattttggcttaagagttgttccgatttcatgtggcgcgcttgctgcgatctcttcccattctaattggttatcgaccgacaggactaacgtcttcattctttttgcttttgctgcgcgaa

SEQ ID NO: 9463 - DNA, 2992 bp, Heterodera glycines
  misc_feature (1565)..(1565): n is a, c, g, or t
  misc_feature (1705)..(1705): n is a, c, g, or t
atgtttttggatataacttttttctttggcatcccttaccaatattgttggtatcattcgagagcttaacatctttctaagctattactaagctatcgcttcgcgatcagacaattaccaaaaccaacaagtacccaaaaaacactagttcgtatttatttcagtagaattgtttattatgactgctcatgtcccaaaggttgctggccgagaatcatataaattatggggaaaattcacaccgcaaatagaggttattattaatggttttgctgcacgaattgagattctgtatataattaaggtcgggtacttcaacgcctttctcgaagcaatgcagacgttccaaggaggtaccgaagaccaattttttgtgaacaaccgcgtgacactgcgaatcgaaccgcctaacgacgacattgttcatggaccgtctggttcagcggccgtgttttgcgctgtatttggattggcttgcaatcgcctctgctcatcagacaccgtcgtcagtgcaacactcgagcgtggccaactatttggagtcggaagtttgctgttcaaaattcgcgcagcaaaagcaaaaagaatgaagacgttagtcctgtcggtcgataaccaattagaatgggaagagatcgcagcaagcgcgccacatgaaatcggaacaactcggaaagtcgccgcctatggtctccatgcctccggtcgcaccccaaccgccctccttgacggtgatgtccgcctcggcctcaccctcggtgccctccttctcctgctcttgcgggtcacggaagaagtacaggtcgggcatgatcagcttgtcgtccaccacaaagcccgtctgacgactgattttgccgcgcaacagcaaaacttcacgagccaacagccaccaaatcagtccgacggagtgcttttgctgtgaggggagggggttggaattgggacagtatttaggtattaaaacgatcaatcaatatggtaccaaaacattttttgttctatagatccgattcgagtaataccaagaccgtatatgtaccaagttttcatggcccggtggtatcagaaatttaccaatccaatcagtgacatataattgagatagcttttagcaattttggttgggtatgggctcattattcgggcatccggccactatcaactctttgaaagacacaaattcaatacaaccttcgggatagttttgctaaaaaaacaaaaccttgttgtttgccgggatggcaatgtccacaaatttcaacggcgagtccgtgttggccaccgcaatcaccggcgtgttcacgtaggacgcctcacggaccgcctggtggtccaactacgggtcggacaccacgagcagacgcggttcctgcaaaacaacaaaatgttgagtttcgtcttccatgtacttaaacaaagtttaaaaatgtaaagtttcgactttttgttcgaattcggacccggagtttggaattgttcgaaatggatcccggattcgtgagtagaaaccgcaaaaacccttaaaaaagaaccttaggggctaggctatcaaatggtaccanattttattttggttgactttagaaaaattatgataataaaataatacgatttggggcagtacgaattgaattttttttaatgttgtaaacaaaggtccctaggaagtgccaaatatgttaaaaaagataacaaattgacncatggatattaagagctatcagttataaatctgtcgcgtatattcgtacaaaaattaatttcttcaaaaatggggaagggacaccgacaatggctattttcttttataaaaatgagttctgaaaccaacttcagagcagcgattcttcccattccctattctttggtggtttttaaaagaatttgtaaaccttgaaattcttttggatttggttggtcaaagagccgggcgtaaaacggccaacgattggagtggcaccgatgtgagcggcgaactgaaaaaagacgaaaaagttattatagaaagattattggcatcgattttggagaaaaagagggatccgtttcaactgtgctttcttttaccttggaaaaccaaactaaacttttccatgcaatgcatttgtaacgggtttaccgctccgtattaagggaccgaaataaataaaaaatcacaatcagcccgaccctgagagcatggaataagcaaaaaccttgagcacagcgcgttgggcgtacggctgagcagagacgaccacaacatcggacggattttcaatggccgcgatggcacgggcggcgaacaacagtttctcccacgttttgcgaatgttgatgatgtgaatgccttaacgcggggaagggggattgtttcttacatatttgtaagatttttgttttaggcatgattcgataggcatgataaaaaaggtttcaaaaatcacgataggcatgataaaaaaggtttcaaaaatcatgggtaaaaatgcaaaaatatccgaattttgaatataaaacatacggccggtattgcttttgcattatagttttaaggttaatgtgtgaaaagtgaaaagataaaccgtctgatcgacgcttccacaaataatgctccatttggaagtccatctttttggtgccgatgtgcgattcgcacaccaaaaatttcattgcgtcatcgtccgtcagtttgaagacgtcaagactgcttgacatgttgagacagaaaaataatacgtttattaatctttaaaaacggttattgttaggactaactcataaaattgggtgaatcggactcatagggggcagcaatttttgaggaaattggatatcagagaagacattatggggataagttatggaaagaggccaaaataaacagggaatttgggattacgaatgagaattgttaggtgtcatggcaaaggataggcggcaaatattacgactgccagactaaaacgtcccctcagactaaaccggccagactaaaccggccagacta

SEQ ID NO: 9464 - DNA, 1581 bp, Heterodera glycines
tgttttgcgttaaaaaatgatttgaaaaatgaaatatttggttttgttttttatttgttttattaattaatgcatttacatcaagcatttttaataaactagcggggatgcgccgaaggagctaactaaccccactagttatacttaaaacaatttacatacacggaaatctgacgtgtgctcttccccaaatttctatctcctaattgtataatagatttcttttgtgtcaatttattgaaatgttcgtcgtcaatagaggagggcaaattacttggaagtaatgcggataatataagcggatataggtttgattataacatctttcatttaagtcgcacagattgtaatcggcaattcgccggtcagcgccaatttagtgaacaccttatgcgttttcatcgtgaagcaacgaaacggtccccgcgacaccgacccgaaaaggcaggagaatgtttaggggtacaagtgatcgaggacgataatggaaatgtgatagacggtaattattttcattttaagcaaaaaacggtacttattggtaatttttgtgcagatttcaaaaaagtttatgtttttggatataacttttttctttggcatctaaatccaatattgttggtatcattcgagagcttaacatgtttcgaagctattactgtgctatcgcttcgcgatcagacaattaccaaaaaagttataaatgaaaattgcgaagaagtcgaaattagtcaaaattttgaagtttttccttaataaaatttttccaggctaaataattttttttattttttgtaaagctaatagagtatctgaagagctttcgaatgataccaacaatgttagctttggatgcaaataaaaaagttataaccaaaaaatgttttttaaatctgcacacagatacctaaccaacaagtacccaaaaaacatagttcgcatttatttcaggggaattgtttattatgactgctaatgttccaaaggttgctggccgagagccgtatatcttgtggggaaaattcgcaccgcaaaccgaggttattaatggttttgctgcacgaattaagattctgtatgtaattaaggacgggtactacaacgcatttctcgaagcaatgcagacgttccaaggtggtaccgacgaccaattctttgagaacaaccgagtgacgctgcgaattgaaccgggttagagaggcaaataattcaaatatttgcaattccctctcttgggctctttgaccccatattgattttccccattcatgcatgcccttcccttcgtccatcctctttcattctgttattttccttcttattgtgtgctcccaaatttgctccgtccctccgacaaatatttgtttatttattttccatttggtttaataaatttatttggtgttcgacttttcacaattaattgtttgagcaatcaaccggctcaacattggcgacgcccgttcttcaggacttcacttcgaacatttctcgtgttgaaattgttcgaattgtggaaattcaaaaatctcgtgttgatttttggatttcgcagaaatcttcaaaaaaccaatcactaat

SEQ ID NO: 9465 - DNA, 1125 bp, Heterodera glycines
gaccaatcggtccatcttgggaccaatcgtccatttgggaccaattgttcaatttgggcacaatcctaaaaatgaagcattttaaacatcaaaattaattgttttatcattctttatagactccaaataattaaaattataattatcaccgtcgatggatttggtgtcaattgtttatttggagttggtccaacctgagtatgattctaaaaaattaattgtaatcaaaattattaattcattttaaattaatattctgatcaaagttttatgtcgtttgactccaaataattaaaattataattatcaccgtcgattgatttgtgtcaattgttattttctctgggaatgatttgaaataattaatgtcttttaaatcgtttaaaatgttttttttattccaaaatttaaaatttgttttttaattttcaacacaaatgacttttaaagtttaatcataatgattttataaaatccgtttcgtttttattggaaattctaaaattttaccatcgatggatttggggtcaattgttttgtctgggaatgattctaaataaaaataagaattcattttttcaaattaaatgggaaaatcacctcaaatggatttggagtgaatcgtccaaccggagaatgattctaaaaattaatataatcagaattgttaattcatttaaaatttaaaattctgattcaaatattttatcaatcattttaaaacccgtttttaattatcaccgcaaatggcttttatatgctaattattgacctcaaataaaaatgatagaataattaatccaaaatagaaaattcatttttacaaattaaattaaattttggtgaattttccttttttctattttttaaatttattttaattgcctccgttttgtcatttttccatttccaccaatcgcaaatgatccttctgaacgtatttggccaatatttgccgttcatcgaccaaatcgcaaacgccgccattcgtttggccgcgaattcgacacgaaatgccttagggaattccgtgacggaacaaattgtgccgtactgggaaaagagttggcggatgtgccattcttaaaaaatattaattcattttgcatatttaatcactccgtg

SEQ ID NO: 9466 - DNA, 3503 bp, Heterodera glycines
gatgaatgggattgatgaaattttgagttgctagacacactaaataaacttaatatggggaccggcaaattggacaccggaaaattggacaccaagcggaaaaatggacaccgccggaattttggacactaaaggaaaattggacactaagatttcctttttaaaaaaaatcaagaattaggtgaaaataaatttgagtagaatttgatcaatgtgccacaaaatgcaccaaaaatgggtgacgattgatcaatgggccaaaaaatccaccagaaatgagtaataaaacttatttctttatgaatgatatgattttttcttctcctgaagttacaaaaataataacaaattaatttccatattatttacgcttataaacaacatatggcagattaagataaagatcttttaggccaaaccaaaatttttgtttagtaatttattttgtttattttcatttttatttacaacagtgtccaattttctggtgtccatttttccattggtgtccaattttgtggtgtccaatttaccgggagccaataattattgcggggaattatatggataaataaattttatggagttttaaaaaactgaatttcttattcacttcgtaatttcagaatgacttgaaattttgcaggaaatgcccttggtatttatattggtattttcgtgcatattaacgccccctttttttgcattttcaaaaaatcctctgttagaatggccctttctcttttgttccctaaagaatagaaaattaaaaaaatattatataaattttagggccttttctcaagaatatacataaaaatttgacttacagtcaggtgcaaaatattgcagcaaatttttgtaatcctatgcctatataacaatatataaaataaaacctacgcatttttttagggattactaaatttgttgtgaacacatttttgctgcaatactttggcactgactgtattcaaaatgccagaatttttttctatctttgtgtaaaatttgaactaattaaaagcaagaaaaaagatacataaaaaagaaaaccatgccatttaattacaaaaaagttaagggatttttaatttttatacacaataaaaaatatgaaaaaaccaaagaaaaaagaaatttaaatgaattcaaaataaataggtaatttgtgtggatgttcgttcttcttcagccaaaatgaaaacactgtgaaaggacgggtgaataatttatcagatcacaacatcatcatcaccagcaaaaaaaggaggagaaaaagagcaaaatatttacatttaccactcacattcttaaacaaatttatttagccttcagccaaaaattgatttggaaaacaaatgttttttttattgtttaaatttaataaatgaatgtttgggattaggcaattaggggggatcattgaagcaatttttgccaaaataataattcatttatttatttatttcaatacgctttcattgagaacgaaaacataaattttaaatgtcctcaaagcgcagaaacaattaaaaaggagagcaccaccgaaatacataaaatattattatgtgaggtcaataaaagtagtcaaaactcgttttagggctgatccgtcccctttccgggctaactcattttagcaccaccaaattataaaagtgacaatgcttattttcaaaataaaagtctcaattcggtaggtactgtattttaaataataataataaaaaaatattttccaaatttgccactttttctgccatttatttttattttaatgttattaattttgataacgatgcgggaaataaatgtacaattttattgtttgttgtgtcccaattgtgttgcatttgctgtctttttcactctcttctgctgttaagcgatgcttcgcatttgctccgcttttcccaaataatgcgccttcagaagagaagcgaactgaaaagggcggtggtcataattatgctattagcgtaatgttaattagtagggcttccttttttaggcaaatgcctaaaattttgcacatttgattcgcaaagataagcacaaaaaacgcgttttccgcttggtttggggtgtctacgatgacttttataatgcctatttttgcctatttccgggtttttgaaaaaatctttaataaaaatgcaataacaacgaaaaatacacccctaaaaaataacccgaaaaattttcagaaaatacaccccctaagaattgaaaaaattttcaaaaaatgacccaaaatttaatattttttcttcataaaaatttttggtttaaaatttgttcttattcaaagaaactttcaattatttaacaatttcatctaaaattgaatatttaagtttttacgtgttttaccatctaaaaagcgttaataaaaatgtttatttgcctattttagtgcctattcgaggatttttgtgcctatttcgcgattttttgtgcctaaaaaggaagccctattaattagtaatgaaaaattaactaaactccttttacatcattattgttatttctggtacttatttccatttttgtgaccgttcccccccgaaataaattcgattgtgttcagcattttaagagcgccatcccggcccggaattttctgggcacaaatctccacaattttgatcaatcggtttcacaaaagttgctttcgtttattttcagatattttctatttttgaaatcaaatttcgcattagtcctttataggttttttttcataatttgtaaaatttgaagttttttttactaaaattaattattttttgaaaagggaagtatttttgatcaaatttatttctttttgttaaatttaaacatatttgcctcgtccacttcagcttctttggtggcaaatgtggtgaccaaacggaacagtccctcctccgtgtacagcttcaactcgcgtcgctctccgtccgggacattccactgatttacaaaaaataattaaataaaaattgaatctcttcggattttggggtcgcaaattcaaatttaaaaattaacaaaaaaacgcgccgccgctgccaacaaaatctgttctcatacgcataaattagcagcagatgataattcaaaatatttctttgtgcataaaattaaaaaggaaaaacattttcacccccagggaaaaaatgtgagcataaattagccgtaatggtggggatcgatcaaagatgtgtgccgtcgacaccctcaaaaaactttggcaatacggaatcggaatccgacatatccctgctggggatggtctcaaattcagccaaaatgctggcaaaaaattgtatggtttttttttttcaaaaaatcctaaaattttggcacatttagggaatataaaacagctgacagtgccaaaactgctctcggaaaattggacacttagaaagaaaagagttatagattaattatgcctcaggttatgttttaaaatattgaatattttttagaaacttatgggaacgcgggaa

SEQ ID NO: 9467 - DNA, 3364 bp, Heterodera glycines
gtgattggccgaaacttcacttgcttgtgtgccggttgattgtaaagttcgccaaatcggtcacaggagttacgccagacattgatgacctcgttcaaatgctggtctcgtgcgatttgtcgtccgttgtctgcaactttttgttggtagaacatttgcgccacttcttccactgttgtgtctgactgaatgtagccttcgtgtgccgcccaaatctcttcggctggcaagttcatgttgcgtgttaaccagttaaagagcaatgcctcgaagaaattgttggcacggaagttttggaattcttccatttgaaatcggttgcccgctgtggaaccgtaagtcgctgttttggcgcaagttgtgtgcgtgttgtcgcatggctcgaacaggttgaattggctgtgtgtgttcggtttggagtcggccatgcggtattcttcgagttttggcgattgtggtcgttgtggttttgttgggtgcttcgtttgttccgtatttgttgccggtgccgttgtgtcgttgattgttatgatctccagctgttcttcggttggtactgcttggagaaagatcacatcttctggcaccatgtgtgagtagtatctgccttccacgaagcggaactcggcaaatggtcgttttcctccatacattcgcgagacgctgagttgtaggcgatcggatttgtgatgaatcatccatcgcccttgatcttccagttcatggagctctcggagaacacgtcctctttgccatgctgacgtccaattctccggtccgtaaatacgttgaacgtagctgagcagcgtttcgttttcctctggccattcgtctcttgaccgttgccgtttttcttgcatgtcgattgtcttttttctgccgatgcgatgtcgttccagctctttgtcctctttgtcctttgttgattgctgctttgatttcgttggttgatccgtttcttccggttgtttctctgttggatccggctgatccatcagatcgtagtcaaattgtcgtgccaattcttgccaagccttactgcgtgtttgttgattgatggcacgctgttcgtcattttgttgtctttcgatttgttggcgtttggtttctcgttgttgctcttctgttgttgaatgtggcacttcttgaatttctttttgctgccgctttttcggttgaagatgtcgatttgcttcttgttgacttttcctcaccattcgttgttcgtgctcgatctgttcatgacgtggtgccttctgcacttctcggctttcctcgatggcctttgtggtggccttgctgcttccttgttggtccgagatggcttgaaataacttgcgtaagcctgagtcttgtaattgcttgcggcgtttgtgttgtccttgcaatggactttgctgctggccgatgggtcgtaacagtgctgagcgtcgtttcggaattttgaacttcttctttggtcgtggttgttgactttcgtcgtcgctgccggcaagagaaactgaatcgtccatgactgatgcgatgaagctgtgcactgcttgaattggttgctctggaatatcaacgattggtggcttttccacttctttgaattcatctccgggtcggtagatgacgttggattctggccatttgtctgcttttgaaagccaaatcgggccaaagcgccaaagcagtgctgttcgaaggcattggggatctgcgcctctggatgccatatccgccgggtttgagtcggttctgacgtgtctgacttgaaaattcgcttctcggattttttgtaatcgatttgccacaaatcgatcttggcgcttgttttctcgaagtcgttcgactgagcattgactgtctgtccacatgatgacttgatgatcggcgaatttgatttgggcttggatgaatttgactgctttgactccgagagtcagtgcttgaagttccagctttgggattgtaccgtcgtgtgctgccactttgattggtttgacaaggcttttcgcgtagatgaggttacattcatccttcatgatcgtcgtttttgctttttggtacacggcaattctcatgccgtatttgctggcgtcgcagaagcagtggaattccactgagtcgatgtctttgatgtgccgtggaaattcgattgtgattgcttcgcctctgtcgagccactgtgccatcaatttgagccagtccttgttgatgtttgctggcaattcgtcgtcccattttgggttcaagttttgcacttcttgaagaatgagcttggctggcagtagtacgggtgacatgagtccgagcgggtcatagactttggcaatttgcgacagaattgtccgttttgtgatttttccttcgaagattggcaatttgaagatgagccgattgtgttttggtttccatcgaatgccgagtactttgttgtcttcgaggtcctttgccaagtcgtctggttgcagcttttttagctcttcgatgttgcttccgtagaattctcggagtttcatgcccgctgcttcgaagattgtcttggcttgcgtcaccaaatcttgaagcttttccgttggcttggcgtcgaacatgatgttgtcgacgtacagattctcttcgatccgccttgctaggtcggagtcgaatagcgcgaggtgttctcgtaatgtggcattgagcaggaatggtgacaccgtcaaaccgaaactgacacggcagaatcggtagatgcgcaattcggagtggctgattggattgagctctgctgtctcgggattgttgagccaaatgaatctgcaggcatctctgtccgcgtgtcgaatgccaagttgcagaaatgccttttcgatgtcggcgaggatcacatgttccatgcgtctgaagcgcaggaggatgccggtgagatccttcagcagttgtggtcctgtgtacaagcagtcgtaaaggatggtgctgatggacaattctttggctttgctgacgcatccatgacgattcggattttggttgttgctttatccgctctgatgactgctctgtgtagcagaaaatgcacaggccatgcacttgatggagactcgggtggaccgatgtattcgatgactgagttttgaacttgtcgtccaaaattgcctgatatttgtcaatcaggttgaggctgcgcagtcttttgatcaatgagacgagcctggctttggcttgatggatgttgcttggaagagcatcaactcggtcgttccagggcaaggcgacttggtatcggttgtttacgaacgtgaggttctttttgaagtggatcaacacatgatcctgatcgatcggcgttcatgtgtcgtccaaacgaatcagatttaatccgaagaagttgttgagt

SEQ ID NO: 9468 - DNA, 2345 bp, Heterodera glycines
  misc_feature (2204)..(2204): n is a, c, g, or t
gaaaacggcggttcgaaaacggcggtccgaaaatggcggtacgaaaatggcggtccgaaaacggcggtacgaaaacggcggtacgaaaatggcggtacgaaaacggcggtacgaaaacggcggtacgaaaacggcggtacgaaaatggcggtacgaaaacggcggtacgaaaatggcggtacgaaagtggcggtacgaaaatggcggtacgaaaacggcggtacgaaaacggcggtacgaaaatggtggtacgaaaatggcggtccgaaaacggcggtacgaaaacggcggtacgaaaatggcggtacgaaaacggcggtacgaaaacggcggtacgaaaacggcggtacgaaaatggcggtacgaaaacggcggtacgaaaatggcggtacgaaaacgtcctggcccgacattcgagaaattgttactttggcaaaatgttttttaaaattttattgcgaaatttctgcctggagatatgaaatttcaaatttgcggatccctttgcggggttgaaattgaaactcaaaattttacgggacaggatcgaagcgtgccaactgtatctgagacaacttttagaagctattgcttttgttaaaacaattctgacttttctacagttttcaagcttttactttttcgaatgttttcatttttatttgatttaccaacgagaaaaaattaaggcttcttaaatttgtctcagacgctttgaccccctaccgttagtgattaatcccgcaatttccaagaaatgccggatactgggaccctgcaaaattccgcgccggtttctaataattacattttttgaaaattgcatatgaaattggtacttatgcagaggtcgcatttttacttatttgtagagctcggcctggacctggatttttcctggatccaggtccaggtcatttttcggcaacctggatttttcctggacctggattttcctggatttttgtccaggaaatcccggtccaggtccaatgtgaaaaaaaatccaggtccaggcaaaacacgaaaaacctggattttcctggacaaaattttagaatttattatttcaagtgaccgatgttttttttaattttcaaaaaaagattaaattaatttaaaaatacattattattattaagtagatatttttagatgtttctaagcaattaattaatttttcaaacctttttttgatttttaagatgagtttcaaaaaatccaggtccatgcctggatccaggtctcgaagagcctggatttttcctggacctggattttcctggatttttgtccaggatccaggtccaacatggaatccaggtccaggcttttttcaaaataccgatctctaataaataccacctaaaaacaaaacaagcgttacatctcaagcaattttaaaaacctttaaaaattttataaatctcaattattgaaattttctgtgccttttgaagtcttacaaaattttttattttatttgctattgaatctgcaaggaaatataattttatttaataattgtaaattataaactctcatgacaatttatttttttcaaaaattatgaaattttactggatcagcaggtagccggactggaactcttttttaaagttggacacggatttgggcttttctgtatacggtaatacctggaccctgtttttgcccaagtacccggacccttgtaaccctaaaaaataagcttttggcatttcataatggtagtcaaaattgcttgaaatttcttaaatgtttttttttaaatgagtaacacatcttattcatgtatatattttaatttaaaaaagaaccttaaatatttctctataaacaaacttaaatttcaggtcttcaagcggagcattttccaacgaaattgccattgcaaagtgacaaaactggccaaaccaatccatgatattgacaatggcataacgaaaattagcatcgagaaaaccaacgcgatggcatcggctagtcaacaacacccatatgttgtgcgatattattcgagctagtcattaaggaatttttgtataattaaaaaatgaaatgtattgtgcaaaagtaaatttgaatttgcaaatatcaaaaaaaaactaattaatgaagagtaattcaggccaggttttagcccagacgggatcatgccgagattagcctttggctttgatgcagcttagagcatacatatntattgacccatatttatattttataattgctgaatttttgcgataaaatttgaatttatagaacgaatgaaagagaaaaaatcagaggtggtgagatggccaaaaacaaaaataaataatcgaaagtacaagcagatagac

SEQ ID NO: 9469 - DNA, 1127 bp, Heterodera glycines
atgaaattaataattgtttcgccgttttttagccgtttgaatttcggcacttttcacaatgattgcggcattttgttcgacaaggacggcgggctgtcgaattgtaaaaggcattgtttgctcctccgatttttcctcccattcgctgtgctgtccgccgctgatccgttcgccctttgacaatccgttgcgccgttttgaaccgctgccattcaacaaaagcgaccacggcacagccgacaatgttgatgtattgtcagccgagcaaagtggcacggtgtgttgttgttgtatgtttatattctttgacgccagggaatggccacaaaaccaaccccttgggttcgggtaatcctgtagtttgccccacctcctttttggaaaaaaaaattttcaaaattttttttccataaacaagttttctggggtattcgaggtcgctgatcacggacaaactacagtattaccgggttccgtacatacagtggcgagagggacgagttcgaacaactttttgccccgggaacaaagaaatgtattttaaaaattgcttgtatgaaaaaaggcatttttcaacagattttttgcccaaaaagtcccgacattgcgttcattaaatcaaatgtttgggaaaaggcccacattcagctttcttcgagtatatttgtgaagaattttttttacctttagttactagcccataatttaaaatctacaaaaaaaatctctagactttagctttcgattgataccaaaaatgtgggcattgacgaagtgagaacaaagttatggcataggaaactgaggatagtcattgaatggatgcctaaactgaatttgcgtcaaaattctttttaatggaaaagatgtgccttatagaaactctggcggcactctgtggatatcggattttctcaaataaaactgcaaaatgtttcagtcggcccagggcatcggtctgaaggagttcagggagacgaccacagtgcaggcactgcgcgccaccgcgtacatgccgttggtcagcgggcggcggaatgcggcggtgaccatcgcatacgcaagcacagcaacggtttttttggcatatttaatacgagcacccgggtcacccccccccccccccc

SEQ ID NO: 9470 - DNA, 1220 bp, Heterodera glycines
acgtcacttttcgtcactagaaatcattattttggcgcctttgaaactaaaatagttaaaaatcactattttggcgttctgtcactatttcgacattttttgggaaaatttctcaacaaaaatgcaataaaaacggaaaatacatccctaagaatcgaccccaaaattttcaaaaaaatacacccctaagaaacggtcgaaaatttttgaaaattcagacctaataaatgaaaaattttctcaaaaattcttcccccaaattttttttttgatgacaaaattttttatttaaaaaatgtcaatatttgttaagagaattttataaaggaaatgtagctcatttgtaactgcaatcagtgaataaaaaattttttgctcaatttttggctgaaaattatgtcactcactattcgtcactattttggactttttgtcactatttcttcactattttgggatttttactcactattttagttaactatttcggtatttttcgtcactaaaagttgctgccctagttataacatttacagagagttgctttttgaggggagtaactcggccccccatcccccaatcaagaaaattttttataagaaaattgcaagaaaaaaatttacgtcttcggtaatactgccgatggttccccccccccctttttggaaaatttttttttttggttttaaggtcgtgaaaacatgtttaggggggttttcaggattgctgatcacgaatatgacattctttttgatcaatttcgaatcccggacccggatttttttaagcatggaaattttaaaagcattaatatttgtgctttatttacacttctgcaaaaaacgggtgcaaaaaaattttcaaacctagaaaattttcatagtaaaaattcttagttaatttttttttaattcagctattttttggaaaacttttgaaaaaactaagtagttcaaatgcttttaaaatttacatgcttaaaaaaataagtaaaatgagtgcatttataggcacctaaaaatgtatttggaattgctccgttaaaaacttaattcggtactcttctaatttataggctacttttaacatacatttttcaactgcccataaatatgttttagaaattaatgaaaataagtgttaaggggttttcgatgtcgctgatcacgaatacagcatctattttaccaatttcgaacccctgacccgaacttgaacaa

SEQ ID NO: 9471 - DNA, 1065 bp, Heterodera glycines
tttagcattattttattgcttaaaatttgttacaccattataatccaaggaaaaaaaaaagattatccgtcagtgacatttattataatttattcatcaagcaatcattcggttatccttatcttagcgctctctctctttctcaatttgtcttcacagcattcaaacactcgagcgggatcaggtcgtaatgttcacctccacccaaacgcactacacatggaaggtttgggtgccgtaggcggagtccgtgtttaacgtaataatagattcgcacctttaatttttctatttatacagccaccaaatgcatgagcaaacaatccgtaattcccaaataaccacgcattgcaaaagcatcagttgctgaaagagtcgacaaatcactacattgtacgtcaaagttgcggatggccggtctgagatagtttgtacgcaggcgtacacagaaacgcatatattgtagtatctggcggcgtgtgttcaaattgtgcaagaacactccaagtcccttgtttgcgcttatgtctaaaacatatttatagcatttgaaaatgtatgataaaagcagcctgaaaactagaagagtacccttaattctaggttattcaatttttaaaatttctttgaaccaaattctttttaaccgatttttccaatttcatattttaaactcaaaaacctcatcgcgcatcggcccaatcccgcgttcctgctggattcgtcggatgcaattatcaaatttatcacggcgttcagcgaatgcaacggccccatgttcaagcatgtaattggtgtatctcattgttgtgtttggacgatctaaacggtataaaggcactagggcatgaaaaaaagtacaaaaaaatttttttttttttttactaggttttacattctaaagttttgagaaaggttcgatttaaatttttaaaaatttatggtaaggctgagctgatagcaccaattcaattttttccaaatagttttttaggagttttcatggtcggagaacccaatctataagaaggtattgcggcacctgaatccggattataacaaaaa

SEQ ID NO: 9472 - DNA, 1326 bp, Heterodera glycines
atttggaccgtcaaacagcagcagccgaggtttaaattacaaattaaatcagaaataacttttatttgtttaggtgcttgggcatatcacaccgcgcagcatgctcaaagttttaaatcggccaattgtgtgtctgatttgttgtcaaaaatttttcctgattcaaaaattgcggcaaattacggatccaaaagagacaaatccgcagcaattattacaagttttcataaaattaaaggataaataaatcgagaataatttaggagtacttgctccgcattctgtctccattacgttgcaggaaatgactgggcttccgttttcaccttcgattgactcatcaaatcataaaaccaccaaactttttcctttggtggttcgttacttcaatccaaaaaaaggaatttccgtcaaattgatcgacttagaggaattgggtggagagacttcggccgaagtttgaatcatactttattttttggcgaatcagctcatttgcgtgactcattccgggtttttaacgggaaattttcaaaattttccccatttttcagaattttctgaaatcaacacttaactatgtcgataaatggttccgtgttgaacgttttccaacgaatctaaaatggatttctctcaaggaaatgaaagtcactagcgccgaagtgatgagtttggctgaacagattgctccggaagtgaacgacaatgagctttttgacgaaattacgacgctgaatgaaatacttgaaagtatttctgacgagaaatttggtgaaatgaacgcagaacagaagtggatgaaggttttcgaggcggaattacccaatcttgtgttgctcgtcagcaaaattctttcaattcccgtgtccaatgcatgcgtggagcgcgtcttctctttgttcagctcagtggactgatgtgcgcaatttattgaaagttgaaaccgtgaaaagtctggcccaaatcaaatcgaattatgatctcacttgcactgaaatgtacgatttgctcatttcctcaccaaaattgttaaaaatgatcatgggaggtgaaatatataatatttgatacatttttgattgaataaattgtaaaaatatctgatttgaagcaatttgcaaaatgttctgattttcgaccccaaaatctgattttttggacccgatgttctgattttgaaaatttttcgatcgcatccctgttttaaacatacatgaaatcattttttggccttgaatacttaatattgcgctaaaaataacgcacactcgactacggcggccagcagtaggtggggcgccgctcgctcgctccgggttgctc

SEQ ID NO: 9473 - DNA, 4103 bp, Heterodera glycines
tttgtcaaagtttcacatattcttacattagagacgcctccttgtatttctgtatgttttgttggagattcatgtgtctttagacattggacggtttcagtcccgggtctgtaactcttcagggagtggttgccgccaaaattttttttcatattctttcatagagaccgagaggagtcgattgatattatatttacattttcaatcccgtcagtatcttcacttttaccaaaaatatataaattcgcaccctactcatttccaatgtttttgagtaatttttattttgaaagctttgatcaaaaataggtacatatgtacctatgtgtcccggaaaacatttttttgtcccgttaacctcgtttaattacctgttttagacaaatttgtttgttttgttgaatttccaaatgctgcttattttaaagaattgttttggtcggcttcatgttatttgtcatcaacttacgcgcagaaattttcgtcttcttttgcatcgacgaaaggaattttccgtattccattaaacttcctgtccacaaaacgaatgaataaatgttttagaaaccgattttcttcagcgtcggtcagccaaagtcttctttcactggtggaaatgcatcgggcggtagcggcggaatgcctcctaaccctttgtcggttcgtctcggcaccttttctaatactttcttttagtcagggcatgtcaaactggcagaaaatggctgttgcagctgctgtgattgtcggactgcaatacttcatcaatcgggtaacatcttttgtaggtgatggcaaagttggtgcttgagagaggcagcgatttgagaaacgattgggggagggtaagtttttgtaaacaaaaaaagtccaattccgagagtgatgagacaaattttcaatgttgttgacccattttcctttttttctcaacttttgattatcatttattccaactaaaattcacttagcgtttcttgcgctgtttttcataagaccacagtgttgccattgccttttttgttgatttgctattactccttctgtttagctcgcttacacagaaatatcatggaaacagttctacacggactttttggaaaagaacaatgtgtgctaatgatttggcgttacacttaacggattccccgaaccattcgtttaggttgaacgcctcgaagttattgacaataaatgggtccgtgtcattaccagggagccaacgcaggtgacgaagcgaaacaaataaacggttgtatttttcatttgagaatttagaccgttttttacttcaacatcggaagcgtagacacttttgagcgcagtttaacccaggcacagcaacatttgggcatggagacgagtcagcagcaggtgccggtgttgtacaaaagcgaaacggacatgtgaggaggctggcaggccattgccaaataaaaaatgaattcttttttttcagagtcggaatgattccccatatggttaactttcttatcacgggcatcttcctgttttacatgttcagaatgtttcgagggttcggaggtgatctttcgaattattcacatcatactttctcaaaaacccaggaaaaaagcccggccaacgtggcggcggcggaggttttccggggatgggcaatctcttcggtgttgggcagtcgactgcacgggtcatcaacagagaggacgtgaaaacggcgtttgcggatgtggcggggtgtgaagaggcgaaaatcgaaatcatggaatttgtcaactttctgaagaaccccgcacaatacaaagcactgggcgcaaaaattcccaaggtcattttgttgattcattcgaattttcatcttaattagccatccttatcttctttttttgcagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacggtcggagcggggatttgtactacgggcatagaaaaatcaccccttggcaaaacacaaattttcgcgagggggggacaaactgcaccctcttcgcattgggaggggtggactaattgtaagagagtttggagtgggggaatcgttaccaagtctatcctccgcgagggtgcaccccaaaatttcgccggccgaaatttcgccaaaaatattttttaatttggaaattttcaagaaaattcttagaaatttttatatggaaattccaaggaaaaattttggaaaaaaaaattttattggaaaaaaaaattttagcttatttcttgaaaaattgacccaaaattggtcttttttttgcccgctggctattcatccatccctttattggactgaatgccaaagttaagggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggttgcgttagtcacatgtcaatttattactgtttcttttcaggcgcagacattgccaatgtttgcaatgaatcggcactaattgcggcccgaggttccttttttatggatgcgatttcaatctcgctcctctcctggagcattcccccgtagtcttcgaaatttttaaaaacaaacatttttcgtttttaatgttatttttttctatgaaaaatgtaaaaaaacttttagtttaggaaaacccctctaattgtaagaaaattagaaaatttgccgttgttttagatgcacacgatgaggtgacttccaaggactttgagaatgccatcgagcgggtcatcgccgggatggagaagaaaagtcaggtcctgcagccggacgagaagaaaacggtggcgtaccacgaggcgggccatgccgtggccgggtggtttttggagtttgccgacccattgttaaaggcaactacttattttccaaaactgatatcaattatttattttcccattgttttgggtgtcaatcattccgcgtggaaagggcctcggctacgcgcaatatatgcccaaggatcaatacctttactcgaaggagcagctgctggacagaatgtgcatgactttgggtgtgtaacctgtgaattttgtgtcacttaatagcgcttaaatttctaattttaggtggcagagtgtcagaggaaattttcttcgggcgaattaccactggcgcccaagacgatttacggaagatcacacagatcgcctactctcaggtgggcatttgcattagtaatcagttttaaatttcaccaataattaaaatcattgttgtttttgtcttacgttggtttcaggtggtcaaattcggaatgagcgagaaagtcggtccggtgtccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggttcgtgaaacaatcagaaataattaggagagaccataagcatttacaaaaacggagaaaaatttgaccttcgtataaaaaatcgggcccgagacacccccccccccctgtcccaatcgtccgttgtatggcccttgggctgagtcaccccttggcatgtatgattcatttttcttatttgtaggtcgctcttcgactgttggagaaggaaatcttggcaagggaggacatgatcgagttagccacacgttt

SEQ ID NO: 9474 - DNA, 1381 bp, Heterodera glycines
cttcccaggcaatgaatgccatcagcggattggacctgccatatacgcgcatggaaatgtttgctgctgccactaaaccacttatcggaacccagggaattgtcgaaaatttgagcgcattggctgactttgatttgagcaaggtttggaaaatcacgatagcatttaatctttctttaattttagctgcagtttccatctgaagcgaattcaaatgacccgaaccaaggggcgaacatcttttcccgacagtacattgaggaatggtttcgttacagcgccagaaatgtgctcaaattaaattacgaccagtcaagcgcggataacaaagcaacggctgcgaattattcatctattgaaacgcaacaacagcaactttattcgacaacagcgtccgtaggaacaaacgagcaggaggtcacaaaattggaactgtttggttggtaaataaatggatattttcttcagatccagttcagcgaagctgccgctcttggagttatccaattaaactgtcttaatgctcgtaacattcagcagaaagtggcagagtttgtggaaacattggaatcccatcccaatttgtaattgttttatttttttcaaatgaatacgatcaatttcagtcgtgaccttcggacttgcattgaccgcctcctttcattgagcgctgatgatgagaattttacgaatcctgaggacactgtttcggttgtcagtgtcagcgaaacttccgtcagaggtgcatttgagggaccagtttatcccccctccctccaaagaatttaagcatttttatttattactacattttgggaaggggcagttcaccctctccatacaaaaaataggggggggggtcggggtggatttaatataattctgtatatatgatctgagcacgtaacaacatgttcctgttcagcaataaacttaaactaattgtacgttaagactataaaagacaatcaaaacaaaaaccgggtaaaattgcgagacatgtgattttttggcatctgaaatgatgggaaggaatttaaatgaaactatatttattgcttcacgacgtatctattcgaatggttaatgaacttttttttgtgggaaaaacccaaaattttgaatacatgcgacttgatatttattcacgtcttccaccccctcactttcttagctctctttcaccatacgttaagacttaaatgatgaatttgaagattttttgcagcccatcaaccccacccaaccccgatgaatattagagtattctgatcccgaattctcacctctctacaaaatgtatgattttacgaggatgatgattattagtatggaacatatgtacggagcaacagtttctctgatggtatttgtaggcatg

SEQ ID NO: 9475 - DNA, 3450 bp, Heterodera glycines
  misc_feature (3388)..(3388): n is a, c, g, or t
ctgaaaacatgaattgcatgaaaaaatggacgcgatgaagaaggaattggcacaagttcaacgccagttaagcgatgagcaagccaaatataaaagggacacccaatcgctggccgattcgaaaaagcatttgaacatagaacttaatggaagatatgccgaagtgcaaaagttaaccacccaactggaggagaagtcacaatcgctgaaaaagagcgagcagcaattggcaaacgtaagagagaacaattagcaaataaattaaaggattaaaaattcaatacaatccaaatcatttttcattatgtgaaaagtaatgaatatccgtttcaacaaacaggaacgaaagaacagttcgcagaccatctccaatttgcaagaacgtgtgaagcgggctgaggtgaatttattggagcacaaattggacgacggacttcgcgtgttggagcgggccaaggacgactgttcccaacagatcaaactactcgaagagcagaagcagaaaaggcaattgcattactagccaaaaatggacaatgaaaagatttttaggaaggcatcagcggaccaagaaataatcaaaaagaatatcggagaatgggagagcaaacgggaggaagtcacgtcattgattgcccaagcgaagaatgacttctctggccatattcaatcgataaagaatgggaaacagctctcacaattgccaaaaatccaagtgccaaaaccgccgcccggaccaaaaatcatgccattggcacccattcaaccccactcgtcgtctacttcactggttaacaaaataaatgcagtaattgcttttctttataattgtataaatttcacgaaattcagcttcaaaacaatggcgggggagcaccgcaacaaatgccaccctcaccgcttccattggaccgtaaagtcattactccgcctgggcggtctcacattggtgcttccgctccacaacagcagggccttgccggcgcgggacttggccaggtgcgaattgcctccctaaactccccattggtgagcaaatgaacttaccattttcttgcttgggaaggggtggttattgttttactgaatactttctttttttaagaatccgaacatgaccaacgccgcttccgccggtcgccagtccatttcgtcttcggccaacgttactccggtcaaattccacagtcaaccgactgcgattgctgcactttcgcaaccgccgcctcaggcacaccctcctggacattttactacaattgcgccgattggtgtccgtccgcaaaattaccaaaatggcatcaccgttccgtccgcatcatcttcctcgacaacgattcaacatcagaaaatgagtggagcacaacgtcattctcctcagctgagtggagcctcaatgattggcggggctcaattccatgccaacgcccctccgcctccaatacaacaattccatgtggttggaaattcattgtcttcggttgggcagcctaatgccaccttgcaacaaaaacagcagcaggcaaacgctggtggtggtggctcatttcaaacatggggcggtggatggggtgatcagctcaacaacatcagcgagttgttcggtcaggggaggtcgtttggtccgttgggcagtgaatttggcggcagtggtgggggtgtcgtcgatggaatgcgctcggccagtgtcatccatccgccagctgccggcgtgatcggtgcgccctcttcgacggtttcgaccgggaacaatgtcagcagcaacaatcccccgtcttcgcaaccgatcggtgctggccgcaatttgcagaatatgtcaccttcacagcagcgcaacggatggccatcttttggatagacatatttcctctttttctctcttccaaatctccctgctgaaatcgtcattattattgttcttgtctttatttaaatatacatacatattcagtcacatttgtactgctgattgcacaaccaaccgtatatgctaatgacaaacaatcgcaaattttcgttggattttgtttacagatttggatttgttgctttccccctcccccctcccttcggattgttcgttggcccatgagaacaatgattattattatgatgatgatgacaaattaccgacgatgataaaggataaatgcttgtctttaaaatttatttgcttttttgtatactcaaaaaatgatgaatttgggtggtttcccttgagggatatgtgggaaaagaaggggagaggggaaagacggagaaatacattcggtgatgaaacgtcagaatacaacaaaaaaaaagaggaaaaaaggaaaagaaatgtgtggttggagcctagcgatttcatttggataaaagagatcggcggaagaatagagggtaatactaccgatggtaggacccctttttgaaaaaaatattttaactttaaaagtcactgaaaatatttttctaaaggttttcggggtcgctgaactcgaatctgacattcatttgaccaatttcgaaacccggatccgaactcgaacaaaaagtcgaaaatctaaaattttcaaaattctcaatttcgttagatcctacatagaatgaattattttaattgttagaatagttttagactaaattttgcatgttttattcgtttaggaacaaaattgagaattttgaaaattttagattttcgattttttgttcgaattcgggtccgggattcgaaattggtcaaatgaatgtcagattcgtgttcagcgaccccgaaaacccttagaaaaatattttcagtgacttttaaaaagttaaatatttttttcaaaaaaggggtcctaccatcggtagtattaccaaaaaatcaaagacaaaaaacaaaccattgtggccacatcgccgccaattttcttggacaaatccaaaaaagttttgagcgggccatcaatttgttcatcatagcctttcacggagggaggcatcgtttgggatgctgcaacaataaaaaaaatttttagtttttataggcgcttctaaaaattgtcagttttttaaattttattaaaaaccaaaggtggaaggaaccttttggtttgcaatattattcattttttaagatgatgtctactcgttaaaattgtttccgagaattttccgggttgttgatcacgaatctgacaaacatttcatccaatcccgaatctctaactaaaatttaaaaaaaaatgaaattcgagaaattaaattttcgacttttttgttaagttcgggttagggattagatattgttcaaaattgctgtcaaatccattatcaatgacaccaaaaacccctgtaaacaaagttttcacgatttattatgacaaaaataatttgcaaaccaaaagggtccctttccccntgtttttaataaattcaaaaatgccactttttaattagtgccatttttattggtagctatct

SEQ ID NO: 9476 - DNA, 943 bp, Heterodera glycines
ctttcatcggtagtattaccgaatagaggaaagaggaaatgagaagggaatggcaaaatcattcggagggggaaggggtgaaaggcattggcgggtggcgtggaaatgattggcttttcccttccgtcggttcgcttcgtcctttgcctcatttggccaattaattggatccatgatgaaaagtgagcagagatggcgaagtgtcgctgtgaccatttttgcaggggaagggagcgcaccgtcgagaggaagcggacgaggccaaaggacgcgtcaaacgaatgtgaaatatccgtcggatttgcgccgtttccgaccaccgccgcgggcaatcggattggaaccatcaaaagggggttttctgaagagaggggaaaattgatggggttaagacagaaagagaggacaaaagaagaaaagcggagggagggaaagcgacagaaacggacggccgaaagttggcactgaacgcggcgcacatccaaagggatggcgttgctcatccatccccctccccactgctgaagaaggaaagaaagtgcacacagacagaaaggaaatggaaaagaaaaagaaatgagagagaaagggaggaaatgggaggacagcacaagtgggaacagaaggaagaggaaaggaggaggaagaagagggcactcacatcaggggaaatgaggaggaagggcagcgaacggagaggagagacggaggaggaggaggaggaagaggggagggggatgcacagcaccaagaaggcatcgtccggaagagcaaaagcatcgttcggaaggaatggcggttgggtggagtggacgcttctccttctgtctgtctgttcttttccatcgtccgactgtttctctccctctctttctctctcgctctctcccctcttctttctctttcgtccgctctctcagagatggtcgcgcgaggcggaaaa

SEQ ID NO: 9477 - DNA, 1396 bp, Heterodera glycines
  misc_feature (49)..(49): n is a, c, g, or t
agaaatatttgcatcatgacattgcccaggtaaagcattttgatgacancataaagaaaagtgacgtaagaactccaacgacggcccatgcaaaaattggacacgtcgtaaatctaaaaaaaagggaaggggaaagagataaaataatggtaggacaattgataagaaagcactgatcagctagctgacccatcatttaaggggatggcaaattggacatcccccccgccttccccctatccaacattggccactgatcgatcgatcactgtgtgatcacctccccccatcccattgatcgatcaatcaacaactgtatgatcacttcccccgccattggccgacctctcgctgcagttccaacgtgtcctccatgtgtcctgcaattgtcctgactgtggcatgccgtgcgtccacctgatttggccgatcactcatcccagtcaattcacctgcccacccctctcctcacatccatcatccgcgcatcgcatgccatttgagtgagattttggacgttgattcctgcaaaagtggccgagagttggcatttctgagttgtgaaatgcaatgcttgaccaaccgctgtgccaatggagaaggccgcgccacattatgcacggaatgtaaaacatcagagcctccaacgccaacacaaaaggcacccattggtaataagagatctgacgcgccctgtacctttaggtaaagcatttttgctacgattgatcagccaatggatcggtcggccccaaaggcgcatttaccgtctgtcgccgtagtccaacggaaaagcgttggtcaaaggcaaatagtaagtctaaatttgggactgattgatcagtggttggttggcccgggttactcacattctccacccaacaataattctccgtgtactgttcccaggcatcggtgaactgcgcgggcacccaacactgaatgggatatcctaaaggggggggggggagggaatgggccaaagtattggcaaaatgccaaagcgcaccgaccgacgtattgcttggcagagacaattatggcaaacgcgaaaataatggcggatgtgtaatggtaattcaatttatccacaaaatcatcgtctacccgaggatgaagccctttgaagatggcggctaaataatagaggagcataccaacagaaagaacctgaaaatgggggaaatgaaggaagaagaaaaaacgggtggatgaagaagaagaaaagggaaaaacgaaggaagaaaaaagggaagggaggaaaaaaggagaggaagagaagacagaagaagaatatggatagggaagaaaaaggaaaaacgaaggaagaaaaacgaaagtgagggatagaagaaaagggggggggagtgagggagaggaaaaaagaggaagaaaa

SEQ ID NO: 9478 - DNA, 6718 bp, Heterodera glycines
gtattatcgcccgagggcgagtggagtggttggttattattattatgattaatgttcgcaccctggcgagggtcatttagacgagtgggggcgaaaggatgcgcaaaagtggggtcaattggagaagcgaaaatggaagaatggcaccaaattgtgtaaaaacaataacaatatgtaacaacaacagaaacagaaacaataaaaatgaaatatttcccgcaaattgatgactaattgataataaaaatatttgagattttggaatatattttaattcacaaaaattgccgaaatggaatttgtttcaattttcaaaaattttcttttaaaatacatccaaattttcatatttatatagtggattaattttcaaattttgttcctaaacgaaaattctaatcatgccagaatttttaaatgaggaattcccgacttccaaaaatgccgaaatgcgataagcgcttatttattgaacagttgttttttatttatttaaaaataattaattgaattgcataatcaccttaaggcttgaaggtgtctccaaagttgcacaaacagttgacgcattgtgtgagagatgagacccaatttacaatagaagagatgtgcgtaaaccggatttggagaatttgaaattgggggaggagaaaatctgagagctatgggaaatccaccgcaaaattaatgggaaaattgcgataatccatccgttgatgaatcaatcatttattcatcgcaccttcaattttaaaatttcggaattaaattttccggaaattactgctaaaacaaaacgattaaaacggtaattagcaattttttcgaaaatcggggtaattgaataaagaagttaccgctttttacagttgccgaaaatcggtaatcggataaaaaatttaccggattttatagatatagaaaatcggttcactaaattaaccgacttaaagcatttccacggtttggaatgtcttgtgggttcgagtcccaccggacgagttatcttttatgttctaaattacattaattaccgaaaatccgtaatccgtaagcggtaaatttcgtgttgtgtttttagcagataaatttttaccgtgccgaacgctaaataatttaaatagtgtcaattaaaatccttagaaaatattttctgcaattattaaaacaaatttttgatttaacaaaatcaatttatgcgacccaatgaaaagaaaaagttatgagaacgaatctccttttcacactgttcaaggccgtttattatgggctgctgaaggtgtaaatttcacataaatttgagggtttgatgcatcgtaaaacaataaataaaaagaaaattgggaggcaattgtggagcgggaaagttcaaaagtccagtcaaataaaaaatgttcgtttttttgtgagaaaattttgatgaagatcccgagatttgaaataaaaaagtcgaaattgaagggaacaaaaaggaaaattcaaaattgtaaaatgtatggcccaaatttgaaaagtgccaatggataaaaatcatggactaataaaaaacttcgaaataaaccagaaaaatggccaaatatcaaatatggcccgagcctttggtttaaagatttctgttttacataaatgtattaaacaataaccaataaataaatatatttttacacataatacatattgtatttttagtgtgttaactttcatattggcaacatcatttattatatttattattaattttgaaattcaatttttttaaatcttaaatgtaaggctaaataactgttgtcaatttccttgtgctttcaatattttattttttttggtttgaaagcgccaagaacaaagaacattttgcataggaaaaaatgatgaaaatttagtttttttttcaattgtcctcctcggagagatcgacgaggtgaaaaagtgaaaaatgttggaccaaatcaatgcttcacagttcacacgcatgtttctgattttcgtcgtattcggccggagaaatctgactgaaaataaaggaaatttgactttttgctgtattattgaatgttttttgaattgctttccgatttctattttttttaatgtcgaaaaattatttattcggtatcgctttattagacaatgaatgataagtaataaaagtaggcaatttatataaatcgacttcatcgaaacgggtctgatcgggagaagaaaacttcagggaaaggggcttgccgaaaaaaaaactcagaattttcatcaaatttcaatcaagaacctaatatggcctttcaaaactgacacgtacaaatacatgagttcggaaatacaaaaaccgattttttatcatgatcatgaaatccggtccggattcaatctggaaaatccttttcctgataactttgatggcataatgccttcgccttttaagcctatccatttttccctaaaattgttgggctgctggccaagcttggccaacctgaaagcttctgttgtgcaactcaggcattgaatcggccactgcccggtcaaagtcgtcgctgctcgtctgttggtggtgctgctgttgttgttgttgttgctgtacatttggttgctgcttcatgtagttgggcatgcgctgcttggcatttgtcatcggcaattgattttgcataaacaccgggtgctcaaagtccattgacctgcaaataaaataaattgaaatttaatttaattttgtaagtaaaattggaaaaaaaaataatataaaattgtaatataattaatattatgtaaaatttagaagtaaaaacaaaaaagaaaaagaaaaattaaattgaaattgaaattaatttttttatattataaaaatttgggaaataaaataaaaattgaaaatgaattaaattaaatttttttttaataatgtaaacttttggtccttagaaaatgcgacagtgaatcaggacaataggatttaaattgaattacaaataattaatgaaggtaaattacaataatccaaatacagtatttttgttgtttttttaaataaaacaagaaaatttgggatagaaatgagtagggatggactgatgtttgtaggggtttttattcaatattttttgtggaaaaatgtatctcataaggattgaaaaacttaaaattttcaaaatttcatccctaaaaattttgcgattttatttgtccatacaaatatggcaattatgatgagaaatgaacataacataccaagagaaaacatttttttttaattttttcataaaaaataaaattacggatcgcgttgaattggcgtactggaagcagtgggcggaaacataaaattgggtgtcaaacgatggccggacaatgccgcgggggctgttgccattgataatgagagaggggtaggccctaatttgtaagggtcaattttgtgcaaattatgccaaagcgaggctacgaggcttaaatattcactaatggtacaaatttggcattaggccagggctcccagcagatgaaaattttcaaaaaatttcattagactgacaaaaaagccaaaaattttccaagtttgaaaatataatgaatgatggaccagcgggcctaaaaatgtcaaaactgaaaaattctaatacccaaatagtgattaattgaaatttcaaaaaatttttagaggcctccttaggcttggttaaaaattcagaaaaggaaggtcggtcctcaaaaaacctctatcaatacgatcggctgattgtgagctggaatggaatgatggtggaggctgaagttggtcaagcaatggcatccgatccattggcctaaaatgaaacaattttttcaattttggcgttttccggagcaataaaatgtgtaactcaaaaatttattaaaactcattgccatcttcgcaatttttttttttgttgccaaattaggacgaaaagttgttggtcaaaaagtgcaaaaaacaaatttgtgcaatttataacaaattattgaaataaattaaaaaatattaactgaaaagtgcgttcggcaaactatttcattctacggcaataataaactaaacaattgctacggaaaacggaaatttgaaaattgttccattttgaggtgacaaagaatgaaaaagagagaaaagataaacataatattgcacaccaaacatattacacaaataaataaagaaaatataataggtattatcattcggtgatcgggattcaacccatcaaaaaagggtcgagaattggcacttggaatcagggactttttggtaatcgccggcatgacaacaacataatatacaaacaaatgaaataaagaaaaatatcaggctacaataaaattaaaatataaaatgggaaaatataaaacaaaaaaaagttgcgtaaaaaaattatgaattataaatatatatttaatttaaataaacatatttgtttaaataaaaattatttaaaatacaaactcttaccttcccacattggtcatgttagtttttgacgatgtttgcaaggaatatcgttctctgtccaatgcgacgccttttcgtgtgaaggcaaaactgaagaatgttctcattttataaatttattttattggccatttgaacaacagttaattaggtaattaaattttaattctaaatttaaataaaataaattataattgtattgcatatccaattaattactaagtggccaccatggcgatcaaaaaggcaataaaatggaagaaacaagcggccatttgaagaaaaaaggccagtccaacacgttgctaaattcaaatttaatttgatattgtattatattagttaatacctcataagtgccaacaatgcccttgatgaaacgattgtcggcacgatgggagaagaagaagaacacgccttcggcaacagaagaaaggaaagctgcaagataaattattttattttattttaatattcatttttaaatttaaatattagaattataattatctcattttataagtaatttgaaattgactggagcgtaataatataagccaaaggatcgtgtcactttttttgccaaaatcggaagcatcattttatcattgacccgtgatcaatgcattattatgccgtcttgcgtcttgaaatcccggcaaagcagagatttcaatcccagtaatcctatccgtgccaattctaatcccgaatcccgactttttcattattccaggccctaattaaaataggggactgctttaaaaacatcactggtaagcagtgcagtggctgtgaacaccaacgacattgaagcgtaacaacagccacaagcaccaagacaaatggagcagaagctggtgatcagagcgagggccttgaaaaatttcaaatttttcgataaaattttccatttttcaccagcattatcagtgtggcgctgtgccatccgtagaagcggtgccggttcacttcaccaaccggcgaattgtcatcctccacgtcgaaagtgccggaataccttaaattggcatatcaattagtaccatgaaaagcgccgaaaaaattaataaattttcattttgtgtgaaatgaataattaattagtgccaatcaaaagcgccaaaaaaactaattaacctatttttaatttgaacataaaatgagaattatttagtgcagtcaaaaacgccgaaaaaattgattaatttacttgtcataatcaaatttgtagacacaatgcagaggctcggtcagtgttgcataactaaatgcattgacaaaatttaattcaaataaatttttaaattatcagaaaattttcggcatggatcactttgtcctcatatggcacaattattatgtgcatagcttaaattttccaatgccggaactcggcacttttctcagtcaagagtctcgagaccagtttttctagcgcatttaatcaaaattgacgaccgaccgtctgaggagaacgccgcctccgtcccggatgtgccgaatgcaatccaaccaaaggccatgctcatgcaccgagttgtactcttgcagattgacaacctgagaattatggggtaaaaatggaaatttttttgaaaaaagtgaccaaaatgaaaatttattgaattaaaaattgcgccaaacccaacctgccacgacggggttaaaatggcagcaattgataagcccatgccgatcaaagtgaacaccacggagcaaaaaatcactgttttcctgacaagctcaggcattgtttttgtggcaattattgttttattattatgcaaaattttctaaatgacacgacatttaacacattcataattttacaaaattaagtgtatgttgcgttcgagagtaaaaaaattgtcgagactcaagagcaagacatggaaaattattaaagacggagttaaagcggtcgaatgtcccctcttttcggggtcgccctaaaaaaggcatgggattcgggtcggttagggcaggcttaatgagatccgctaggacccattattgtgtcataaatgcaaaaaaaaagtcggagaaccgggactgcagcggtgaatccgggaattatttaacttcgggatcaaaaaggcagcgctgaactggcaccaaattttttcatatacataaattttataagacgcataaacagcggcgcaagtgttgtgggaagttgtgctgcgcgacgcgtacatcttttctatacacatagggtgctgcgcaacccgtacgtacgtgcgcgaa

SEQ ID NO: 9479 - DNA, 1966 bp, Heterodera glycines
  misc_feature (1874)..(1874): n is a, c, g, or t
aatagcaatcgattggtctgactagactccatatttgcaggaatagcaatgccaggtctatcttaaagtcctgacgagttatgtttcgacaaacatcctgtactccataaatcgattagcaaatttagccgacatatatatatttttcaaaaaaagattcatcttttttatggttagctcatatgtctctagctttatagaaacggtccccgaatgtgcgaggagctcctttttagagaatttctatagattattgtttgcagtcaatacctaagcgggggaaaggcaacggacgaaagaggacggccaagggagagcggaccggaaaaggacggaagatcgaaagggtgggacggaccaccggcggaggccgagaccaagctgcttcttgtccccccccccctattgtccccttcgtccttgggacagtccaagcgtgacttttgcgcatttatttcccttgagcgcttgtgactgagaaggcataaaatgagaagcggatagcactgcaggaagaggaagaaggaggaggagaagggggaactgttgctggacgaatggacaaatggcgaattatttatttatttgttaagtcaacgaaagggaaaaggttgacgacagatgaagaggaagagaagagaagatggaaaagtgaagaggaggaaaagaaaaggggagaatgaaggggaagagaagaagggaaagtgaagatgaagagaaaaggagcaagggaaaagatgaggaagagaaaagggaaaggggaagatacagaggaagaaaaataagaagaggagtggaaggaaggaaaggaagaaatagtaaaaaagagaatgatcagagaaaataaaaagaaagtaaataattataattacggaagaagcttggtagaggaaaagcttaataaaattctttttcatttcttctccttcccacttcgccctcccaaatttccttctttggtcccttctctctcatttagtgccaatttgtgccctaaaatgacggccaaagaatggacgaatgaatgcgtagtgaccaagcaaaggcacaagaaagcatggcaagatcatgctgggaattgaggacagggcactcgacagacgaaatggcaatttgaggggggcgggggcgggggggaggggacacccgaaacattaaataggcaatttgacgagagagaccattgggaacggagggaggggataatagaagaggaatggatgagcaaatgatgattttttggtattaaagactaattaatgggtccaaaaatgcgctcccgtttcctccgccctttctttgtccaaaaattgaaaatgacgggttactcttataatgattttaaacggattggccaacttagctaacatttgcatttcggtgatggtttacgattacataatggcggataaattgggcaaatggcccgcgggaatgacagacggagggggcgggggagcaatcagaaatccatggggaaatgaaagaattagccgagaaaggggagcacgaaagtcggatgaaacgcgaaagagaaaagaaactgaagacaaaatgggaacttagaagtttagaaaaaagttgcgatttgagggatgggggggatattagcagaagaggggagaaaattacatttgttttcttttacagtccttcaaactccggtttttgaagagagcggcaaattggtggagagagagagagagaagagagggaaaggggggggggggggaagacggggaatttgaggtgacaaatggacgaaaaaatggaccacgtatggatcacatttcaaatgggcgaaggtcaccagcagcagaagaaggcacactcagtgaacgtttgccgcggatgaaatgaccgacggatggagngggagaggggggaagttatgcctatgaaaatgaattaaactgtgggggagactttattgtgtgctgaataatctttaggagcattggtccct

SEQ ID NO: 9480 - DNA, 885 bp, Heterodera glycines
tttctgttaggcgagaagacaaagaaagactaaaggcaggaaatgctcaaaaattaccaaaaaatttgaattagcggggtttttggcacattgacatcagttttctgatgttgaaaatcaggacttattgatttttatcagagttcccatgactattttgatttttcatttttttctgaagcgaatatttgaattaatttgattttaaaaaaaaattacattttatttcattttttgagtgaaattcacaaaatgccaccaaaacgtaaatgggctcaaaatctcaaaattggtcatttttttggtgaaattctgttaacaaatttcattttaatttgaaaaaattttcccggtggcgcctatcggcgcgaccggacaccaaaatcccaatttttcttaaaaaaattagtttaaaatctctaaatttggtctttttttatacaaaatctgttaacaaatcacatacaaaatttcaaaaattttcccggcggcgcctatcggcaccgccggcctaccaattcccaaaagttttttggaaaaagcacgccgcaaaaacattattaatttttaaattttgaataaaatttttcaaaatgctgatttacaaaattttcaattgacaggccttcgtttttatgctaataaaatattgttttaagtcaatttttcatgtttttattgcgtttccttcacgcaaatattagttttagaaaaatcttatttttggggtcagaatcttagtttttaggccattttgtcttattttgaaaaaaaaaacttgggaactctgatttttactcgtttaaaattttaatttcctttcttgtttcagcattctaaaaaataatttatttatttttaatataaatttttagaaacaagcga

SEQ ID NO: 9481 - DNA, 2979 bp, Heterodera glycines
aacgcttcctcagccattcgctcacgttgattttctctgaaattttgttaaaacaattttttatgatgcgttttgcttttgtttaccactcgcttcccacaaatctttcttcgcctttttcgttgtcgcattggcaaccgaaggacaaaaggcacttttcctgcaaggcaattcatccataaatttagcgcttttcaacacgccctctgagtcacctcttttggctttggttctgctgatggggccgagtgccggaaatgtcgcagaacagcgtcaacagatcgcggtgcagttcggacaaatgggagaagcgggagagcacacggcacaattcgtcaaatgcgacacggaactgttcgtcgcttaaagggacaaacggagaaggaattgccattttgtccttccctccgcagcttttcactcactgtgaggccaaatcgcttctgccgttggcaaaaagtttgcactcgaacactttgtcggtcaacggccctttcccccgctcactgaccagcgaaaacatttgcgatttgcacttggcgaattgttctgcgctgatttgctgcttcggaatggtggagagcaaaggctcgaatttctaatcacaagtttaaaaataaatcggccgattgtttcgaagaatgaattcactgcgaaaaaaacacctcagacacattgtagatgaaactttcattgaccgtaaagggcattccttggcaaaacaactccaaattgtgcagcttttcctcattttggcgctctctccgccgccgtttccttttcaatgtccccaacagcgaaagtctcacgctgaacaagcaaattctgccaaatttggtcgactgtttggcacctcgctttttcagtcccttcttccccgctgttcctttcctccccgtcgtcacaatcgctctcgtcatcgaccagctcaaactgttcgtttggacacggcacaatttgagcggcttggatgagttgtgccatcgccgttcggttcagtccattggccaattccgctgaacttcccttcgggccataaacattttcactgctgagttttccgccaaaatttgctgaaagctttgccaaattggaataatcagtcaaaagtgagtgggtgaaacccttctttcccatcgccacacaatgcaaaagaagggcgccgttcacatcgcgcgacagataatgggaaatgagtttttgatgcaaatttgggctcaatttgcaatgctcggcacgcccttggtaaacgtctgggaacacttccaacagcactgatttgccattggttatgaaggaggtcagacaaacggactgacggagagacacgtgggcaggcgtaatgggaaaagagcgttgaagaattgggaactgaatgaagaaaggggatgagagaaagccgagagggacagagaggagagagaaagggagaaagcccagagacggaagagagagagagagcgagagagagaggggaaaaacgacaaaggatattcgcactttgtccgacttcagtttcggcgaggcggtgcaccatttgagccgtacggaggtgaacagattctcgtgggcgctggcgctgtccagcattttggtctcacccattaaaaggccgagtgaggtgagggcgaagtgagcggagcgtgggtggagcatttcgacgtcgtaattgatggactgtccggattgggcctcttcctgaaatgtcggcaaccatttgtacaataaacggtaaattacatcctaatcaacacaaaaaatggtataagaatggtcaccgctgtcattaactccctttactcaacttcattggtattccgcagaccgttgtcgacacaagtccgtaaatgtcctgcaaaattttgtgcatgccgacaacagaagccggcccggcactgacagaaatgagccgcgcatggaaattggaacgatgctaaacatttttaaactcatttttgaaaatttattttcaccttttccttggaaaacattttgctggattccgttgctatgttcaacacaaacaaatgaatttgatcgataagcacagaactgaaaaagtgcagaaaacaatttgatcggtgcaaaaaatttggcaacttttttttcgttgaagttcgatttctctcattcagcacaacaatttgttcggaaatatattcggtgattgtgtcaaactctgtgggcctttaaaaaacggattaaattcggaaggccaattggcaattctcacgagtccatcgtcgtaatcaccgccatactcccacggttccgaatccggaaactgttcctctcaatttttttctgcatttgttcccgcactgtgccgtgggccttctccttctcccacttctccattgcttgcgagtgcgctttttccttgatcgtgctcatctgattggagtccgtcgtctctgatttcccttcagtctccgtcgattcggtccctttgttggcctccgcgacattcttctggcttgaagcagtccttccagcacttcgcaatctcaattcaagctgtccaatatataagcgaccactcaaagtccacacacattttgtccgcagctttccgctgcagcgccgtctgctcggaaaatgcttccaatccgagaagaatgccgttgagaattgagcaagaggaagcgtcgccgcccgcctgaggcagctcacaagtggcaaacgcatttaacagctaaagccaatgggagagatgcagtcggataaattggtgatggaggtgtgacctgttcatgagaaataaccgagctactgctccatccgggcgtcagaaaacgaccgacaaagtcggaaatgacaaatcggagacatttgtcgccacgcggaaacaaatcagtaacaactcgatggaactccataacagcctcaacggaaatgctccacaacttcttctccaacttcccaataatggacgcattctgatcatctttcactgagaaagtgatagtctgaacaaaa

SEQ ID NO: 9482 - DNA, 886 bp, Heterodera glycines
tttttaattaatttgataatgaatatttttctaattaatttgataatgtttaactgtttttgcattttcagactattacttatgataaattcataaacctttatttttcaaaaagaattttttattattatcaatctttatttgctaaacgggcgttcaagttataaaaattaaataattaattctaaaataacaatgatattaataaaattattaattatatcatagaaataaaatttctaaatgctgttgtcgcaaagatcggatttaataagttgaagttgcacatcctatttacttgcttctgcggcaacaatcaatgctgttatttgcttgtggacccattctttttatctcattttgaatttgaaaaaaagtttcttaattacattattataaattaattctacaatcgcacttcttgcacgtttcttaatttgtataaaaaataaagtatatcttttgaggctataaaattaattacagaggaattatacttaaaatgtttaaataaattttattacttcatgttaatgttaattattgccactgtaattgaatgtatatattcaacatgattattttaatgtgctcttcgtgggcagtctcactttattttcaattaatttataaaatttgaagtttgtatttctctgcggaatagaactttttgctcttacgatccattttttacaagtcggaatattttttgttgaattaatttattcaaatgtttattctatcatttggatgaaagcccttctaaatcaatagaatttttttcataaatttaggattttgacccaataaaagccttttatggccagtcggccgttgggatggaaggggtgtaataaagcgcaaaaagaggggggggggggggggg

SEQ ID NO: 9483 - DNA, 2639 bp, Heterodera glycines
gagttaatctaatcttttcgtttcttatattttttcaatcatgtcttgtcagccttctttagaggtcaaagaaaatcaacataaattttaaactcatgatttaaaaaccgcttttgttgggagctttgaacccattgaatcttggaataaattaatccatttcctatatacattagacaaaaatttacaattaacccttgaatatattatattattaactcttttatttctcaaaatacatagttttaaatgaatatttttatctttgaatcttaattcaattattttcaattcaattcttgcttttattatattatttggtacattaattatctcaccaaggttttttgctattaaaaaaaataagaaaatttaaaatcacatattatcttcattaaatgccaaatataacggtaataaactgaaaatcttttaactatatattataatataatcataaaatatttttttgatttttaatttattttaattgtttcacattttttttgaatctttttcgacttaatcattatcacttttgaattttaatttgcttaatatttttctatcgtcaaatttttttgatgtaatatttaaaatttatcttatgaaatgttttaaaatacatagaattatgtttcatttatgtgattgattaaagagttttattgacaaaatgtaaccattttatttattaataagcatttaaaaaaatattttaatatttattaatatcttaacggggtcggaagtattcatttttatttataatgtggagataatgaataaaattaattaatttatatccttctcagattaaatgctatacttaacgttcatttttatccaaattacattcgtcagatgtaaaattaattttaaatacttcactactgttctttaattattttaaattatttgatcattatttatatttatgggttgtttttaccttgtagttttatgcgtttcactgcaagtaccatatcatgcatcgtaatctacatttgtcgatatagtatattatttttctttttatttattttaataacaatggaaaatatccatcataggtcccagactcaaaattgcataaattacatgctcatgatgataaaaacctaaaaacttcaatagtaaaaattaataataaatataaatgcaaaataataaatcaataatttttaaaatataattaaatagcattttttataaatgataacattctttatttaataaaacgatatcggtaaaacattaatgtaaataataatttcaaaacttagcaattatatatttagggctcttttaaatacctaattattagataatgttaattaattataaatttaaatatatcatcatatcaaattcaagattaatcttttaataaaatttttatttattattaattcttccttattagtataagaactgagaaaatcgaatgaaaattagaagaatgataatggcttcaattcacaactgatgaatggagcgggtaaatttagcaaaaacaataaaaatctaatatttttatctatttgcataatctttggccgactttcaatgtattacgcaaaaattttaaatttgtaataattaattagttatgcttacataataaaattacaattttatctttttttttcttatatgcttaaatggtggaaaatttatatttttataaattaaaattttaatgccgacgatttaagaaatcataaaatattgttttgagtctgcaaattcattttaacttaatttatcaaattaaaagaaaaattgcaattccaactaatagcaggacatagaaaatttttatttaaaatttttttatacggaatcacaaaaatacatattgggaaaatgtttatcatagctcccaactcaaaaacacccaaaaccacttttataggttttcttaggtgctgaaaaagcctaaaccatcaaaaaaactgcgcggcaaagcgtttgaacaggtttttgaatcggtttaaatcacgaaaatttgcctcagaaatcatccaaaaatccatttaaataaaaaattttgaacaaatttggtatcattcgaaagctcttaacgagctaagtctaaaaatcagggaatgaagtcgaaccgacgcatgttatgggtcctcaaaatcgttaaaactacttttaaaaccagtagtcagaaatggtaaaagaacgtcaaatataaaagtttgaatttagcttattgcgctaaaaaaccgccgcacactcgacaacggcggccagtaggtggggcgaggccgtgctggtgcgtttcgtaaaaactgcaacccatgcgcgtttcgtaaaactgccaaattggtatttttttaaaacccccacccatgcgcgtttcgtaaaactgccaaattggtatttttttaaaacccccacccatgcgcgtttcgtaaaactgccaaattggtattttttaaaacccccacccatgcgcgtttcgtaaaactgccaaattggtatttttttaaaacccccacccatgcgcgtttcgtaaaactgccaaattggtatttttttaaaacccccacccatgcgcgtttcgtaaaactgccaatgggttccaaaacaaattcgctaatatatataaattcataacttgaccc

SEQ ID NO: 9484 - DNA, 3461 bp, Heterodera glycines
cccggggacctctagagtcccattggctttgcttcttcaaagggcttaacggcttcttcctcctttggtttggcttcttcccattccattttggtttcttcctccaacggcttttcgtcttccattggctttgcttcttcttccttcggcctttcctccacaaccgctggctttgcttctatcgctgtaattaataaaattttctaattagcgatcggttgttttttagttacggataattctcagcggtgcttttgtcgtggcggttcctgctggatttgtcgcttcgcaacaataattgccctggtcgtccatgcgcgacttggggattatcagtcgttgcgtgccgtccagcaatgcctcgaatttgaccgcgtccgccggacccaacggcacgtcatccttgtaccatttgacctgtggctgcggcacaccgctgacttggcactcgaacatggcctcgtctccttccgtggcctgatattttcgaacagtcgatgatgccattatttctctggttttttgagttttcccacctgaactggcttcaacccttgtacaaattcgggtgccacttcggctggcatcggcgcctcttcctcgagcaatacgcgcagtggcgcttctgtgtgcgcagtgccggacgggtttgtggcgctgcaacggaacactcctgcgtcggtgatgcgcgcggcgggtaacgtcaggtggcacgtgccgtccggcgactgagtggcgcggaaattgacatcctcgggccgaatctcatcgtcatcctaaaaattagcgaattttttatgaaacattaccatactcatacagtaccttgtaccatttgacctcgggcgttggccatcccttcaccacacattccaaatccgcttgttctccttcggtcactcgcacttcttgaagccctctgacaaaatatggcgacgatggctcctcttccggctcaggctctaaatgcacaaatggaaattgaaaaattaattactcttcattaaatccaccaaaatgctaatgatgctcaagagtctcggtctcgagtaagtctcgtctcggctctttggtctggtggtactcaattcgattttcgagattctgtctcgagaattctgggcagccctagcaaataccgtaccccctcccccactgtccaccttgtacggtcaatgtgacgtcgctccacacgtcgccgtatttgtttgtcgcctcacaccggtagtcgtccatgtcgcccatttgtgcgttcgtaataattagccgttgcgtgccgtccggcaaattctcgaggcgatagcgcgggttgaggccgggcgttatcagctgctcgcccttgtaccatttgacctcggggaatggcaaaccggtgattcggccctccaaaatgccggtgtcgccctaaaaatttgtgtcagaaatttaaagtgattctcgataaattgggtaagtctcgaaatagcaaacaattttgccacaaattcacatatttctctgtgcctaccactttgactgtaatcggtcggacgggctcaataaaatcgggcgcttcgccttcggtcggcaaactgccctcggcagcgacgataatcggaccttcagtccatgccgtgccataatcattttcggcatcgcatctgtgaagggatagatgtccgcattgttcatccccatgtgttcctgctactgcttgttgctgttgtcctgttccccacctgtattcccccgtgtcgtccatgtccgcattggttagcgtcaaaatgattgtgccgtcctcgtggtactccgtgctaatccgatccgactccgacaatggcccatagccctggcgcgaccatgcgatggtaggccgcgggttgcccttcactttgcagcgcagcaccgccgtgccgccaattgtggtggtgcacgacttgagcaactccacaaactcgggcggtccgggcgccatctcttccgcgtcgcgaggtgcttaaagcagacaaaatatcctaataatcccaaaattttctaagaatatattaccaatgacgccgagccgcgcctctgtccaaatttggttgccgctggcatcggtggccacgcagcgatagacgccaatgtggtcgaagtgcgcttcgcgatcgaacagcaaccgttgggtgccgtcctgcagttgctccactcgtaacgagtacagctccatcttgttggccaggatggagccgtccttcagccagtccacgcgtttcactgcgctgagtgacgacggctccagctggcattcgaacacgacgccacgcgttcccttggacatctgctggtcgcgtagggttcgacgccagctcaacaacggcgcgtgctcctcttccggctgctcaattagccgctcctccgcgtaccgcagcggtgcctgcgtttgcgcacggcccgtaggattgatcgcctcgcaacggtacacgcccaaatccgaggcagacgcgtgcaggacgcgcaacttttgtgtgccatccgcaagctgttcaatgacgacgttcggctcttggccaggcaagatgggtttgtcgtcgcggtaccagcgaatgtcgggttgcgattcggccacgttcaccttacagctcatctccgccggttcaccctcacgcaccgtcctcggctccagaggacgcacgaacatgggctcagccagctcgaacttgtggtccacctccatctcttccgcgtatttcaacggcgcgctggtctgcgcacggcctgccgcgttgaccgcctcgcagcggtacatgccaatgtcggacttggtggcggactgcacgcgcaaatttaatgtcccatccgcaaggtgttcaatgacaacgttcggctgttggcccggcacaacgagcttttcgtcgtggtaccagcgaatgtccggcttggactcttccgcgttcaccttgcagcacatctccgccgtttcgccctcgcggactgtctgtggctcgagcggcacgaggaacatcggctcggcctgctgctgagcaggctcttcaacgcgctgttggacgccgaagttggcttcggataccgactgtcccgccttgttgaacgctttgcacgtgtacgtgccggcatcctccgcccgtgcgttgtttatggtcagcgagtgccgtccgtcgggctcgtccctgcgcatgatgtgctgtccgtcgatgtgcagcgggtgtccgtccttgaaccagtcaattttcggttccggcttgccatcctccaccaccacactcattgtgccggtgtcgccctcattcacgtcaagcggtctcagctcctggctgaacttcggcacttccaccgcttcaatgacgccaaatttggcttgcgtgaccacttgaccagctgcgttcaccgctttgcacgtgtacgagccggcatctctgggcttggcgttgttgatcaccagcctgtgccggccttggccatcgtcatgctgcacaatgtgt

SEQ ID NO: 9485 - DNA, 887 bp, Heterodera glycines
ccgtgcgtccggctccggttcgcccgcgccggtctcgcgcccctcccccgtttcctccgtccgcacgctgacgtccttcagaggttcggtgaactcgggcttctgcagcgtttcctccgcgcggtccaccgccagttgcgcgtggctgctgtcctggcccactttgttgctgatgcgcacgccgtagtcgcccgcatcttcggccaagcagtcgttgatgatcagcttgtactcgcctgcctcccggtactcgaccacctccaacttgcggccgtccggctgcaaagactcgccgttgcggaaccactgcacgtcgggtggcggctgtcccggcttgccggcgcccagcacccgtacacacatttccgcagtctcgtgctcccggacgcgctgccgtttcagcccgtccacaatgcgtgggcgttcaatgcccggctcagaggcgcgcacagtgcactcggacaccgcttggccaacactgttcttggccaccgcgcggtactgacgaaagtcgctctccaccacgtctttgatcaccatgcgccactgcgtgtgagttgcgtcgtgttggatggacacgcgcgtgccggtcagaatgcggaaactgtcgtgcacagtttggaactcgatggtcggctggggaatgccagtcacgctgcattccaacaccacctggccaccgatctgcgcttcctggtccgacagagtgcgtgtgaactgtggtgcttgggctgcaaaatttaaataattaattcttggttaataattactttgttttgtcaaatagaaatcatttaagtcccaggattggtcactcactctcaatgcgcagcgttgcgctcgtagggggacgtcccagcgcgttctccgctcggcacgtgtacgtc

SEQ ID NO: 9486 - DNA, 1214 bp, Heterodera glycines
caggtgatttcgcttattttgtttccttcggttctattcattatcatatttttttatttccatttcgttcggagaggtcactggcgctatttttttctctttttttgctgtatgaaagattttaaagaggcggtgccattaaccaatgcgatttttccaacaaatttgccaaaatattcaattttgatcaatttaaattggtgaccgacgtaattacaattttcacttcgggcctgtaactgtatcaaaagaagtcgcaatttctattattttaggctgagtgaattcgctgctgaacatctgcaggagaaatcattgacacatatcgacgatttgaatgacgcgcttaaagcgacggccaacgctctgttacgaaaatttgttcaaacggaaagcagtgaactgaaccaagtcagcgaaggcgttcatttctcgtccatttcttcggttcttttgtgtttgaggtggccaagcgcagcattgagctgttcgagtggaacgaatgcgccgactctcctcgaaatattcgccctttggtcaaacatttggtgcattccgtggaagaaattcaccgtgacctttgcgtatttgtgaggatttcgacataagcccataaacatttgactgcttcagatggacgacgggggattggcaaaactgaaagagcgcacttcggactcactgagagggtaacatttttagtctgtcatttcctccgaatgtttggaattagttacgcttcgatgcggcgagcgacgagtgctgcgagcagtgtgttcaacgacgcgtcctccgtcagcagcggagggattgtcgagcgtttgtggggcgacacggagactcccgaagagggggccgggacttcgtcgccagagactttggcgacgatggcgatggaattccgcagagacattgtaagcaaaaataattaaaagaatggcacacttttagtccattgtcagcaattactgttaatttatcgtcaggtcatgggtgccattgttcgtctgatacttcgcgctttttgcgattttgtgcgtgtgcagaaattttcacgacacggttttgagcagctccaagttgactttgcttatgtccgtcaaaagctttggtatttcgtggccgatgagcacatgttgaacacgtgcattgaggacattgtcacggctgcggggtaattttggctaattcaaaaatggattcctttcaatgat

SEQ ID NO: 9487 - DNA, 2146 bp, Heterodera glycines
ggtaattttggctaattcaaaaatggattcctttccttatttctcctgttttgtttcagtgaaccaatgtgcccagcccaaattgttggatccatcggtagttaggagaatttgtgaagaaatgcagtgatctatttgtatgtacaattaaaattaaattaattaattgttcactttgttttttattttgcttacattaaagttgacaaggatttataaatttttgccaaaataattgaatggattaccaaccattttttatatttttagtattttttctgattttaaagttccttcgccttgtgaatttttgctttgacttttttatggagagattgttcaataccccgatttcctccctttctacgaacacatcaaattgcacacgaaacaccatttgtcttggctttttggatgggtccatccaatgtttttcctttgacacacagcgagggatcactccatcgatggaaagttcggtaaaactcggtggaatgtggcgcaaacggatgaaacggtccgtcagggcaatgcaaatttctgaggatggcacttcgctttatgcgaccagttcgaacaggttgcccattccccctcgccccctccccaattgtcagttttgaagggccgtctgtttgtatgacgttgagacggggaagagagtgcgctgtattcgcgaagggcacaaaagtcggcccagtgcgatggcactgctgccgggcgaaagacggcattttgcaacgggtgccgaaaacggcgaagtctgtcgggaagaagtccaatgagacaatgtcacattttaacatagataaaagcatgggactttggacagcccaagccgaacgtgcacacatttggcgagcaggcggacataatcagttgggtgtgccccttttttgtcccctccccagcggaatttagcgaagtttcttaatctggcccattgaatttcctcagatgcgttgcacatttggcgcaataatttgctggccgcgagtggcgacggcactttggccgtttacgacacgcacaaaggcaaagtgcgaattcagtcggagacaatgcacagcgaattgctcagtttggcggtgactgaaaggtttcgtcggttttcaatttgcgaaaaggcatttctgtccatcactgattgtcagattcacttacgtcggagcggccgatggacacattgaagtgttcagcaatggccaatttgggaacatccgcgaacgtatggagacgccctttctgatgggcgtcgagcaaatggtcgtcttgcgcaacaatttgctgctcgccagttcgtccacagctgaagagatgaggtgggtgaccaaaagaaggcattgattggcattggccatggcctttgcttcgtttaggtttctgcacgtcaatccgaacaaaactttgtgcggcatttcgcgtcccggcggagtggacattttggcgaaaacgacggacggatcactggtggtcacaacgagtggggacgggacgaggctgaactgctattcggcggaggaactcgtcaaggacattccgatgctaacggcgcagggcatgagagcatttaaaagcagacagagggaggagaggaagcggaagagggcgaacacaacggacacattttttgaggatttattgagtgactcgcaaaggagggatgaggaagacgaaggagaggaagaaagaggagacgaaagagaggaagaaagtgatgaccatggcacattgatatgactgtgatggtgggaaagggccgcactaattgttgctgctccttggttatggtgttgttgcttcagtttgctattcaacaattgatgcccatattgtcttactttcaagtaaattgaattacgcccccccccccctttgatagttttttacatcatattgtgccacttacaaaggagagtgttcgggtgatggtggaacttccaaatgaaactttgtaggtgggtagaccacccctgggttgtattgccaaattttttttctagctgcggaataagcttctgtgccgagatatgaggctttaaatatttaataattatattatattaaatttaaaaggagaagcaacaagcgaccggttggcaggttggtaggagtcacgatttcatttatgtaatggaaagttcga

SEQ ID NO: 9488 - DNA, 1321 bp, Heterodera glycines
tgcagttggtgtattcgcttacgctttccgatgctctttcttccggcgcctttcccttttcctcctctcggccacgttttgtcccttttctgctcgtcccctttgccaacacgtgtccttcaccatccgttcgagatgagtgagtgagttcggaattcttacgtaattggattcggcggggtcgaaccagttggtctaaaacatgacaattcttcgggattgccatctcgcggtgggcaattctttcatccgttgcccgccttcccgccgatgtctatggacctttccaattcgtcgatatccccgcttttcgtaaaatttaagcagcggtgtcatcggcggatggacgacgtctttcaccggctcgggaatgccgtgggcgtccaaaatcatttcgcacacattccaacgattgacggcgtattcttccgcgacttgtaacatctgcgtgccaatgccccacccgtgagcatcgacgcgcgtggcaaatggcccaatttgggcgaaggggccattgtcctttgtgttcccttgggagttcaacttcactctgatgcagcccataagtcgcgcaccaccgtttgaactcctttataaattgtcatttatcaaaatttcataaatttcgatggattaaaatttttattttttcgcattgtgtccaaaatgcaacggttgacgctttaccctgcatctgttagtgccgtcgtttcggcaactatcagcgccccgtcctcctccgctttgaatttgctcagtgccatccgcgtcctttccaacggcacttttttcatttgcttacattgctccggcgtggcatgctttatctttagacaatcctgcagataggattcctgaatgatctcggccgtttcgtcaatgtcttcgtcacggattaggcgaattatgacttcgtccttttggttgcgcggtttaaatcttttgagagtttcttaaaattaaatttttaaaaatatatttttcaaatttattaattaccagggattccttttttatgtaaatacatatttttttcctggcttctccatagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacatttttgaaagaggaggtagagaaaacaatttcaatagagagcgcaatgg

SEQ ID NO: 9489 - DNA, 2294 bp, Heterodera glycines
attcgaaagcttaatatatttagaaactttttctaagctattgcttcgcgattagacaaataccaaaaaagttatacatgaaaattgcgaaaaactcgaaattttgaagttttttcttaataaaaatttttccaggcttgaattttcgctttttgtaagactaatagagcatgttaagagctttcgatgataccaagattgttggatttggataacaaataaaaaagctatattggaaaaacgtgctggcgcccaaccgtgggcgcccaaccgtgagcgcccaactgacgggttccgtaagcaataaataaataaatgattattttttatgagaatttgaccattttaaatggcgagacggaggaagtgaaagtgccgattaattgggcaaattatcgaacagtttctcctttctctccaatgcttcttgttttgttttgtttgtcatgagtttaattaaataatttgttgtataaggaaatgcgtaactttggcacttccgcagagaattctgaggaagtccggcaaagagcaaagccaaggcattcattattcacgtgaactccaaaatttaagatagacaaaatattattataattaatccaacattaatattaaataatttattaattttttgacaatttattattgtcacaaataattagtggtttaattaaatttaattaaataaatgtaatgtaattaattttggagaacacaaaattatttctgattgtaggaattttcagggttatacttagaataaatgagagaatttaagtgaataatgatgaaaatgattatttgttttatgtgcgtttcgaatttaaaaatgcactttaaataaattaagcattttagataattttaaaaagtctcaaacacccaataactttgctcaaatacttaatatcattcaataattttatttatctgttctctatttgtttttaaaatttcaaatacttagtaatttctaatttcatcaagttataaaaagttatacaaaaacttttttgggctttgttgcaaatagttttttagaatttggaagtttgatgattaatgaagtaacttatgataaaaaacggaaaaaaacgacagtcaataaagaaaagaatcgaggaggccgtccttaaaagctgagaagcccaagtacacttcaattactgattgatcagcaattgttcacagtccacagactccaaattcaatttttttttcaaaaaattattatatcgaataatatgaaattcttctactcgacaatttcttttctactacatatttattaataaagaaaattacaatttaaaaaatgcgcaaggaaatttttctctaattgattttctaattaatttcctttttgcttaattcttttgttggacaatgagtggtcatctaaatttgatttttaattgataaatgataatataaacaataaccattaattaccattttctagtaacagtgacgtccgcaggttgcctgtgtttgaggattcaataaatgcaaatttaaagcgaaacactgaccgatttgacgttgacctgcttggccgggttgccgtcaacgcccacttggacccaataaggtgcgaagtacggtttgcaggtgcactgcaaaatgactgtgactttgttgaacggtgagacggaagacgaaacgacggagttggggtcattgttgagcttgaaaaagtgaataatacggtccaggtaatcatcataatcataattaattatgtatgtgattcatgggttggaatttcattattacccaccttcatgaagagcactttgccggtgtttggagcggcgcacgtgacatttttgaagacgcacttcccaaccgggtaagggtcgctttgataaggcggctgaagcggggaatagtcgcaatccttcccagaagtgtggcagtcgacagggtagtcacagccataacaacacggaggtgctagaaaaaatcttacaaattgtacaagctaaaacaaacgttttggagttgttggaacagtgtaggtctttgtagaggaagttccggcagtgctgggtccaggcggtccgggcgtttcagtgctgggtccaggcggtccgggcgtttcagtgctgggtccaggcggtccgggcgtttcagtgctgggtccaggcggtccgggcgtttcagtgctgggtccaggcggtccgggcgttttagtgctgggtccaggcggtccgggcgttttagtgctgggtccaggcggtccgggagttttagtgctgggtccaggcggtccgggcgttttagtgctg

SEQ ID NO: 9490 - DNA, 3524 bp, Heterodera glycines
  misc_feature (3435)..(3435): n is a, c, g, or t
caaatatcctcaaaaagaaaaatgaaaatcaaaaaaaaaattttgtatttttttttagaattttttcatcttatcttatttttccaaatttattaaaaaaaagttttttttaatttaatttataggaatggatttggtagtttttaattatttattttatttacttcaaatgtcctctaaaaattcaataaaaaataataaaatttccattttttgaatctttttatttccattttttgaaatatttgtaaaaaaaggtagacttaattttctattaagttagctaaatgaaatcccatcatttttttgtttgtttttttttggtcaaaaagtgtcgttttggcaacaatttaatataccaataaaaaaataagttctataaacccattttttattttatttttcaatatttcgcaaacagaattcacattaaaattgttcgattttttccacacaaaaaacattgtttaagccgcttttaccctaagaaaatcaaagtgtgtgaataggatgggattggtggtggtgatctgttgggcggtgtaaaaatttggtgcacttaacacttactgacagccagatcagccaacagaaaagaaaagttagccagcccaacaacacccaacgtccagcaacaccaccaccaccactttctttctttcccgtgaccattccattcattcattctttcccccaacttcccccccccccgcacattcattcattttcattatttgtgacgaaagaatgtttggacgggaagatgtaggaattgtgggtggggggatgaagcataaaattggaggaggaggaggaggggagaagaagcataagcatttggggctgctaaagcagtgggcggatgttggaggggaaggcagggggaaaagcggctggcagcaagcgattggtggagaaaaaagaggcgtagaacaattctgatcagtccgtcttccgcttccactctccaccttcgactgctgctgctttttacccacctctaccacagagaagcataaaaattggggagctgaggggcatagacgcagaaacaatccgctgatcaacaaatgcccccacccccggggggggagaagaaaaacggaatttttgggggtaaaaagcagacatttctcccccgcctcgcccccacatcccaacccatcaatcggcacacccttctcgccgccgatcggtcggatggatcaacgaatgaatgaatgcactctttgaaaatgaaagtgaatgcggaaaaattattgtttaggaatgtaaatttttttgttggttagaaaaaaagaaattaagaattttaattaaaaaaacggtggagaaaattactaatttattcatgtactgaaaattaatctcggataaggcataatataacataaatatatcaaattaaaaaccccatgaaagaattatttaaaattattttggtgtgaaaacattgtaaaaaaatattttaaaaatatgactaattaatggtttgaatgaatcacgtttttaattgcttaaaattctttattaaaaaattccgagaaaggaattcggcgtaatctctcccgcaaaacaaacaaattttttgatttgaacctccgcaacgcatacctaattgattttttccgctctttaatgattcattataaaatttataacttttaaataataaagaaataatttttattaaaaaattaacattaacttgaggaaattaaaggaaattagagagaatatcgattgtgatggaaaagtggtgaaatttgtgagaataggcaaaacatttcgcgcaatcattgtgaaaattgtgtgatttgatgtgaatgtgatgacaaaaacagcgtacatttttcctatttgcactttttggtctttaaacaaacaccgaaaaaattaacagcggcggctcacagaagaaagagagttaaattgaattttgttttagaaatttatcaaattaaactgtaaaaaaaaattataattttttgatttgattattagggaccgttagattaatttattagagctcggcattttgaaattctcgacaagtatttggttgaatacaagtatcaggaagagttattttttgaaataaaattatgtaatttaggaacaaatattgattatgattaaattagattaaaaatagatatataaaattattttttattttttacaatacaaaaaatacattgatttgataaaacctaagagttggtcacagttttttaacataatttttttaagaatacacaggccatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaaatctaaaaaaattcaggtaagctttaggcccgctgagatacgtcgacttttatttcggtgcctataaaaagtactgtatttcttaagaaaatagtgcattttacactacgtcaaaattgaagtgcccatacctcagccggtataagtaatagagacatgcggttttttgaatattgtagagaattttgtgctctataaaatgggcctactcaaaatttccagaaaaattttcccaaccccctagaaatttttttttgaaatttacccctcgttcccagccaaaatgggctgatcagatcaccatgaaggagtgatctgatcaacttggtgttgctaccttttttgatcagcatccaaagttatgcttacctgaatttttttagattttttaatgctgatccagagaagcaatattttaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtatgtagtaaagcatatttggctttagaagatattataatcttagcactgataatatccaatatttttaataattcaggaactctgggtcatttgaataatcattttaaaatgattctaaaaatcaaaaaataactttcttgctaacttttttgttttcaggcttataaaaaaaattattatggtattttcgaatgatataaacaaagacgaatttttctcgaaaaatttgaaaattcgcaatttttacaagtcttcgnctcttatgtcttgtgatcactgatcatccatatattatgtcactaggagagtctacacatttttgttctgaattgtccttagagtaagt

SEQ ID NO: 9491 - DNA, 1472 bp, Heterodera glycines
  misc_feature (24)..(24): n is a, c, g, or t
caatgacatttatttactcctccnggtagaaaatttaattattttggataataatttgtcaataacactaagcatatgcaaaaaaattgttataatattatataaaaaattctgctttttagaaaaattttatgaaaaaattgttagacatttataaataagaattcattttttaataaatatatttcttctctaatgaacatcaaattattaattaaagtaggaaattaaaaaaatatattttttgactaaatgaaaatttatctattaatatttctgaatttatttttggtgcccctaattgaccaaattgaaaaaaagtaaaaattaagcaaaaaggaagaaaatatttagcaaaagaaagaaataaaattatgccgaaattagtaagaaaattgacgcaagttatgatattattatgagatggaagaaacaatttgaataagaattgttataggataaataaagtgcttttgatttgtttaagtgcataattatatatttaagtgactaattaggtcaccaaaattcacaaataattaactaattaccactgttaggatttatatatgcaaaaaaaaaccccaaaaatacaaaaaatatttgccaaaaatttaaaaaactgctcaataaattcttgaatttctcaaaattttttccaaaaacagttgcaaaaaaaaactttttaatgtgctgctgaattaagtgctcatgtttagttaggcaaaattctaaaataagtgactaattaattaccagggttatgatttatatttgctaaacacctcaaaaaggcaaataattttgccaaaaaaccctaaaacaatgctaaaaattccaaaaaatatttgttaaaaatttaaaaaacgtctcaataaatacgtgagtttctcaaaaaccattcttcataagggtgggatttttatgtgctaaagattctgaaatatgtaataaaatatattcttaaaaaatgctgaattatgtgctaaaaacccccaaaaaatgccaaaatatgtgctaaaatatgtgttaaaaattggcaaaatatagcgtatttttacataaaaattccaaaaaatctctcatttttggccgcgcaatcgcaaatcaaatacatttcaaagtgttagaaagtaaaatttgtttttttttctctgataaattattttataaatttaaagttccatctggcaacttcgaatacagtatacggtaaaattgccgaatacggtatcggctcaaaatcgcacaaaaacacttttataggttttcttaggtgctgagaacgagagaaaagcttaaaattgagcgcggaaaagcatttaaaccggtttaaaactcgaaaatttgaatgaaaaagagggctcctgaccttttaaaacggtcaaattcggacaaatttgggatcattcgaaagctcttgatgagctatcgctacaagacaagggataaactcgaaacaatgccatcta

SEQ ID NO: 9492 - DNA, 3864 bp, Heterodera glycines
atgaacaaattattaattaatccttcgcttttactttcgtttcggcattgcatgtttgtacgggtctttccataatggcacttcctcccccttttcgtcccttttgcttgcggcgtccaaattctgttcaagaacacgagaaaaatgaaaagacgacacttcaattgtctgaggatttgcgaggcttttgcgaatcgcgcggcgataacaaaacgaaaacatgctaatgaatgccgcaaattacgaaaaaattaatgcttttggaaataaatgttttgatttaaacgattcgtaataagaaattgaaagcagaagtctgtctttcaaaacaattaaaaaattaatgagtttccgtcttttatcaccacccttcgcccgtcgatgttcggctgttcacaaattcctgaatcagctgcatgagttctctcttcacttcatccggcacaattcgacgcgaggcatccttcagctcgtcaaccatcgcttgcagttcaacgcgttcatagccctaataagaaaccatttattcgtaggtgtaatttccaaaacaggaaagtttatttaaaacaataacccacgcggccttattcaccttcgctaccttcttcgcgatgtactcctcgcacatgctctccactcgtttcgcccaccccgactcgtgaagtcgtcgttccacaacctcttggacccggtctttctcaccactctccacaaattccttctccaagtcttcttttcgttgcaattttttcaaaggatttaaaaatgaacgtgccgatgatccttgcattatgacaaaaaaaaaatggaaaatcgctttaatttctcacataagcatttgtccaagtatgtttaaattaccaaatttaattaaatggaaggaataaaaaagccatcaaaaccaattagatattaaaagcagagaacatataaaactacataaaaatgaggaagacatgaaagtccaccaaaggaaaagaaaacataagaacgaatatcatggtttttctcattatcaaaagggtccagatcagatcaatcattgttttgcaatcactgatcaatatggtctcggtcgttcagcaaatccccctcctccaccgccttcgtacccacgcataggtccccctccgccagggaagccgccagggggcggcccaccaaatgcacctggcggcggaccaccattttgcggccctttcggcgcatggcacgagttgcactccttacgaaacgcgaaattgatgtttccgcagcttaaaacgaacaaatgtgtcaagaaaagtaaggaaataaacagaataaaatcctacgggcagctccagtcgccctgacgcatttccaagccgcccctcccacgaccaccgccgcctcctcctcgtccaccacggtcaccacgagcacccattcctccgcggccacggccaccatcccctctgctacgaccacctcccggggtgaatccgccatcttttattaatacgtgttaaacaccgtcattagatttccacagttcaccttcaaatccaccaccgtctcgcggcggcccacgacctccgcttccgccaccgccatcacgacggaagtcacgaccaccaccgaaacctgagactaaataggaaaggacaaatcatcgaaaagtaccgccgccgcctcctcctcgtcctccgccccctccgaagcgtgacccgcctccgcctcgaccacctcccccgcggcctccaccaccgccaccgaatttggcaaaagaaatgtccatcacattgtccgtgccaggaaagggttgtcctatgcaattcgttgcacaaatgtgagaaaggcttacaattagccgctgtctcaccattgtatgtgtccatcacgcgctgtgcaaccgccgtatcgcggaaagtgatggtgcactcgccttttgactgtcccccttccttgtaaattcgtatctttgggccaccattctggtcagtttcaacatctccttgctgcatactgaacacatcatgaatgaattgttcgttgacactgtcaagagacaaataaaggcaaacattcctttcttcactgactgttgcggaagtcccgagaagaagaggatgtttttgctctcgaagccaccttctttcacccacctccacggcttctctcctgtctcattgggcctccgccggacgatcgccggtcaaacccaccgtcaccgccacctgaagggctagtagttgaacaagtttttcaaacaaaaaagcaagacacatataactcgttttcaaattttcccaatttattttcctttttattggaccgttaaatgtcaatattcatgcttattaccaatccctgtactttatttaaaatacacagtcaattgttctgctaaaatataataaaatccacgcaataaaagcgaataaaatgtccgccaaaacaccgacgtattggaccagggaaattttttaaaagataataaataatctccaccagtcctcattagataaaagtttgtaagttacgagacaagcaaagcgttgagttgcaaatacctcgataaccagcttgaccgcccggtggaccgctattataatcaccgggtctgaatggacagatgaatcattcagtcattacacacatagcacaattgtctcctccaccctcctccctttcctccactccttctttgataccaccgtaaaaatccttcgaaataaaacttgccctcctcgaaagaggagcaaaccgttcattaattgggaatgttcaattagaaaaattcttataccatttctgcaaaaataaaaatgactacttcaacatttcaattgtgcagaaagaccaattagtttaagtttattacgacaaataacccaaagaaaaagagagaaatcaaatatttttaatatattcaagcagaaaatttgaataattaattttgttggaaccaatgagattttcaaagataagaaaccatcgctataattgagaaccaatgcattcaacaaattcagaggttttgttataattaatacttaaaacataatacagggcgttcattctgcacaatgtccttttcccaatcgaaatgttagtgtttcgcttcctttgtaacttagagaaattaaatagaccaacatataattgtactcgtttggtctatttttatcactcaattccccaaatttttgcgcagttttcaccttctgctgaattgccgttcactcccaccgccgctccagcgactttgactgcccccgccgcgttgaaagcccccaccgcgcggcgtttgttgcccgtacggcggtggcccgcccatgaacgaattcaatggcgctggtggtccgcgctgttggggagggcctccactggcggcccatgctccaccaactggggcggccatttgttgcacttgcggtggttgaggcggtggaaagacaggcgcattcgaagcgggacggccaacataagcactggcgagcggttgaggcgcagcagcgggcggcaccgtgccggggaccggctggtcaaaataggctttatatgtcccaccaacctaaaaacgattatggaaatggacaatgtttgaacaaagtaattgtgcctcttgtccggtatgttgttgaatgttctgcaccggttgttgtccagccccagtctgtgcataatactgctgccatgcctcatattgtttctgtgccagcttaaccaactaccattctgatgattcaaatgtcagtgttcagttacctgtgggtcaaacgatgttgcgccctgaacatttgggtcgccagcattgtaagcataatgcgctaaaagaaaggttcatatctttaagagatatgtgaaagtacctgtcggaaaaccagaaaattctttttt

SEQ ID NO: 9493 - DNA, 2982 bp, Heterodera glycines
  misc_feature (2751)..(2751): n is a, c, g, or t
  misc_feature (2859)..(2859): n is a, c, g, or t
agaatgtctttagcttaaaactagagaaactagcaagaagaagaagttgatggagaaaggcagcagcagcgcataattggaaaagaaaatgaagaacaaaacgccataaaatttttagaaggactttgaagatttgatatagagtggacaagttgggacctccaaaaaatttggagactattcaaaaaaaaggacaattgtttcaatttttttcattttaatgtattaaaatataataaaatggtttagttttgtgttcattttcctttttgtaataatgagtgcatcacgtgaaataattgcaacacatggcaaggaaattacggctgacgatcattttcgaagtgcaaatggcgccaaagaattcttcaagcgcaaagaccgatcaaaatcatatgaaatgaacaacgtaaaacggttttaaatacaaatctctcacgacttctgctgcaggtttcgggtgtgaggacaatctcgtggaatgcgagtggaacttatttggcgagtggttccgacaacagagtcgtttctgtcgggagtttggacccacattcttgtcgattggtcagtttattgttaattcaaaaaccattatgtatttgtcactcagaaagtttagaagcaaatatttgttggctatggtcacgaagacatcgttgaagcgattgaatttgcaaaacgcgatgaaatggtttctattatataattgtaaaaagaggggggggggggggcaactaacagaaactttttgcatacggaatgaaatccgctattaatcgagtcatgttaaatattttttccaagaaaatggcttcatgttcaagtgacaagtctgtgcgtctttgggaccttcgaaatccgagtagtcacaccaaactctcaacgccaggtataaacaaacaatatgattgcctaaaatttcaaataaatctttaaagttaacacgttttctttttaaatttagttgaaaaagctaacatcatacaaaagggttttagtaaaacgtataaataaaacattcaaacaaaacaaatatcttcgcaaattgcttctaaaagaaattacgaagatggcaaagcaataaaaagtccatttttatcagcttaatatttgacctgaactttttacaggcgcaaatctttttgtgacgtggtcctactgcgataatttcattatctttggcgacaaatctgataatttgggcgttattgatgcgcgcgctatgaagacactggaactattcacattcaaaggtcaattactccataccaaattgttccaaacaattttaaactcaaaaattctgaaggggaagttttttggctcttgtcgatgttttgcgtccaatcgaattacttttatgtaaaaaagaaaagaaacaaaatgtttgtatattaatataaaatacctattgggacacataatatcgacaagagcttttataaattttctattttttattgttagcttaaaaactggcttttccagatgaaattaacgagttcgtttgtcacccaaatgggcagctgattttcgtggccaccgacctcggaaaattggaagttcttaggtggattttgttgccgtttcaacccttccataattttcaaaattgtccattttccgcttgccgaagctgaaacgcgttcgaactgtccaggcccacccgcccctttcgacttgcattagtgtcgccctttcccccaacgaaaggtttttggtggtcggtgcttcggacgcctgctgttccgtgtgggacattaacgatttaatatgcgtccaaacactgaccaggtaattagcactgccaaaaaagtttaactgaattaattaaggctcgattatccggtgcgcagtgtttccttcagtcattgcagcaatttgatcgcttcgggcagtgaagaccgagtgatcgacatttcgtggactccgactggcgaaaagtgcgcactttcgaaaaacgcttatacattttcaaatattcaaattagagtcgccgaagttccgatcgccaccgaatgttatgacgtcgcctggcatcctcggctttatcttttagcatatgcaatcagtggaggattgaatgacaacagaagtgatcggagtgatcagtcaaccctcagagtttttggttactctggaggcatttaactctacagaatcatttaaaaacattgctattgtcaattttattaagtaaaaatcctttattttaagaaaaaaggatttgagattctcatgagataaaaattttaagaaaaattttttattttgcttttaattattttatgaaaatccagaaaaggtgcgaaaaagcatgtcgaattcttcatatttccattttgtttttgattagcaatttcaaatttcttctgtttggttgagtcgaagcggcgtactcttagagcaatttgcgacaaaagaagttcgttcagttatcgcttttgtccgaccattccctctcaccactgccgccccggacgacgccagccgaattctgaatttgttccctaaattttccttttaaaattcagaaaccgacttgtattatgttcaaaaatgctcaagacgaaacttatgacagatttattattagtatagtattgtattattattattattgttcagcgattttgaaaatccaatgaattaataactattctacataatcaaacattgttcttagcattaccgtcttgagcattctgaagtgtataaaaattgtttttgaattttaaaaagtacatttangcgttttatgtccaattttacttctctcgcaattgtccatccttcacatatactgtattgtactgtattcattgatcaccttacaacatagcaaccaattacctattntatttatacaaatgctcaattttcccagaatatattcctgatgcgctgttactgtcgggagggctctcaaaaaatttttactttacctaaattgtgcaaaaaaatttttctagaaatactaca

SEQ ID NO: 9494 - DNA, 4268 bp, Heterodera glycines
  misc_feature (73)..(73): n is a, c, g, or t
  misc_feature (159)..(159): n is a, c, g, or t
caatccgtccctttttcaccttttgtccgtttcagtttcaaattcatccccggagggagtttctccccccccncaataataccattgccattttcactctcggatttgtccctcgaggcgcaattaaattttctgtgtcttttcgctgttttattgtgncacccccttcctcctccccccccccccccccccccgccggcagatgtgtcgttgtcccaattaaaatttgccagtccattgggtcaatgctttcatccgcgtcaaatctgacagtgactggcatttgatcagtgagtgttgttgaaaggtgtcggaaaaaaaaacaaatgtatttgttaatgacagggaggataccctaaaatgacgacacaaataagtaaatttatcaaaacatttttaaatttaaaatattttactgttttttattttaatgaaaaaattcacaaatatattgtaaaggttatgaactcattttttcaatggattatgcaattcgacagctccgcctcgcactgatcacttcgcttgggggggggggcgatgggacggcggataatccggggacaatccgccacaatctccagcaaaacaattaaaatggtggtaaaacaactcaaagggtcgcaattgtctcctcgttgcgagtgtttatgggcacattttgcaaattgcattttggccaaatttagtggcaattaaatatttttgttgaattttttaaaaatattttcattattccaccaaaaatgcttttcttcccaccgccgacttcagcagcagcggcggatttgctggttgacccggcgattgacggattattacttaacggagtgataatgccaaagccaagcgaattggaacaagcgcagagaaatcatcaggtcagagtggccaaaagaggaaaacaattcaaaaggggctaatcaattttaaaaattgttaattggcgattaatatttgcaaatgttgaggctgaacagctccaacgccaattagccatcatgggacagcaacttcagcagcaaatgccaatgcgcggaagagaactgtcgccgacgcagccaaatgtgccaagtttaatcggcccattcagcggactgttaacaaccgcgcaaattgatgaaattgaacaaatcggaagcgacaaaggcaccgacatgcaaatgctgaccccggcaaattgcctaatgccggtgagattgtccacttattaaattggttcgaatgtttgccctgattaagccaatcgtcggtctttcgccaatcccttcggtgtcatttggcaacacattcactcaattaactccgccgatcggactacagcagcgtcaacaaccgattgaccacattcagccgaatttgctgcttcattcaccaggcaaaataatttattttgtgaatattccgtttcgttttctgagcttttcccccttttcggctttctctgttccgcgtgccatcggccaattttggatcagagttttttgctggtggatgaccaaaagtggcactctgagtgctgtgtttgtgtgatttgtggccaaaatttggaaaaggatgggcccacctgtttcgtgcgcgatggctttttgttttgtcaccgcgattactttgcgtaagtaactcaaatattttaaaaattgaatcgctttttaagtaaatatggtaaaccctgcgatcggtgcggcattccaatcgcaaggggagaattggtgatgaaagtgccccaaaatggaaactccgaccaaaaatcgctgttattccacgtccattgtgagtgaattcttttttatctttgatcatttttgaattgtttgcttttcgttaggcttctcctgtgtttgttgtggccaaatgctttctcctggccaacaatttaccgttggaatttcgggtcaaccgagcggggctttgttctgtgatggtgagaacgatttggatattggaattttataatccatcctcattttagcacatttccatttgaatccttcgctttcccttggccaattttcgcataaaatgagcgacgaagaacaagtaactctgaagaacttcgaatttttgaataattttttcggaatcagctccattttttgaccgatctttgctcttccaatttggggggccacggccaacaaacgaatcgcaaagttttcgagcaactttcgactggcgtaatttcgccgaataatagccaaaccgacagccgatattcttttgcggaatcgagcaaggaaaacccaggtaaattgcaaaaaatttgattaaggaatatttgaaatccttaatgcaccttgaaatttgatctttgcggaataatgagattgtgatcataaatacggtggcgaaagaacaaataaatcggagagagaagcgggggaggggggggggggggtgttgaatggcacggcacaatgtttgatttgcataaataagggggaaagggataaatattgggaaaaagcaatgcccgaaatccatcaaattactaatagcccaacaaaataaaaatttaattactctttatttaaaccaaaagtttcgcttgaccaattcgttattttatcgtacctcggttaattggcattgtttgtcatcccatttcacatgaggcaaaagcgggaaaatggcgcggatggcattggcatgggaaaggaagaaaaatgagagaatgtgaaatggggagaaaaggggaagggaatggagagaaagggatagaaaatggaagagaaggaagagaacgggggaaagagggaaagggagagaaaacggaaggagagagatagagaaaagggaaagaaagagaaataaaatgagagagaaagagagggaaaagggaaaggagagaaaaagggataaaagaatgaaagagagagaaaagggaaagagagagaaagagagagaaaaggagagagaaagcgaggaaaaaggaaaggagagaaaaaggaaaaaagaaggaaagggagtgaaaagggaaagagagagagaaaaggggagagaaagagagaggaaagagggagaaaaggaagagaaggggagaggagagaaaaggagaaaaaggaagtcgcaatttacaaaagccaatgccattttaggagcaattcaaaaagggaaaatattgtactatatataaatgatcaaatgtgaagtctttccatccactcttctcttaagtgtgccctttttgctttttctcagattcgcttcatctttcttctccttcagtgactccgaatggcaccgacgcattttgcgccgggcgaaacggagggggcagctctaatggaggcgaaacgccgggcgcaatgggcgcaaatgggcggcaaaaacggatgaggacaagcttcaaacatcaccaggcaaatgaatgaatggccaattggccactcgtcaatttggccaattaatttggccaatgaaagatctttggctattttttacttaccaaattcaaggaaatattgaaaatgcaaagcctttagcttcggacgatgaaaaactatttcgcctgtaaccacaacccggacgcgaaggatttgaagcagctttcccaaaagacggggctcaccaaaagggtactccaagtttggtttcaggtcaaactcatcccattggcgttgttttcacctttcttcttcagaatgcccgtgccaaacatcggcggaatcagcaaattcgcggggaagtggcggcggcaatgaacggcacaaatccgtcgctgaccacggcaatgtccggggtgcatgtccacgcttctctatccacctctgtcgagtgtggcggaggagccattaatggtggtggatacaggcaaaatgtgagaggggagcaggcaaaaatagaaaaaagtgccaaaaatgacaaaatatctcaaagtacaaattgcaaagtgtgccatagatggaaaaacgctggaggagagaaagccaaaacttagtaaaaattctttgattaattaaaaatgctttgcttttggccattcattccttttgttttgcttctttctcacttttcgtcccttttcagcgctctcttccgccgcctctttccgtcactgaccatcccccgccggtgccaatgtttgtcgccggctcaaaagtcaattcggctgtccaaagtccgtccgcttcggttggtccgcgttccttgggcacttcgtccgcttcttccttttcgtcgaccgaagaaaggggcgggggatcatttgagaacgaagccaactgaaagtgaacagaaaaatggcgcaaaaaatacgaaaaacgaaa

SEQ ID NO: 9495 - DNA, 1172 bp, Heterodera glycines
aaattgagcaaaacattacggtggctgtgcgaagccgcgaaaatgagggatttgtgagggcattggcaatggtcaattttgtgacgacagtggccacctttttctgtggaatgtaccaaattaggggctttccaactttttcattattttccagtggcatttgccgtcaaatttggaagcgcggcgaaacggccgacatcaaagcgtactcctttctgcttggtgttttgggcagcagctattggttcacgtacggagtgctgttgcagcacccgttgattcagtacgtcaacgcgtgccaattcgtaatttactcggcttacaccgccttttattggacaatgagcacgaaaaaggttggaacattcgcaaaatctgctgcattttttttttattattttcaaaacacagcgtccggaaactgagctcctgtaccaaaaaagatttgcatgtgtggctcagtggtttttgtaagatagtaaagggacaaaggcagggggttcgagtccgttgtgcaacatgaatatttttatttatttttgtccaaaaaatttaaaaacacaattttcggaaattatttttggaggtttttgccaaccaaattgcacattcttggtatctttcgaaagttcttgatgagtagaagcttttcccaagcaaatgctaagcatttttataagtttgaaaaaagatataagcgtttgaaattttattttttgaataattttagatcggagcgtaaaaaattaaaactcgagcgttaaaaatattcataatatttttctctatcgatatgcaaaatttggtgtaattgtatggttagaaaaaaggttatatggagagaagtaaatgttgtttttgctaataataaaaatattagatagtacgccaaaaggagacaaaaaattagagaaaaaaagataatgtttttctctggcactctctatttattggtacacatctcgttttttcggacggtgtgaaaagaaataatttttaaggtaaaatctaagtgatcagttgatgatttttattttattattttatttgttataacttatactgttaattaaattagtccatcaatttgtatcagtccttttgtgcctgatcagtcctctctttccttttgtgtctgatcagtcttccctttgctttagtgtctgatcagt

SEQ ID NO: 9496 - DNA, 2338 bp, Heterodera glycines
  misc_feature (2253)..(2253): n is a, c, g, or t
ttccccccccccccccgtgccaaattgtccgtgccgccgccgcttttcacccactttttgatcgctcatttgcgatatgttgttgtgccggaatttcatctcgtacactcggatcactttcacaatcgttttcaacgtttgtttgctgagcacgggcggaagcggcttccgaaactttctcttctttccgccgcttccgctgttgcccgtttcaaagaaatacataaatccatcaaattcatttaattcatttgcagcagattcggccaattcggagagaaactgttaaatgattaaaaccaataaatggatctgaaaatctctcgaggatgtgtgcatgcatttaaatagagaattttctttttaaataatttaaaaataaaaatactgaaatttgttcgctcagcacaaaattaccgtatttacggtatttgaacccccggggttctatttttcagcccccctcgaaaggggggttctaattcggggggggggggcgttcaaataccgtgaatacggtatatgcctttttaaacttttgaaaatatagtaataatttttaataattcaatcgataaattatgtctctaatgtaaacgtatttgttagccaaattatttttattactcgttttctccacttgaacacactcgccagtccaatggtgaggaatttggtgatttgcagacttttgtcaaatgtttgaataaaaatgttcaaattaaagtggtgggactctttgtcgaacaaattgttgttgtgctgatcagcgaaaaagtgatcaaaaaatgcatttgtctccccaatgacgccagttggcgttttgtcattcgccgaaattttggcaatttgctcagtttcactgccaactctttgatttggatggattgtccggtcatttttggcgatgggacgttgttggtcctttgtcttgataactttgacatctgaattttaaaattaaattattattactatatttttaaaatttaaattaattacagatggaaataaattccaaatgtgcagccggcctaatgatgattatggcctggaattatatgcacatgcatatttttttttcctgaactgcaggaggcctgaaacgtacgaaaaacatgtttttagctcggcttaaagcttctaggatgactttccatatgcatattttgcatatttgtgcatatttcacgatttatgcatattttggcatttcatgcatattttttgtgcatatttgagcattaaaaaacctctattagaacggcccccatcagctaaattagcctttttttacctctaaagcctggaaaattttccgaaaaatcattttttagccaaattttctaaaaaaaaattgcaaaaattaaatttttcttaaaaatttgtaaatttatgtcaaaaatttaaaaaaagcgaaaatttcgctttttgggttgatttttagctaaaaattcgtcaatcttagctttataatgtttttttcatctaaaatgatttttaataccatatttgaccacttttaaaagttttaccttacatttagcgaatttgaagaaattttaagaaattataccctcaatttggagaaatttatgtgcatatttttcactttttatgtgcatattttgcaatttttggtgcatataattccgagccctaatgatgatgaaacgaacttcgaatttgtaatataggcaaatgcttttaaaatcatgaacccatttttaattggtatgggtcgcatttttaaattaaaactagagaccggacgggattgggataccgctggattttttcggaatccagcgggattaaatttgggattcgtcccgatcgttctttcaaaatcgtcgggattgatcgggattcggtcgggatcaagactcgggatcctccgaccccagttgtccggtctctaattaaaactgatagattaagttggcatttttcccaatgttcattaaaataaacaaatttcgaagtttggattagtgccaaagtgtcaaatccaattctgatcattccgctcacagccccacctttgacgcccagtgaatattcctgccgaaaactctcaatggaaatgccgtcgaaaaatgcgtcaacaattgccatgacgtaacgcattgaaatgtcctcgagctgtttgaagaactcgtacagcggctccttctgttccggcacgcgcttccaccagccctcaaactgtgccaacattttctctttgattttcttgtaaattgtctcgangtccaaatgtggcgaaggctctcaaaactaaaataaaactttccgtaaaatttttaagattatgctctgtaacaaaatataaact

SEQ ID NO: 9497 - DNA, 1899 bp, Heterodera glycines
  misc_feature (148)..(148): n is a, c, g, or t
agaacaaaattgctacaggttgaaatcaggaaattttcagaaaaaattcctagggggctggaaaatttttttcgtgagatattattgaagtggcaaaaaaattttttcttgagtttataattttgttatggagcataatttgaaaatntaaacaataataatttttttgaaatcttttcccaatttttacctctgtttttggcactgtttccctcatcgtctccccgcgccgccccttccgccggtggtgttggcacagtttcttcctcttccgccgcccaaaacatttcctcctccaattgctccctttgatcttccgctttcaatcggttcatctccgtgtactttggcaacaatcggtgcagcagctgaatgaattggagcaattttcgtccgcagttcagccgatggatccaatcgatgctttccgtgaatttgcgccacaattcatgcacatcctccctgggatcatcccggtagatatccacttgatcggcgaactgatcagttgggaatcgacggatatttacatacattttaaagattattaggaccaacaattaaaatttgggtaaaacaggattttttgtaattcaaaccctattcatagagttgactaatttaatgcttttcatttcataaaattcagttttataattatttatttaataatttcaattaaaacaaataaattttttaggtgtccacatgaccggcgaactgatcaaatgggaatggacggacatttagcatacatttttaaattattaggacaacatttcaaataacatattttgcggatttgaaaccaattcttataaaaattgactactgtattttctctaattatatgccacggtatattattttttaacctcctcagaaagggggagataatttgagacacgggtagataaatggagacggggcatataattagagaaaatacggtaatttactgtttttttcaatttttataatttatttatttaataaaataataattattttaaaagactaaaaaaacaggacagattcaaaatcttcgtaaatttttgtttcatataaactgatcattgagaaatcaacataaattaattatgatccatacatacctttctgaccatgtcaaaacgattcgttctgttgaactcgtccaaaaagcccaacaagcggtccatcgacccatttgagtctttcgctttcacaaattcgctaattgcctataaaatatcaattttattccaacgatttattgatttttgcctcggccatttcgaactttcggctttgccttgggtcccaaatgccgccatggacttcgtgcttactgtccgccacggcttttctcgttgcccggaagagtattctcgcctctccaaccatcgacggtttcacagaaacatttgcaagtcgaaaggacaattggttcattccaaatatgtccaacacgttaacaaatgcttaaatattttataatttatattcttaaatttaataattacggcttctatttagagaccggggttttaagtgctaaaaacactgaaataggtactaaaataggtgtgaaaaaagtggaaaataggtgataaaaacgcccaaaatgccaaaataggttcgaaaataggtgttaaaaattggaaaagcccagtgtctttatgcacaaaaattacaaaagtgactaatttttttataatttcgcccgcacactttcaactggtcaagaaaataaaaataaattttggaaatgttttttaaaatttatttccattcataggggtgtgttttttcagaaatttttgggaccgattcttaggggtgtgttttccttttttattgcacttttgctatgaaatttatggaaaaaggccaaaatatgtgctaaagttcgaaaat

SEQ ID NO: 9498 - DNA, 2665 bp, Heterodera glycines
gttcagttccgtgtctccgcctccgtccaaccgctcgaactcctgcttcaaatttgtgccaaccgcgatcagtttcagagcttccaacagacgatcaatcgccgcgaatgcttcttccgcccgctccaccaaatcggcaattatgaccagtacgcggcaaagccaagcgacgcgtcgccacgcgttgaccatcgccgacttccgttggcgcagtgaaattgaaacttcgcgcagaccgctccactgaagtgagcaaaagcattatttaatcccacttatgaactcgagatttttcgggattttatttctgaaattattaaattaaaaattaattgccaaaaatacgtcgaaatgtattccccccccccttttacattaaatttattcgtttctttaggggaattttctgaaatttttttgggtcatttcttagcggtctgtttttcgttttcaatacatttgttaaggattttttgaaaatcctgcaaataggcacattaggcataaaaatcccggaagaggcaaaaataagcattataaaaatcatcgtagcctcccaaaccaagcggaaaatgcatttttcgtgcttatctgaacgtttaaagtgcgcaaaattttaagcatttgcctaaaaaaggaagccctatttattgttcttaataaaaatatatttagtaaataaaatttctatttttgttttagaaaaattcatgttttttaaatttcaagaaagttatgatttattattttccacaagaatgccataaagaaggaaaaatactattaccttataaaaatgaactctcaaattaattgatttctaattgtatttacataaatataatgaaatatacaaattaataatatttcaattaagttcgaaatttaaaaaaggattacgtaaacggaagaagaaaaggacaccattatttcgcaatatatttttttcaatcttctcttaattaaaaaaaactgatacatttctaccttcatggcctccgaaattttgttgattttcgatctcagacccggcgatccgacttcaaaataaatgtcttcaagcagtacaataaatccgcgcccttttttcggttttgcattgaatcgctctctcaatttactcagctgattaatcaactgtttcgaaatcttttggaatgacttttcgttggacacttcgccgccaaccttttcttggctttttgtttccattatttcatcatcccaatacatttcaatcagttctccacgtggagttttagcacttttttctaaattaaacaaatttacagtaaacaattatagtatgttcataatttacggatttgtttatttttttcttattgaagcttttgtacataagttacagtagcttaatttgaaactttctactgtcgtattttccatgagccaaatgattttataaataaataatttaaaaattaaataatttgtttgttttttttttttgccttcaattggtggttctggcaaataattgcacttttcattcattatttgttccattaaagtaataaatttgtcaaattgttcactcattttccgcaagaataatcgttcattctttggggtttcctttacaattatttccaatttttcaatagtttcattaatttttttgtgattttttgttcccatttttttgagcacatttcgtccgttcgaatttctgtccataaaagtttggcttagatacatttgaattcgtttgtttctgttcggctcttttagagccaaccaatgctttagcaattgttccgcaatttggcaatctgacgaaatatttcattattacttagagcacggatatgtataataatttcataattcaaaattacaatatgaattggtgttaacctatggacaaatattaacaaaaatggcaaaatacggcgtaaatttctcaaattaaattgatataagattcgaaatttgaggcctaaatttcgatattctaagaaatgctcgaaatacttgaaattttaaaattaaattttggattcaaaaaaattttatgctaatgcagtttcgaaattataaaaatgggttcttatatagcaaataatgctaaaatggaaaataagaaaacttcttactataagcttcaaaccacgctgaaaatggctatcattcttactagcccaaaataagcttgccgaaattttgaaatcaacaaattctttatataaagtagtgaccggacgactggggtcggaggaaccccgagtcgggatcccgaccaaatccagaagattttggaaaagtaatcgggacggatcccgaggtcgggatcccgaatttaatcccgcgggatctctaaaaaatcctgcagaacccgactccgtccggtctctagtataaagtagaaataatattaataaatggaataaaaaaattaaccatattttgaatggtcggatgatgacacattatgctcatttgccgctgctgaatcattcgcaacaatttcccctcggggactgatttttagcgcttgcattggcgatcgaatcgacggacttctttgaccgatgttcggtgatcgaagtgataaatgttcttgcatacttatgggcgatgatgattcgctactgtttctgtcgtgatactgattttctttaccgccccattcattgttggttca

SEQ ID NO: 9499 - DNA, 4224 bp, Heterodera glycines
  misc_feature (70)..(70): n is a, c, g, or t
  misc_feature (4206)..(4206): n is a, c, g, or t
tccatttcatctattgctaattgggtttaattatttatctcccctggttttaagcacaatgaatgcaccntttcacataagccttagaatataggcaccaataagccaaaaacagaactaaaattcaatttttccaaaaatttcttaaattttaaataaatgtactgaccacaaatgcagaaagagttgggcctaaataataatgatttgtattttatataagtttattaagaattgaaccatttcgaaagttagttttaaaaatgaaaataaaactttatagaaattaagaagcatatagattgacaggtgactaattctaatttaatctcggatcactctcgtagagtaataaaagagaaaatataccaaaattatattacaatttttttaaaattaatttattagcaatcagtattctgcccccctcgcatatagcaaaaaaaaaatgaaaattatttaaaataaaaattcacaaaaaaaatttagaacccacctggggtggaggaaaagcatacgcttcaacaggaagcgcgtgtccgtcttcacacaattcagtcccgcgatggattttgctgccgcgtccgtgctgaggcgtgagcgcaaatgcaacacgcgtggtaaccagtatagccggaggaacatcagtgcgcacgcgaacgcgtcaccaccgcatggcaaacgcaaaagcggcaatggcacaacggcacacagaacaagttcgagcagtatcagcacccgttggcgcaagtggaccgcacagtgccaacgcttgattgagttcacatgcatccgaaactgtgaagatgggttgaaaaacatttggacaggggctagttagacatagaaaatttttagaaaatttcgggcggaagggccaagggctgacgatttaaatttttcgcatgattttttttccaaaaatcgcatcgccgaaaatttctaaattttattcgacttataaaaagtttgatgccaaaaaattaccaatttttagctatagaaaatttgaaaatttcaagaaattaattattgtgtcacactgtctgtctataggaacaatggtaaaaaatttaaaattctaaaaagtattacggtattttaaatatcttgtctaaaatgaatgattttttttaaagtaatttgtttaagtgccaactctattttatatgcgtttacttttgcctgtagcacatggtagcgtacagtaaccagcagcagcgttacagtagttactgctaatgtccatcgcatcgcttcatccattttttgccatttggccaaaccgaactccatggccaacaccatgaacataatgccaagcaatgataatgcaagtgccaactcggcactatgacgacgcgcgtacgccaaatgccgaatacgctctgatgttgatgttttattctgctggggaagtctgaaaagaaaataattgacaatttggtgccgtcattgccacaaattaaaaatttacttttaaattattaatataaattatggaattttaaaattttaatcgcttagttaaactattaaaaaatgtaataaaaaaaataatcacattcattttcataaattttattttatttctaatattggaaagcttaaatctttttcattggccagaaaaatttttcttaagcagaaaatttataatattaaacgaacataccgtattttctaaaatacagcccccccccccctccctaaatcagaacccccttgaaataaagccccccttttgagggggcttgaaaaataaagcccccgggggctctattttaggaaatatagtaaatggttttgtaaaattttactaaaaatatattatttaaaaaatgtttaacaatattttttcagattcatatattaattaactaattatttattacctcaatgcccatgaaataatacaaaatttgttttcggcttcttttgacatatttaaatatttttttttgtaaaatactcataaataaatgggcttaagcattgtgttcattgttgacttataatacactcaaaattcttaaagcattattcattcattaaaggccacaaaaaagatcggttgctattggatgcaaattaatgaaattttaaatcgaaaaattttaccaataattcttccattaatttgtgatttaaaatgaaattaagtaattattttttaatttaatttactgatatggccgcgcaatgacatttctgttgtacaagctattcaagcgtcgcatgtcttcgttgcttatgccaaaatcgaaaatgttcgtttgttggccaatttgagttgttgggccacaactgcacactaccgccatgccatgttggtgcaaccatcggcataacacctgctgacgaaatgattaattagactaggccctgttgccagaaaataactcgagatttgccggaatgctgatttacgacattttgggactcggaattccggccgaaattttttcagtcgtcacaatttccgattgccgaatttttttgagggagtcggcacactttcctggttttgacctttttttttgctcattggccatacagcattttccggtcaatttcaaatttatgaaaattgatactcaaaaaattcacccattatttcatagcattttatgaaaatatttatactaaaagaaaattttaatttgatcaataaaaaagcacaaaaaactatgccatagaagctttaaaaacaagaaaacaatatgcttttcatacatttggtattgtaatacaaattctcttcttaacaattagaaaaagaaaaatatttgaatatcaaatttaaaattttttaaatttgtttcttaattggcaatcagtgagtgcctgttgccacctgtgttgccgatttgccatatttgttggccatttcgcgcaacagtgtgtggtagaaaccgcgctgttgctgtgagccaaatttgctgcttgcacccatcgcatttgcgcgaacaattggcaccactttatggtgactgcacagtgacaaaacatcatcaaaattggccatcaacggggccaaatctatctaaaaaataatggaaatttaaggggcttttttggtgtactgtattgttataggactcaaataataatgtaatatggtaccgtatatgtatttcgtaaagtcatagatacatacttacttggtcattttaatttatttggtaaaataatttggttgcatttcggagatagagcaatttgggattttttctgtttccaattactaattttcttaatttgaaatcattttgtaacaattaatcagcatcgattaaacaaaaagtgatttaaagcaatttgaacagcagttacagttgagagtgttcccttataagctgtccttactcattcaataagctttatcgataatttcgtattgaaccaaacctcaaaagtctcaatgatagtaatatttaaatttaattgtaattttaatttatttgcagaataataaattataacttagtaaatttcattatatgattagataaacgaatgttctctattagttagttaaaatttgattaagtttgagttaagaaaatgatttcttttttctggaaataaaattaaaatattattaaatcaaagacataaactaattgctttacggtttctattcaattgttttgagtggatttatctatgctgtctgttaccacctgccaacagtgaggtcgagttttggcacgttcacacaacagcttgaccatctctatgtctgttcggcttacacccaatgctttgactttgccgtcattgtacaatcgttccgcaacactccaagcattcattagcacatcgacaggcttaattgttgcagttccttgctcaagatgatggtcctccattaagcctgatgttagcaatgtgttgttgattgccttaagaatgggggacaaaatgaaaaattaaaaaaaaaaaaactatcgtattaagataaaaaattaatgccctaaaatttctggtactcaaacgtatgctcaaacggcgtcaagtttcaataaattttgtttggacctttttttcgtgtcgatgttttggtccacaatcattgaaaccgaccatcaataaacttacatagtctgttttaaggctattcattatattttcaatttttttttcttgtattttatttttgggtatcgtggcgattaattaatctaaaaaaattaattattnttattattttttctttta

SEQ ID NO: 9500 - DNA, 2124 bp, Heterodera glycines
aatcctagccccattgacacatttaaaatcaaaggggctagaattttgtagtaaaaaagcaaaaaatgactgacaaaatttatcgtaaaaaacataaatatgtaaaaaaaatgtggaaaaaattcccttgggaaaagcatggtgaaaagcggcgcattatttttttcctcgggatttttgcggcataaattaggaagatggcactggtgccgtcttttctttatatgtgagccgccttcttatcgattttatgcatatttaacaaaaaaaaaggcaattattgcggaatatttaaaacaaatttttatttaaaaaaataagaaaattgacaaaataagagcttttcaacatatgtcaaaagttaatttttcttcagcagcacaattccttttaggaagtcaaaaaatgtcataactcattaaaattagtccatctgtcatgaccatgaacatattgtgtttttaaaaatgacaaaatgggcacaaaaaaaaataataatttaaattagttttttaaaataaattaaataccattccagtgagaggcatgcttctgtatattcaaataaaacgaaattatggggcgttaattaaaaaatatcctctcaaaaaaacatttttttaaaattttttattgtggaatagttaatagtttactacttttttactgctatgcattttacgttatttaataattgaatattaatgattatgggctcaattgaagcaaaaaggaagaactataattaatgccttcttctgtgattttcttcgccataattataattttaatgcttaatattcatcatgattatgttttaaataaatctaaataataaataaattttatttgagagaatactttttaattagcgctgaaattattactaattagaattaaaaatattatacataataaaagcctgaagaaatgtaaaaagcggagataaaatttttaaaaatttgtttacatagcaatttagcaatattcccaatatttgttttcaatgaatgaagtgttataaaaacggattttgtgttaagtggtgtgtgagaaacttttcaacattttttttactagcataacatttattgtagcaaaaaaaaactttgataaaataaattcacatccatttttcttaaattgataaattaacatttattcagcaaaaaaaaattagataaaataaaaatttctacatccaattttcttaaattgaaggtccaacaattttttaaaattaacatttattccgcaaaaaaaaattgaaaaattaattaaaatttttacatccacttttctttttaattaacaatttattcatcaatcaaataaattgataaaaacaagtcaaattctttgcgtctaattttcttaaataaacggcccatttttcaaaagaattaaaagctgctgttaaaaatttcacaatcaacaatttgatttcaccacatttattttgagtcaaaaaattcgctgacccacaaaatgtccaggccacgaaatgtccaagtctcgaaattgagttttttattattcggatgggcctaaggttaggcaaaggagtaatataaaggctatattcgtattcagcgaccccgaaaaccctaaaaaccccaaattagactcattttgtttttataaattttgaaaaattttggacatttcgtggcttggacattttgtgggggcgccaacaaatttccctcattcttcgcaaaggccccccgccctgaacactactcacactcatcattcattgttgagatgaaggaattgattggtgttagagaagttaaacaaataatgtatgtgtgctcagaatgatgaactgacgaccatgacaccctcatttgcttgagacattattcattatccatcaaatgggccattaagtatttttaaatttatttatttatttttttgcatttagtaaatccatttttatgggttgttatgttccgcacattttgaggcatcgaaaattttttttgtttttgttgttgttggtcagtttgactgttttcactcttctgtggtatgaggagacaaataacgggtcattgattaactggtacggaaatattgtcgacaaattgtttatcgacaaatttatgtgcggag

SEQ ID NO: 9501 - DNA, 2067 bp, Heterodera glycines
aaccctatctttttggtatcattcgaaagcacaaagtctatagaacctaaaatacataaaatctcagcgtttaggcaattgccaaaaaagatatggttaattaagtaattgttgattgttttcgtttgtaaatttctttaaagcttagcattctcttgtttttttttgtattattacattcgtcagactttgttgcgttcgaatgttaccaaaaatatagtaatgtacgttgtcgaattgtttcgaattttttagagcatcaggttaggtaaatcggtttttaaaatggttaaaaagtatgtggttaaaaagtatgccactttgtctatcaaatgaaaatttttttttcatttttttgagaataatggaaaaatatgaatgtgattctattttggtttctgcacgtgattcaataaatcgcgtccaaatttcctgtcccaaaaattggaataggatgtcaaaatgttattttgtaaaagcgatcgatggtttcgtgcataaattaaagcctccgatgtcccttctcccctccccaccacttcttttatctctcatttccctttttcaaaattttcagtggtttgctgctcccatcacaatttatgaaaaactttgttttttttggtaattttaggctcccaagaaaaactgaaatttattttaggcaaattcggctgtctgatacaaattatccttgaaaaaaagaaagggggccaattaaaattgttggtgttccagtttatgtttcgtcggcactgcgctttggccaaatggttgtcgctcaatccgtccgtgcagtacgcgttgttttggacgcggacatgggcgtgatcaatccggaccatttgttggagcattttttggcaaaatttgacaccgaattgccacacggaggaacaattgacatggttttctatgagcgcattttcaacggcgaaataatggccggaagttattgggcacggaacacacgttttgccattgaaatgttgcatttttgggccaatttcactgtgccgtcgcgcaccccttttcgcggaggcaccgacaacggggcaatccatgtaattttgttgggggatcgcaattagggattttttatgggcgcaaaatagggaaaaaatgccagattgcagcaaaagttttttttgggccggatatcccggctctattgcagttcacacaccataaaagagacgacaatacatttttttgtaactttaatgcaccataactttttctaaaaggatccaaattaaactttcttggtatcattcaatagtccaacgaattctttattagtctgctaaatttcaaaaaatttcattatgtttcaataaagctatggccaaaaatgtttagaaaaccaaatttttgaaattttctggccataaattttttgaaacaacgaatttttttttttgaaattttgcaggataatagaggatattaaatgctaccgtatgataatcaaaaaagtttaatttggatgcttctagaaaaagttatgatgcattaaatttgcaaaaaaatttatgtcgtgtcttttttttatcgtcgtatgaactgcaatagagccgatatccctccatctattaaatgtttagcgaataaataagaattttgtgaagaaaaatggcacttttccggtttagggctcccggaataaaggggagtcccttttggattgaaaacttcttgtgataattagtctttcaaatttgttctccgccggtggtttttggggtgctaaccaagaatctaacaacaatttttgacgaaaacaataatcccgagtacttaaacaaaaagtctaaagttcgatttcagtttttggttcgaattctggttacaattcggaatttgttgaaataaatgtcagattcatgaccagcggccccgaaaattcttgcgaacaaatttgaaagtctaattatgacaaaaaaaaaacaaacgaatttttcaagcaaaaaggttccctccgccgttcatccattcaccagtgtttaggccgtctttttgaacattatttgtgggcaacatggtccgagcttagcgcccgttgct

SEQ ID NO: 9502 - DNA, 1620 bp, Heterodera glycines
cgccaagtctaattgaagtgcaattgggagtgcaataccgttaagagcatcgttggcactttcaaatgatcagagggaacttccttagatttgtgccatttcggacggagcatttcgcgaagtgaaagagactctgcagaacgtcattttggacaacaactgtttggagcaggtgcccggaggagcactggaggaaatgaacgcgtaacgaacggataaaaggcacaaataaacggccaatgctttcctttccccttcagtttgatttcactgcacatgaagcacaatcaggtggagggaagtgccgtggcctgcaaagtcgtgccaattcgttcagattgagcaattggacgatggccatctccgcaatctgagcagcctttcgttgctcactctcacgggcaacaaaatttctcaaatctctccgaattttgcccaaaatactccgaatttgcgttacatttatttgggcgacaacaaattggaacggatcgacccgagctcaattaagcaattttctgcagccgaaatcattgacctcagcttcaataatttggctgaaataagcgcggaattgttcaacggaatggaaaacctgcaggtgacggaattgggggagaagcggcgccttggagaacagctgtttcatgctttagcatctgaacttggagtcgaatgccatcaaaggcgtcgccgccggcgccttcgccaccactccgctgctccttctgtggctgccccacaactgcttggactccgtgtcgcccaacatgttccaaggcgcgcccttcctcaagcaagtgtcccttgcccacaacaacatccgcactgtgcaggtcagcaaaacaactcgcggttgttttaacctctgcccatctgccaaaaaacccaccaaatactttctactacttttagccgttcagtttcgcccatttggccaatttgcacactttggatttgtcccataacaaaatccaaagcattcagccttcctccattatgggctcagatttcctcacagtccgagtgcaaggcaagtgacaaagagcagcagatgaggcgaccaaacggacttttcttcagagaatccgctcgtctgcacccaagacggtttccacgtgatgaacggacgagaagcgatcaatttgacaacagaagcaaacctcatttgcaagacgaactacggaaacgaagtggaggacaaatgtccacgaaaaccggaaagtgtgccatggaagggatgttgtgaaggtaaataaatgagcagagaatggcaaaagtggagacaaaggcacaaaaccaagcaggaacggcacagaaaatgaccataacagttcaaccggcaacagaaacaacaacagcattggtggaggagcagacgcaacggacagtgccaacaatcggtggacagcagccaatcagtccaatgggtacggtggtgccatcatcagcaactgtcgcttctgatgaccgaaccgtcgaagcgacaatcacttccacggcaccaacggacgagccaataacaaaggcaaaacaactgaacatggaacggttttatcgactgtcaaaacgacctgaaacagcgcaagtcaaacatcacaacagcaggcgaatgtttcc

SEQ ID NO: 9503 - DNA, 4960 bp, Heterodera glycines
  misc_feature (4903)..(4903): n is a, c, g, or t
  misc_feature (4908)..(4908): n is a, c, g, or t
cggcacttccaaaacagaagcagaaacgcccgaagcagcagaggggcgaaggggacgccgcgctaacgagtgggagaagttccgactcggaaaggcaaacaaaaggggggggggggcagaagtaaagtgtatgcaaccgaacccccaattaccacgccactccagcgaaggtggtaaattcataatcttgcatacaatcaagaaagtatcagcctgcaaaagttcaaaaatgttttcggggaattcccagggaaaaataaataattttgcatatgaataagtacactaatataaccaaaaaggattaaataatgcgaatatgagcccgctttaagactgtgtgaattttcagaatggccaagcaaatgctaactacggacattcggaagaattctttgccgtctccggaatttgctgattcattagaaacaaaaatggccaaacgccctcttcaggagaacggcgagttcagcagggacgaggaggcagcccacgtggaggttgaagagaagaagccgagccaaaaggaagtggtggccaaacagtgagtgaccggccggcacccatacgatgcttactcactcactcatactgtatttaacattgaattcccaaatatttatttttcataaataacagtacaactccagttcatcctccccatcccgtaattcagaaagaaacaaacaaaaaaaacaaaacaaaaaatatggcccaaaaactgccaaaatagatttatcctcgtttctggataggaatgggactgttaaaatctagaattcggtaaaaatttagttatctgacaacagtggatgcgaaaatttgttgcataatctcagggatttgagcagcgtccattgcaataaaagttttcccggcgggaagatgcctttgaagactaaaaatgaagacatttgttctgcttgtgaacggtttgcaactagtgacaaactttttcgcctgttctcccaacgatccgatgagcacaatgaaagcgttgacactgtcgcccatttgcagcgcacggctcacttctgacggtcgaattccgtaacggtccaaattcgcgtcggagagcagcacgacaaatttttcatcgaagtcattccctccgcccgtgtccaactcgcgaaccgccagcgaaagggcctcgacggtgtaatcaccgctggtgcaaaattgggaatgggccaacatccgtttcagcacgttcagccgctccttctcattggcgggtcgttggtccaacgtaacgaagggaatgctggcactttcgcccgaatgtccataaatttcgtactaaaaagggcaaaagaaaagaggaggcggtcactcgcccactttcactttgtcctccttcccgtcgagtccttccatcaccaacaacgccgcctcaagcgaacgttgtaaacgctggtcgtagccattgaatctgtcaataattatttagtaaaattaagatataggtaggtaattttataaaaaacaagcaaagaattcaaatgaacagtttgtgagtgcagcaccagtaagtcatggctcatcatcgactgacctgtacatggagccggacacgtcgaagcacagacgaattcgtttcggttgttgttggtttgagggatcgggcggttgctcaattcgcttccttttacgttgtgttagggttgggtcggtccccccccctcaccggtaaatgtttctttcgccggccatcccttcgatcagtttggcatcgtccaagtctccgctcgtctggtgcttggcccactgtctttcgtgcttccgctgctctaacgagtcgatcacactgcgcagcacccgcacttgtcggcccacgcgagtggccaattcttcgtatgccgccgcgtcgtattcgcccatgtcaatttccttttaaaggcccattcattagacgccaatcaaaagctgattgtgagtgcgcttcatttgcctacttttagtcgcttcgcatattcctctctggcgatttccctcgcccttttccgaatgtgttctggcacttgctccttggcactatccggcaattgatgaaccgcatggccggcatccaaactttggcagaatttaagtcaatgattaattgcaattaccgaaacggaccaccgactcctccaagtccggccgtgttgtacccccctgaaaaaaaaaatcggagccaaaaaatcataagacattaccggtgccacccgcccaagtgtttccgccgacatgtggcacattattcggatcgatctgttgaataataaattcttaaattgcatttgaagaagaaacctttccgaatttgggctcgtcaattttggacaagtcaaaaacggagccgtccctttcaatttggacgcgttcttcttcttctccttgaacacgtttcatcccgagaattcgaccccaattcccataagcatcagacggaccaatggacgacgaaagaccgacacctttttgagagaataattaataaaacaactttacattgtctgtctttttctaaccaatggaaatgcctttgcgctgaaaaacttcaccgatcaattgggcagtgtccacggaataagcgtcaaaatcaaacacatttctgatcacttcaggcaaagggtcgtcgggaaatctcaaaatgagtgaattagtaatgggacaacagattcaggacaatgaatttgaaactcacttttgcaagtgtttgacaatgttgaccaattctcgcgtggaataggggtaacttatcagttgctggtcgaccaaagaacgtaagtcgccaaacacggaaacgagcagttcgagcacttcctgtggaacatctgtcgaaaggtaagcaaaaaggccgtcgtccactcgcctggtccgtatttggaaagcatggccaactcggactctttggaggggttgtccaatgcgtgtacggccaaaaggtcacccaacagagcgtaaagatcgttgccgaggaagggaaagccgggccgattggcgaggagaatggcacggaattcgggatggacaactagcggaacaaacaaattggacaaactccattgtgctcaaacgtacaaatatcgttgccatcgcccttttcgctttcatctccctttttccgttttccagggcaaacccttcggccatccgaaagataaaaaggctcctcgtccaacagcgactttaaaatggcgacgacgtgcagaggcgccttcgcaaagtgaaaagataaaatgacaaaaatgagtgggcactttgtcagcttcgtcaatgaccagcacaagtccgtcgcagatggcctgcaccaggggggagtcctcataagtgagcactccgtcaacgacggtcgattggactgtcaacgattggacggtggtgtctctgaggagaaatgccattggaaatggcctttacccaccaccgctttctcccttacctgtgcaattgcatgtatttgcgcggtcgatccaaaagttcgagcagtcggtcagtgactttgttcttgcccaccccttggttcccgatcagcaaaagatgcgctccgagatggaaatcgcgtgccatgttcgccataacaatgagatgctattcgtggggtattgtggtgtgaaaaccttcacttcctacttggggattgtcgaagaacagagttgatgggatcattgcttcgtccgccggtcggcccccaacttttgtttcactctctccgaccgatgacattccatccggcacttccgccctcttcctcatcttttccaattcttctttctcaaattcggcgtgcttcttcttcccgtcgggcacaatgccaatttcggcgagtgtcgcgtcaaatgcgcgtcgaacaattggcggaacgaaacgggtcaaagcggcgcgttgaacggcgtcgaaaatgccctcttcggggtgagcggaatggcgacggaggatgtgaatgagacgacgcagcgaaagggaggaggcgatggtccgaatctgaagaggaaaacaaacacaagaatgagatttaaataaatagcccataaaagtcacgaccgaagcgtcgtgcgaattggacagccgatcgattagtcgcaacaatcgcttcgcatggccaaccgatgcattaggaacacgctgctgaatgatgcgcaatcggtcatcgatggagagactagggagagagcagaataggaactgggacagaagctgagcattcagccattttggagcggattcggagtcgccgagggcgacaattcggaaggaatccgggattcggaagacatttctatgaaaaaagaaattgaaaatgagaaaggaaatgaaaaagtaagccattcagaaattaacagattattatccacgctttaaaacgtacccaccgatcgttaagcatttgttcgctcaatccgctgcgatgcttcaaaagttcaaagtgtgaattgccgactaagcgagtgccattaggcagtgccaaaaagcggtgatggacgagggaagcgattgactcggcggtgctccaatggactgaaatggcaacaatcattaggcaacaatgcataaaagttcaagaataaatgctcgggtttcccacccctgtcgactccgtccaacacacacaacgccccgcgtttggccgccctgaccaattggttgtcctcccattgcgtgtcgccgtttggaagaattttcctgcgctgaagcaactctctgctgctcatgtcctgcaaaaatcagttgagtgtttgtcggttttaagcgattacctggtaaaggacgatcgtttcgacgggatagcccaaccttttggcaaattcgttgaccaccagcgatttgccccctccgcgaacgccgagcagacaaaagtcggaagtcgagtggagaaggaccatttcggccaaaggacggtcaagcgaagctgaagagncaaanccagcgcaaaaaagaccctcgcggacaaagcgacccgaagggacctcaaaga

SEQ ID NO: 9504 - DNA, 3692 bp, Heterodera glycines
  misc_feature (3599)..(3599): n is a, c, g, or t
  misc_feature (3626)..(3626): n is a, c, g, or t
  misc_feature (3648)..(3648): n is a, c, g, or t
  misc_feature (3682)..(3682): n is a, c, g, or t
tttttggatcacggtcacggtcacgattcacggtaacaattcacggtcacggtcacgattaacggttgacgggttttttcagtcacggcgcatctctaatgagcagctctaccccgatattttttcctactccgcaaaagttttttagaatttttcctaaaaaatcttaattaattttttttataaaaaaataaaagaaaaaacagtaattttttgaaaatttcttaaaaaactaaattagcataaaaaaacttttttcttttttgaaaactttcttagttagtaattaaagaaatatttttctggggtaaatataattcatcccagataatttctggttaaggggctcttgaccgaaagatattaacaaataagtcgaaatggcacgactgcaaattatggccttcaaccaatttaaatttaaatacccaattagcaagtgccaaaatgctaaatggcgctttgttggaattttgggacgttttacctttactgtgttaatggttggcatttgcaacaactcgtcgacagaatgatcttatgcagcagaaatttcaggttcaagcagtttcacgaactgtgcaaccattctggaggaaagtgcctttatgcactcatttaacagtccaaaggggccaaattcttccgaaaataaaacatctgcttggataacagcctaaaaagtgaaaatttaaaaaatttcccgtattttttcatgttttttatagttaaattaaaagaaatataataaatattcattgtattattttcttgattcattttatattattaaaaaaatatattgttattatataagttaaattattttttttaattatattcaacgtaaataattctttgaagctattaaaaatataatttgaatttaattttgttgtagttggctgatttatatttgtatattatttataaatattttttatatcttttaaatttgtattcaaattaataattctatgaagttatttaaatataattttaatttaattcattaatatattacctcgataaattgatgagtccgtttttcgttcccgtcaaattcatcaaattcgattgtatccaacaactgatcaattaatgtgacacgaaaatattgtgccaaaaggcttaaactgtttacaaaaattaacatgatttaatgcaaatttttttataaagtaatttttttaattaaaaaaaatccaattaaaagcaaaattatataaatggcaccccggaatgtgccgatcgacgagaaatcgcagtgccatcgatgtgcgcgagtcgtgaaagtgatcggaaaaaaatatggcttccaagcagcgttgttctcgaagcagtagccttagcgcaaaatttgggctacattcggatggcaatagttggccaagtcgagagcgatcccaaacagcggaggaagatgaaggacgatcggcatcgcactaattagataaattaagcaaaaataaatttgaatatttgtttgttgggtcatactgtaattatacggtctagatcgtttcgtaaaaatagccaaatttatagatttttcgagagaaattcgtcttaatttttctccaaattaaataatgttgtggtataatatgatagctgttgatttatttattagcatgaaaaacttcagataatttcattcagtttcaaaatgttggtggcaattttttggatattttttttataactttctgaaaattgaatgaaaatttctatgctaaaagattctaagattattggtttggatgtgtttaaaaaaagatatgacagttactctacaacattgatcaaaattattcaaaccatctcatagaattttcaaggatgaaaaaaaattaaaaaaaaagaaaattacctcaaaattttcctccccatcatccaactctgcgcacaccatcagatttggcaacactgttgatgttgccactcctccaggcactactgcttcaacatgatggcaccggttcagctgttcaaaaaggcgggccaagtcaatgccgagataataagcggcaaggaatctgtgataaattgagtaattagaagattttttaaattttatttgttttaaaataaaatttattgaaattttcaccgaaaaatttaattgattcataaattggctaattaaggaactgcgttgaaaccaatctattattacctggctaagtctatgcgtgctgagctggccgtgtttgacttggattggatgagctggtgtaaggccggtgccgagctgagcaaggcgaacacacgaagccgaaacttagcttccaaatcagtgccgggtgaagccatcattttttgttcaatttggcatcattttcattaaattttttgaatttagggtatggcatattgaaatcgcaaaaatctatagatttaaaaacttgaattcttatttattgcggcacaatttcataaaaaaattgaaataaatttcgctattaataaataaatgaataaataattttaaaaatactttttgggatggaatatggcaaaaacttccaaaaaattcaattatggccaatgaaattacttcgttttgatgtggtattgggaataatttcaggaagagcattggtggtaggagatgacatccgctcaaacattgtttgcctatttttgtggaaggaagtcaactcatcctccgccgttggttgcatgaatttttaaagcgctccacccctccccgcccccctcccccctcccctttcggcattttgttttaggaaattttggcattttaccattgagaattattttaaatttttaacaatccctttatctcaaattttgtaataataaaaaattgcgaaatttcggttttgtgggcatttaaaaaaaatttccttaaaaagtcctaaataattgctaaatattattcatttgcttttgtaatttataaattattgtcgatacaaaataatgcttatacttttgcaatgccaaatgttccccaactcttggaaaaaattcgtaaaaaatatatttttttttacacttaatatgtttgcatgtggttattggtattttttgaaaatgtgtgcttggtaaaaatttcagtttgaacaattcacggaaaaatgatgtgaatttaaattttattccagggtttaaaattgagaaaataggtaggtcatcccaaatttgggttagaaaatttgcttatttcaatatttaaatgaaaaattaatatgaaagaagcattggcactagccaaaatcgaataacaacttttattcaaaatcaacaaaaacaaccaaaatggcattggcacaaaacaaaattttgttcacgcctccgcgcagttggcacaaatttgagcacaggtggtcacaaacaattgaagggatggatggcacggcacttttggcatgcataattgagtgaacaattgaagcggcatgcgcagtggacgggcagaaaatagaagtgggaaagtgataaacattaccaaaatatttttgtttaatttgaactcgctaattaatagtttttttaaatattaatagtcacttttctccgctgcttttaattaattaggcagggacacacggggacagtcttttaattangtcggaaaggatgggacaattgattangactttgaccaatgattattgntcactaattatccaactccgtcaaattaatattnaaactcaaat

SEQ ID NO: 9505 - DNA, 4133 bp, Heterodera glycines
aaatgccaaacaaatataatttaaaataatatcaaatggtcaaaagtcaactgatcactacattatttgtttgtttcctttaaattaaaaattaattattaatttgtatttatttttaaaattattattccgtttattttaattttaaaaaaaatcattaaaaaatttctttatttttattttctaaataaaaagttattataatttttatcattatttattggtaaatgcctttttttttgttcttggcgaaaaactcgaaaagagccttttgcatttgatttaaatttataataaatttggcgttttgtccatttatttctctctccttcatagacatagacaaaacatttgtttatttgcctaaggaacatattagaacaaacattgttgaccattgcccatctttgtctctttttggcatttttaaagtctcacatttaagcaaatgccatcggcaactccctcgtcggcactcggcgagctttgggagcagtgcctgcaatggttgcgcagtgccggcgtgttggacccgcgcgagcagttcatccgattggccgactttgcggcactgttgcgcaacggggtgctactgtgtgagctggcattgcgactaaagccggacagcattgatcggcaagaaattctgatccaatatcagcaatctccggcgagttttatgcccgtgaattattgttgtaattcgtcaggttgatcagtaggacggggccggtgatcagaaaaacccaataaatcggccgatataagactataaaaagggcatgattttgagaaatcctagctgatcagatcagaaatggcaaaatgctatataaagagattgggaagaggaagacttccctgatcagcattactgatcaaaaatggcaataaaaattatcaaaatgttcgaaattataaataattattaaatacatgccatttaatcgatttgtatgttgctacttttcaacaatcaatttattgaatattattatatcttattcataccaaagttaactgtttccttaggtaaaaaaatgggattagggagaattttgcttcaggcaaaaagtaaaattactattgcctgaggcgaaaatatttaattaaaatggattaaaataaattatcaaataaaaatggaaatgcccctgaggcattaaaaataaataaatttaaatcaattgaatttccaactatttccagttcacttgctcaaaaaatattggcctctttttgaacgcgtgccgtgaacatttcggcattgagcagcagctgtttgatgaggaagatttgtacgggctgcaaaattttggtgccgtcctccgtctcctctcccaactgtcgcgcacccaaacatcgcgtcagctgggcctcaagtttgttgcggcgcctaatagaggggggaggtgtccttgactcttgtaaaaactggaatatcatgggataaggaccgaaatcctggaaaatccactagggtcaataatgtcttatccggattaacttatcaaattccaatttaaatttgtctttcattcataaatccgatccggggatttaaattttcaggctcgcttaaatgctatggatgtccccgggggcatatttttttaaattaacaaaacatgattaagctcttaaatgtttggccccatgcatgtttttcccatatgtggaaaaattttattcgaatattaaaataaaacaatttaggcctgcctataattccattaagtttttcattgccaaaatttggaatttgcgtcggctagaggagcctggattttgaaaaaatcctgactaattgtaaggcccggatttaggagatggacccggaccagatccgggtctcaagtgtcggcatgttaaaagttggcactcgtgtccattccacaaaattcagaccatttcccgaggagaccacgttgccaagtgtgttggacactgcggaggaggaggacaacaccatttacagcaacttgcgcgacgaagtggagcagtgcaagcaacatgacgttgtggtgaattactctcggcttaaccttggtaatagtggcacatcggcgaccggcgacggcacaaatgctgctgcttctactgctgctgctcaagatgaacaccaacggcacaaggaagaggaggatgggcaaaagatttacgacacaatttgtggtcaagcggtcgtgccacagaagggcagcaaaacattgccaattgtaaataaggcggggccaaatttggggccgggctggctggtgggagactgacccttccttcaaaaacaacaacctatttcggcttttaatgcgataatttaataaaatgaattaaatccgaatcgggctaattctgggtaattaatgggttaaattattactaatgagtttactacaaatgtgccgttttatttgaacattcgcgcagagttatgccgagttcaagccaacaacgaagcgggaattttgcctcaaggagcttcttgacaaggacatcaattacacgaatgccctgaggaggttcaaaaatatttttaaaaaacatcttttttttggctatttgacgagtgatttatatgaattttttggctctatgttatggagaaaggctgaaaaagctcaaaaaattatttctgcatcaaaattttgaatttatgaggtccatataaatccatattttgtgggttttcggggaacaactccgcttaatttgatatttttggggttttcgccattaaaatttccaaaaaaaaactgggggtctagcggtgccgttagacgtagggctcagccttttaccattttttttggatttctaatccatatttcgggtgttttaatccatgttttatgccctcttttgatatttattttttagtccatattaataaacactcgccctaattagacacataattcgtaatttccatcggctttaaaaaagcgatttaaacaaaaacaatttttcccattcagaattgaaaacattttctacgctcgaatgcattttcatttgaatgccgaagatttggcaacaattttcattaacattcgcgaaattttgcggctgagcatcagttttgtggccaaattggagccagccgttttgcatgcgcttaaccttgctgacagtcgccgaaatacggccaattttggcactggcgttgctgacatgccgcccctcagtgtggccgagctgttcataatgtgaacaattaatttttaaatcatttgctaaatttcaaatgccaatttgaattccaacaaatttcgattccttccaaattaaaaaaaaaaatttaatgcaaaacgtttatttaaaatacttaaattcgacatacatttattaattataaactagggttgagcccccgatcctgagccacgattgaaccaatgtttccaaattttgcattttcgtctcgcttatcgaaataataaaatttttaataaaaataattgttgatgttttaaattttaatagatataaggagcgcttcacaatttacggcttgtactgctcgcagctcaccaagtcgacgtgccgaatcaacgagttggaacggaatgaccccgagtttaagcggattgttacggtagctataatcaaaagtgatactgtaatatatttatttattatttttaagaatttggcaaaggatgaacaatttcgactccaaacgcttttaattctgccatttcaacatatcacaaaatatcagctgttgctcaatgtaagttttatgtcaaaaattttttttatttacttttatgactaaaggtgaataatttgaaaattttcaaaaaaagttaatttttgcttattttctcgaaaatgctaataaatataactttttaaaaaattcgaaatttataccaaaaataattcacaattggaaaattctcaattttttacttaattttactcgtaattaataaattttagctttatttttattttcttttaaattgggttttcataccataattagctattttttgagattttatcaaagatttattcaattaaatttttttaattgagtcatccgaatttttaatttattttgactattgctattttttctcaatttttaatgggaaaaaatcatcgaacggatctctctctctata

SEQ ID NO: 9506 - DNA, 3897 bp, Heterodera glycines
tagggttcgagccccgtgggcgggggtggcttttcgcgggggcgggggtgagaaatttctcgcccccggggacgggggcgggggtttgtttttaattagctccaaaaaatctcacaaaaaattttttttttttgaattgtgtttggctccacattcctttattcgatgtatcgcctcgattcaattcttttttggtataattgcatagatattgtctaaaaatgaccaaatttaaggattataaattatgccagaataggcaatttttatgggtgtttttgtctaaatccagggtttctatttcaaaattttcaaaataagaataaaggccaaaaaataagattttagggtcaaaaataagaacattttgcaaaattgcttcaaatatttttacattttattcgatcaaaaatgtattctattattatatttttcataaatttcagtgcattcgggatcactaaatcagatttttaacattttttgcggcacatttccaaaaaacttggtgaatgtgcgaggggagaggtccggtggtgccgattggcgccgcaagcggaaaatttttaagactatgaattttgttagaaattagccaaattttttagaaatttcccttttttagatgaaaataaggtactaccccaaaacagaacatttcttagaataacaacatagaaaaccctgtattatttggaaaaaaaataaaatcaaaagaaaacgtcaaccgatgtcgaactcataacaaaaagtttgttaatgttgaagcactaaccactaaaccacaaatattttaaatatacgcaaatttactttatttcataaaaattttgtaaaagatggttaaaaaattcaaaattgtataaatttttgcctttaattccacgaatatgctattcttaggggtgtgtttttcacccccatgcccccgcgggggcgaaggtcgcgggggcgggggttgcgggggtctgagtcgcgggggcgggggtgaggccaaaaaacctgtcccgtccccgggggcgggggcggggtccggaccctagtccaaatggaagccagatttgtgaccagcgactccgaaaaaaacatattttaacgacacggggacatttttctttcttttttccggaattaatattttaattaattttttccatttttaataatattaaattacttccatcgccgattgccttcggcgtccgttccttcctgacgcttttggacctttcaaatatattaataaagcagatataattgttagcatttttattagaagtatatcattatttatttaggtttttcgttttttaccttcaaagccatgcaaaggcactccaacggagcaccggcacggtgggcaaattcggccatatttaagaggcaaatttaatgtttaaataaaatatatgagttttttaaaataatatatgaatggatgactaaagcgccgaagaggaaaattgagagataaagagaaattggttgatgaacgaacacatgcattctctcaacacaaagcagatgaataattgtgctgtgttcaatcgatggtccttctcctcccatcggtttcgcattatctgttattttatctcaaaattaaaataaatttaaaatttttaagccattttttaaagttgaagttagcaatatgaatttgtggccattcaaatttaataccatttcccagtgtaaatcgagaattttgaacatttggctgaattttcaaattacactcattttaaaaaactcaattgtgaggacaatttattttcttttttttatcgttaattaatcttgaaagaaaatctttaattatattaataataatttaatattaaatttgaaaaaagaaaattattaatttatttattgtgttattaacaaatacatattctactaaccaattaagacaattaaaaatgttattttattataccatttaaaatatgtaaataaaactattcccattctatgttcaatttgtgaatttctttctttttcctccactttcttctatgttttgtttattcacaaagtcccgacgaattgttgcattttctcggcgcttcgcattcactgcaaattgggcccgacttgtaagtgctcatccacacataattgcccctaaaaggcatttataaataattaattttataatttattattcacagcttaccctggattgtaatggcacaccacataagtttgccagtcgccgtcacagttggccacggcacagccaatttgcaccgaattaaaccatgccatctgaattttaatatgtataaaacacagaattttgcgattgagaatttaaattttaacgctcaaaaggggtaaaaaaaattgtgcccaaagaatgtcaatttggtcattgtatcaatgagaattggttgtcgagataatgagaggctaaattacctgagtccaatggccaactttggacaggttgtcgtcgtccaaccacatgtccttgttgatgccgaactctgccaactcggaccaccacgcgttgcatgacttttccagcacttcctcttaaattgtcacaattttctactttaattggctcccaatttgacttactgttgggaaagtcgcgccagctggagaagtacagattctcgccaaagtctgtgcccgagtgttgaatttggcatttgctggcccaatcctgggccgatttgcccagtccgtcgtcccacaccatcttcgccatgttggccgcggttggcattgtctgtcccgttttgttcgccactttgcccaaggccaattgcgaccggtaattgttgtggcactggacaatcgtcactttgtcctccgccgacattggcgtcgcgaatcccatggtacggcctaaaaggtaaattggcattttgtctaaatttttaaattaatttcccattcaaattattaattattaccaattagcatggaaaagacgggcagcaaaatgaaaatcatttttagtaaaataaattaataatatttttaattattgtttaatgtgattgaaactgcgctttttcggccttttaaaggctcattaccacccaaagagtgctaattaattgtcaattggtgagctgaacaaatgttaaaatattgaaaaatttctgtgatttttaaaaaacttatgcgtgtgcaaacaaaaatttcaataatatttggtggaatgtgaaaaaaatccaaaattttgaaattccactttttatgagaaagcataaaagaatgaatgcttcttgtcatttttgaaccaaagaagcgccgagaaattaaaggcgaaaagtcaaataaaattcaaaacatgcaaatccaataaaattattatgaaaaaagaaatgtaaacaattttttatgtattttattaaataaagataaatgacaaaaacatgtttttttctcaaaaattgagtccagattttagaaaaatttaaactattaaatttttatgaatagacgagaaaaattattttaattctcgaaaatcaaaattatataaaatccctaaatttttgttatatcaaattgttaattcattaaaataattttttctcattgagaaaaaataatttttaaatgtagtttattttaaataggaattttgaaaaatatttgcacaatttttcgagtttttaaaaattattaggtcttattgttaggggtttatttcttaaatgtttttggtctttggaggtgttttttgaatttcttaatgaaaatggttgtgtgaaaatatcgaaatagaaaacctaaaaaataagaaataaaatatatcttagaagcatcaagccaagctaaagtaagtctgatataaaaatatttgctaaataataaatcataatttaacgtaaacttaatcaaatttatccatcttggtattaaaat

SEQ ID NO: 9507 - DNA, 2400 bp, Heterodera glycines
agttctagccaaaaaacttggaaaaattgtcacaacttttgaaaaacttaataaaattttttgaaatttagcaagctaataaaacaattcaaatgctatcgtatgataccaagattgtgcaatttggttgtgtttgagaatagttatgagttgatttattcaaaaatttagcaaatttgcactttttgtgaagtgacctagcactgcccgggtattcaaatagagaaagtacggtaaaatgggggcatgtaaacagtaatattatgtaatttcatcaaatgtggctataatggcatatgattatactgctcttcatttggagatcaatgaacatgtaaaaagcaattttttttttaatttttcaacattaaattttgaacaaattatatgtttttttttcattttttaatattttgctaaatattttggcgttttttatgttttcttaaatatttgacgttttttcgtgaagatgtggcgagtggtgaatgtccaaattgaacggagaagggcccaaccaaaacagtctctcttcattttgccagactccgtccgttgcggcacttttttctgtccctgacaaaaagctttgccatatcgcttaattttgaaaataattttaatttaaaatattgaattttctcagaaaataaagaaataatcaagtcaatttaaattttatttaaatgacacttctcctttttaagataactgcccaattttcaattggatcatttatcaaacccaaaggtatgaaaaaaataaaatgtatgaatctaatcgcgaaaaattaggaataaaaaaaggcatttaaggcacgaaaatcccgaaaaaggcaaaaaaaggcataataaaagtcaacgtaggagcctcaaaccaagtggaaaatgcgttatttatgcttaatatatcgaaacaagagcgtagaaaaaaggcgtatgcctcaaaagtcggtctctaattataagatatatttcttaattttggggattgaaattcgtacgattatcggacaaaattgactttaaatggaaaatggcgggctccacggcgaaaatgtcagaggagtaaataaataacatgggatatggagaacatctgattctgtgtttttttcttgatattttgcaaaaatacgcaaattcccaattttctattcgacgatttaccgagacaatgtcgaaaaatttgtttattgttttcgtgaaacccccccaaaaaagccaaaaatatttatgagaattaaaaaaataatttataaaaaattgaaaaatattaataaattattttaaattttagtcaagaataaaccattacatttttcgttacaagaaattttctcctaaatcttattttccccttataattaggattgattataaattgtatgaatttacatatttttttgctatgctatggagaaaggtgctcaagaataacatttctacattatttttttttgttttatgaaggtttttaattcaaaaaaacgaaaaatacacccctaaggaccgaggtgttatggaaccaaaaaagagaattttttcgaaatttggtaagattttttttttagtattttatttgcctccgaaaattttcgttgacaatagaatgagataattaccaaaaaatgttgagatgtatttggtttgaaattgttgaagataaatttaatacaaaagatatgacattttttaaggttttaactctaaatccttttttttgttagtttaggtatttctaatttttttaaacaaatattgaatattcctattcactttttggaattttcgagggtttaaaacttccatattttgaccatatttagccattccatatttcgggcttttttaatccatattttatgtccttatttaatttttttagtctgaataattttttactctaattataataaatagatcacaatttttgtttgcttccgaataaatttaaatgtgccatatttttgtgttttgccaaatatttatgctttttgaaaatgttcacaattttcggccatgtttttgccaattaatctttatgtttcaacataacaattctaaagggctaaaacaatttcatttaaccattcaaaactctgttgagaatgaatttgggccatttgttgatgattcaaatcaattttatgtgtcgatcaatttgtgaatgtgtgcttctccccctcccctctccgctttttcatctttccgtccccatcggtccttggatggaaaagcttgcattttctaatttatacatttatttatttttatgcaaaaataatttaagtttttttaacatttaaaattttcagtttaaattttgcagaaaaaattctgattattacgcaaattattcattaaatataatgtcgagcagttggctgatcggatgaag

SEQ ID NO: 9508 - DNA, 840 bp, Heterodera glycines
agggctggccgtgatcacgggtcacggattttttcaatttttccgtggttttgatccgtgattggcattttatatagggaatttttattgagacgaaaataggtttttgagaaaaaaattaaataaacagattcatttctgtttagtaatggcatatttattagcctggtggttaagcctgctgtctcatcattgtttgtccattgggttcaattccttattgggataggagagttttcaaattttattcgtaaatttttgctctccaatccatttggtttctttaaaaaatcttttggatatttttccgtcgattaaattcagttttcgttaataaatttaaataaaaaaaatattcaaattttttttatgatcacgggaatcacggggtttttggggtgccgtgattacggatcacggagttccttgattggaaattcaatcacggccagccctggtgctgagtcgttatataaaaaccatcaataagggcgttatataaaaaaccatcaaatgaaaattttcaacaaatctacccataacttttgtcaaagtcaaccaaattagacattcttggtatcattcgatagcctaacatttctctattagttcacctaaatctcataaaaattcgccatgtttgagcaaagttatggccaaaagtacccaaagaaccgtgttttgaaacatttttggtcataacttctttaagactcagccaaattttttgaaattttgcaggctctaatagaggaaacatagggctaacgaatgatagcaagataactttattttgttcgtcctaagactattttgatcaaaatttttgatgaacaaaat

SEQ ID NO: 9509 - DNA, 4782 bp, Heterodera glycines
tagtccactaatagagaattattagggcgatcgaatggtatcaagaaggtttaatttggttgactatgacaaaattgggtatttttttgtcgaaaattcacattcgatggctgttatataacgcaacttttatttgagtttttatataaacgacattgcaccctccccggaggtccccgctccccgagaatttcttccccgcggggaggggtcggcgcttaactatacctcaaacaaaaaatgtaaaaaaaaaaactatgaatttcccacaaggaacggcacatgccgaggaatgttaaagccaattggacaaaactaaattcaaaatttctttcaggtggcggcactactctactgctgccagctgttgtgccgttgcctgtggcgtctacgctgggatccgaacgtgaacgcaattccgttgctgaccgcgctgggcgacttcctcggcaccacactgctcgccatcgcgttcctcgcccatgccgaactgttcccggagtatagcgtcaacggcaccaattgcactaacggcacaattagtcaacaagacacagttgaggatgccatgttgcaagtggttgagcaacaattgctgctgggcaatgccgacacaactctggcaacagaaactgctgaactgatgttgctgaaccgaacgctctgatcaatgaatgggtgactcatcgtgtcgcgatcatttttaaattattaattacggggggggcggcccggaggaatacgggttgtttcaaacgggcccaccattaattaacacattaagcgtgttttggtcaaaacttttttgattttaatcagagtcctcgcaaatgtcgcgcttaatttttaaggttttgtctttattttcaagagttgggcaatttttgaagatttatcaattctttttcgctttttcgatttttatccccaaaaaaaatcagtgattttccctcattttgcatgcctttaatgcacaaagcttctattgaatgtgagttcattctattttattaattgtgtatttaaattttaaataaaataaatgcaaatttcatgtaaatacatatttttccttagttctcttctccattcactaaacaaaagtttgaacttttatttacatattcccggatttttcttttatatcggtacatattttagacctttttttaactttagattttcaaaaaccaaatacattattctaacctttattaggtcgtttagcattttttttaccctatttacgctttcttagatttattattcaaaaaaaaaaattaataaaaatttgcatattttggtacgtattctgacctttttaataatatatatttcttatatttttcagacttttttttcatattttatgtatatattttgcgctttttcttgttcatatttacatctctattcatttatattcaattaaaaaaggactgactgacaattatccgcttaaacacattttatcattcaataattaagttagataatttattatgaaaactgcttatattgaggagaacgaaataagaaaaagacgtaataataataaaataaaaagtgaatgaatttctgataaaataaatgatcaattaggaaaatatttaaaatcaatttattgcctatggcaatttgaggaatttttagaaagaaagtttttttaggtattttgacgctgtttcacttagattttacagaagtgtccgtcccccgttcgttgttcacttgccttccgagacgagcttgtctaaaaatttgaaatttcaaaatttaaaattccattgagtaccgtaagcatccaatgtgagaaagtcgctcaactcgggctccaacacgaatttctcgagcagttccgaggcctccgggatgcgattgaccacagagccggcacggacgaggcgccgctaatgaaaaatgaaatttcaattttgataaacactaattagcaatggagagtttttcgggaaactatggaaaatctacctcagtttcagaagcgattgtcattttgaccagctgaggatcaactgtacgtccatctgaaaacagaaaaaattaaaataataacgggaaaatgaaaaaatcattccgtaccctcaaggcgcgcttcatggcgcgcccattgccacaattgggtgcggctgatctcggcggtggccgcgtcctccatcaaattgtacaacggcacacagccaatgccgcgaagccaattgtccatgtagcctaaaaaaaagtaatcaaagatggacggaatagagttcgatcatggtaaaatcaaggtctgtgatcatgagtcataaccctcagaaaggctttgatcaaaatgttcgaacaccgatttggtgccgtgccggtcgcctttcttcccctgcttttcctacccaaagtgatcgaaatgttcctgcggaagccggcttctgttcgcacgccttctggcgccattgtgagccgcttgttgtccgtctcgaatgactgcagttgcttgccgatctggttcgggccttgcatgatttggtcgaacacttcgcgcgcaatcggaacaagtcctggatgagccacccaagtgccgtcgtggcctaaaccgatgacattcaggcccatacccagactgggaacggggcggtggcaattcaattaagatgggaaaaggcaatttttgaaaaatgacgcaatttttttttcaaatttgtctaaatttcttcgatcgtatttatcggccaccatgccacaaattgataattatttattgacttaaaatttcgctataaaaataatatgtaacagattttcatcaaagagataagtgataattttagtatgtgccaaccgctaccggaattacagtattctaacgctctaatccctcataatcattatgccaaatcctcctgctattgattttttttgggggggggggggggaaacaatacggggggacgagctgctcccattttaactagtgatcagaagcgcctgctttaaccagtacaacagtaaataccgtaatccatcataaacagtaagtatgccaagccctgacgcattacaaatggtgccgacccaccgtccgatgcctcgcgctccttgtccttgcgcacagcgcccagtgcggtttcgttggcggccatgtcgtgtttgatcggtatttgtgccgccattccgcccatcgcgaaaatgttccgctggtgcgcaattttgatggacaaaagtgtgtaggcgcgcaaaaagtcggaagtcatcgctgaaattgggtgccgaattaattcttgatcactttgtttttgggcttactgatcagaaagcggtcgggcaacagaaatttgcgatggttacggaacacctgaggaatgatgagaaaattgaagtgagaagaaatatgcactggtcagagtaggcttggattgttttaagcccaaacaactacagatcagactcttcgggttgtacggtaagggtaagggttacgggctacaacccgcaaaaactttaacacgtaaagacccgcatcagtccaaaaaagtacagattacgggccagtaaaacccgtatacggggtctggaccgaatatgatctctataaaacccttcttttcttccaacagttctcaaataagagaagttttaaaaaacaacagtaattgattgattgatcagataaactattacgggctaattgagagaattaatgctaatttgagcatcagaacaattacaaactgatcagtgatcactgatcactatagtttaatctctccaatcataaaaaaaatttggaaagctgactttgatgtatgagaagatgtaatcccatcggccgcagttgatgccaacaatgtaatccctttaattatataaaatttaattatttattagaaaagttttcgattgcattgccaaaaaaaaaaaaaaaaattaaaaatggcatttaaattgaatttataacattttcccacttcaatgcatgcacaatttcgtccatttggaaggtggccaacagatgctcaattagcaccgtgcatttgatcgtcccgtgcggtaggcccagcagtgtttcggcatggccaaaaacatcggcccacagtttggcctcctgcgcattctccaatttcggcagataaaagtaggggccgctgcccttctcctgcaacgccttggcattgtggaacagataaagcccaaagtcgaacagcgaagcggacatgggcttctcgttgatcagcacatgcttttccggcaaatgccaaccccgcgggcgtattttgagcactggcaaatggaaattgacattaattacatagttaatcatagtacggtatcgaattaaaacgatcaaatttgatctggtctctaatttttttgtttgatctttcatattctaagaatgtaaattagagaatgataggctttctggcaaaatgtcaatcaaccgcaagaatttttaaaagatttaaaccataaaaaaaattctaaaaagaaaattttttcaaaggttttaattccgccaaacaaaatcccaacaaattctctatgtatccaaccagcagtgtcctgcttcagcgtgtactcctgcttcgtgaccgggttcacgtagtggatttggccacgaatggcatcgtacaaattgatttggccctcaatctgattgcgccaagttggagaatttgcgtcctacaaaatttatttgttgatcaatgattttaaaaaaggtaatttagcatagtaattagtagggctgatcgcgattatcggtctcagttcacgagtcaaggaaatccc

SEQ ID NO: 9510 - DNA, 4955 bp, Heterodera glycines
  misc_feature (4926)..(4926): n is a, c, g, or t
ctctatttgttagcagagttgtcatcaaaaaatgatgaaattgagtaaaaagagtggtggtggtggtgtgccgtgccaatcaaatctttcgaataatttacagagttccgccggtctctcctttgcctgaggcatgaaattgctgctcattcactcacctcccatgtcgccaatgatgaaaaatgtcattttgtccagcttgtcaaatgcgcttttcctgcacgtttccgcgttgtaatttgggtccacgcccggccccttggcacacatcacgcgaacctcccactgcggaaattggaacatgcccgccctgtcggcaggaagcatgcgatgccgacttgagttggcggagttggcgccatccctctgggccaaacagccgaatgttgtggccaaaagcaaaagcgaaaattggcgcaacatcaaatggccatcaaaaaagagaagaaaataatttaatattaaactattctttaaataataaattgttagacgcgttaaattaaagatttcaaaattggatgcttaatcataaaaaagggtaattaacatttatttgtttttctcgcaaattctaattatttaatgatatttgttatttaaaattgttccgtattagaaaaacaaatgaaaatagggaaaaaattaggacaaatatcaaggttaatttttgtgtggaatgaattagcgacgacgccaaactccaaattagagaattacaacaaaagtttcggtggtgatttgatggaagatgaattgagtgatgatgattggcatatgaaaatacaataataaaaaaagtggaaattggaaccagttctcagcagtaattttgccaaaaaaattgttattcaaaattctcattaaaataatttcttttcaataaattttcaataaaacaattgattttcaattttaattaatttattataaattttgctcttgcagactttttttaaaatacactcaaggtcattatttataataattttccatttcgatacatttaagctaacttttgatgctgatcaaaaaaagtaattagtaatttacagcaattgtatcaaatcattccttcatgctgataggacaacctaaaatacacagaaaaatcgggaaatttttcaaaaaaattgacattttggggaacgaatcccgggcccagggattgttgtgaaatccccaaaaaagcctcgatgttaataagttaatttattctcagcggataaatgtgtgatcgacatatttccatacatagacggacgatatgagaaaaaagaactttcgactaatttaaaatgatttgtctctattttcactttgtttgtattaataaaatccgggctcaatcaattataattggctcaattaaatgttcgtaaaatggcgacgaaattaaagcagcaaatttcttttcataatttcttctctgcgtttcacttttgttgctcacatttttttccattttaacattttcctgtgcgttttcatatatttttttcattttattctcaaattccatccgaagtttttccgtttcccatagttttttaaattccttttcaaattgttccattgttttttgcttgaattttttacgccaaatttcgcttttttttgcttcataattcgcttttttaaattcttccattgctttttggattaatctattctgccaattcttctcattccccgtaattatttcataattcatttccaattcattttgaagttcaaaattaatggaaaaattgggatcattttgccgaaaatatttcgaatgatcattgaacctttggacaagcacaataaaattaatcaaatagccttctgttaaaaatattggcttcaccgctggcaattgcctcgcttcttcttgctttttagctgaacaaaaattataatttaaaatctggtaattagtatgaaaagatttgggtttaatagacttagaaactgaagagaccaaaatttcccgaggtttgaccccgagactcgaccccgagaccgagaccgaaaacccgagacacaaaaagccgagactaaaaattatttaaaatttttttgagcctttcttaatcaatttttaattttcaataatcaaaattttaagcggttctttaacaaatttcgcgttccaaaataagctattttacaacaaaattttaaaaaaatccaaaattccagttacagatcaaaattaggaaaaatcgtgaaaataaatttaaaaataaatacatacctccagcatagagccgaaacaaatattcgtaaaaaatgcgcaaatatatgccatatttttgacatcttcttatctaaagtattttaaaaatttatttgatttcaataaagcacaatatttgagctttaattagttttatttaaaaaaatttttaggatgctaaaaccatttaaatttataaataaaaataacttcagtacaaatttttgcactatgggatcccgcggattaatcccgaaaactccgcattgaaaatttgcgggatcccgcgcaggattgcatcatctttgaaatctcgaaaaacttcaaagttaactttgttaatggaatcaatccataaaaatttaaccatttaactttttttacatttttagattttagattttattgattaaaattattaattttatttaaacaatacttgacattctgtcttttgaattttcaaaaaatccaattcattcccgaggaatagcgcacaaaaaattacatttgcgggtcccgcttcgggattggtactaaaaaattttgcgggacgggaccccgcgggattaatcctgaaatctccaaaaaatgcgggatcccgtttgcgccaggctatagaaaaaaatatatttcaaaatttcataaactcaaaaagccaaacaaaaaaaattacgaactttgaaaatacattttaatttaaaccattcacaattccatttaattttcatcaaatacacaaggccaagaagagctccatattcttgcataatattcactttcatctcatggaaaacgttcgaataagctttgttgatgattaattaagaatgccaattatgtggattaaagtcacgaagagtgcgaaatgcttacattcatttcaaaaatatacatatttttattaaagattttttgaatatttcaaaaaaatatttttatagaatatttaaaatttctcaaaaatattttttaaatttattcaattcttcaattcttctctgttttcctgaattctttaaaatgaaaacttaatccaaaatctggaattttatggaaaaaaaaactaaaattatatttttcgtgcatttaagctctattagatagcccatataattggcaccctcatcaagaatgagcttgaagaatttgtcaaaattcgtcgcctgtccctttacaaattccacaaataacacgtcatcctgctaaatttgacatgattaaatttcaaatcattgaatgctttcttctcacccaattcaatgagtcatcaaattttgatctccaaattattttatgtgcgtcttcacttatttcatttgcactccatggaccgttttctttggcattttgttccgcctttttaaacattttctttaaatttcgatcaaaaattattcggttaataattttttccacaatttcatccgattggccattcgctgtgtaaattgccaactttaaaatggcttcgttaattggcatttcttcctgctcattatcattaccaaatgcgttcaacaattttggttcaaattcattaataaaatgtttgttactgaacaaattgtttaatttgtattgataacgattgctattaaatggatttaaataaaagcgcaaaactttggccaacgaatgcaaaacgtaaataattgatggttcttccatttcaaattggtgtcttttaagcatgaattttggcttcactgtgttgtgaccggcgaattctctaaacaaatattcgtacaaaatccccaaatatttgcgatatttttggcattctgtccgttcatattgttcaaatctcttccctattttggcacattgccaattctttctcataaaatacacagtgccaaggtaagcttcatatttttgcgtggaatattcactaatttgtgtttgttgatgacatttcataaaagcaattaacatattgtcgtccatctaattaaaatagaccaattaattaaataccctaacatttggtcgacaagtaaaaactcaccgatggatttgcatgtgaaattggaataaagaagaattgaagaataataataataattataaaagaaagcatagaagctgcagaaaacaaattattttttttacggattttttaaatgtgctgtttatgagcggtttgggaaagaattggcaatttggcaaaaaaaaaatggaaattttttaaattataatttcacgtaatttatttattaatttgtatttgaattagagagcataattttgtggttttgactttctgaatttgctgatccaatgcaaattttttcgataatattattttactgaaatattccaactctccctaaataaatttaaattgatgctctattgtatcagaaaaatttaaagatataattgttgttgcattaaatatatttcaaattttttttcaagccaaattataagcaaatgaatgaaattataaatgcttaaattattaagaaatttaattaataatttaaaaaagtgtcatatcgaattgctttataaacgaatcaatttttagctgctgatgtacgtgggtggggtgatcttattcagcccaatttcacatgataaaatggcttatccttcagtagaattatccaaaatatgtaaatatttatgagagttttaattattttatttttaaaaacatcacactaattaaattataatttctttcttccgtntggtttctcttattttattattttattct

SEQ ID NO: 9511 - DNA, 1397 bp, Heterodera glycines
  misc_feature (68)..(69): n is a, c, g, or t
  misc_feature (75)..(75): n is a, c, g, or t
  misc_feature (82)..(82): n is a, c, g, or t
  misc_feature (86)..(86): n is a, c, g, or t
  misc_feature (91)..(91): n is a, c, g, or t
  misc_feature (1091)..(1091): n is a, c, g, or t
caatgcttttgcactgcccgtccgatactcaaattggtaaagatgactatccaagtaagaacgtaganngaaatngtctganaacnttaancaagtgagatagagaagaagaagcttcccctagagaaagattaatggatcaattgaggcgataattgatcctatatgattgagcaaagtggggagccggagagggaagggtcggtagttcagctggtagaacactagtctggaaagccagagacgccggttcaaagccggcccgccccattgggttttccctcaagggcttcctcagctcgttcatatatttcataaggaagagattttatccatttaaatattttttgcatttaattcaaaatgatgaaatttaattattttcctgaataaaattttgcatcaatttttttttcatagaaaaaacagcgacattttaaaatataaactttttgccattttcggcaatatcgccgccaccaatttttaatttatttttgccattaaatttcagcgcgatttttccaaaatgacattaattaattagaaaacaaaaattttttgccagcagcaggtgggattcaaacacacggccctccccaaacccgtggaatgctctttaaccaactgagtcacattattttttttaattgcgaataatttccatttgatttatgtaattagctcaactaaactttaccgatatgcacattatgtaataatttcatctaattatgtaattaatgtgattaactcaaatttaccgatatgcattatgtaagggaattcttcttccaataaatatgattcatttattcccattaaataaggaagccatcttttgtaattatcaatatttttatggtagcacaaataatgttgaaactctgtcaaattcacaattaggagttcaaagaattttctaaaatgtgaattttgtaaaaataaaattaaaaaaaaataaacgaaccgataaaaaacatgggaaagcattttttgcgctatatctgcggaatattccttcttttcgttgcacttttttacatgttcaaaaaattcttcttcactaattgttgtgaaatgttccttanacttttagataaaaaaatatacactaaaaaaataaatgaataaaatttattaagaaaatgagatttgcgaaattaattaaattttgtaataaaaaaaaagtttgtcgtccatgtccaaaatgggaatgaattgtaacaggaactaaaaaatcccaaaaattatgcggtataaaaaattatcgacaattatggacgaaatttttagttttagaaacaattaatattttgaaatttttaatcttttattatgactttttttcatttttggtatctttgtgttatgaatttgggtatggcttctttaca

SEQ ID NO: 9512 - DNA, 1513 bp, Heterodera glycines
  misc_feature (1473)..(1473): n is a, c, g, or t
  misc_feature (1497)..(1497): n is a, c, g, or t
aagattggaatgcgataagttattttcttggcattttttgcccattcttcgttggcattcatagtctgatttcggactatgtgatgcgcatagccaaacagcaaacatatttctctgttaattagttcactgttttcattataatcatcatcatcatcatccgcaaaagcaaattccgtccgttccgcccattccattgacaatttatttttcatttcaaaaaaagtgttatcattgctatgaatctaagaataaaataaatataaaattatttttataaaatttatgagcgattaatttggggttttcgtctagaaaataggggcgcgtcccttttttgtcgtctcgcccctatttttttcccctcattttagctttttgaaaattcttttcaatattgtaataaataagattaattattgaaaattgctgaaaatttttggaaaattttcgatcacagctctgcattttccatttttgcctctgtttttgcgatttttcgccccggtataatctcttatttcgtgatttttcgcctcaaaatcatggaaaagcttttattctggttttttaactataattcgatgggttttttgttttaaaattaaaaattcgaaaattacggattagataacttacgctcatggtaaaaaaatacaagggtttttatataattattttaaacaaattatatacattaatttcatccatttttccgaatgcgtcttcaatggaaagattgaaatgccaaaacagcatttttacgtcgagccatttctttcggtccgattttacaaagttatttttgtaatttgacttcgattcgttggacaaaatctttttgaattcattttgcatttcgtcaagaattttgtattctaagcaaagagtcgaattaaattaagcacataaattatttaattcaaatgagttaaaaatcgagaattttgtctttttaaattaaaaattagatttgtgatcaaaaaaccataaaaaaccatggaccaaaaaagcatacatttacagagattgtaattaatattttcccgacccattgtggaataaattctcggggagcgccggggaatcaggtcgggggatcggggaccccgatcggagaatgacttaaattttctttaaacaaaaaaattcaattctttttactaattcctagagatgaagcaggaccggccctgtattattaggcgcgtcttggaaaactagaaaatttttggcccggtttttgagaaaatccaaaaatgtcaatttacaaatgcctggggggagtcggtgaaatatttttaattttgaaaaaatttttctattttttttacctttagctgacaaatcttggttatgggcgtcattttgtcttagcacagaaattggcacattttcttttgggcattccaacagatcatctttgtttttctgaaaattacaaataaaataataattcatttaaccgaaagnaatgaaaaagttcataatttttanatatttatccattaat

SEQ ID NO: 9513 - DNA, 2866 bp, Heterodera glycines
  misc_feature (20)..(20): n is a, c, g, or t
  misc_feature (78)..(78): n is a, c, g, or t
tattacagtttaaatttgtntaaaacataaattcacttacttcttcgtccgattctgcattgtcagcgccaattaatntaatcgcaattaaaaataccgtgacaaaacggattaaattttttaaatgtgtttgtttcatctctgtaataaaaaaaagttggatatctcttaatgacattttatagattattaaacaactatatttttaaacatgtataatttttataaaaaaaatataataaaatgctttctaaaaataaaatctaaaaaaaattaataaattagaaagagaaaatgtaaaagaatgaataattttgaataattttgtaaatcaattggatatacgcaaatgatatgcgtaatatagaaattttttatattttacaattttaatttctctacggcgcccattgataaattagttattttggccaacaatcaattgctaaattggtaaaatggcaaatataatttgaaatgataatattaaagaaatggaaaattttaatgaaattgtttaaaattaaaaaataaatgactttaatgagtggagtggttctctcatcagatttcatttgatctgttcatttggcattgtttcgccgagttccatccgaaacaatgccctcatcaccaatttcggcacctttgccgttttcggcattattgctgttgttttggttggtgtacggtagcccaagagttagcggtggtgctaaattttctgtcattatgcatagaaaaagatcatgaatagcttttgagataacatttctaagaaatttggttatttttaattttttttttcgttaacgagactataactgactgagacttaattttcttaaaaatagatttaatatttgttaataaatcccaaaaattttcaaattttgcccggcgcaaccgttcggcaccgctttaaaagccttcccattcaaaaactcgattgatacaccattaataatgaatgatcctacccttggtaaatctacaaatgacaacaaaattttttccagaatttacgcgttagcatgaaagatgtctgcccgaacccatcaccagcatttgatggtgccaccaatgttccgttgttggccaaaacgcttaatccggccaccgccgacggcaccggcgcgtccagcacaatgggatgctcaatgtgccagtcgtaggtgcgcggagtgtacacgcggaaaatcggccaaacggtcaaccattcgccgttgtccgtgttgcattggtggtaaacgcgcaggtaaaattcgggcctatcaaaagtataaaatttttttattttttagtaaaaaattcacgtccagacctttgcctgggtttttgcgtaccgcttatttgttagttaaatattgaaaaaactgagcaaataagcaaatttgttaaatatttaaatgctttatataatttgcttgaaaaatttaatttacttccataatattattttaagccaaaattatattataaatacaattattatgcttaattgctccgtttttattcaacaaaaatttgattaatatccaaatgacacccaatgtttaagctttgacaaattttcattaatttctgagggtcaatggcaactcgtataatgttgtaaaaggaaactcgtattttaaaaaaaccataagcctacggcctaagcctaaagcctaggccaaatcgaagcaattgtacgagttgtcatgacaccatttttgataccgattgatgctaaaccaatcatgatcagatgcgcagccatccaacttccataaaccagtcgggtcgtccacctctgtgaatgtcgccttgtcgtctgagtccagcggattttgaaaatccgtctgaaattgtgatcgtaaattaaaaataataagcctcattttgattttttgttcatttggcatttttaaaatttgttataagtttttttattcttttttaatattcaaattttatataatttttaatatattgtaaatttatagaacatttatgaatctttcatgtttaaaacataatcaaagaccattagtcataattacttgtattaatttatacattttgtggactgtccaagtcccaaagttccaccaccgcccccaacactttggtctgattcttgttgcacttgaccagccctgttgcccatacacattctgtgtttgctgcgcaagatggaaaaagagttgcaagaaggacaaatgttgccgaaaatgacaataccaatccaatttggtgcattttaaatttaattttaaaatattaaatagtaagtgtcatcgataaaacaatttgaaaaagttattctttcaaccaattgaaaaatattcaaaaataaataaaccaaaataaattatttcgcaaaaccggtcattcatctcaattatttttaagtatattatgaataaaattttggtataaaataaaattatcttattctaatattcacattatgcatttctcatttataacattttacaaaagtacatatatatttttatatttttaaaaatgttttctcacaaaaaatttacacagctttggttggattgggagaggggaaaattcagcagattattatggcgcatttgcgcgaattcgaaagcggaatgcgggcataagtatcattatcaacacagcacaacacttattataattgcttgtttaccactggaaattcatgtaattgaaaaatggcatcaaattacgagtaaattcaaatatcataggtgacataaataactgaaatgggcgaacgggtgtagtgcagaattgggcccgctaaaaaaccgcaaaaaacatgtttcaatcaatctcttatgacctctaatcaacataaaaaatagtcccgaggtgcggaaat

SEQ ID NO: 9514 - DNA, 3079 bp, Heterodera glycines
  misc_feature (2929)..(2929): n is a, c, g, or t
tctaattggtgggcgggcacctggataattttgaaatttaaaaattgagaaactcgctaatataaattttttgaaatttctattttcaaaaaaagggcccatcatctaagtattaccaaaactcaatttttttgactcttccaaactacaaaatgccttaaatattacatgtctcattaaataatattgcctctttaggtttattatttataaatttataaaatgcaaaatcaacagaatatggacaattcagcaaggtcaattttcgttggcaatatttcttacgatgtgagcgaagacgaattgcggaagcttctctcagcagtaaataaatatgctaactttgacatttttcagactttttacatatttctctcttttttattggtaattcgtttttagtgtggtcaaattgttagctttcgccttgtccatgaccgcgagacggggcgccccaaagggtttggtttttgtgaatttgccgatgtgcctcaagcggaggcagcaattcgcaatttcaatgggttcgagtttcggggacgtccacttcgtgtcgactcggctacgggcaatgatcggagtgctgatgaggtgatcggcggatatgccgtatttactgtacaattatccccggcagcctcgtagccggggggagggaatttccccaaccctcgaaaatggcaaaaattagtcctttttggcaaaagaaagctacaaatcactccggcgtttaaattttaaaataactggagaaattggcccgaagagcacaaaattacaattagatgtgttaattttctgtttttttttctttacttttctatgagaatgatattacacttaaaataaagcaattaaaatatgacttttatacataattttaaatttttctgggagaataggtaaattggaaagttcttgtttaaattagcattttcataattttctatttttactttagatgcaacacttccaaatgactttgactcgtccgcaaaatcccaccgacgaattgagtccttatgggcccgaattggagccgggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggtgcaaattcccaatttttaagtgttgaaattctcaattttaaaagtaaaagtagacctaacttttgtcggaaatgggaagatattaatttacttaaaaacaactcttttttgtccttattttttatggtaaatgtattgtcgataggtttttgtgtcgtcgctgatcacgaaattatattattttgattcgggactatgcatacacatttaacacataaattggtttgaaaaagcgagtttggtgttgacaattagattaatcaattctcctttttatattgtttttttccaccggaaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctccattggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggtggtggacaggccgactgaatgccttcctcccgccagaattggtctttacgtatcatttaggctgttactccgcctccgcttagccaacaagcacagcaaagcaacagcgacaatttggacgaggagcagcaggcgcaaatgcttgtgagtgttcaaatgaaagatgtccttttatataatagtggcaaattacccctcaaactaaaaaacgatcaaaaaacagtaatttcggttatgtgtaaacggattttatttaaaaaagcaacaaaggccaaaggaattcacacaaataggggcccaacatttggcggttgcctcttttaaatttcgcgctgttttcacataaaccgaaaagtaccaaaaaactcaatcgaatctcaaaaattcaagatccgcgtgctgcaactcaccgatgagcaaattcgtatgttaccacccactgaacgtgcccaagttatcgaattgcgtaaccaactgagaagtgcggatgcaaatgcgtgaccatatcaaatcgcactgacagaggtcgaaaagccaactgatctcttctttctccatcaacctatttttatataatgtttatttctttgttgttgaaaatcaagatttaatgaaaaaatttttactaggtttccaaagttttttttatgcttgacccttttgctagactattcggtaaggaaacatttgcaaaacgtggataagaaaaatattcatttaaaacaaatggtaaaaacagcatcggtgaggttaaatatcattccgactgtatcttttctggcgcaagctccataaaattaaacaatttataagtttttggggtcgctgatcatgaatccagcatccatttcgaacttgtaatttgttgcaaattcctcgtagtaagttttggagctcatccattgattttgcaattctttagataccagcaattttggtgaaaaatgaattccgacttttggttcggggttagaaatggggcgaaatggatgtcaaacttagtcaacgaccccgaaaaacatgtaaatttatttagaaataaaaaaaatttggggcttanactgtagaatagccttctttgtcatccttataaaacgaaggatagccatcccaagatgaacatcagacctgaaataatgaaaaatttaattttcatcaggaggctcaaaacgcgtggatatttacgttttcaaaatttctaccaatttta

SEQ ID NO: 9515 - DNA, 1825 bp, Heterodera glycines
  misc_feature (79)..(79): n is a, c, g, or t
  misc_feature (123)..(123): n is a, c, g, or t
aaacatcagaatgccagaggcaaaaagagaaatggtcagcagagggaagcgggcgtaaggcgagacagaaattgccacngtgtggaggaagtgatgtttgttggcattgtccaccgctttttntcgtctctcatcgatcgttggatccatcaaaactgagaggaatgatgggtttatggcttttgcaaaacgggaatttctcttctacctctgtgtgcgctaaagccggccattgccactgcagcggcgcccgaaagtccggcaattcgtcgagccaacgaattcatcgcaatttgagtgccacaaaatgtgaaaatttgactttcgatttcaggctgatggtgcacgagattcttgaccgcggctgatgatgttttaatgccaaaaattgaccataaatattcttgtgcagaaattgataaatctgcggtggattgtaaaaaattgaaagcgtatctttccattttaattgcgctaaaaacaaaataaatgcattttaaaaataaaattctaaaaacgccatccgttcctgaggtcagattttcttgaaattttgcataggctcatattttgatctcttctagagaagttttgtttgttatttttcaactcgagaccggctcttgcatttgacaagggaatcacaaatcttttttaaattgtggcaaatttggcgttcagatactaactgaataaaaaataaacttacctaattgggagcccaaattgactcgctttgattaaaaggctttttatcacatcattttcataacttgtccttatttcctttcgtttatgattttatttacagaatgtttaaacctcggattcctctttttctcacaacggacagagtaaatgtacaaagagcacattttgcttttgagagaaaagtaccatcaaaaaaattccttggctatcgtgtttgccatgggaatcaggtgatgtttcagcgaaaaatgatacgcaggttcacattggaatgtctcagcagattcgggaccgaagtggaagacgtggcaagtgaaaaaatacatttaaagagcctttaatcttgggaaattggcaagggtaaaagttgtttttgtgaccaggaaggaaatccaattcaaatcgaacacgataaaacagtatatgtattgttaagaaactggttttgggcaaccaacattcgtatttccgcaaattgagcgacaccaagcggaggcaattcgctaatttgtaccaaagggcgctggaggatttgatatctagcgattatgaactgcacggaatcctcataacaagagtcagattaaattagacaaatggattaaagaaatatgtttttttgttttaaattagttacaattcaaatcctatgggctggttataaaaagatgcgtttcagatagaagtgcccttgattttgaagcacattcaaatccattggcgctgcaccggcgacgtgcagcgcgacgaagtcagtttttgggaaggtgcggtagtgataagataagttttgcttgcccttaggaaattgaccaattgttggaaaaacacgcggattctctgcgcagaaaattaagcgaaatggtattgttgtcttctttgcccacttttattcctcgaaaaggcatttgtttaactccgatttctgcttttagttttttcatacgccaattcctccatttgtttttgttgaggaccggcgacatttgtacgaacaggtcagtcaacagccagggaaagcaattagtagggccggcaattttaatgacgaaacgcccccccccccaaaaaattgacgaaaagatgccaaaaagtgacaaagtccgaaatatga

SEQ ID NO: 9516 - DNA, 2212 bp, Heterodera glycines
  misc_feature (2092)..(2092): n is a, c, g, or t
  misc_feature (2172)..(2172): n is a, c, g, or t
  misc_feature (2196)..(2196): n is a, c, g, or t
aaaacccatttttctgtatgagatttctacatttattagttattacttttcacatatgcatatgtaatttattatttatgtataatatgaaataaaagtaatccaagcgcataaaatttattccttgcaaattgttaaaaaaagacaatgatttttcctttgacgttaatattcattcgtaaattaatttttatccattttcctttatgcaatattatcatttttatattattttttctttatgtttaaaattttcattcataaatttattttacgcattttattttataattattattgccattattttaatttgaaaaatactttgaatgtaatgaatagtagttatataacctatattaaaaaacacttttttgttaccaatttaaacagaaaaatgacattttattatttgtttgcttgcttatacattattttgctcctcgctaattcatcgaccggtgggaataacaaaaaaggcaaacaaaatgctcaaagttacaatgaaaataatcaagcttcgaatacctataaagaatatttacctggatctgttctgaaaaatggtagaaacattaaagagctgaaggaacttttcgtgaaaaaaattaaaaaaattatgaaagaagcatcggaagaccgaggacaacgaaccacgaacaatgaatgcgctgttgatctgccagctgatttttgggatcaatttcaagaaattgcaaaactacctgaaattaaaggggttaaatttgatgggaatcgcatgataatagaagaaaagtgataaatgaacaatattttgaaacatgaaaagagatggatggaaaagatgcttttttagatttggttagtcataaaatttaacaattttttgctgttcttttatacttccgataaatttttgttgcgggaatcagtcagcgtgaaaatcttacagttttggatttattttaatgtactttctaatttaactcaacaaattggtttatttgcacaatcgttgaaacaaacattccatagtttccggaaggcggagtcgtacacttgcaaaaggtacaaaaaaaattttggggattgaagtagccaaggcccatatgactaaggctggcaagctaagcaactcctaaccaattgagtgatgatagggcaactgacgatacaactttaccaccaatcataacaattttcagcatttgcgcacagtcctaaccaccactaacttttgtgcctcctgccctaccgctcgtcggaaatctccactctaaattcaattttcttcaaaaaataaatttgcgctacgtaaaatttgaatactcaattttcaacaaaatagaaattatgcgacaaagatacattaatgtaattgacccatagtgtggcttttgcgggtagacattgattgattaattactatatatgttatattgacaaggagtttcgtctgcaaaaacaaaatctcccggccgaaggccgggagcgccctgaaagtagtggaagggtcttacaactttttgaggcgcatccgggaaaaatataggttttccggtccaagggccaactgagtaccagggactgatttctcattttttcgtgcgtttgacggcccataactttttttctaaatcccgattcaaaaactttccgctggtaggaacctaagttgaagtgttgtctaaaagtcaaaaaaaattccaggcctctacctatagtaggaagggctgcagaaaataggagaaattcagtaccaactttgtccacttcagtcccaggtgaataccgcgtcagggtttgatctgagcgagggggctccagcggacttattgtagagctttgaaagctcgatttttccaaattttaaaatttcgaaaattttcaaaaattttcgagttaggcctaaaaaacgtttttttggtttttgaattttatgattttttaacgatttttctgggaaaaacggagaccacttccaaaacatcatttttcgagttctatcgactggtaatttttttggaaaaatttcgggtttttcccggaaatagaaaaaaattttggcctgagcgggacatttgagtcctgggcccataactcgtcaggngttgattttagcgaaaaattgtcttagaacatttttgtagagcttttaaatgctatcgaatagtgtatttatatggccgnaattttcaaaaattttcgtgctangccccctagaaatttt

SEQ ID NO: 9517 - DNA, 2484 bp, Heterodera glycines
gggggggggaaagttcagaatctgggcggtgtaacattatttttttgtgcatttttacgttatttttaatttttatttatttaaaatatttttattttattaataataaataaaaaattttcatttgaattaaattattttttggtgaaaattttatttaaaaataattattttttaaattaaagaatttaatgttttttaaattagaaattgtcaaaaaaattatatttggtgtaattttcaaaaattcgtaactcgggttagggagggtgaattttcacaatcaaataattaaaaaatgaggaaaaatacggcgcattttatgacttttattttaatcgctgttgcacctcttctaatcacttttgtacctcttttatcacttttgtacctcttatcaaatttgtacctcttcaatctctgttgcacctcttctaatcactgttgcacctcttctaatcacttttgtacctcttttatcacttttgtacctcttcatcaaatttgtacctcttctaatctctggtgtacctcttctgatcactgttgtacctcttttaatcactgttgtacctcttctaatcactgttgtacctcttctaatcacttttgtacctcttttaatcatttttgtacctcttttaatcacttttgtacctcctataatcactgttgtacctcttctaatcacttttgcacctcttctaatcactgtgaacctcttctaatctctgttgtaactcttctaatctctgttgtacctcttctattgtacctcttctaatcactgtgaacctcttctaatcactgttgtacctcttctatttactgttgtacctcttttaatcaccgttgtacctcttctaatcactgttgtacctcttctaatcactgttgaacctcttttaatcactcttctaatcactgttgtacctcttctaatcactgttgaacctcttctaatcactgttgtacctcttctaatctctgttgtaactcttctaatctctgttgtacctcttctattgtacctcttctaatcactgtgaacctcttctaatcactgttgtacctcttctatttactgttgtacctcttttaatcactgttgaacctcttttaatcactcttctaatcactgttgtacctcttctaatcactgttgaacctcttctaatcactcttctaatcgctgttgtacctcttctaatcactcttctaatcgctgttgtacctcaaaatttaaaaaactggcgcgaagcgcccgtatgagttcaacgaatttaaaaaacgggcgcgaagcgcccgttcaaggctaacaaaaattgaaaaaccgggcgaagcgcccgactgaggccgcgaagcggcctaacaagctaaaaaacgggcgcgaagcgcccgtatgagttcaacggatttaaaaaacgggcgcgaagcgcccgttcaaggccaacaaaaattgaaaaaccgggcgaagcgcccgactgaggccgcgaagcggcctaacaagctaaataacgggcgcgaagcccccgaaacgggcgcgaagcgcccgtataagcccaacaaaatttaaaaaacgggcgcgaagcgcccgttcgaggccgcgaagcggcctaaaagtcccagataattttttaaaaattccaatttccacaaccagagctaatctaggtagcgaagctcccaaagcgcgaagcgctttttcccatcgggaacggctgggcacaccgggctgaaattttgcaccaaggggtagctcgagacggcgcatccgggaaaactatagaaaaaaattctcgacgcccagctgagtaccagcggctgatttctcattttttcgtgcatttgagggcccgtaactttttttctaaaacagaagtcaaaaagtttccgctggtaggaacctaagttgaagtgttgtctaaaagtcaaaaaaaattccaggcctctacctataatagaaaagcctgtaggtgcgcggagaaattcagtaccaacattgtccagttcagtaccaggcgaataactcgccagggtttgatctgagcggggggtggccagcgaacttattatagagctcaatgagctcgatttttccaaatttaaaaaattcgaaaattttcaaaatttctcgagctaggccccctaagaggttttggggtttttgaattttatgattttttgccgatttttccggggaaaacggagaccactttcaagcaaccgtttttcgagctctatcgattggtgggatttttggaaaaatttcggtttttttccggaaatagaaaatttttttggcctaagcgggacatttgagtcccgggcccataactcgtcaggggtcggttttagcaaaaaattgtcttagaacatttttgtagagcattttaaatgctatcgaatggtttactacatgatgtaaaattttcaaaatttttcgtgctaggccccctaaaaattttcggaaattttttttgg

SEQ ID NO: 9518 - DNA, 2365 bp, Heterodera glycines
cgatgcaaggaaaatcccattcagttgatcaattggatgtgcacttagaaaatacccagagttttttatagaaaaaatgcaactgatcaagaaatcgaagaggcattgttaaaaaattcaaccttaactgcttattttaagttttgcctagaaaatcctgataaagaaattaaatacactgatatgccaaaatattgtacctgggttaaaaaagataaaaagtggaaatatccaagacaaggttaccaaaataaaattggtagaatggtaccagtacgcccatctgaaacagagaaatattatttgcgttttcttttgctaaatgtttatggaaaaagttttaaagatttaaagaccgttaatggagttgaatatgattcattcggtaaggcatgtttggctagagggttggtgagagacgatgaggaatggcacaaatgtttagaagaagccacgtatttttctcgaaaacacgcgaaaggcttaagaactttatttgtaaatatattggtacattgtgcaccaaaatatcccgccagattatgggattcattcaaagagcttatggttgatgatattaaaagaaaaaatccttccttttcaataaaacagataaataatattggattaaaattaattgatcaatgcttaagatattatgacaaatcattgagagattttaaggatatgccacaaattattaacaagacaaaaattgttgatgaagatgagatttacgatcctgaaaatgaattagaattagcgaatagattaattatgatgatgaatgatgaacaaaaagcaataatagataaaatgcgtaatatcttagaagaaaaagacggacaaaaatgcatttttatagatggaccgggcggaaccgggaagtcattcactttaaaaactatttatcatttggttagatcttttaataaaaatatttgtaacatggcattctcaggaattgcggcaacaattttaaaaaagggtcggacattgcataatcgatttaaactccctttaaacattaaaaaaacgtctacttcaggcattgaaatcaatagttcagacgcagaagaaataaaaaacattgaagtatttatttgggacgaagctccgatggcatcacgttttattattgatattatcgatagaaaattaaaagaattaatgggtaatgaaaaaccatttggtggaaaaattttcatactaagcggagattttagacagtgtttaccaataaaagaatttagtacaagatctgaaactgttaatttattgattaaaaattctcatctttggaatttttttataactatgaatttgaccaaaaatatgcgggcaaatccaaatgagagggaattcgcaaggcaattaattgaagtcggcaatggaaccgctggagaaaatggttttataactgttcctgatcagtgtataagcaagggtgatttagctaatgaaatatttggagaaatcataaaagaaagtaattttaatgaattgtctaattacgcgattttatcaccgtataataccgtagtcgatcgatacaacgaagaaataatggaaaaattccctggtgaaacccatacttatcttagcattgacgaaactgatttgattagcgatttaactgttacacccgaaattcttaattcgcttaaatgccctagcatgcctaaccatattttaaatcttaaacaaaaatcgatggtaatgttgttaagaaatttaaatgtaagagaaggattatgcaatggtacaagattacaaattgttgatacaggtgaacatgttttaaactgtgttataagaagtggtgataaaataggagaaacaacccttataccacgtataacattaattgaaaacaaaaattttccgtttgtattaagaaggcatcaatttccagtaagaattgcttttgcttttacaattaataaaagtcaatcacaaacatttgaaaaaatagggatagattattgtgacgaaccatttacccatggacaaacttatgtggcactatcaagggccaagtcatggaacggcattaaaataaaactatctgaagataacaaagaaaataaaataaaaaatatcgtatggcacgaaacattactgtaaaaatttttacgaataaaaaattttattcgaatacttaattttatgaacggtttaaaaaggagccagtaaggtaagttaatcgctacattaatgaggagggtgtagcgtgtgatagggcgggactcttgatccctttaactatcacttaactcctcggctcctttggtacccgagctttggtgcgttcacgtcgcgggtaccgttagtaagcttaattgccgaagctaaacccaaagca

SEQ ID NO: 9519 - DNA, 1542 bp, Heterodera glycines
gcaaaagctcgcaaagatctttgaggaaaaattagacaaacaagcggtcatcaaattgaatataaaggtttgaataattttataaataaataaattaattaattaactgtttcaatattgaaatttaggagtcgaaaagcgacttcgagggccatgaattcgattgggtaattatggcaatttgcatggacaacaaaaacgaggaggaggatgccaagaaaaaaatggaaaaggaggaaggagaagttgatgaagagtcggaggaccgcgaagatgaaattcaactggttggtgaggtgaaactgtccagtactgaggctgcaaaaaaatcgaaaaagaattgagaagggaaaaatcaatgatgatgatgatgatgatgaagagattgttgttgttgttgcaccataaaattggaaatgttaaacaaaacctttctttcgaaagacaataaggcattattaaatttgcttaatatatctgcgtgtaatgaataatatatttttttgctccaaacagcttcagaatgaaacgaagatgggactttcgttcaatgagcttttttgaacagcccagcttgcccgaacagtcgtcatcatcacaacgacaaagccaacaatatgatgatgataatcaacagtatggcgaaggtgacacaacaacaacagcagcaagaacaggaggcagaaaggacaaacaacaaaaggcagaggatctgtttaagcaggtcacccactcagtgcatagacttgaacgcttctccgtctcccggcatataactgaatttgttttgaacgcaagtgttgaagaaccggaagaagtgatgcgcagcgcattccagatgctaatggcacgggcaatccaacattcagaacagcaaagtgggaggaaagttgtgaagattggcgttactctgcaaggcagaggtctattgattgggaagtgtcgccattgctatgctctaacccatccatttgaacaggcctacatgatcccatcgtcctacctcttcgaccaccagagcaaaacagcagcgacacactgatggccgagttggacaagctaggccaaagtgatggcgatgaagaaggaggcagtgaagagcacggcggtgcgcccatggacaagcggtcattgctgctcagcgagcctgtgcaaatcacggtcacgtgtctaactccaccgaccggtgcggggcggccacgcttttatccctatcagcattggggttacaacgatgcgcatcgaataaggataagaaattggggtgacagctattgcctattccacgctttgattgcttctcgtgcatatcatgaccctgtgttgttcaaagaatggatgtcagcagggcagcagcagcagcacacaatggcacggctgactttgatgcaagacttttgtgaaacaaatgaaacatttcggcgtctgatcgtcaaccgagagctcatgtgttccgcagttcgccgtctcatgcttgaacttgccatacctgaagctcaagctgcctatggaatggatcatttgcaggcggttcaggaatat

SEQ ID NO: 9520 - DNA, 1882 bp, Heterodera glycines
cttttgtgttgtccgccgaaagtgccgtcaaatttgatacattcaaatcgtatttttccattattttgttgatccattggtgcaccttttattgcaattaaaaatgcaaaaaattgatctcacttcaaatgacgtttcacccggaagtgactccaagtcaatcacacgggtttcaataccattatcttttgtaaaaaaccgaacaacaagaggaaaaagtttttgattcccaaagtttgacgcatcgatcgatatggagaatccaggaaaaaaatatgtatttacataaaaaaagaatccctggtcattagatgtggtatggaactttattttttttaattttgaagaaaattccaaatttttacggaaatttaattaatgttggaataggtactaaaaaagttgtttttttaaaatacgtgttaattctatcgattatttataaggatgccaaattggtgttcaaaataaaaaaaaatgaaaaatatgtgccaaagggaggagagattaacgggccaggacgttttcgtaccgccgttttcgtaccgccgttttcgtaccgccattttcgtaccgccgttttcgtaccgccgttttcgtaccgccattttcgtaccgccgttttcgtacgagtggatatgcaaaaaaaattgcattcaaataatttgtttattttttaaattacttttaatgttttgacagttaagcttttattaactacaaaatgaaccagcagcaagtaattaaaacaaaacgaaataatgataaattggtgcatgatggtgcacttcagtaacgatggacttaagaaattttggcggtgtgagtttcatggcccggcagaccaatgcaagggtatgctaatatattattttgaattttgaaaatcttttaaaatccaggacgcttgcacacggatttaaataacgttgtgcagaagttggtcggagttcattcgtgcgacatgaacgctgcgcatgtgtaatgtcagcgtcttgtaactggactcaagcgacgtgctgctgagacgtgcgaagcacctgcgaccattcgtgctcaagtgcttcaaaacacatgcacacctgtgctggcctcttttccgagcaaagatgccacaaaaaaggtgggttactatcaaaaacaattttgtaaataattttgttttctttttattcaggtcatcaaacgtttgcgccgtgatgaaaatgcaccgcgagtcgaacctctcaatttggagcagttggagattccgaatacctatcgtgtttataagcgcactgagattgacgaggagcaattcctgttggcggacactggcgtttttcaaattcacggacagaatggaccccaacggtaagatattaatcgtttaaaccattaaatgatggtcgtttacactattaaggattctcatttttggaagagcgtctacggcagattggacccaccagatgaaagacatttacgcggacggcacttttgcattgacaccgccgcttttcagccaaatttatgtgttgttggcaaagtaaggttaagtgtgttgtcattaagtttaagcttttttaggagagatggctgggtctttcccatttgctactgccttttaacgtcgaagtgtgccgcaatttatacgcgtatgttggagcttcttgtggaacgatggccaaatttcgagccccgaacaatttcgctcgacttcgagttggccatggtcggtgcggtccgcacagtctttccggcgtgcaatgtgcgctactgtttttttcacttggtccgcaacatgaagaagcaaataagggccctgggcctcactcgtgtaattttagaattttttattataaggttcccattcaaactcattaaggtttacaacactgat

SEQ ID NO: 9521 - DNA, 981 bp, Heterodera glycines
ctcattgacaagatgagttgccactggcttctgctaaaaaacagagatgttatttttaaataaacattcattacacagaaaaggcggagatgaagcacgtcctccgctctcaacagtgttggacattccttttctgctgttttcgtacaattcatcgcctaacatgaacattttgtaagtgatagctgcagctgttcgttggccattcttttttacaaaggcattaaaaatggtggaatgatgtgcatcagtgacgtttagaccagttaaaaaaataagctgacggagtgcgccattgagaagatgcgaatcaatgtcctgcggttccatccaagattctcttaatttattttgatgtctgccggttttatgtttgggaccaaatcaaggatttcaaaaaataaagaaatttctaattaaaaaatgcaaacaatatgtaatttaaaagcgtaggtcgctgatcagtgatcacgaatccggcatccattcgggcaatttcgaaaacggacacaaattcgaacataaaatcgaaagttctgattttcgaattaggtaagcatttttggttcaaacttcatttcccgtttgacagtatataattggctacatgacatttcgcctactcgacatttcgcctactaagccaaaaaattcatttcgcctactaacctaaaattggtcatttcgcctactgacatttcgcctactattcatttcgcctactgacattttgcctacttttcatttcgcctaccaagccaaaaacattcatttcgcctactggaaatacataatgccaacgagaaaataaaaatatctatcattttttttttgcatcaaataaatcgggtcggggtcgttttcgcgtgggccgttttcgcgtggggcgagtttttggactataacttttttctttgtcaaccaaatccaataatcttggtatcattcgatagccctaagtgttctctattagagtacaaa

SEQ ID NO: 9522 - DNA, 2109 bp, Heterodera glycines
ttttgggttagtaggcgaaatgtccgtacacctatataattccaccaaacctcccccccccctacatgagcgactgttttatttcctattcgaaactccgagggtttttcggggatctttgatcacgttctgacatctatttcaacaattcctaatccttaactcgccaaactcgaacaaaaagtcgatacatttattaatcggagacacatatgtaggtaggtacctaagcattatttgagttaattcgtatatttgaatcgttttttgttccataaatgtgcattttttgaaaatttaaattttgactttttgttcgagtccggattaggggttcaaaatggaccgaattggatatcagaattggattctgcgaacatgaaacaggatggcgtaaaatcgaaaaataattattaacctttatttcattttgtactttggcatagtttcccttactggacaacaacagcacatcaccttcttcttcttctttacatacacactgatcggtttgtttctgcagtgcttctcgtcaataactaatttaaacacacaaaaaacagctttaatgagacaaaactttgccggttggcccaagacaattaataaatgaaaaggaatgagaaaagagattatgcgaccaatgccgaaagtgacaacattttttgtgggaatttagagatcaatcagtccaatgctccgatcactccgttgggaaagagagaaatagcagccaatacgccactcccaactcctttggcgctcatctcttcccgtaacgcatcagttgtccatcgtccgcatcaatgacaattacggaccgttgttcctcgggcgactgaagaccacgttgggagcgcattatggccgatgccgaagagccatcgacgccgtagagacttcgtccaaagcgatgaagctttgtttggccagcggaagaaagtagtaatcggaacctttcctaagcaatggaagagagagagagaaaactgtggttcttgactaattgtcaaattaattgactgtatcacacatggcttgaaactggaaaaccagaaacatgatgatttaatcaatttcgacttgactccgaaaatcccgactcctttttccaacccagacgtcttttcattagtttcagtttttaaattttcactctgtttcaatttttttgggcacagcacaaacgtactaattgacggggattatgttggaagaacattgggtaaggcgattccccaggaggagtaacaatgcgaaacacatcatcatcgaatttccatgaacggccaactcttggtaaggcacctttgtttaaatatgttagcataaaaacattatatgacaggtctataagacctcatagagcagcactttaaatggacgaaattgaccagcatggctaaattaggagtcattaaaagaaaacagcgttttattggcattaaacagcaagtcgtttgtacattgaacaacccaattacccacgctcgaacttactaaacgatagcagaaccaatgccttagcattttccctcattttcgtttgccagttctttaattgttagctcgcttaaatattttttggttttgagtagttagatcagagcagcagtaggagacgagatggactcaacagtaaaaaaaatgaataaaaccccaaatgaatgaatgtccgctccccccccccccctcccccgtttgctgctgcctataaattaaatgacgtttcatttcaaccgctcgtttctgtccagagaaagccaaccaaccattattctgttacccatttgtcccagtaaatttcacacataaattcgtcctcactcataaatcagtggaaaaggaaaatgaaagaacataagggaatgaacattggattttccaagaaatggtaatacggtcatggtcatatgtataatgcagttctttttgtagacaccgaaattgaagtcccccccccctccccttatctcactccctctccccttctctcttctctccccctccccctccccttatctcactccctctccccttctctcttctctccccctccccctccccttatctcactccctgtcccttctctcttctctcccgctcccc

SEQ ID NO: 9523 - DNA, 2546 bp, Heterodera glycines
  misc_feature (9)..(9): n is a, c, g, or t
  misc_feature (27)..(27): n is a, c, g, or t
acaagaaanattctatgaaaaaaaaantttttgagaaattttcattgtgaattactaagatttttcaaaaaaaattcaaaaaaatcgttaaaaatttctcaaaaaattttttttcttagaattttcttgtaaaaaaactttctaagatttttttcttgaaaaatttctaagttagcaatttttttttttaaaaattttctcgggggggaaacgattcgggggggaaacggcgggggggaaacggcggggggggaatcggcgggggggaaacggcgggggggaaacgaggtgccctcgtgtaaatgattgtcaaacattatgccaatttattaaaattatccatatgattggcatccctactgatgataagagaaagagaatcaaaaggtcaatgtaggtggaacattcaacccgtaccatgccgtttcaaatgccagtcacagattattattattttttttgaattaaatatgctctgtaagaaattatagcgccaagaattttttttcggaaaaaagcgtaatttttttcatttacactttccgattttttttttgtgtgattcttaatattccaaggaggtttaagaagccataacttttgcacatttggactaaatcgtaaatacataggtaggtggtttcgtacaaaaagctcaaaattatatgtttatttaaaatattatggaaagcgtcattgttaacactttcttttgaccattaaaatgcaagttgagactttttcgagtttttaaaaaatccttatttttgacatcacaatctctttttgacctgcgatgacctttttttagaattcgagcacagctctgactatcaagattattaatatttagagccaaagaaatcatcctttatttgaatgtcttcgtttgggcgtggtgtcagaggtgtaactggggtatcatccttcgggggcagaggaggcggcaccggcagaagtttcggcagtttttcagccgataaagccgataagtgagctgcagcaatattttataacaaatgtctttccttaagaggcgaagatttcggtggttctgatggtgaacgaacaggctcattcggttcagctggaggtggtcgaggcggtactgggggagatcgtggtggttctggaggtggccgtggcaactcgttttcttccggcgggggtgagcgcggcggtcgagacggctcgttttcttctaggggtgagcgcggcggtcgaggcggctcgttttcttccgggggtgagcgcggcggtcgaggcggctcgttttcttccgggggtgagcgcggcggtcgaggcggctcgttttcttccgggggtgagcgcggcggtcgaggcggctcgttttcttccgggggtgagctcggcggtcgaggcggctcgttttcttccgggggtgagcgcggcggtcgaggcggctcgttttctttcggcgggggtgagtgcggcggtcgaggtggctcgttttcgttcggcgcgggtgagcgcggcggtcgaggtggctcgttttcgttcggcgcgggtgagcgcggcggtagaggaggcacattttcttctggggatgaccgtgcaaaattttccagtatgttttgtattcatcaatcaattgggctcaattcataattctagccgaagaagagcgtgcacgtgctgagtcttacatcccaaccactcgcaccatcgaggacatttttggcgatgatttgaaggtaaaagacaaatacttggacattcgtgaggacgacgatgatgtggaaataacggggaccaacagtggagaatgtcaacagaccttagagtaagtgtgccttttttgttttttttctggtaacagcacactgttgattttgtgcgtcagcaactggaaggaagctggctttgaagagctgctggctaagaacatcgaacgttcgggctacactgtgcctcggaagatccaatcccgcacaattccactcataatggatggtttgtattggatttcctgtctgttaattgatctctctgcaattttaggccatgacatcaaaggacacgcggagacgggcagtgggaaaagcgcagcttttttgctgccgatcatcaatacaattatggtcaagaagaagaacaacgaatttacctccaagcgcatatgtccttttgcactaatcatcgaaccaactcgggaaatggtgattcaactgtacgaacaagcactgaagatggcagacggtgggtggactttcatttgtgataaaaacggacgctacggaggaactgttgttgattttgtcaaatcaaaaaagaaagtatttttctatgggttaccttctcatctccacctcccctgctctactagttacactaattgaatccaggaacatactctgtttgaatgcattatgtaaaaaaaaggtttaacttgaataagcattccaggttgtgacgtttctgtttctcgcacttatgggaagtacaaattccgcgagaacctgaaggacatctctacaaatggctgtgatattctcatcgggacactcggccgctttcagcatatg

SEQ ID NO: 9524 - DNA, 2420 bp, Heterodera glycines
  misc_feature (52)..(52): n is a, c, g, or t
ctttcagcatatgctcaaagaagaattggtagtggccttaaagcataattgntaaattcttattttctgttcagatccttatggaacagatgaaggttttggttttggatgaggcggatcaactgctggaggatgagagcgctcgtgatttgcgccaaattgctaagattgacggatggcccaaggtaaaatagtgcatgacggaggttgtattgttttatttttacacttaaaacccgtgctttttcggtggaagaccgccagactttgctcttcagtgcgacttttcccgatgaggttcaaaaatgggctgacgaatgggtgaagccaacggcgctctttgtctccaacaagaaacctgtctcagcgaatgtgaaggttgtccaaaagtttatccgtgtcagtcgatcttcaaaaaaccatgagttgcttaaggttggtattattgtaagcaatccttcaaaaatgcaactatttcgttaagttattcgagcaagagcgtgctgaactgaaggcggaaaaacgtgtgttccctccccttaatttctattcgatgttccatcatttagcagatgagcccgagccaaaaatccggcctactatggtgtttgtgaagatgaaacgcactgctgatgtcatctccacatatttgaacctcaacaaagtgccgtcaaccaccatcaatgggttgattggttcttttaggctctttcttaatcaaagtgtttcagagaccggccgcaaaaacttcgacatgcggccttggatgattttcgggctggccgttaccaagtggtcgtcacgactgatgtctgtgctcgtgggatcgatctcaaggaattggaccatgtttgtctgggatgggttggaattataaacgaaacaccaaaatgcttataggtgatcaacatggacttacccatcgactacacaacttatgtccatcggatcgggtaattaattaccaatgataaatgcttattattcctttgtgtggttaggcgcactggtcggatcaaagaaggagcatctacatcgttttttgatctcgcggaagatgttgagctggcgaaagaactcgttgaagtaacttttattggttggtgccttaaatgtttcgcacccacagggactccaaaaacaagaccaagaagtgccggattggcttaagctggtggctgaggggaaaatgccacttgacgagtcggaagcagccagcggtgcaaattcggtgccgatcgctgttcgcgttccgtcggaaactgttcctgacaccaattctttgccaactgctgtaactgttccgactgataatgtggctgcaaccggtgctaattcggtgccgcttggaacccgcgttcaagacgacggaaccccgaatggagaagcaaaggacccagccatccagaacaattctgctccattgccttctgaagacgccaacgatgagtggtgatttgagtagggtttattcggctccggactttcattgttttgttgttcagccttatttattgacgatctctttcatcattcttaaatcacaacgtacttagacattcgtatagctgccccatttgattacttacggatatctagcaacaaatttttgatcagtgtcttatctatttttgagagttgtttctggttttgttttattactttgataaaactttttattgcaattcacattacacgaattagaaacgccgagaattttccttggcaaataatgcgagagaaaatctcggttataaaagaaattagaggggtcagttgcttctatttgtgagcaaatttttcaggttgtaatttgatgacctcataaatttatttttatcagatcattccttcgtggtgatctagacaccctaaaagtacgtgcaatcgcggaattttttataaaaaatcttagattttgcgaaaattttaccagattttgagtacgctcattggaaagagcataaaatgttttttaaataactcaaatggttcaaatttttgaaaaattcagtcaaatcccagaacttagccgacaatggtcaaaaattgtaaaatttagaatgttttcgaatgccttttttatcttgaattcaaggatattttcaactgagagggctcgatttcaaggattccttgccattcaaggacgaatgggaaccctggctcggatggaatgtgttcgtttcatcatcggtcccccctccccctataaacaaaatttttcgacatgcgaaatgcattttccgacttgcagttcgcgcccttcccttgtgagtcgtagaatccagcactgacactgaaaggtcgaaccaattccctatcatcaaacgggtgggcgtattttgtatgtgtattcgtttgtgacagtgctccccgtatgagcataaatcttgaagtcccctttggttgtgactgag

SEQ ID NO: 9525 - DNA, 1036 bp, Heterodera glycines
tgacagtggaaaagggcgaagaaagtgaccacagcatccgatttgagttggaccgaatcggtcggatcaacttctccagggatttgccagtcagaagggtaaaattcttgccaataaaaattgaaatttctttccttgggacaaatggcaaaaaaaggaacaacaaaacggtgccatcgaaatttaatttattgtaaaatgaatgaatgattcatttcgtgactctcgagtgagtgttttgttttccatcatttcgtgttgtcccctcgctttaatcttcgcattccgcgatggatcggtaagtgtccgtctcgcgcgccttccgtttgtttttctccaattgcaatttcgactcaaagccattggagcggttcacgccgtcccaccggtagccgggcgcaattgaaaagcgattggggggaaattggcctttgtaggaggggtacactgaagcgggagaaatgaaggcattttgaattggcaaaagcattgctcaaacagattttgtcgtcaaaatgaatgagtttattaggtaaccatttagagaattatttttccgaattttaagaaaaaattgcattaaaaattccaaaaattttccccggaggcgcctaatctcggcatcacggacccccaaatctcatatttttgaaaatttaaccaaaaatggcaaaaaaaattttttttttttggcaaaaaggggtacaaaagttttgcttttctccctggcgatgaacatttggacaaaaaatttgagactcgaagagcaaaaaaaggggtattcggtttccccctcccgaaatttttttggctacgggcctagggttacgaatgtgccattttaagtggtgccaattccaagcataccaacaccggtgcgcatttggactttgtgggatttgacgcggaaatactccgccattgggtcctcctcgtgcaactgttccttcaaccgcgcgttcattgcctcgtcgtccgcgtaacgcgcaaatccctcgtccaacactttgcccatctcctgcagcttggcatcacg

SEQ ID NO: 9526 - DNA, 2930 bp, Heterodera glycines
  misc_feature (51)..(51): n is a, c, g, or t
  misc_feature (2878)..(2878): n is a, c, g, or t
gaaagcaacagcagaactgtgaggacacattttgagcgttaaaattaatgnttttttgtccgaaaataaatgcggccccctattgtttttggagcgaatttacgcagccattaatgcaaaatgaccggtcatgatagctccaaatggacaagggttttcaaaaccatgccaatttttgcgtatttttttatcccaaatttgttccgttaccccttggaaattccttttgtcacattttccccaatttcgccccctctgcgtctctgtccccttacttcctccgcctgtgccacccctcggttccacagagaatatttggcctccatttccttctgtttggccgcctcgcgctctttgcgtgccgcgtcctccgccgtctcgcgcttctccccgcgccgccttcgctcaaaccccgtctcgcgcttgcgcgtttccgcgtcgcgaccactctccgcggtggacgcttccaactcattgaggcgcttaaaatggtcaaatcatttgtaaatacggacgtaaaaagtgccgggccagttttcctcactaatcaggtggaattttgtgcaatttaaattttaaaatggaacgaaccgtcgcccatttccttcccatgttttgctcacttggaggtccctctcgcgcagctcgcgttcctcccgctccatcgcctctttgctcaaaagccccgcgcgtcctccgttgtccatccgtcgctttttggcgattgttggcatttcgttctggtcaaaacaaaggaattattcactttgataaagacaaatttaaaaagctatcaattaagaaaggaataaatgccaaaaaacatttaaggtttataattggtgaatttatttgggaaatgttttgcaattgcaaaaccgggttttactattaaaaagaatcgatgacaaaatttggaaaagcggaaatatgacaattaattgggggttttgtctttctgtcactgctctcttcccctgggaattttcgttttttttttactaaattttacatctgtcccccggttttccattgttcaaatgaccaaccgtttcctcctccttaatttcgtgctttgcctctgttgtgtcttttgtccgtcgtttcttttcttttgaccgacttttgcccctttcttcgtccgcttccaaatgggcgggggaaagcggctcttttttgatgtcgtcgtccgaaagggctaaaattcagttaatgaataagtaattgaatcataaatactccagtaaaatgcacttccccacctccttcgacggtgacgaatgagtccgttttgaaattgggcccagccatttctttgcccttccgtttcaatgccatcaaattgcggtcgatgtcgtcccattagctcatcgtcctcatcctcctcaattcgttcttcgtcgattttgctcggcttggcatgcggcgtccgaatgaaagtgtcctcgtcgtcgagcagtcgcattctaaaaacacttttcgtaattttaaaccaaattttttgctttttacccggcactttttccgcttttttgttcctttgcgccctttttctttttcttctcatctgtcatgtaccgctttagataatcggcacgagaagaagccgaaattgaagttgaatcggccataaaattgaataatttttgctgaaattttaaaattttttttattatttaacaaaatccgaattttagaaaagcggggaattgccaattcagtctcattaattaagtttgcgaaaaaagtgccaaatggaaatgaattgctttttagatgatccgtgagtggattttgctaaatgccacccatttggaggcgcgtctgcacatggccaccgtccacccgaactgtggcaagtcgccccggtgtgccacctatcacatgcttttgcacactcaaattgtgtacaaaagagtctatccgttgtgagacaaaaccaaaggaatgcaaaaaacaaaaataatacccgtgattatttacgaataaaactcatgaataacagaagaaggaattaagtattccctatcatcattttacattttcatttgattatttgtcaattttatttgaaaaaatgaaaaatgtgcttcaacttataaatggaataaaaatacaacattaatgaaataataataaagaaaaggcataataaaattaaaatgagaggtttttgtgggagatttaatttaacatttataaaccattcaaaatgatgagtttgggaatgcgttcgttggtttttcttttctcgcctctcccaacaccaaacagtgtcaagtcaatgtggcggcagtgcgtttggcgatgagaaaatagacaaccgccgctgctgcaattccgcacaaaacgacgccgaggaggggagaagccgagggaagggcaatcgaagctaaaacaaatttgtaatttattagtctcgttgatgcaccgactttcccgttctttgagggatgaaatgtgctcaaccaattggagagagtcggcgcaaaagcgatccttgaaccaaaaaattattacgcaactgtcctttggatgtgccaattttaacgaaaacttgttaaaaggtgtaaacaagatgtttttatattacaatattttgagttttttggatacagctatatatattttagtccgaaaataaaccattttgagctaacaattaactaaaaagaaaggcgccgccgaggaaatttgtgggatttaggcctaaaatcttattcaaataagcacaaatggcaactcagtttggggtggtttagtgtttctgttcatttaaacccgtacccatgagtacgccgctgtactgtcttcgttgttcgcaaatgtgtacagtttgtagcgcaacatagtcgacccgtagatggacacttggtanatttcgcgtcggaaatccctccgatcttgttgctcttcacagaaaacagttt

SEQ ID NO: 9527 - DNA, 3712 bp, Heterodera glycines
atccgttttctttttagggtgggcatttaccacatctgtccgcccatctatattctctgtttttttaaacatatcaatgatcttctcgtcgcccgaggagaagtcgacagagcggaagacgaaatgaacaacgacgaggatggtcctccgcaccaccaattcccaccgcccattcatcaccctgtgtggatcacaccgaatcatatgcgcatcggctacacgtgttttgacaacacaagcacatacaaagtgtggaaaatcggtgtcaaatgttaatggcattgaaataatcaatttttctccttttggtccggtacatacgaaaaaatggaatttgtgttccagtggggagaatttttgaactttaaaacaatttagcaagagcccgaacgtttgagctggtatactaagaaaattctgatatgaccagcgcaattgcgaaatattacaaaaaaacacaaattgttattcagcttctaaaatttttcaaaaaaccaatagggatttcatcacaatgcttcgtacaaaagtggctttttattttgttgttcaccgttaaagctcctattttttctgctattcactccctgcccccctagggtttcaaccgtggcaaatggaacgacgacttggaaatgaatgtgtggaagttggcgcggaaaagcagcatcaacatgttcttgttcaatggaccgctgtgcttggccaaaattgcgacgaacggggcattgtgtgtcaaatacaatgttaaatttttacaccgattttcaaaaaagtttcctcattgtccaaatttcacaggtgattggtgacagccgagttggtgatgtgccaacccatttcttcatggttgtgctgattgaacggacggtggacaacttcgtattggaggtttagaatttccgaggctattatcacaattactcccgcttaattaggtctatttgatgccaaatgcgccaattccggacgagaagccgatcgccgacttcctggtcagccttgacacggtgaaaattgcggccggcttgctcattttcgaccacctgctcataccgttgttgaagaaagtgaacggaagaagcattatggagacgaacggggcatttaatgtgaaatacaaggtttaaattttaaccgattttcaaaaaattttccgctttgataattgaattggaggtacccaaattggatcggctttccattatcatttaaaaaattctaaatgtttatgccttttttaatgggatagagggttcaaaacttccgtgtaattggtcttaattactcccggttaattaggtctatttgatgccaaatgcgctgttcccggacgagaagctgttgatcgccgacttcctggtcagccttgacatggtgaaaattgcggccggcttgctcattttcgaccacctgctcataccgttgttgaagaaagtgaacggaagaagcattatggagacgaacggggcatttaatgtgaaatacaaggtttaaattttaaccgattttcaaacaaaattttcctcattgttaaagtccaaatttcacaggtgatcagcgacagccgagttggtgatgtgccaaccaatttcttcatggttgtgctaattgaacggatcgtggacaactttgaattggaggtacccaaattggatttggttttccattatcatttttaaaaattcgaaatgtttattccttttttaatgggacagagtgaccatttttgttttctatccactacccattttttattccaacttccggataattggtcttaattactcccggttaattaggtcgatttgatgccaaatgcgctgctcccggacgagaagcttctgatcgccgacttcctggtcagccttgacatggtggaaattgcggccggcttgctcattttcgaccacctgctcataccgttgttgaagaaagtgaacggcaaaagcattggtggcggtgatgaccaaagtaatggaatgaatgatcatgtgcaattagacaacaaattgcaaaatacccaatgcttgttaaacgaaatgcatagaattgtcgttgcttgtaaaatgaataatttgttatgtataaagccgatgataaagaatgagattctacattgtgcatgcggtagggataattaccccataaaacgcatgaaaaagcatttgcccgttttttatagacccttaaaaattttaatattttttgtggggctcaattgaggccatttgattatagttggctgagcctactgccgtgccggtaatcactttttttgcactcttcattacatatacagtcaggtgcaaaagtattgcctcacaaaaaaaatttttttttaaatggttttctcaaaaatgaatggtgaaaaaaagtcttatttacccaaaatgcgtgacgaatacaaggtggtcgatctccaaacggcaggggaaatgttttttaaatgccaattttcaaaaacgaaacaaaaaagatatttttttcaaaaaaattaattttttaaaaaacgagaaaaagatttggaaaattgctaagtattaatttcttcaaaaatcttttggagacaggaaccgcgtgggggttgaatgtgatgaaaattttagattttccttgctggtaccccccccccagaccgagcctcaccaaaattttccaaaaaatttgcaacatttttcaaaaaattcacaattttttgatgaaaatctgctaaaatggtttaaatcgcaaaatttgttcttttttggacaaaatttcgttaacaaatcgcattaaaaaatgcaaaaattttcccggcggcgcctgtcggcaccgccggaccccatattccccaaaagttttttgaaaaaagcgccgcaaaaaaatcaacttcgatttaaagccaatgtgccggtaaatatccatcataggttccagactcaaaattgcataaaatcacgttttctaaattgatcagaattttcattgccaaaattggcctttttggtgaaaatctgttaataaatcaggacgaagttacaaaatttttccggcggcgcctaggataatttttcgagtgcccgacccgaaacctgaacccgaaatttttttcaacccgcggcatcactgatttgcacctacatctttcacaattgatttcaattggccgtgagcaatgcggtcacaactgtatttggagggtgtcaaatcaatttttgtttcttccattttgtgcgaaatttgcaaaagaaattgaaggaacaaaatttgtggcaggttttaataatttttttttaattagctgtttcagcgctactgcaccgattctgtgtttgcaatgcggatgcacggaccaacaactagagaccggaaattttgttttgagggaaagtaattagaacataattcgacgcctctcggtctgtaatgcacaaatccgaaagcattttttggcggaaaccattttgggccgaattatgggcccgtgactgaagtggtcaaatggtggtgggactgaaccgtccaaagccgtaaaacgcataaaatgcaacaaaatagatatcaatcgcttcctttcggcatgtaaggatgaatccgaaagaattttgatccaaaaagaaattgacaaaagttatgggtcctcaaaacctcaaaaattgacactcataaaaaatattgtaatggactgtaagtttataaattaaaagtgaattggtgagtgtattttggc

SEQ ID NO: 9528 - DNA, 895 bp, Heterodera glycines
catgtaattggacgaacggagatcgtaattaaataatgaaaaattcggtaaaattaaaacgttgaaaatatcagatcgaatctaaagaaatctttctccgactgaatgtagtatcgaagttccaattaattaatctttgaaattggtattattggagcccttagatattaaaaactgtttttgatatgattgataaatttaaaaataacctcttttcatttcaattttgtagccaaacagtcaattatttttcgtttgattataattataatttaaattttgtaacccaatgtccgacaattcccaaattgctatccagcttcaacgaatggcttttttgctggacgaaaaggaagccggattggaaacaatccaaaaacttttggtcgccaaaaacgaatttttggaaaaaaacgcagctgatatattggagcgacagaagattcagcatgcgatcgaatcccagcaaaatgcgcgtgctcagctgctgatcgaaataacgaacaatcttttgaccgctgcgagcgatttccaatttcatttggatttgcatattattggggaaaaccccctatcagaaagtccttaacctcaattttctgttcccggtgcccaatcgctaacaatcattatttttagagacaccggtgatacgtatagttatttgtcacttaataaaactcattttattttttaaatgtttgacaaagttggtattggaaaaggattaattaaataaaaattaaatattttattttgccgataattaagggtttaaaatctccatttgattttaattggtttaaaatcgtttaaagttggtatttattaaaactatattttcataaatcattctaatttgtgatatgatagaaagctgtcactttaggttacg

SEQ ID NO: 9529 - DNA, 1730 bp, Heterodera glycines
aaaaaaaggcaccaaaaatcgcgaaaaaggcactataataggcacgaaaatcccgataaaggcatgaaaaaaggcatttaaaaaaatttttctaaggttttttagggtgcaaaacacgtaaaacttaaccaaaaacttaattttggtcatttaaatggttattaaatattttataatgttttcgaataaggaaaatttttaaaccgagaattttttatcaagaaaaaaaaaagaattttggcgatcaatttttgagaaaatttttcaattcttaggggtgtattttctgaaattttttcaattcttagggatgtattttctgaaaatttttcaagtcatttcttaagggtgtattttcccgattttattctatttttaatggaattttcggaaaaaacgccaaaaagggcactaaaatcggaaaaaaaacgtcaaaaaaggcaccaaaacggcaaaatgccaaaaaaggcatttaaggcacgaaaatcccgaaaaaggcaaaaaaaggcataataaaagtcaacatagaagtctcaaaccaagtggaaaatgtgttatttatgcttaatatacgggaactagtgcgcagaaaaaaaagacatatgcctcaaaatgcggtctctaataatcacaacgaaatcagtgaccttttgaggccgagttgagcatggtcaaaaagtgggaaaatgtccatccaaacgtcaatacaaacccaactgaaattggggaaaatatttagggcaaatgaattttgatttttaaaatgcattaccgtcggttcatttcgtggcaattagaacaatttgccttatttcgaatgttgtcacaaagggcagaataataattgcgttgaaaacgtttttttctttctgataaatgagagaaaaatcgaaaaacaaaacatttttatagtcacgaaaatggaattgaagaatgaatacctatttgtttgtatctttcaaaaccgaatttaaaaagtcaacagatttaaaacggcacaaaaccatgaaaatacaaatgaactgacgcttactttaataaagccgtgaagtcccattacccagtgctaataggggaattaattccaggagaccttcttacgcgtccgtaattagggccctcagggcttggaagggaagggatgatgatggatgcctggggacgtctcccaggcggggatcgattggccaagtctcttagatggctcccgactgactcgattgatcccgttggctggctctccattgccttttaagcgcccctcgggatgggaggagtttatcggagtaataaatgggcgtgggaaaatgtcatttccggtcccagacttacactttgttaaggaaaattggaggaattttaaatcattttacataattaatttataaacatttcagcttgatttgcaacgatgtttgtatggacggtttcccgttttttcgtcttcctcaacttggcctcaaaattgcgctgctttcgccccgttttgatgttttagtgttggcacgcatttcgatggcaaaacggaaattaacaatttggaaaatgataattaattaacaatggcataggatcaaaaccggaactgtctgtacgaattgatggaaattttagtcaacggttcaggtccaaactcaaacataccgtattatctctaattatcgcccatctccattaatcccccatctccatttatccccccccccctttctgaggaggttgagcaataa

SEQ ID NO: 9530 - DNA, 2280 bp, Heterodera glycines
  misc_feature (65)..(65): n is a, c, g, or t
  misc_feature (158)..(158): n is a, c, g, or t
tctccatttatctcccgggggaataaatggaacttttggaaaaaaataatttctttttaaaattntaataaaattaattattcaaaatcgaaattcatttgcaaaaaattacagatttttctttctattttaatttatgaaaactccttttaagaatnggagtgctgaattttttgaagatatgcaccttatcgttctgaatcaaataatttgaaaaaattattaagaaaaagcaccgacattattttaaatgtattttattttattctttttttttgctgaataattgttttttcatttttattaaattttttgttttattggcaaggattttaaaaaaatttgctatttctttctgaggattaaaatttttcactctctctgtcaaaagttctgtttaatatttgtacttttggcggtaaataattgtttaatacgatgccctaaacaatactgaagaggatgaagtgggtggaatcccttcaaaagaacgaattcattttttttttgaattttgaaatgtcctttaaagggattaagcgactgccgcaaaacgacagtaactaatcagagcttggaacattctgtaaggcttccccgctgggatttaagtgccgtaaatttgcctttttaattaattcattttaaaattttcattgcccaaaatttccaaaatgaaaatgccgtcccttttctccctcattttcttcctcatgctctttgtcagcagcccttctcggcaccgattagtcactgctgtcagcagcaactcatcgtcgtcgcccattggcaccagcaccgacgcttttggcattccttcgccgaccagcccaatctctactgctttaacatcctacacgaatggcactgccacttttggcatccccccaccgccgatcagtccgatcattaatgcttcatcctctctcccaccgattgatccgttggaagcatcggttcagttaaaaatcggcttcctctttgccaacggcacccaacggttgcgaacgcttttcggctttggccaatccgcgcccgccgtcactttggcacttgaacgggcgaggcaagagcacctcatcgacagcatcaacttcacgtgggcaattagaatggatttcgaagctcataattaaggcccggatttttagaggcgaaaaattccaatttaggagcctaaataagggcgaaagaatcgcgaaatttttgaaagaaattttcaaaaatgccaaagcgaaaacagggccgaatgctaaaatagaggccaaacttttattttgggagcgaaaattcaaaaataagaatttttaaggtcgaataaccaaacttgggattccctagtgacggataggggcgttaaacgaagaaatttcgcgttaaaatgtgtttttcgtgcatttctcaccgaaacaaagccgcagaaaaaataagtaaaaacttaagaatccggggccctcctcataatcttaaatcaccttaaatgattattggccgtaaatgccaattttcagttacacgtggcgaatgtgcgactgctttcagccttgggctgtcggctacgctactcaactgattctgacggaaaatgtggacgctttgatcggtccgccttgtgttaccagtaaaacatttttttttgatgacactttgccaaaataatacgaaattgcaaaaaggtgccatcgccgcgggctatgtggcctccttttacaacactccactgtatctgtggggtgctaccgtgtcctcggaattttacaacaataccgtataccctacaatgaacaacttgaatgttaactcggacatgtcagttgagagaaaacaaattttttttttcttctccctctcctctcctcccctcaaattatcaatttttaccaaaaaaaaaaaaaattaaaaatggattttgcttggcattccgtgccgtcacaaaattaaatcgacatattgttaccaagggcgtagccagacccttggctttgggggggggctaaagtcaaaaattcgatttttaggggtgtatttttggttttttgaaatcccgaattatggggtgtattttacaaaaattttcgccgttttcgccaaaaattaatatttttttgccagttttgcctccatttttcaaaaatatggtaaatgtaggtccggcggtgccgataggcgccgtcgggaaaattttttgagtattttaatgcaattttgttatgaaaattgcttaggatttcaaaaaaaatttactgaaaatttttacttttttgggtttcgggggggggg

SEQ ID NO: 9531 - DNA, 904 bp, Heterodera glycines
ttatttataaaattaatttattcattttttatctcttttcccatcaatggaatttccacagttttcacaatttgtccacatttttcgcttctatcaaatcatccgacaaaatctgttctgattttgctgttgatgagtcacttttcatcaatttcaatgcataaaattatggaagcaaaaaataaaaataaaataatacacatttagaaaaaattgacaattaaataaataatatggaaagttaaacaattaagaattttgaaatgttacagtgttttactcacaaaactattttggcagtttttagcatctaaaaatgttattcctacttctaacatgcatttgtttttagcaatcctgatgaatgggcattcctaatttaaatttgtttgtttgagctaaaaattggtatattgggattatccggggtgctaatcactagggttataaattatatggattaacatattttttctgcgccaatgctatgaagaaaggggctcaaaaatagcatttctacgttaaaatttttagatttggtgaaagtttgtagtagagaccggacaagagggtcggtcggtcggtttcggtataaaaaccgaaaaaaaccgaaaccgaaaaaaaccgaaccgaaaaaaaccgaagaaaaattttcggtataccgtttcggtttcggtttttttgaatttttttatcttttcccaaaaaaaacaataaaccatttttatcaatagaaaaagcgaaagatcacctctgagtaaaattgtagagctattgaagctctatcaatggtgtaaaagttgggaaaataattgaaagaggcagccaaaaaacgtttgttagcttcctgattcttcttataaactagggttgctccccgacccctgggggggggggggggggg

SEQ ID NO: 9532 - DNA, 4088 bp, Heterodera glycines
  misc_feature (2552)..(2552): n is a, c, g, or t
attttaattgtaagcagccaatcatttcttatacggctcttatttttaaatggcataaagatttctgtttaattttcttttaattttcacgaaacacattcattttcgggttgggccaaaccgaaaaataaaagtttattttttgaaaaacttggtgctgggagcttcaaaagcttcgaaaaaatagattatttgttggggagtataattgttgtagtttttttttgtgttgctgaatttatgaaagaattattcggattgattgttttattgttatagatacaatacataaatttacttgttgataaaaatttgttgctaactgttgataaaaatattattattttttatttgttcagtttttttctaaaaatcaccggaccggggtaattattattcacagattttgtacaaaatggtcattttttcactccttaagtacatttttggaaaattaaaaagttttcttttaatcaaacaatcagccccgagtgatgcgtaaaattcttgtttataggtttgacttaataagttttttcaaggcattaacatttttatttttacgtcatttatataatatatataaatatattatatatatagttattttcaaaataaaataacaattagattttgtttttaatttcattgacaattgaaaaatttaagtttttacgtattttgctaactaaaaatgttattaaaaaaaatttttttgcctatttttgtcgcctattcgaagattcttgtgcttatttaatgccgattttacgattttactttttttgccaaaatatttttatttgaaaaaattgaaaatgcttttttaatgttttaatgtgattttgattatattccgcctccgttttctgtgcagcgctcttcaacaaattccgacttcgttctgacatgaaagactgcgccatttgcaaccacagtatcaaatttgcttttggttactgtacacaatgcttttggtattcgtggcaaaacgcaaagactgtaggacagacagcccgattcgccgggcccaacagttttgtagaaggcaaatatttgattatgacaatcaacaagggcacggtaaaagggttgtgaagttggaaatttctgtaaaaaaaaaatttaaaattaaaaaaaaaatgaaaaaaaattaccaaatcttttaattttcttagctgttttaaggcatgcctgtgcatttcgctgatgttgaatttggtcatgaattcattttgaaactcatcagaattgactcgctaaaattcaaaaaattaaaaaaaaatttaatcttatgttggaatataaaaaattaaaagggcccagcgagcaaggacgtagtggcagacccttgtcttcgggggggggggggggggctgaagtcaacaattcgatttagtagagaccggacaagaaggtcggtcggtcggtcggtttcggtataaaaaccgaaaccgaaaaaaaccgaaaaactcaaaaatttgtcggtcggtcggtttcggttaaaaaccgaaaaaaccgaaaccgaaaaaaaccgaagcaaaattttcggtataccgtttcggtttcggtttttttgaattttttaaatcttttcccaaaaaaaaacaataaaccatttttatcaatagaaaaagcgaaagatcacctctgaggtgggggaggggggtgtccggcgctgccgataggcgccgccgggaaattttttgaaaatgagtataatttgttaagagaattttatccaaaaattgtcaaattttgtgattttcaagccaatttttggtaaaaaaatttttggagttttgggaggccggcggttccgataggcgccgccgaaagtttttcggaattttaggaatttttaattaattttattaagaaaattgtacaaatttaaaaattttcaagagtccccaattccccgagttagtgtcggggggtcgggggataaaaagtcggaggtagggggctcggggtcggggagcaaccctattataaaccccccaaataggtgctaaaaatggaaatgagataaatattttaaaaatcaaaaatgtagtcaagtaaataaataaataaattttgaatatgaatttttgataaaattttccattttttgaaaaaaaaattgaaaattttttttccggatatgtctcccaattttatccggttgaatagtgtcatttgttatttttttattcagttcgtgcattcgaatcggttttgtcgcataaatgtgaatttgttgaaaaaaaaatttcgatttttcgttcgaatccgggttcggggtttggaattggttggaatagatgtcggaatcggattctcccacccgaaaaacctataaaatgaattaaatccggaaaaaaaattttcaattttttttttcaaaaaagggggggtaccatctatagtattaccggtttttttttcggtttttaaaaaaagtcggtcggttttttttggttttttgattatttcggtcggtcggtttcggtataaaaaccgaaaaaaaaaccgaaaccgaaaaactcaaaatttctcgggtcggntttttttcggttaaaaaccgaaaccgaaaaataccgaaaaaacccgaaaaaaaccgaccggtccgatctctagtcatcatcgcctgtcagcgttaccacagcgattctttaatcatcatttccccatgaccgctgcaggttcgatcccacaacatttttaggcgaaacagtgcctttaaccactgtgccataatgccgttgtagagcaatcttttataggttaattaattgatagttcataatgagcccaaattaattattcgtaattaattattttgttaatcatcacttttcttattgagccgaaattttaattaaaattaatatttttattataattaaaaaatgttttaagaaaatttagaaaaatcgaaaattaagtctatctgcgagaaaataggtcaaattaaaaaaaaattaaaaacatgcgtgcaggcggggctgaaccccgctagtttgaatcgcggtggagcgctttaaccattgcgctatttgcacgacatgaactgcggctctttgatattatttattctccacattttctcttaatttttgttgcgacattcagaaattattctttttattatttattataaaattaatgttcattaagcctaaaacttgtgttaaatttagcctaatcttgaaatactaaacggctttttgaaacgaattttgtcattgtttttttggttagattacagtatgcccatctgttttcagggcaagaattttcgagtggaggggggggggggagggctcgaaaaccttttttttcacttcaccccgaaaatttttatgaacttttttttaatttttgcaaaaaatgcccgaaaaaaatgagtagaacggcacccaccagaaagtttgcattttttacccataaaaaccgaaaaattttccgaaagaatcattttggtaaaattctctcgagaattttaaataaattttaaattcttgcaacaaaagagcgaacatttctcttttcgagttgattttttcgataaaaattagtaaaatgtttatagaaccctgaacttttgaagtaccgggactgggtttagacaattaatcgtgccgcccggtcattaacttctgtttcaattaatttttatgcaccttccacaacttttattaaaattagtttttggccaattttccgcccatttcattttgtgtgccgtcgggccgacacagtgattatagccaatgtcccccgccggcgctgggatttatttgttttcaaattatccggggaatagcagctaatgatgatgataatgagatcacaacaactgttatacccatcttcatccgtcggggctcctttgtactcacttttatgcattgtctccacgggtttgggctgctggtggcaacttatttaatcgatccccgtctctccacattcccgccggcgtcatcttttctccctgctgctgttggaggagtgaatttggaagaaaaattacttccaaaaattagaattagaatagagcggaaccgggaattttgggcaaatcaggggccgggggg

SEQ ID NO: 9533 - DNA, 945 bp, Heterodera glycines
ggggatctctagagcctaattttgaacccagtttcactaaaccataggggtgttaatacagcgccggttggacgcttttgtaatataacccagtgtaagcactcctgccacttggataaatgtaaagagtaccaagtggtagcagtgcttacactaggctattttttgttgacttttttgtacctcggtcgagacccagaagtgtgaagacatcggccacaatgttttgaatgtcggcctcccgctcaacgcggcgttcatggtttgcaactaactcaatatgattatgcacaaacgttagtttgttttaataacctttttgtcgcagattgcgctgcagagttcgcgtctgctgctccaattccatgattcgtgtacgcaataggtccacgaagtcttcagctttttctgcaaaagcgtcgaatgctgacgcaatttcatcggtcggctgaaggccgatgatagcctcacgatcagcaggtccatgcaaatcctaaattgtttactctaatggaaggcttaaaaattcacaaacatcatgcaatgcatttgcaagagtcacaggcggttggccagcgatgactccgggttgttcttgttcgggtggtggcacgtaaccgtcttcgtcctccggtttgtccgggcagtcctcgatcttgtaatggactccacggttcgcataccacgcggcagacttgaccttcgtgtttttcgagttgacgtagaataagcggtaccgtccagcgatgtatgccggtttatggaattctccattttcgcctcggccgtaggcttaacacaaaattaaagcattttttttgatttgtatatgtaaggagcgcttacagttggacaatttgtgtaagctctattttcacctaatcttcttttttttattaatcatgttaaaaggcaagaaaacattgtcaaacaatcgtttaatac

SEQ ID NO: 9534 - DNA, 2247 bp, Heterodera glycines
ccggccaccacccctccacccgtcccaagggggacagccgtgggaggtgaacaaaataaaatgaaataatgaaacaaaaaaaaattaatggtgggttttctcctcctcctcctcctcagccagctcgatcaacatcctcacgatgttgctctttgcgtcaaggtgatcgatgggatggcccgtttccaacgtgagcagagctgcgggcattcgctgtaaaaaaaatttaaaaacattgcacatgtaagtatactttacagctgacagaattatctctaccagctgtaagaaattctttcattaagtgaggcaaaaccaacctccaaggagcgaaggtgctcccgctgctgttgctgacgcagtttctccttcgcagcatccgcttcttgctgacgcaattttgcggccgcctcttgttcacgtcggcgcacgatcttcccgcctaaaaatcgccaaatttaaatgagaaataaaacaagaaaaaaaaactgaccgaaccccggaactaattcgcagagcattttgccatccatggcaatcttgtccgacaggaccagccgaaacttctgctggtcctgtgggaattcgtgaacgaattttttaaattcgtccagaatcgcctgttttaaaggaaaaattagttaatattgaaaaaattatgaacgaagaccttgttcggacaccggtggaatgtgtggtcggttcgctggcatgcaaagcactatttaccatgaacctcccttctagggctgctaattttatgtaaatacatttttttttcctggcttctccatgctctaaatagtaggaaaacacttttcttttttgtgtttgcgtataaaaatcgggacttttatttgcatatttttgcatattttgggtttttatgaatttttatgtatattttgccattttttggaaaatttgttaacaaaaatgcaatacaaacggaaaatacacccctaaaaataggtcctaaaaaatacacccctaagaatcgaccaaaaatgtttttaaaaatacaccactaagaattggaaaattttttcaaaaattgtttccccaaatttttttttcattacaaaatttttgatttaaaaaatgttatttgcatatttatgcgcatattttggccacttttcgtgcatatttttggcagccctagtcattatttacgtccattttctcgaaaatcattttcgcccgttttcttggcgaatcgtccgccgatttggtcacttcggggcccaacatttcgtaaattgcctaaaaacggcaaaatgttggaaatgtcaagcccccatttgtgtgtacttcgatgattttgatcaactccttctcgtctatcgtcccattcccgtcgatgtcgtacatctgaacgggacaaaggcaatggcatcgttttgaattcaaaattcaaaacccggaatgcccattcgagtttctgctcgggtgtgccggaggaagtgacgttgatggcaagcaagaactccttgaagtcgatgaacccgctgttgtccgtgtcgaaggtccggaacacgtgttcgcagaagccttccgcggagccggaggggaaaaagtcctgaaaagaagcggggcatgagtaaggctaaagtcagtcctcgaccgattaaatcggcacggcactgaccttgtacaatttgatgaactgctctttggtcagatggcccttgggacagtcttgctaaacggggacaaaaagcggtgaacggacggaggcgaaattatgaaggatttaaatgcttttgtcggttcatcaaaatgttttcgttttgtctcttcaaattccgtccgagctccttttctttggccaggctttcttcaatttctgtgatgttgttgagcatattttggtcgatggaaatccattgccaatccctcgaaatccgttgcccaacaaactcatcggattctgacgcattcaaatcctgtaaaaattgatttttggatttgatttataattatcacattttcagttacatcgatcaaaatgtcatggaatttttccgccgttttcgccgtattttcgccatttgtaccatcgatttgatcattatcactgaaaatgttcgcatttcggagtttgttttgttgaacatttggccaatgctccgcgactcaattcgtgccataattttgaacaccatcgcttttcggcatttgcgtcaattggctccggcactgctcagcaattgtctatcacttcgcgctgtctctttcaatgat

SEQ ID NO: 9535 - DNA, 3250 bp, Heterodera glycines
  misc_feature (3229)..(3229): n is a, c, g, or t
ttggcccactttgttctccggcggcgtgtcgagtcggacttcgccggcacagccgagttgggcgaaaaagttggtgaagttgttgctgatgtttgccaccaactcgcccagcgggtccaaccactcgctgagtctgtcgtccatttcgcgcttccaccgttcgttccgttcgcccactcgccgcacttccgtgcccaatttgtcgtgctcctccaacagtcgctggtactcgtggacatcctgcaaaaaatgcgatattttatctaatgatgtatttagtattaaatgggtaattaattgattttgggatgagacgttcgcgctatatttagaatccaagtgttcaattggcaatttttttttttgaaaattttaagaattttcttaacaaattatattaaaatttccaagagttttcatgacaacgcttaaaggcaccgccggtccccattttaccatgtttttttgttgaaaatttgatccaaaatggccaaaattagtcattttgtggcgaaaaatagctacaaattcatgcatttcccccggcgctgaaaatattaaaataacactggagaaataattttagcccgaagaacaaaaaaaaattcttggattttaccctccaaattaccaagggtctgattgttttgctatttttcaagtttttattttttccaaataatttttgtgccatgccttttcagtgccctcctgacgccctttggacgctttgctcaattccctcgtcatccgttcgtccaatgcgtccgcgtcgtccggaatttgatggttcgtgaaatcctaaatcacaaaaaatgccatggcatggatcccgcagtgccaaccaacacttttcattttggtgaacgccctcgtttcctcgtgggactgttcattctctgccggcgaatatttggccaaagttttgaatgcgtccttcgcttcctccacatttattttgtgatcctcacgaattttgcactgtgcttggtaacgtttctaaacatgagaaagcataaattgccattaaagaaaatgcattttaatttcctaaacatttttggccataacttttttgaaacattacgaaatttttgagattttgtagactaagagagaacacttagggctattgaatgaaaccaagaaagtttaattcgaatatttgtagaaaaagttatgatataaattgtcaaatttattttttggtcgtttgaactgcagtagagccaaaagttcctctcctcttttgtccaatgttcggaattattatttttttgaatgttcccaccttaacggtgttcagctgttcaccaatgtcgtcgtcgtccatgcccatcacgcgccgtcgtcgtttcagccttttcaattcgtcatccgccagcacacatttcacgctcaaagggcgcaaccgattcttaattttgaagttttacttatagttgcagtttatgataatcgaatcgttatttcattgttaatttaataattagagttcgactctctaaaatcaaaaaaagaaccaggagattcggaaaatgagatgaaaatctgtatttctgattcgaacgtttatttgtatttcttgagactgaaaatatgccgttttgagaataccagacgagaccggtcccagagccccgctatttattcaaaattccctcaccaatgagtcgacgtactgctcgaacatgttggcgatggaggcagtgatctcgcgctttcgctgcccatacgcggcctcctcctccaccaaatttggctttcccttgaccatttggtccaaatccaattccatgcgtcccatttgcttgtacaaatgctcaatgttgctccttttgtcctggtcgattgtctatcggccaaaaatgcttttatttacaatgaatttggcgtataaacttcttaccgcattgtttttgtacgtttcgtagtgttgttcccacgctggtctgtcctgactgtactgtttgatctgttggttgagcttaaagaagacgcaacaaataatgacatttccaaaaaataaaaggaaaaacgatagattagccaggccactttactcacaaattagtgttcacaagggaagcatcgaactgtaagttggaaaaaggcatgcaaatggtacggttgcataggacagagtcgatttgccaatcgtgcattttcatacccattttccgatttacagttcgagtggttcccttgtcattgtcagcccaatcgttcccggtaagaaattcgaaaatttttgaagatttgtgagattttatgccatctttgaaaatcttccgaggaacttataaatgagaatactgcttcagtgcctcgaacagcagggagaattctcgggaactttagcaaaaccgtgggccgatttaagcgtggttaacaggacacacacattccccgtcccacaataattcacttcttgctgtcgttgtcgccactcctcctccatggcttcaaaattggtcaaaaaattgtgcacttgattcgtgaagttggaccagttcagtgggcccagcctaaacaatttaaatggaaattaagcaaagaaattttaaaatacccaaacagacacaaacgaaaattccgagttactaaaattgaattccaattgaaatgagagcattctggcaaaaaatcaaatttttatcaattatcaaaaaccccaagattcgttttttggtttaaaaataataaattcaaatttgggactcccattcttcacgattgccagcattttaagttttttcactaaatttaattttattgaaccttctcagtgttcttcagcagtatttgcgggccttgttctgcaaaacttttcactttgtcctgggccaaaaaggtgcaaggattgtccacctgaaaaacgaacaaaattaaacgacgacaaacgaaacaaaattctagtggaaatttatcgttttatgttttactttttcagtatcgcactttttacccaagtccgactttttctgtcgttttgatattttttttaaattgaaatactcaaaaaaaaaaaaattgtgcacccaagtcacctggatgttgtactccttgaccagctcgcgcaattgggtcagcttcatcgactgattgtccacaaaaaaggaggccgagtttggcaatttgatgtgcacgctgaaacagcgttcgcgtcttcgtcgactgtcccaactgaaaatgcacatttattggaaaccaacggaagatgccctanatccaattaaagaatgaaaaa

SEQ ID NO: 9536 - DNA, 2409 bp, Heterodera glycines
  misc_feature (2313)..(2313): n is a, c, g, or t
cctgaagcgaagcaagcctaatcgttcttttgcaatacaggtatggtttgtatcgcagccataaaggaatgattagacaaatggacgtgtcaattcgctttatagcaattcaagacatttacaagcaaatgcctggcacgggctacaatttggctacatttaattgccagcattggagcaacgcattttttgaaaaaggttatttctttttaatgagctattgggctgaattttaaattgcaaacaaaaaagaattaaagaaacttttaaagcaagtctttggataaattttcaacccaaatttctcattaaaatgaaataaaccccacaaaaatcatcattagttaaaaggaaagtgtacagcctgtccggcattttcaagattccggtctctatttatacacccatgctacgcctttgtttgaaaaacacttgtatctcataactccatccccctaaataattgtgagatcaaaaacggtttttataccttaaaaatgcttaattctcgaatccctttcattctatcagctaccgacccattttttggcaaaaaatttcataaattttttagtctgaagacgactagtgcccactcagtttagatcaaagggaaatatgaaaatctgacttttgacattttgttcgagatgggtccggaatgcagaatttggtcgagtttttttcgaaggggagggggggctaccatccgtactattacctatttttgtttaaaaaactcactaataagaatgaacataagtatctatcttaaatcagcatttatcatatttaatttgctttaaaataaaacctgtatttcggacatgattccgcaaggtacgtggctcactgcacacgcccttaacgctctcataaaactgcatatttacaaggcacatgacttgggagagtgggtaccataatgaattgtcgtttcttaaatttcctccttgattagttgcggggtacttaccaagaaaggttcttcccctttgactgtccccgccaccggccctctctacaatttctatggaaaagcgaaacctcgtctctgatttaattattaaattgaaaaaatgttaaaatttcgagaaagaagtgttaaatcaatgcaataaaattcagcccattaggttaaacatatctagacgggtctatccccttgatctttagtggaagaggctagcatgaaaggagttagggattgcgcctgcagcggcgagggtgtcaatgttatctctatggtgcataacgaatttggcaataagaatgtttgtgtcgccagcattcgttgtacttgccagacgattttccatattagttatgaaatgagcaaatatggcaagcggaagaagcaagtttatttataagaaatatcttattttgcaccaaacatgcaaggaaaggcaaatagaaattcaagagataacaatttctgacttaactttggtactttttaattatcagtactcataagcagatttcgaaatttttttttaacaatgaactgattttaggggttttcagggtaggatccgatatttatttcaaccaattccggacccggactcgagcaaaaagacatttatttaataattgggttatttagcaatggagaatccacacgcgatatgagttgtttgcggattattgttatgaatatgccattgcgcctgatagaagaggcattctcaaaaatgccatcagaatactcgttagtgcgaatgaatgagaaaaagtgggcggaaatgtttatgaatgaagtggcgaaattgactaaataatgttgtaatttcgttgtcgcataaatagggttatttgaagaatacccattttcctctatttctattttaaaaaataataggtcgtgaaattattcttttttcaagagttaagaaggttatcattcgtgttgttacaaattcaatctcctcttttacctcaaaaaatggatgtacctccataataaggggcacgaaatcacattccactatattgtcatcctcaaaccttgtctaacattgcaaaaatcgtaggacgaaattgcgtttttgttgatgccaagatggcaatcccaccatcaaaataaaattggcatttaaatggccatttacgagtgcgagtttggtccacaggtggattaattaaaaatagaaatttctgtaaaaataaaaatttgctaaactttaaaattataaaatttcctaaataatttatccataactcccatccggccgttcttggatttaggttccttcgattagaaaaacacaaatttttgccattctgttttcattaatttattatganattaagcgccaagcccagtgttagataaacacattcataacgccaattctgttctttttttttgcggtaatcaaaaatagcgaattgatcccgaca

SEQ ID NO: 9537 - DNA, 1156 bp, Heterodera glycines
  misc_feature (34)..(35): n is a, c, g, or t
ttttagaacaataaattctctgaagttttgactnnggcttttcaatgttttaagcccaccgtgaggcgggacagttccaaaaatttgtaccacattttactgtggaaagtccaagtaccttatttggacaattaattgtcaacgaacaaagtcgcctctggtcctcttatggagcagaaaaggggaaatatcagatggggtgcgcgtcccttcctaaaaatttctcttttcgtctaaccatcccccctttttgtgcactatttcattttcaaaattgggaacatttttttgtttgtttttttgaaactaaaatgtaaaaaatttaataaaattatttctgattttatataatgcttctgtttcgaatcttttgactctaagaaattaaactgtaatttttagaacaaataattctctgaagtttttaactatgtttttaagtcccaccgtgaggcgggacagttccaaaatttgtaccacattttactgtggaaagtccaagtaccttatttggacaattaattgtcaacgaacaaagtcgcctctggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaagaaattaaactgcaatttttagaacaaataattctctgaagttttgaacttggcttttcaatgtttttaagcccaccgtgaggcgggacagttccaaaatttgtaccacattttactgtggaaagtccaagtaccttatttggacaattaattgtcaacgaacaaagtcgcctctggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaatttaaaaaattatttctgattttatatatgcttctgtttcgaatcttttgactc

SEQ ID NO: 9538 - DNA, 2445 bp, Heterodera glycines
  misc_feature (2428)..(2428): n is a, c, g, or t
ccaagtcccttattggaccaattaattgtcaacgaacacagtcgcctttggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaatttaataaaattatttctgattttatataatgcttctgtttcgaatcttttgactctaagaaattaaactgtaaaatttagaacaattaattctctgaagttttgaacttggcttttcaatgtttttaagcccaccgtgaggcgggacagttccaaaatttgtaccacattttactgtggaaagtccaagtaccttaattggacaattaattgtcaacgaacacagtcgcctttggcctcttatggagcagaaaaggggaaatatcagatggggtgcggtcccttcctaaaaatttctcttttcgtctaaccatcccccctttttgtgcactatttcgttttaaaaattgggaacatttttttgtttgtttttttgaaactaaaatgtaaaaaatttaataaaattatttctgattttaaataatgcttctgtttcgaatcttttgactctaagaaattaaactgtaaaatttagaacaattaattctctgaagtttttaacttggctttaccatgtttttaagccccaccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatcccccctttttgtgcactatttcgtttcaacattgggaacatttttttgttgtcttttgaaataaattgtgaaaaaatataataaaattatttctgattttaattatgcttctgtttcgaatgcttttaagccccgccgtgaggcggctcctttttgtgcactattttcgtttttaaaattggatccggattttttggctttttcaaataaattgtgaaaaattcaaaacaaaaaacttttattgcgctacaaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgttttaaaaattgggaacatttttttgtttgtttttttgaaactaaaatgtaaaaatttaatagaattatttttgattttaaataatgcttctgtttcgaatcttttgactctaagaaattaaactataaaatttagaacaattaattctctgaagtttttaacttggctttaccatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatcactccctttttgtgcactatttcgtttgaacattgtatcaattttttgttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgcctctgacctcttatggagcagaaaagggtgaatatcagatgnggtgcgtcccatcctaa

SEQ ID NO: 9539 - DNA, 3947 bp, Heterodera glycines
  misc_feature (27)..(27): n is a, c, g, or t
ttgcatgggcctggcaggtctcaaaancacctcgtagactaggggggataattaggagactgcgtggattaatagagactgggctataattagagcatatacggtaaatgtgataccatcgatcagaaaatttctcgagactcgaaaaaatggatgtccaaaagtgaaatggcgtctcaaaattgatactctcggtctattatccgaagcttcagactgttaaaaatgtcattttttctcaattcatttatcaaccgccaattcaggaaatctttgaattgattgaaaatgcaacattttgaacgtaatcgaattttctggcaacttagaaaagtgcgggaacatttggccgtcggtgccgcgaaccattgggcaaaagtggtcgaagccttcacgcgcgtgccaagtgccgtttccggtacctttggcggtggtcctccgccatttaaagtgcgaaaaatgccaccattggtggcattgttggtgcttaatttatccaattcggccccattttgggtcaatgtgtcgaggaaaagcaaactgaggaaaagcagtggaaaaagtatcaaattagtcatttaattaatttgtgcacaattttaaaaggtttttgtgatcacattaagtgaatatgtaatgctctaataatgcactttttaatgaaaattctcttttttatgtgtttgaccatttttaatacctttttaattgggcattattggcagaaggaaaattttgcgagattaatattttggtaaacagataatctcgaggattattatataaaaaattcaaataattaacaaaaaaaaatttaaaaaaagaaatttatataaaattcgaacataaaaaaattcaaagggtgttgcataaatcttcaaattttaattcattttaataagaacattttcaccaaatgcatgtttttcatgctttttcacatgaataaaaccgcctaaatatttatttatgcttttttaatgaaaattttagccgttttccaatgataatcacatagtttttttttggcatttttggcaatatcatatgaataaaatataaaaaaggaaagtgaatgtaaacgtgtgctgtaatatcaataatcaataaaattgtaaattaaaaaaaatttattcattatttgccattttataaaattaatttaataaaaagtaataaaaatataatgtaaaattattttttacaatttttagatgaacattttttcacgcttcagtttaataattttctttttcctttatgttatttttgttttcattgaagtgaatgaatgcgctcccggctttttggatgagattttagcaaaatttagcccaaataaaaaaaattggaaaaaaaagtttatgaacaaaaatttggtcgaacaatgcaaaggacaatcggtcgaaacaatgacacacattttcaattacaaatcgctgaagaacagacgcgaaaataatgttcacgataaagttgatggatttatggcgggggctaacggaaaagtatggcaaatttggagaattaatttaattagaaataataaatgctttttcaaatagattttcatcggttacattggcgaccgtgagaaatgtgtcgcaattaaactgatcaaaaatgatgtgaaaaagaatatatttgaaaattcatatttagtgatgaataaaatacagaaaaaattgccgtcgcgggaaaggcaacacataattgagctaattgattagtaagtggcaaattagaggcagaaaaagcaataaagattgaaattaaaatggaatttaattattttcataggaatgaattattttctgttaaagtgcattaacattcacaatttcttcctatttatacgtccgacataaatttgaaagaaaaataggcaaatttttaaattaattattaaaatataaatttttaccattaaaatttttacatttctttaagcggaatagcaattgtcagagtgtcaaagggtggtcatattagagacgaagacacaacaaaattcttcggatgtttctcagatgacgaggaacaaaatgatgatgagaaaatggaatttgaatttggcgcactgataacggaacttggcacggaaacattcggcgaaaaaatttacaaggacagaacggactttgaaagtaatcagcggagcctggataatgtgataaggcaaattgttttgccgttgaaggaactgcacaaaggcacgtaaaaaattcaaaaagacaattaattaaacaattaaattgacggaaagaaactacttttctgaaagatttgttgtagtgccttagatttggctttgctgttgaccgaccttaaagctcaattaattaagagtcattttctaaatttatttttttcaattagcactgtaaaatttaaacattcttctcaaatcctaatttgtttctccagttgccatgcatcttgactataagccggacaatttggtttatgttgaattggaaaatggaggcaaaattctcaaagtgattgacttcgatggcacttatttgctgcccgatgcaaaagaccgtaagggaaagttggcaattgtcagcgatcgtttgaaaattttgaccggcaccgaaaggtataatgcgcccgaattttacgcggaattattcgccaaaaaggtcaaaagttgtattccaattatctatccatttaagaaattgcaataatttagctttcaacaaaaacggacatttgggcagttgggataatgctttacgaaatattatttttgcagaaaaaatatacaatttatgaagaaatgggaagtgacacgcaggtcagttttatacatacatatgtataaaataaaaacaatgggctttgattaaattatataataaaaagagaccgacttttgaggcatattcatttttttctgcgcattagttccggtagattaagcataaaaaaacccattttctacttggtttgaagcttctacgttgacttttcttatgcctttttcgggatttcgtgccttttcatgccttttttcaattttttggtgcctattatagtgcctttaatgcgatttttggtgcctttttagtcggtctctaataataataatacgtaatttaattttttcggaaatgaatttcatcaaaaaacgatttttaaggtaaaggtgaaaaaaacagtttcaaatgggaataatctgcagcaataaatattcagattagtgatggtcggaaaccgaaacgggatccgggaatttatccaaaaagaaaatttgcaaaataaaaaaaaattaataaggataagaaaatctaaaattttaaattcactcaatattcatcactatttaatcacactagaatatgtttttgtaaattacatacaattcccattcttttatcataatttttccgtcatgacgtatcaaaatcgtctgtagaacacaaaaggtaactcgcttggtgggactcgaaacagagagtgtgacctaaaacccgcgccccgggattggtataggaattcaaaattacggtttagactagccaatttttaggtgaaaaaacattaaccatttcaaaagtcgaaagagtaattattgtatttgcagagctttaaaaatttgttgtatcatctcaatgaaattcatcgtggttttacagtgtcaaaagatctcattaaatacaatcaccatccaatcacttattccgctgaatggctctcaaaatttaatgtgaaaattctattttggatgttccaagcatggacagattttccaagggttggcctactgattacggtaattatctaattatatttaaaataaaaaataataattattgagttttgactagagaccggaactcgcgcggacttttacgggcttcccggtcccgctcccgtaaattattcatttaaattaatgagtcttgtggtattatgcgtcctaactgcaaaaatta

SEQ ID NO: 9540 - DNA, 2299 bp, Heterodera glycines
  misc_feature (2202)..(2202): n is a, c, g, or t
ctatctcaaataattagcatttttacgctgaagaatttgctgagtgtcgtgccaacgaaacgaatgagtgccaaaggaattatggactttttggacggcaactgttgtccagtggaattatacgaagaaaagttagaaattgagaacatttttaacgatttgtcagtgaaagaattgaacaaaaacattgatcagagagtagaaatggacacaacggaatttgaggaaaagcagaaattgttggcgatgaaaagaatgatgaaaaaagcgcgagtaaagcgattggaaattgccaatgtgctgaaactgatcagaacgcattgcgacacagagacaacgggggactgactgattagcacagaagcgatagctaacaaataagcacaacaaactcttatcatcccatctgaactccgtaatcatcattagaaggatagcatttttaggacccaaaaaatgagaggtgtatttttctctgcactctcaattttttgattcatctctcgtttttcggaagatgtgtaaaagattttccaaaaaatatttttgagcttgcttttgaaaatctagtgtaaaagccatccatgtcaacaaaatttttattaaaactttcaaataaaataaaatattttttgattttaagttttgtaccaaaataccggtattaatggtaagattcataaatttatcaaaaacttcctagtgaccgttcattcagagttaaaatctctgagcggtattctaattcaaaaaacatttactctggggtgcctgccacaaggtaagtgtcttaggccctttgctttttcttatttttattaatgatctcccgaataatttgcctaacaaataagcatgttggtattaagatgtgagcatgaaaatgataaaaatagagataatttatcttccacgcttaagccaataaataaattgtcataaaataatggcctaaaaatatcaataggaaaaacaatggtcctttacctgggtgaaaataacacaaaatttttttttttcttgatggcgaaccattgccagaaacaaaaaagtgtaagggatttgggcattttaatcggtcaaaagctttccttttctaaccatattaataaaattttaaaaaattcatatttttcttgttttcagcttctccgagcgttaaactcggaagcttgaaacattaatttcggcatataaaagctatatcagaccacagtagaatacgcaacagaaatttggaatccattaaaaaaagaaaatgtccgcaaaattaaagcagttcaaaaatttttaacaagaaaagtcttcaaaaattgtgggcttgttagaggagtgatttgtttcattgatatttattgtttgttcaatttgacacttattttgtgatttgacacttattttgtgatttttgactaccatttatgttttttttattattcgctggcattttatgttgccattaaatcatgttcagtaccgtcttttttggttagccgacttttgcgccgcagacatttgcgccacgccatttgcgccgcgacacttgcgccgctcagcaaaaaatactcttgcgccgctgacatttgcgccgtgccatttgcgccacgacacttgcgccgcctaacaaaaacgacatttgcgccgcgacatttgcgccgtacagcaaaaaaagacatttgcactctgattaaaataaatttatttgctttatagaataagaattgataaatattcattattaatacctttttcgaagcctttatgtcaattccatattgaagtgcacgtaatgattgatcaaatcttgattattttggttttcattgggaccatatgcgataacaagccttcgtattgcctgatcattaagcggcgaattttaagcgaaaaaaataggtaaataaataagggcataaaaattgcgaaataatgcgaaaaatggtaaaataggagcgaaaatttgaaaatcaggtgcgttttttcaatgaaattaaattaaaatcgatgaaaataacatattgagcaaattaattacaaaggaattgaatttaattcttttttcgaagcaaaaaaataattggggtttctacagaaaattctgtttttttcggttttttgttagtttgtatattcttaatcattttttcatatctttgatgaacctattcaatgttaagattttaatggttaaaaaattgaatnccaatctttgtgaaaggtaattttttcgaattttcaattagttattttccccggggtagaatatagttttagtaaaacttattgatattagtgaaat

SEQ ID NO: 9541 - DNA, 1296 bp, Heterodera glycines
  misc_feature (1142)..(1143): n is a, c, g, or t
  misc_feature (1212)..(1212): n is a, c, g, or t
  misc_feature (1248)..(1249): n is a, c, g, or t
  misc_feature (1251)..(1252): n is a, c, g, or t
  misc_feature (1267)..(1267): n is a, c, g, or t
  misc_feature (1281)..(1281): n is a, c, g, or t
atcagcagggcttggatttatatgagtccacaattgttggcatataataatgtaagagattatcagagaaattgtgattattgaatagtgcaatttattgtatttcaaaaaagatgctctcccaactctccaaatggcttatatgtaattagaaagcattaatcagtaaaaggctaatcaacttataaagccgttaaattcctttttattttttcccctatccttaccctattttgagatatacagtatgcctattctcactaatcttacaaaaattcaatgcattatttatattattttattgcattttaatttgttatttgcatgccccaattaaaatgcaatgcgtatatggcaataaattcaattataattttatttagaattaattttaaacatggaaaatatccttgatcgtgttggcgagaatattttggagcgcatccaaaacaaacagtttgaaagagatgtactgtaaattcaaaaaaaatatatataactttaaatttaatattttattccttcattaggtagagggattcatcccggtgtcgggtgagacaccgtccccatcatttgatctgctcagagaccattggctgcaggcaataaaaattaattaaattataaaaataataataaataatatattgttaatattatagagagatggtctctatgaagatgcaaagtttccagtggagtcaattcaattgtacttcactgcagggccagtggcgatccgatggctgaggcctggtgaaattgttgctcatccacagttcataaaccaggagcccattgctggggatgttcggcaaggaagcattgggaattgctgggcgctgtccgcggcatcggtgttggcgcagtatgggcccctgttttacagggtggtgcccccggatcaggggttcgggcataattacgccggtaaatttaaaataattaaatttaaatattcagtcagaatttaaaaaaaaattgttttgaaacgattccttttttcaatgacatacaattttggtagggatcaactgcgacttgggtcaacttcatctgacaatgagccaatttcgtctcgccaactccgttttggtatataatgggctaactccgtctcagacaaaaattcaaattannatttattagttttttttattataaaacgccattttttggcaataatattttaaaattaagtgataattntatccgactaccacaaaaatgttcaatttcccttgnnanntactgtagtttttgngactaataaattanaagacgaataatttt

SEQ ID NO: 9542 - DNA, 2545 bp, Heterodera glycines
aaggtttacacaaaaattcttcgttttttacaatatccccataagaaattttgaattttaatctatattccctgaaaatttgaatagttttatacaaaccatataagcaataaaaattggtcattttttgaataactgttaacaaaggacacacaatttttcaatatttttcccggcggtgtatatcggcaccgcctgatccccccccccccccaacatttccctattttgtcaacaacgacaaatcggtaaaaaacagcatataatttttaatttatataaaaatgaatggtttaataagcaaatttaaatttgaatgcagattttatttaataattagccatttgttggcgcaaaataacaatattattattgtgtttttttattttaatttacaaatatttgcttttttttctcttttttcaaattaaaaaagttcaatataattcagaaatctttttgtgtagaattaaaataatatattaaaatttgcttttttattgagctatataatttaaataaatttattttttcaataaagttattatttctaattaatatctatacagggaatttataaaaaattgttatttagcttgtattattttttcgtaaggatagttaatttttattaacaatgatcgattggtcgaaaaatggttgaattaagtgtgcttaagagtcgcaaataatcactctcgggggtgcttgcgcgttttataaaaaccgccacctagtcgcgttttataaatccgccagtcgcgttttataaatccgccacctaacaattcgcgttttataaaaccgccagtcgcgttttataaatccgccaaaatggaaaggcgcgttttataaatccgccagtcgcgttttataaatccgccaaaatgggtttgcgcgttttataaatttgtcaatatgcaaataaccaacaaaaatactaaatttattttttttaatactaaatagatcgataaaaatatttttatgtgacaatatgtgccagtcagactgcaataatatttgccaatattacagctgaataaaaacaaaaatatttgttagtattgcaattaaattctataaaagcattaaattttaaattaatacccatttcattttattttttattttataaatgaaagctaaattttatttattagcttatatattactagtatgctgctgctcaaaactttttcatggaattagttttgaggaattaacatcaaacaatcacgccaaacccttaattgatcaatatcttcgaaaggaaataaagactaaaggagaattattggaaaaactggctgaaatcggagtcgacctaagcttgagaagcttggaaagatatatttcaaaaataaaaaatagaaaatcaacagaaggaaacaaagtagatatggaaaatgccgaagtatcgcaatgtttttcaaaatttgataacaaatttctttttatcattgggcatgaatccgaatatcgaaaattcaataaaactaacgagagagaaggcgtaatttatttgtactgtatgtgttgcaaaaaattgaaaaaacccaattctgacaggttagttttaattttaattataatttttatatagttatgtgtatttaagtttaatagctagtgcaatattacgcgatggcttattagacagaactcatcaaataattcatgataaacaatgtaaaggagtaccgcttgagcaactagctgctgaacaaatagataggagccaaagacgagatcttgtgcaatgttctataaaccctaaatctttgtggcgagaagtatttctctttattaaaaccagaactttttttgttaaggggtctgatcgggctagagaacacgatgttgctgaggatattgaaattgaagatatttctggaatttcatttaactaccctaattggcaatctgtaagaagctcttactaccgtagaagaagaaatcacctaggggattgttctgatccctttaatgtcccagaaaggcttcaactaaataaacggggttcaataaaattgcttcttaaaaagaaaatttccgaagaagacatgtaagcattagttgggtaaatttattaaataaaaactttaaggtggttgcgatttagagataaagaattaggtgtaatgctttttatttcacattctcaaataaaagctgtcagtcactgtaaagttttaggtaatagtacctaatgatcataaagaaagattattttttagtttccgacggtacttttgaattggcgcctttgaaattccaacaaatttggacaattcacggattggttagagcttttccgttggcaggtgtattcgcccaatttagaaatttcggttagactaattattttatatgctaaaaattttacattaactattttaagctttcaatagtcaaaagaagtcttcacattcaatatttttatattaccatgatgcgcattttgaactcataaaacaaccacaagtttgcattttactcgattatttatttttactatatttaaattatataaaaattgata

SEQ ID NO: 9543 - DNA, 409 bp, Heterodera glycines
aataatatgaaaattaatatgacaattataacggtaattaatcattcacaatttggtttgggcacggtcataggaacaataaaaacggtttaaaatgtgccattcggtcgacctgctgtcggtgcttgccaaaattgtcaaaagggaaacgaacgacacagaaactcaacggtcaattaattaattaattaggggtggattaacaatatttttggtctctcttttgcttcttcttttttggtttgcttcactttgtgtcacgcggcgccgtaagggtttccggcggagttcagcgacgggtacactgaaaaaggaggcgatcaatcgtccgttttgcatccaaattaccaactctcgcagagagtggtcaattaatcccacccgattttacccccgaacggcgtttgct

SEQ ID NO: 9544 - DNA, 2707 bp, Heterodera glycines
cattgtgtccatgtcgccaccgtttgctgttctccctgtccctcctccgttgctcatcgacggcgtcggcggccattggggcgcaaaatggccaaaggaagtgcggttttggtgctgctgttgttccatgttttgctgaaggatcgaaggcgtcgaataactcccatcggtgccagctaaacgaatgattgaaaatatttaaaaatatatttaaaaaataataaaattcaaaagcctcacaaaacggagtctgcgagtaaatgccaaatccgcccgtcgtttgctgttgtgcggagttctgttgccaaaaagtggcgccccctgcgccattgttttgtgtgtacggagtgttcgctcccccgccgtaagtgttggtccccccaaatgcctgcggcgcgccgaagggattgttaataattggctgggcaatcggaagttggggggcgaacggcggtgggtgagaagcagcggcgccggggaggaaaggattggagagggcgggggacggagcgacgaacggcggcgcattttgcgaaggcaaaggaactgaaaaataaaggaaaataaagtgaaagaaaaaggaagggaaggagcaatggaaaagtcgcaatattttttaagtgtaataaaaaaaattgtttgctcgttaaaatattgttgtaattgtcgattgaaaataaaatggagtgcatgaaaaagttttgtattataatatgggtcagtgtttttgataagcattattaaacaattaatcaaaattattttgaatattaaaatgattaatacttgtctcgttcatttaatttaaaaaatgtaaaaaataactgccccatggcgggctcgaaccgccgacttctgcatatcccatcacttataagtacagcgctctaaccgactgagctaatggggcactcccgctgcctttttaaaattcttttagttgatataaaaaagatttttgtttgctttaacaaaatgcgcattttgttaaatgtaaacaaaaatcaactgaaattgccttgttgggatggtcggttgttcagctcggcgacaatggcgaagggattggtcggctcaatttgaccgacggcgacagaattcccatcttttggcggagtgtcgaaacagataaggtcggaagcgagggcgaacggattggtggagggcggggggatggacgacggggagggcacggaagaagtcggcactgaaagggcggagaaacatttggagaaagacaaaagacgtattttagggaaaaattaaataataacattgccaataatttgtggttcttatttgtttagggtttggaatatatattattattcattaagtttcaaaaaaatatggccagaacaactcaaaaacctggatttttgaaattttttggtcttggtctttttatatatgaacaaaaccattaccaagaatgcttgattttgttgagaaaaaagtattgtccgaaaattcattggaaattaaatgaatttttgtaaaaaaaatatttcaaataacagtttttgtcccttatgaatttaaagtttccacttgccccctttcccccattttcccacctcctccccccggctgttgttggatttggcgtcggcgttgctcctcaaattggcgcagtctctccttctcctcctccaaatagcgctgctttgccatttcgtctacgctgctgttcgattgaaataactgttcctgacgggccgaattgatttgctgggagaccatctgaaaattaaacccataaaattgaattttattcaaattttgtgtgaacttgttggacggactgtgccgactgtccgctcggcgcgccccggccgccctccaattggaacagatgcgcttccaacgcctccaaaagggaggctggcgcccgcgtcaaatcgggcacttcgccacggtcaatgccaacggactcggcaacggtcaaaaaggcggacacgcggtcgaggcgagactaacaaaataagggagtcaaaattgaattttatttaattcaaatacactcgtcataaaaaaatacccaaaattcaattcaatgagtataaactcaccaaaaatgctttgtattggtccaacgcctcgcggcactgttttttgttcatgtcgaagaatttctctaataaattgatcattccgtcgttgtaacaggcgaacaaacggatcaaatcgcggaaaagcaaaatgaaagagcaattgatgacgccgttgttcaactcggaactgctgacctgaaaaggcatcgaaattaaaagaaaaaaagggggagcggagaaggaatgcctgaaagtcgagcagagagtcaatttgggactgaagaattggcattgttttcagcaactgaaagatggcacaaagattagtagccaattgaaatatgataaataggtcgataaaaaaaaaaccaattttccttattttttaaaaacaatttaaaaaggaaaaaagttaaacaaattaatatcattcaaaatgtattatcggattctttttcaagtatttttttgtatttttgttacttttaatggagttggacttacaaaccaaaaaaatcgtatccatttttgggactttatccccccccctcccaaaaaagtgcccttcccgtgtcccatttgtctgcagtatttggccattccctaagaaacaagtgtgaatttgcttaggcctcactttgtccgtgtgcaaa

SEQ ID NO: 9545 - DNA, 1110 bp, Heterodera glycines
agggtgagtgagtgctcggctccccccccccccgcccctttgggcgaaatgacgacgacaaacggaggccgaaatctcggaaagaaagggaaagaaaagaggaggggaaggaaggaatgttttgatggatgggaggataaaataggcggaaaagagaagaaaaagcaaaatggagttgggggaatgggtgcctaatttcgaattcaaatgataggccaattggtttttgaactgaatgaatgggctgaaatggaagccattcactgggaataattgggggagggggacgaacggcggagcaaaaccaaaataaaatggaagggacggacgaaattggggagggaggcaaaatgggggaaaaggggaataaaggggggggggacacgtgtccactccgaccatccatcacttttggaaagtcgacacactgctgaatttgttaataatgaacgaagaaaaggggacaatgcaaacggagaaaagcaaagaaaacacaaatattatgggaaatttgcggtgaatttattggggaatgattcatcaaaagcatttccaatcgcatcggatgacaaagttttgtttattttgccaatgtttttcccttcgctttgtgccgcgtttatttgccaattaaatatttcggccaatcaaataattgttcttcgttgggattggcgccgggatttgcctattttcagttgctcaatttttccttggacgttcaaatggctttggcattggcacagccgatgagacaaatgccatcaaaagtgggtcgggcgggggaaaactccccctttttcttccattttcaatagtccgtccgtccctcttcccccacccatctttgccatttgcgattttccgtcccgccacttaaaagtgaaaggaattgaaaaatggggaaaagaaagggaatggtggggagaatggggggggcagaggagggccaaggcaatgccatcgaaaggttttgtgccgttgcgttcgctccgtcggcggagcgaaatgacggaaacgaatacgaaaaagaataatgtatatggcaaaaagataagccaaaagggtgagagatagagaaaaaaagtgaaaatgaaagagataaaaagg

SEQ ID NO: 9546 - DNA, 3656 bp, Heterodera glycines
tttaaggcgtcacttacattgggtcgttccactcgcccccccccgtactcgcgttttgctcttgatgactccaattcttccgtttttcattttgttttgttgagaaattcgtccgttccgccggttcaaaaccaacaagattttttgttatgccttggcaaactttacgagttagtgtcacgtggaaaatgtacgtttgtcgatttggatgttctgcgggatggcgaagaagcggacgaaggactgccggaggaaattcgctcattggacggatacccaaactttggaatgcgactgatcaaaatgcgtgggaacaaattgttgtccaatgattatatggcagaagaggaacggaaattgcaatatccaattgctcgggttggttaaaacggaggagggagcggtattgacccatagccaaaaaaagaaaatttaaagttttgttccatgcagtttaatcatttataagtttttcaaattttaaatggccaaataattgggcttggggtcgcagatcacgaatccggcatctctatctcattttcacagattgagaacattcgacgaacagaagttggagcagtgcctgaagctgatccaaaggacatccaggcttgcagtttgccatgctctttctgcgaaggctatggtggaaaatgcccgaacactgacaatctgtgggtgtgcgacgattgttgcgaagcattgacttttgtcaaaatcgaaaaagtaattaatgatgattgataatatcaggaaaaaatctaatacctatttaaggcacaaattacgcattttttttgcgcttgtggaaaaacgccggtggacggattttcgtttcgctgttccgatgtggaaaaacatggaactgaattcaagcattttggttctgaagcatcactggaaaaggaattggatcggttgaacaacaaaggcatgctgacctttttgctgctcggtgagacgggtgttggcaaatcgacgctgatcaacgcactcatcgcttacctgaaacatgcgactttgaaagaagcgcttgaggtgaccgagtttattaaatgttgtgtttgtaattggcattaccgtatttgctctaattatcccccaatctccaattatcccccagtctaggaggggtttgaaaaataatccccagtctccatttatcccccagggggataaatagaattttcagaaaattatatgccgtcaatttttttcaaaaaacaaacaaaatcgacagtaaaagtactacaaatgccaaaatagtggcaaagatagtggcgaaaagtccataatgacataattttcagccaaaaattgagcaaatttttttttattcactgggtgctgttgcaaatgaggttacatttccttctaatattttagaaaatattgacattttttacatccaaaattcttgacaaaaaaaatgagggatgaatagcttgcaaaaatttgaaaaaattagttaagattgaaaaaagttataaccaaaaaagttggaaagccgacttccaaaatgttttttatagtggcaagcccaaaatagtgatttaaaaatgccaaaatgacgacgaaaacccaaaatttttcatatgtttggggtgtaatttttaaaaatttccaaaaaattgaactttaggggtgtatttttcgcttttttgcattttcttgtgaaaatttgccaaaaatggccaaaatatggactaaaaacgccaaaatgtcgaaatattgatttatccccgaaaacccccaaaatatggatttatatggactaaaaaccttccaccaaatcgaaaaattttaacgcagaaatgttatttttaagcccctttcttcatagcatatgcgcagaaaaaatatgttaatccatataatttgcaaccctaattatagatacctagttaaaaaactagaaaaaacagaatttcttttaaaaaatgcaataaaaaatgatttttctttgactcgatgacattttttggcgacatggtcaaaaaatttcaaaaattttacacaaaataattctgtcgaaaaataatccccccttctccatttatcccccaatctctaattatcccccccccctttctgaagaggttgaaaaataatcccccatgggggataattagagcaaatacggtaactgaggaaagagatgaagaccttaaacaataaaaaaagataattagtgctaattgcgtcattaacagattaaatttgtcggattaattaagccaccatcgttctgatgctgctgttgactcgttgagggtcggctgtccaaataagtgatgaatttctgcagagcaccgattggagaacattcggtcgtcggcagagaatttaccaaaatcataaaaatggataaatattttaattgccattttaaaattaattaaaaatactatactatttatttatttgtgtaattttattaaaatattcaccattctgagacgaactctgcttcttaattgaattcgcaaacagagcgtcaattgaagaacggctcattccaactgaaatttaaaaattgttaaattattaaaaatatttatttgattatttttaattctataaatgtgattataagttgcaaatgtttcaaactttgctgctgatcagagacaaatttccgtatagatttgagaggagaggaaaagtttagtgccgacgtcggcacttctgaaacgattagaaaaattataaaaaaccatatatttatttaagttgatttgatacttaaatgtttaaagatttacttattttgaatgaattgacccaatggatttgcaagattagcgaaaagaatcgaactgttttggggttgtgacggaataaattcaagaagattggatgaattaaaagcagaaaagagagagggtgtttatgtgtaaatgaatgagtggagaacgaatggtacggtaaaagcagagggagggccaacaacagcagatgggcaaaagtgggaaaagaatgaaaaagttgagatgaatcggccgggatgaaaaggaattaattggaaaagggggaacaaatgaaaaggtgggggggggggcaaagaagacagacaaattccaaaattcagaaaaaagacaaaagtcagagagagaaagagagaggggggaggaggaaggagagagagaaagagaggaggaagaagaaagaggcagagagagaggaagagagagggagaggaggaagaagagagagaaaaaagagagtgtgtgcggagagagggagagagagagaggaagaagaagagagagaaaaaagagagtgtgtgcggagagagggagagagagagaggaggaagaagagagagaaaaaagagagtgtgtgcggagagagggagagagagagaggaggaagaagagagagaaaaaagagagtgtgtgcgtgtgtgtgaaacccaacaaaagaactggcgaaaacatgagaaaaaaactgcataagtccgaactgttgggagggaaggcataaaagcatggcttaaacagtactttcggagttactgtaattctaggatttatttgtcccgtacgcttttcaccgtacttggctgtctttgcttcttcgtcttcatcttcttctgctgtgcattgtattgtctgagccagtccgtttcgagttcgctcaacggcaccgaa

SEQ ID NO: 9547 - DNA, 3097 bp, Heterodera glycines
gggaaagtgctgtttatcttttatatgaagcccactattttgatgaggccagatagtttgatgggcattaggttgtagctgtcgtgaaaaatggtgagtgggccatgctcgttttccctgattttcagctcgtagaggcgatttccttgtttgatgatgtccgggttgtgaatcccttgcgacaaaacttccttgatgatcatcgtcatgtcgtagcggcccccaaagtgtgcaaacgcgactgttggaaactttttgttgtggtcgaaaagaagccactggacgaattcgcacagcggttgttgagtgacgactttttggtcgactgttgtctccgtgtagtcaaagggtgaaaaggtgattgagcggtgaggaccgcaaatttggcacttttttccctgaagtgatttgttccagtagccgttgataatgcagtcggtgcagatgatggtagccgctgcaaagttgacctcgtgttcgaaacggttctccaccttcttgtcctgtgtcgcctcaaagtcgtatgcgatgatcctgtatgacttaattctttgttgtttaaggggttggatgaagcatttcgtgcaggggttcatcccgtcttcgtcgtcttcttttatatgaaattgtttgcaaagtttacaaaactgttccccacatttatgcccaacactcccatgaacctttatgttataaattaccccacaatcttcgcagcgttgaaatttggtgcacaaatccttgtggaggtggcgcccataacagctgttgttgtaaaaggtgtgttacagtgctcacattttttgctgtatccttgctggggatcgcagggatagtcaacgcccacctcacggcacccgtgacagagtgaagagcattttgaagagtgttcaaatttgtgactgtaggcagattcacaggagatgcaatagtaacgtttgttgaaaaattttgaaagagttttgatgccgtcaaagtggttgttgttgtggtagagaagaatgggaaactggtagtcggtgatatcggatttggtgattgggcgcatctggtaatcattaaaaataaatattttgtactcaccgggatacttgacgttccacaacccttgcacttgatgtatataaacttctgcgtcgtactctgtctccgttgtcgggatacccgcctcgcggagtagttgtagcgccttttgtcgtaaaaccgttgtttggttgttgttaatccaccgccagttatcacgcgtgataattcctcgtttatacaaagagtagtagcgcatcagttccagcgcgtaaaaaagacagtagttgtcgttgttgttgactttgaaaatgtgcgattgtgaggagacaggtggtcgcccttttccctttgttgtccgttgtcgcggtagtccattggtgtttaggacagtgacggtaattataaagggagcgccatataagttgacgtgtttcgatttgctctgctccactttacaaaactggttgaaaacggcgtccacgacatttgcggtaattggtgtaatgggcagtatgatgtcaccctggtctaaaagttcagaagaaattatgacacctaccttatttgcagcgccaagtgtgttttgtccatctaaaattgcttcctcaatcgaatggtgcacacatgaacggagctcagcagcggggtcagcacatttgtcaatttcctcaatgacgaacttggattttgagcgcaccagttgatattttttactttttgaagtgaggttatcaattttacgaatgcatttatttggttgggattttttggggaaggaggaggaagaattttgagagagggaaaaacgtttcattttatttgaataataatatatgaatgaaaaatttatgatttataggtgatataagataatatgaaagaatattttgaattagaaaaatgtaaattttatagttgtaatagaaaattattgaaaatatttttttttttataagttgaatattggtaaaatattggatgaaagggtaatgtagttgcaaatttgttagtttaaatattttttgacggagcgcgcaagcaatgaatgtgggtagaattttcgcgaatgaatgggagaagttgacttttgctggtaatagccggctatttataccctcacaagtgggcggagcttgaccttcactcaagcatgtggtcatttggcaggttggcaactaaattgttcatgccatggcatatgcgctcaaatggcccctgcgtgcggtcaaatggcacgcgcgagcgctcaaatggcctggcatcccttccctcccaaagggcacgacagctgatgtccgtccctccaatacgatttgactttaataattatttaattaattaattttatattttttcatttatttttaaatttttatctattattttaaatttatttaggtattaattttttaactattattattttaacaaaatttaattttttaattaatttattattattattatttatatttttgtgtggtattagagagagcaagagaaaagagagagagagtgagagagaagagagaatgagagagagagagaaagaaaaaagagagagagtgagagagagagagagataagagagagaaagaaaaaagagagagagtgagagagagataagagagagagtgagagagagaaagaaaaaagagagagagagagaaaagagagagataagagagagagtgagagagagaaagaaaaaagagagagagagagaaaagagagatataagagagagagaaagaaaaaagaaagagagtgagagagagagagataagagagagagcgagagagagaaagaaaagaaagatagtgagagagcagagtgagataagagagaatgagagagagagaaagaaaaaagaaagagagtgagagagagagagataagagagagagtgagagagagaaagaaaagagagagagtgagagagatagagaatgaatcttagctttttattcaattatttctaaattataaaaaatttttttttttgaatttatttatttaatttatttataatttattatttaatttattttttattttattttatttttt

SEQ ID NO: 9548 - DNA, 1299 bp, Heterodera glycines
gaagtgaggttatcattttacgaatgccattatttggtggggattttttggggaaggaggaggaagaattttgagagagggaaaaacgttttcattgtatttgaataataatatatgaatgaaaaatttatgatttataggtgatataagataatatgaaagaatattttgaattagaaaaatgtaaattttatagttgtaatagaaaattattgaaaatattttttttttttataagttgaatatggtaaaatattggatgaaagggtaatgtagttgtaaatttgttagtttaaatattttttgacgtagcgcgcaagcaatgaatgtgggtagaattttcgcgaatgaatgggagaagttgacttttgctggtaatagccggctatttataccctcacaagtgggcggagcttgaccttcactcaagcatgtggtcatttggcaggttgccaactaaattgttcatgctatgccacactacactaaaatgagtcgtcgtctgactaacattttatgccatccacggtcagtcattagcggttaaatgaccaccagcgggcgctcagatagcccctgcgggcgcatagatgacacgtgcgagcgctcaaatggcccctgcgtgctctcaaatgacccggcgtcgcttccctcccgaagctgacgcccacccctccccttttaaacatcagcgaagccccataaaaacattccaataggcatccgccaaaactaaaccaatttctcaaattcaaaaataacgaaaaattaaagttttggcgccaaattcaaaattttgaccccggattgactactcaaggactgaaacggtcggactcaataggtagcgccctctcagctttttttttatttgactattataatttgtgtttattattattattattatttttttttataatttatcaatttcttaaatttttttcatttatttttaaatttttatctattattttaaatttatttattaattttttaactattattattttaacaatttaattttaattaaattaaattttttaatttatttattattattattattatttatatctttgtgtggtattagagagagcaagagaaaagagagagagtgagagagaatgagagagagagagaaagaaaaaagagagagtgagagagagagagagagagagaaaaaagagagagagtgagagagagataagagagagtgagagagagaaagaaaagaaagagagtgagagagagagagaagagagaatgagagagagagaaagaaaaaagagagagagt

SEQ ID NO: 9549 - DNA, 3247 bp, Heterodera glycines
  misc_feature (78)..(79): n is a, c, g, or t
  misc_feature (116)..(116): n is a, c, g, or t
  misc_feature (121)..(121): n is a, c, g, or t
tcaggccaatattgcgcagggtgagtacaaatatttggtgtcgattgggagatcaaatcttctgaaaaaccccgcccnngctcagaactcgctagggatacgcgagcaaaccaacnaaaanaattaggaataagggagaaaaaaatccctgggtttcctgcctattaataaatccccgatcaatttcaaataaaatatctgatttagaacatatagcacaaaagtatgatccatcaatattcatcatcaatgagacctggttaaaccccagaaatacaattgaaaatgaactatctataaatggtagatatagagtaatgcttgcgaaccgaaatgagaaaaagggcggtggatcagcaattctaactaaaacaaatattccttatcagacactattctcagggacaaaattccaaagcgaaattttacacattaaattactttttaaaaaaccaatccaaatcataaatatatatcgtccaccgaattgtacagttcagaatactaaaaagctactcaaatttatttcggaccagagtaattctgaaaatatcatatattgtggggattttaacatcccaaatattttatgggatgaaaataaggtaattcaaagaaatgaccctgtgtcaaatttattgattgagtttattgaccaaaaacaattgaaacagcatgtcaaacaaccaacaagagaaaaagctattttagatttagtaattactagtgaatcagaaataattaatgatttaacagtacttgaaaatttttcaacttccgatcacaaaatggtcggattcaaaataaagggaaaatttagtcgtaataattgttgtgtcgtgcgattggcacaacaaaatagtaaagacaatatttattcaaaatagtaaaagtggagaacgaagtgatgagtcagaggaattaatcaataactggtgaaggagcaattgccattgttgctgtgtgtgttgacaaaaatgaatgaataaggaaaagaccatgagtgaacgaagtccactcattaaatggacaataattgggtgatacagtataacaataaatgatcatcatttggcgtgaatttaaatatataataaattcactacacaacacctccccccttaagtgaaaaggttaaaaatttgattttgttttggggtaatgtgtgtggtaatttatcagtgatcgtaactctgtccagtgtgcgtcggactaagaaaacgaacacgtttcctcgtttgttcggaacgacgcaaaggaagtggttgttggttttgcccttgttcttcttgttgcgctgcccgttgttgtggctgcgtgtttgtctgttgatcgtccgtcgtttcatttccagttccatgctcctccctcgcaaagatgatgtcatcggcgaccggacatgtttcgtcacctctctgtgccattgttgttcggatttggttggcatgacgcgtgacaattcgattgccaagctgaggggaacggatttcgtaaataagccctttatttgaaacaatgcgcccaaaaagccaaagtgttttgccatttcggtaattgagaaattggacttgctctccaattttaaactgtaccggctttacattgtgctttttgtcaaattgcaatttcattttggacgtgtgttcgtgatgttgttgctttggaatggtttcgggcctcatgagtgacaattttgtgcgcaattttcggcctaaaaacaattcagctggtgagcgttggcctaaaacagcaattggtgttgagcgatatgagagaagtgatttgctaagccaatttcggtcaccactgcattttttgagttggcgtttgaagtagtcaacgtagcgttcagctgctccgttcgactgaggatgatatggcgggctgaaaatgtgtttaatgccattatttttgcaaaattccttaaaaacggatgacgaaaattggggtccattgtcagacacaagcgtttttggaacaccataacgatcgaacaaccattgtagctgtgaaataactgaatgagacgaagtattgtttaactggaaaatttctggccattttgaataagtgtcaattacaaccaggtaagttctaccattactgcatggtccggcaagatcaatgtgaacacgttcgaaaacggatgttgttgatggccatggttggagaggatgttttgtgggttgtttggcggcttcttggcatggaacacagcttttgacaagtgattcaatgtcggcgtccattgacggccagtagaccaattctcgggctaagctcttcattcgaacaatgccaggatgagcgaggtgaagtgccttcaaaattcgatcgcgcagtgcctgtggaatgatcgtacgtccgttgaaaacgagacaatctgagattatggacagattgtttcggacagtaaaatatggttttatttcgggattaaggcctttgtttggccaccgtcccattgtacactctaaaacttctctgatcagcgggtcactgagctgtgcctcggcaatttcctttgcggtgagtggcaattgttccgtttgcgtgttgaatacatgtgccacatctgcttccgtgtcggccaacaattttgcaatgacgacgtcttcgtctttagagcatgatcgttggtcgctgatcagtcggctcaaagcatcggcttgtcctgtgcagtccgttctgacaaactcaatcgagaagtcgtagttgagcagaatcagtgcccaacgctgcaatcgtgaagctgaaaatatggggatgccactctttgagccaaaaattcccaacaatggtcggtgatcagtacggagaataaattttcgtccaaaaataaattgatgaaatttttggatggcgaaaattagcccaagtccctctttctcaatttgggaataggcctgttccgttttggtgagagttcgtgctgcgtgttggaaaactttctcttttccgtcgttgaaccggtgggaaattgtcgctccgattcctttgttgctcgcgtcggcggtgacgatgattgtgagatcggggttgaagtgtgtaagaactaagtctgacagcaacacagactttgcttcatcaaatgatttctgatgttcccgtgaccattcccatttagctctttttgagcaatgagtctaatggtgcacgaatttcgtgcaaatttttgatgtatttcccataaataattgatggcacccaaaaatgaccggagagatgagacatatcgtggtggagg

SEQ ID NO: 9550 - DNA, 2244 bp, Heterodera glycines
cttatactgttaacatttttttttgttattttatgcttatatttgttgaattgaaaatttttattcattgacaaatatgataatccacataaaaatgatgaaaacacaaaaattcctcacatctagcgcaccgaataaggaattgctgatcgcagcacattttttggcatgtttccggcccttttgaatcaaaaagatatttaacaggatgaacaaaatttttaaaatcatcatctgttgtgttcaaatacccccctttgtgccatgcataacggagaaactggacaaattttggtgaagagatttgtcgatgaaccaaactttggagtttaacaatttcatctctggtatgcaaattgaccggcagatcatcgagtataacgcgatcagaaaatcgcctcacaatttgcttccatgttcttaattttattttaatttctttattttctgagcaaaagaccgaaaaagatataaatcggctggctgtactagcccagtacatcccggtggaattgtttgaatgcgaatgtcatccaccaccatccgctcggaagtgctctctttttctccaatcacacttttccaagttggccacgaatcaaggatcaaaacggtttttttgccagaaattattggcaataaaacatcagagacaaattttttggcaatttctttggtcattatatgagatcgtcccgcaacagacaaaatattttcagcctttaaattttaaaataattcatttcttaaaaaattcttgcctggaaaatgcctttttttggaaaaactccgcttttttctccaataacaatcaacattggactatacaaaagtccatcagcagaaaatattgggcagattgtgtaggaatgagtagttgatccaacactctgaacatatccttcaactttttttgtgccggatatttccagcgtatgtgttgaatgaagttctaattcgaaccctgattggtctgtattaaggaccaaatcagggtgttcttttccaatgagtgttttggtatcagaaacaaattctgccgaatcagtgtatattttttcttggtcttttgcccattttttgccaacaaatttggtaatctaaaaattatactaaaaaaccaacaaaaaaatttgttgtacctttcgtgttacaatgtgcttccgccgtttaaatccttttagccaataaattccagctttaaatccagaaactttatttcctgattggttatttaattgtaatgcccatcgacgaaggtcagaatttttgatcggcaaattcattttccgtttttcgataaaaaactcaaaaagcagatgatccaaatttttataagccgatattttgtctttcatgttgatttcaaagctaaaaagtttttttatataattatttattcaattttactttcgaagtttctttaaatcagattcttttttgatccaacgaaagttttttgacattgccgttagtgatctatatcctttttgagcacttcgataaaaaataagggccttctttttgtcttcaagtgtgatatgaggagacatcactttttttggtgatggcacataatttgaagatgacgatgattctgattaaatttactatatttaaatacagtaatttaaatcacttgttggtgattcctcttcactttcaaattgactttcgccttctatttcaaattcatcatccgattcgctcccttcctttccaccaatttcagcaaactcatcatagaccaaatcttcagaaatttcaacttcaatgcgttctctgttacatttttctatgacattgatcagatcgtacgacaattgctcttcgatttcattaatttttgttaattccgattatttgaagtgattttgcagaatataaataatattagcggggtttacaaaagacattttaaaaagaaaacattaaatattttaaaaattgaaattaaaaagtttaaaaaggttttataaaagcaaagcataaaataacaaaaaaaaatgttaacagtataagggaattgaaccagcaaagaaaaaagaaaacctatagcacaaccaatgcggcaacaagggagttgaaggtcgctcttctctattgcatttattgggataaaaaaagtttggcacgccatatctcggcactcatgctcatttggcaaaaattatcaaaattttacaatagaacctaggggtgatctacccacccacaaaatttcatttggaaatcccacggtca

SEQ ID NO: 9551 - DNA, 2746 bp, Heterodera glycines
  misc_feature (428)..(428): n is a, c, g, or t
tttttcagaaagtgctctaaagcgcaccaaattttatctttacttaattttagcactctgatgctttagtatcaaaaacgaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaaatttttgttgaaatatttgtcgtgctctgaagggcgtggggggggggggcnggaattttgccgaacattcggctctccaattttcgtcttaaatttaaatataatttcaaatgattatttgaatttcaccttcttttggagcggtacaacaaagaaaaaggctcaaacatttgacggcacttcccataatcgtaaatatttgaacggatattttccatggaagtccccctaagcacgtcacagtttcgcttttgcgctcactccaaatgatttctcgcgcaaattgtgacactttttcaatgtccataaaaagtgtccctttcgatttgctctgatcagcggaaattgctctgtccatttctgcttgccccacaatgacatcaatggccaaagtcactttgtcctcatttttgtcgtaaaagccgtttctcggatccatcaattgcttaattttggatatatcatagtgagcccttgaaaaaatggcgcaaattatatatcaatcgattcatctcgagaagcaaagcccgaaaacaaaggtatccagtcgcggaaatgccaaaaacggaacctgaaaactcgaaaattgagcaaatttggcacttacaactttttttctaaatgatcgaaccaagacaaatttggtatcaatcgaaaaccttgacgagctaaatctaaaaatcagtggatgacgtcctgccgtcagagaatgagagaaatttttgaacctggttcaaaaaacgaaaatggctgattcgatgataccaatttgtcataattcgatcatttattttaaaaaaaagttggaagtgccaaatttgctcaattttagagttttaaaccggttcaaaacaggttttttggcatttccgcaactggagacctatgtatgttttcgtgtttacaaattaactccccgagacgaatcgattggtagcttttttgaatttatttggccgtttctccaattctgccattattggcctttcttaaattttccaggggaaatgaaaaataatgacaaaattacttaaagtcgatgaactttgatatcgttcagaagattagaatattttcattagaataccgtacttactgaattaatacccccgggggttctatttttcagccccctcgaaaggggggttctaattcagtaagtacggtatatataatcagccctcacccaaaaagcaatgaaagtggggaatccccagctgtttgatttgctgtcaaacacattgtcaatgcgtttccctgtgcaattctccgcccctttgttttgcgcgacaattcgaaaggttgccgaacaattgcaactccaattcgaatcttaatgccaatagttgaaaagagcggtaccggtgccgatttcgaagtggaaaaaagaaaagtgcttgaaaattcccggcggcggcgcctatcggcattttttggtttgaaaaagcaaaaaagaagaaaaaagcaattcgattcatggcatgactcatttcataaaatttgtcgtcgaccccccccccccccttttagccaatgattagtaaacatagtttactttcattattattcattatatagttctttgaaattcaccttctgttggcgctgtgcaccaaaggaaaatgcccagccatttcccaacaaaattttcatcgttttccgtcgtcgcatttatttttgcaagtatttcaaatggaagccctcggatgtgcacagttttgctgtatcggcagctccccataactttgcccgcaaattccgacattttttcaatttccagctgaagtgtcccttctgttcggtccgaaattcttccctgcctcggaaatttcaatgggtaaagctcggaaaccatgtgcaaattcggatgacaatgaaactgataaatgccgatcacttcttccactgttaacacaccggacggaactgaaaaataaataaattggaaacggaattaattaaattattttaattaatttaatgggaatatattttcgaacatttaaagtcttaaattccttgtagactttagtttcttacggggggggcgaaggccccaccacgaggccgcgaagaggccgagtgagtaccttcggtgcaggtaaattattaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttaagggagttttgcataattaattcataaatattttttcagaaa

SEQ ID NO: 9552 - DNA, 2552 bp, Heterodera glycines
  misc_feature (16)..(16): n is a, c, g, or t
gcaaaaaagaagaaanaagcaattcgattcatggcatgactcatttcataaaatttgtcgtcgaccccccccccccccttagccaatgattagtaaacatagtttactttcattattattcattatatagttctttgaaattcaccttctgttggcgctgtgcaccaaaggaaaatgcccagccatttcccaacaaaattttcatcgttttccgtcgtcgcatttatttttgcaagtatttcaaatggaagccctcggatgtgcacagttttgctgtatcggcagctccccataactttgcccgcaaattccgacattttttcaatttccagctgaagtgtcccttctgttcggtccgaaattcttccctgcctcggaaatttcaatgggtaaagctcggaaaccatgtgcaaattcggatgacaatgaaactgataaatgccgatcacttcttccactgttaacacaccggacggaactgaaaaataaataaattggaaacggaattaattaaattattttaattaatttaatgggaatatattttcgaacatttaaagtcttaaattccttgtagactttagtttcttaccaatatttctcgaaaattcttcttttgacacgagcggaaagcgaattttgaacagtgctgggccgagcttggcacgacggttttcagaggagcactcaacggcattttgacggcatttctcgtcagcccaacggatagccaaaaaatatcaacgtaattttcttagataaattaatatcatactgcgttccaaattgaaatttctccactgatttgcaattcgtcacgactcaaaatttcacacaacgttttttggtcaatttgcaaaaatgccaccgaattgagcaaagtgtccgcattctcatcaatataaaacaaacaatgataggcaaagttcttaactcaaaaaactaaataattaatatttcgatattttcgcatggtacaaaaatcgccataatccgacctccttaaaattccgaaactcgcaatacccaatactgaatttttaaatttctatatttcaaaataattgatgcataatttttgccttttctgaatttgttcaatataaaaattttataaacaatttaatctattgaaagagtgatgcttttgagtgctctgtcatcccacctctaattcaaagagctgagcctgggcataggcaaagaaaacattgtgcagttttgaaattggaatttgcaaagatgggacaaccaggccaacgatgttgtactttttggctaattaatgaataattaaattgttagattaatttcacaaaaacaatttgaccagcgtaaagcactgccattgcgttgtctccgtccaattggctcaaatcgtcggcataaatgaagctgagcatcactttgaacgctgctgcctcaacatcgggcacttccacaacacaattagcgcaggctaataaattaattgaccaattaatttattcatcaaatttttaccattttctacgttttgattctgtgagtcaaaacggaacattgcctcgaatacttcggaagcatgcttcaaaattactttatgggctgcaactctcttaaaaaggtttttttaaaaattaaataaaaataaaaattaattaataaatacttttattttcaaacttgcctccttttcctctccttcccccaccaaaaagtgcacatccgcgtcctctccagtgctcaacatccgcttcatccgatcaaccacagacaaagacattgtaatgataaagcaattgccaaactcgtaattttatcaattcaaatgccaaaatcggtaaaaagaaaattttgttttcagagcgtaagtcaatttaaagaaaaaaaaagatgtttaacattttaatttttaaacgataatttacattttattattagcttaagttattatgtattatttaaaaatgaacattactcattgtataattgtaaaaaaagatttgcaatgtaaaggattttctgctgctgatgagcttcactttcttatgcgggagggcacaaaataacaaaataattgcggcaaaattatgacccgaaaaacgatgaggagaacaaagcaaattcatttgaatttgttgatttgtacatatgcatggataaggacttttagatggaaaaagataaatctcatcccttttcgaatataatggtttaatttttcattcttagaatgaaattttttaaaataaatggtcatttatgggttttttgactcccatgaaaatttaattgttttttgaaaggtgatttaggcgctgatcatgaattattcatttatttttatgttaacgcattctataataatgttcatcctaccatataaattgaccatagcgaattttgaatttttccgttttttcaaaattagtattaatctttggtgcaaatttattaacaaaatcgccaaaatgtttccccggtggcgccaccatcggatccctaaaactcctctgctttcttacacaattgtctcaaaatcccaaaatttggtcttttgaataattcca

SEQ ID NO: 9553 - DNA, 3625 bp, Heterodera glycines
  misc_feature (3562)..(3562): n is a, c, g, or t
acatgtcgggggtcgagtcggggaataggtccaaaaaacgtctcgggtcgggtcgtggggctcggagtcggggctgaaccctagtatgtaccgtcgtcataaacgggcggcaacaaatgtctgagcggactgaacgaactgccgtagtgggggaagcgcagattgttgcaccaaccgttcggagttctgttggcacaaattgttaaagtgttatttggagtcaaattggcaaatttagggaaaattttttataggcttacaactagggctggtcgggaccgggaattttgacaaaaaccgggaccgggactgaccagaaaagtcgggatcgggaccgggaccaagtttttcgaccgggaccgagaccgggaccgcgagaaaagccgggaccgggaccaaccgggaattttcccaagagaaaattttttgaaaaaattttgaaaatttgagtgcactttgttacgaaaatttcctaaattcaaaaatgtgcccagaagattttaaaattttcttttgggggaggaattcgaagaattttctattattctctgtttcatttcgggggggggggggatctggaatcttggaattttctgggtcccaaaattctggattttttaataaattaaaatttcttaaattttttgcttttaatcgctgtttttgtggcgctgttttccaaaaaaaacttttgggaacattggtgagggggcggcagggtccggcggcgcttatcggcaccgccggaaaatttttgaaattttgagtgaaatatgttaagagaatttgtcaaaaaatgaccaatatttggcacttcaaataagtaaatcagatgttttcccttttttgcataagggctaacagatctgcaaatttctgcaaaatttcaatcattctgacaactacgaactgaataagaaaagccgctttttcaaacttagggaattcctggtctatattttttgacagccctagtacctacctattctaattaatattttaattcaactttgacttttcattcaagaatgtcaaacattgcctttataagaattcaaaaagaatgcaaagaaatcattttatgtaaagaggtaattaaatagaataatccaaaaaagaaccttttttacagttacaagaaaatggtgtaacaattgaacctgtaaatgagacgctttttgaaatcattggaaagatacgaggtccaccaggttggaaaattggactttttagttaattgtagaattatttcagatagcccatacgaaaacggaatatttattttggtacaacttaaatctttttttttaaatttattttttggtaatactttggtttgcccccccccccctattttcaaaaaattattttttgttcgcgatcagcgaccccggaatgtctctgaaacattttatttttatcttttgaataaatcaaataattgaatggcgtgaaacaaagtattaccattttatatccttttgttattctatttttaaggacgttaaaattccacaagaatatcctttccaacctccgaaggtttgatcgaataatatacaaaggcaagagagtattttttacttataggttaaatttactactcatatttggcatccaaacattagttcgcagactggtgctatatgtttggatattctcaaggaccaatggttttgtgtgtttatattcacattattcaataaaatacgatttagggcggcatctatgactctccgaacaggtgaaattaatttaatataaaataatagggagtttatagcttctggactggttgttctctttagtgcttctcagtgtgcaatcgttgttactttcaccggagccaaaagatccacaggatgcaattgttgcgaaacaatgcttaagtgaccctgcattattcagagtcagttgttaccaacctttgaataatgacttggtttgtttatctatttaagtccactgcaaaatattgggcacaacattatgcaaacgctccgggggaaatagacagaaataaggcaaaatgtgtgtccacattacaggagatgggagcaagtaaggtgaacaagcaaaatcaattcaaagcagcactcgttttaatcttcatcttcattttaggacgccagtatatccgctttaagctgctataattggaaccttgcaaaagctaccgaatttctctttacataatttattgtttaataacatcattttgaataaatgacgccttacaatgtttttggtgtaacgggagtttttcattcgctattttttatcagttttataacaatacacctaattaggttttaagcataaaaatgtacaccggagatgctgcaatttcggggtcatctgcacaacaggcaaaaacgggcaccgaatcgagcacgagcaagccaaaggcgtgctgcgtctgcaaggagacaaaaggggtaaacggggagttgggtataattacacactcaaaattcatcattcgggaattgtagacctcttcccttcccacattccgagctaaactcggaaaatcataaattaaataccattagatagagcagagtcgacttgcatgctatttttaattttagcggtgtctggcgcctatttcaaatccacttgcctgcaaacacttaaaattttagggtttttgtgacggttgatcatgaatatggcatccatttcgcccaattctgaatccttgacccaaacttgcattttttaatattctatttttaagcatttaattattaacctcctacagctttaatcgcacatttcttttttgaattgatgtaaaattatttgttctagttgggtcgggggttcagaactagccgaaatgaatgtcaaattcctgaccaacggtcccaaaaactcaaaataaacacaagacgaccttgatctatccaatggtatattaacttatatggggtttcaaaagttacacctcggaatattcccttttaagcctattgtacgaattttttgcaccaattttctatgtactaattttcgaccatttttattcggaactaaatatggaattggttaagtaaggtgttacctaagtccattattcagaagcgggacgaatgtattattctgaacggtgaagagaattgtggtcaactgatcgaagcacacaaaaaatgcatgagagaatatggatttgaagtgtgatgagagaatatggatttgaagtgtgatagctgatatacgtttcttgttttaatgttttagtattattgtagtaatctagtataaatggttgactagttatgtattttgtgccatcatggaagtttgccatcccctccctctttctgacaataatctaatattattaaacttttcaataagttgaacaggagacaattctttattcgttggaaatacaaaaaacggggtaaaatgcgcaatttgcgtcaaaatatcattgaacacttcactagtcaacccgttcaaagagtgtagtcaaatgctaccgttatgttgcgtgtttttagtcgatgaactttgaggatgggtcttcttattaagatttgtgtgttttctncccttccttttatttaaaggttaaaggattataatattcgttttgttactgaataattggatg

SEQ ID NO: 9554 - DNA, 1939 bp, Heterodera glycines
gttaatttatgtcaaaaataagcaaaattttgcttttcaggttgatttttcgctaaaatgagtaaattttaagctgtatcgtgtttttttctcctaaaatgctttttaataccacatttagccatttttgaagattttactttatgtttaacaaatttgaagaaattttgagaaattacaccctcaattggaaaattttatgtgcatatttttcactttttatgtgcatatttcacgatttttggtgcatattttatgcgcatattttgcgattttatgtgcatatttttgccaaccctaaagattaggggcgacatgaagtttgggcactgggaagtttgggcaccgggaagtttgggcaccagaggggggatttcaaaaaaataaaacaaaataaataaataaaatgttatataaatcattaaaatttagtaaattttagcaacccttttttcttaaaatttatatgttcttgaaaatcaaaaaatttatgtatgggaacctggcaatcttattatttaatcaattcttacggttgtttaaacgtataattaaacgtgtgctagtttctgtttggacttatacctgaataccggcttagttgggcccgaaataacaagaacccgtctaattttgtttaaactcataaactttaagtcttgaacatactgagccttgtaatgttataagttataaataatacatatgtatggcattgatattgaattaattgtaatgagtttagcaaaataagcatgcttaatcgaatgaatattcgttaaagaactttctatttcctaacttgattaaattttctatgcttttaattagatggttgcaattcatagacaattaaaaaatatttttattttttaactctttaagttggtgcacaaacttcccggtgcccaaatttctggtgcccaaacttcccggtgcccaaactttccccgccccccttttgttggattggtcaaaaataagtgacatattcataatcagcgacccccgaaaacccctcaaaagagtccccctaagggtttttagtaaaattacattatttttcgtcccacctaaactataaaagttccaattactgtatttaaggaattaattctgttcattttcaggaagttaaaaagaactccattgaactgagtctattcgaatacgaccgacgctttgaacagaaatttccgcaatttttcatcaattatgactaccgtaaaccattggatgtgccttccaatttgcatcacaatttcgattttttgatagctgatcctccatttctatccgacgaatgttttattaaaattgcccaaacaattcgcctgctgtctaaaaaagagaccaaattgataatcaacacgggcgctgtaatggaaggactgctccaacggattttggatgtgagaaggactgaatttagacccgtacacaagaacaatttggccaatgaatttctgtccttttcgaattaccctttatccattttgtaacttattcttactttcttttttgtaatttaatgaaattaatttaaattctgtgtttttattttgacattgttttttaccatatatgtatttaattttttcaagacaatttatattcataatttaagcaacaaaaaaaggcatttttgacgctgtgattccgatggcatacggcactgttcagcaacagttgtgggccgagttgctctgttgttcaaactgcggaaatgtatgagttttaaaataaatattttaatgttatattatggtatgctgcaggaaaatttttttttttaacaaaaaaatggagtttaaaaaaaactacttttgttgggttgattagtctttgcatgtgcgtgttttgtgattaattctttgcccctcttccatttcgttattgccaacccttttttcttaaagattactccattgaacatttg

SEQ ID NO: 9555 - DNA, 3804 bp, Heterodera glycines
  misc_feature (2103)..(2104): n is a, c, g, or t
  misc_feature (2125)..(2126): n is a, c, g, or t
acaacgtaaaatcgagaaaattgttaagcaattcagtttatatttgttttattatgaaaggaaagaaagacttatatagcgcaaatttatagttttcttaaatcaagtattaaaaagctcgaaaataaaaacaaataaaaaggacagataatatagaatcaattgcaaataatcaaaagatctaactaactaagtaaccaactaataattattttttcaaatttaattattttaagataacgaaataaaacaaaaataaaattcagaaagatagatttttaaaatataagaaaataacctcaacgaaaattttcaattaataaattaaagagttttttcgagcgttaaaaatattaaaataaatgattttttatattgcaagtttaaaagtacataataaatatcataaaaaggttggttgttaaaaatataaataaatcattaataaatattcaaaaagtcttaaaaaaactatttatgtttttccctctttcactccggtttatttgaataaatattttgacgttagaatacaaaattttttaattattaaaaataacgataaatttatcaatttaaagaataaaaaatataattttatttaattgattcttggtagttgtgtgtggacgcgcagaagccgatgcgtttttggatgaagaagggcatcaatattttccttgatcaatttggaggggagcatgcagattgaaattattgcaatataaataaaaataaaaaaagttcattaaattttaataaaaaagaaaaataataaaatttatacaaatgaaaaatgaaattataatataaaaagtttaaaataatatttggttgttcgaatggctgaaaaattatataggcaaaaacgggacattgttcaagtcagattcaccgtgcactctacctcaattgaatatcatttaaataataatttaaagattactattactgtaggcaacaaaaaataataatggcacttacaaaatcccttacctaagaaaacaaaaatttattttaaaattttcaaacattatataaatataagtataaaatatttaaggttggacaatttgaatgtgctcatatataatcaatagaacccgtacaggaccgggatcccgccgggattttgccggtcccggtccccgtcccatattttttagacaaaccaccaagaccggtagtccctttaaaacgggagtcccggtcccgagatcgggagtcccggtcacgagatcgggagtcccggtcccgagatcccgtcccggttcattttccaagtcccggtctcggtcacggccatttgggccggaaaaacggtctaaattttaccagtgtaacagccccaaatttgataaataggtgaaacgtttctaatttaaattttcaagatagaactttagattttttaatttggggcaatttcaactgttaaaaataccctgaattcaatatgaaaataaataacatttgcataactttcttttaccaaaaaatatttccaaatttatgaaaaaatcaacaaatttcacaataaatttcattaaaactcaaaaattttccgcagcgtcgcctagtacaaaaactaaatttttttctaaaaaagttagctcaaaatagtaaaatttggccatttttggtgtaaattttttttgaaaaatgtgctaaaaacacttgtacctaaattacaattgaaaataaagcaataataagcacaaatggtaaaatattcatcaattaataaaaataatgcatttggtcatctcttaaataacactcaagattattagcaagaatatttcatcatgttaaatattgaaggccgaatccatgcggattttgtaaaaaaaatttatgagaaattttaatattgcagacaattatcatttttacattgtatttgtcggctatttcgttattttaattatataaggaaataatgaaaaacctttaattatttaaaataattattattgaattgtaaatcttccatatttttgacttgaatataattgcattgatttattaaaataaaaatagctcaaataaatataaaatatattattttaaacaattaaatagtgattttatctggcatanntttgcagcaaaagtttaattnntaatatttcaactattatattagtgtagctattctcaagcttacgaatttataaatattttttaatttaaaataaatgtattattatttctgttaattaatatgcgcaatcctaatatggagaaatttgtaatgttaaaatgtgctggcgaagattccgcaattatttttttttgagaacgagaattattattaactgctataattttattcaataaataagttgaaaatttgtcttaataaaataaaataaatgcaagcaatgaaaaataaataagcatgaactgttgatattaattttattttttgcctctaaaaatacatacgctatctattttcaactaatttgattaataataattcatgaaaataatttgataagtattttgtatttgaaacttatgagttaaataaattaatttaaaaaattaaaaagttatttataatgagagactcaatagcgaacacgctcagcttggtcgcatctcgcaaaatggcgagtgcacgaattttggtagaaatactcttaaaactacatctaacatctattttatctggctaatttgaacatagaaaaattattaagcaataaagtgaagaaaaaaatacaattgaatacaggattatatatgaatatcaaatattttcaaaaaaaactattaattttcattcttttaatatttattatttttccaaaccaaaaattaatttgacaaataaaatatgtttgtatgttaattgttattaaaatattagctttatttaaaatatttgaaattgattaataaacaaaaatttatatgcttctttccaaaagaagttattgggtccggattatagatcaatagggcatatttgtcaaataacttaaacaatttatttattacaaatatttgctttatttaaaaatccttaatatccacagaaataatatgtctactgtagtttttccatcactaattgatatttaactaattgaatgtttcacaacattaattaaattttcttaatttacaataaagtcatgtatttttgacaaagcttcgaccgcgacatcttgaaagtacttaaagaaattggttaaagaaacgccttttgaaaaatttatttaaataattgttaagttagaaaatcgttgtctataatcaatatagtttattcaattaaagtaaatttatgaattcacgatttttttacttaaatcccatccttagtaattaaagtgtagtgatattattgaaagaaattcaatctgaaaatataaaataaaatttaaatctccaatacaaatactagataaagaaatcaaagattaaatttaaccctagtactcaaagacaattaaggcaaattaattaattatgtatgcattgttgattggccgacatttgcggcgctgacatttgcggcgctgacacttgcggcgcagacatttgcggcgcccagtcaaagcgacacttgcggcgcagacacttgcggcgaggacatttgcggcgccgacacttgcggcgcgacacttgcggcgccgacacttgcggcgcccagtcaaaaggacacttgcggtgccgacacttgcggcgcccagtcaaaaggaaatttgcggtggcacaaaatttcaacgaccccaaaaaaattttcacaatttatttaccattaaaaacatttataatgactctctc

SEQ ID NO: 9556 - DNA, 2729 bp, Heterodera glycines
ctccccctccccataccgataagatcaattgctccatggtcaggttatgtaaaatttgagctaatgcataaaaaataaaattaatttgaccgtttcagttaatattgaatgaaaaatcccaaatctaataaaaaaaatatattttatacataatttcttaatccaatgaataaaatctaatggtaaactctaaactgggaaggagattaaattttatgaaccgagaaattgttcgcatatatttcaaaaacaaatcaaattcaaaacataatttcataaaatattaaattaatatttcattaaaataaaataaaataaatttatgaaaataaagcattaaaaccccataaaacgagcatgcattagattcactttgatcgtataaaaattcataatgtgataattaaataatgacctcatttgacttttaaagttttaattgatttggcatattgttttttttgtgtgtctttcattttcatttgatgttttttttcactcttcgcccggacttaaatttgtgatgcggattgtgtgtggtaattttaatggtgcttttaattgttgtgttgtttaaatttaattgatttggattgctgtggctttaagtgatttaaaaagtcttccttctcattcttctccttcgccccgttttggaattcggcaaagagcaaaaaagaccccgacagtaaagggcaatttatttacgacgataataatttttaagtaaactttgtttttaagacatttttgatcaaatatctgaaaaatgcgaattaattttcaaattttgtacaattgcctaatttaattaatatttttttaaataaaatttaagtaaatacatttggctgatgcgacattgcggcgattaaacttgcggcgttacattttcggcgcagaattaaacggcgtctaaccaaatatatttttattttatccattcctccgtttaattatgtatgaactggacaaaatgttaagccattggtggtaaataaagaaagacaaaacaactttttcttaagaaaaaaattgttttatcggagatcaacatttaaattgttatttatttatttatttagcattttgctaacaacgtataaaacaacttgtttttaaaatttccgtcaatttttgaaaatttattttagcgggtaataattttatggagagagatgacgcaaaatgagagagtgcagaactttcagtccaagtcatacaaaacatttttgatcaaggaggatagagaaaataattttaatagagagtgcaatgggaagaagtttagttcccaatcttcgctgattcctttggtaatagacggagaattatcattatgtttctattgtctcgatgtctttgaatctcttccaataacactctctattaaaatgtttgttctctgtctttcttcatcaaaaatgcttatgtctgaccagtactgaattttttagctctctcattttgcgttatctcttctcaagtgatatttcccgctgaaataaatttttaaaaattgaccgaaattttaaaaatttagttgttttatactttgtcggtaaaatgcacattgttaataattaaataacaacgtgaaggttgttcgcccgaagaacccgctgaaaatgtttgaaagaatgaattaattcagcggttcattttgcttttgaaaagaatttcttactagaaaaagggaaacaaaggatgtgctgttaataaaatagactcaaatgtcccgccgaaaatgccggccaatcatatattttgttaaaatcgtgaaggataaaaatagattatagatgattcagcaatataacttaaaattataaaatataattctaattctttaataaaaataagaaagcttcattaatcaataacgaaataaaactaaaatttggaaaatacaaaatttcattaatcgatgaacaaaataaaactttgtattggaaaaattgaaaatcaagaatttcagcaaatgaagatatattttctgaataagttgtaaagcatgaaggtttcattttataaaaactcacctaaaactaagctttaacgaatgaagttcagatgcaaataaatgaaatgaaatgcaaatttctatacaatttttaaataaatctatttcaaaaatttgcttcctagagacatactaaataaaattcatttttttataatgaattttaaagctttaaaagactcaaagtttaatagtttaaaaaatgcaattaattataaaacatttaccaaataaatgtaagaaatttaagcaataatatataaaaaaatacgcattaaacattatgaatcgtaattaaatttgcttgagtaaaaaaatctttcttcttcaactgatatagcagattatttatatacttgctaaaaattttgtcttgtaagacgcaatcagtaaatataaaaattatacaaataaaaacaattattatttaaaaatgaataatgactaaaaaatctaatgaaattatcaattatctagcaggtatgtatgtataaaacaaatgacaagtaataagcatttaattttttgggggaaaaattttttttttttttttgggggggggctatattataggaaatatgatatccttataaaaagaataaatagagtgattattcaattgaacaataaaaaataataattgaaataataatgaacacaataggaaatttgctgaattctcacgacgtgcaaaaatattaataac

SEQ ID NO: 9557 - DNA, 5498 bp, Heterodera glycines
ctcatgcgttcattttcggcacagcttcttaggcactgttgctgctgtacatttgttgtcccccgcggcggcgccattttcgtccaccaccgccaccgccgtggcaccgtcctcctcctccgcctcctctggactgagcgccgtcgttgaggagcagcaacggcaggctatgccaatgccgtcgccgaaggtggaagacaatgagcagcagcgagcagtctcggccagcgacgcgacgaacccggcgactggagcagaagtcaccggtgctgaggtgccatcgtcggcgccgttatcctcgcaaaagcagtcatcgccggcggcggcgattacttcggcacatgtgccacgccaaactttgctgtatttgcccccgaatgccaatcaatggatcccggtcgtgtgaatgggaagaaaatgctggtcagagaacgaagaggatggacggaagaagaagcatcatcgagagttggagagagtttgccgtcgagaaaattggccgagttttttttgtgtcgaattggagaaacccatacacaaagagtcgatccctcccctcccgtcccccaggggattatccattatttttaattattttttttatcattttaaatttgtttcaaagatatataatatataaatacacatgtgttttgtctgcattaccacatcattttcatgcttttctctgatgctgttccccctttttcttatcactcaccagccaaacatttcccgccctaaaagaggtgctttgaaaattattttgttaattacccaatcattatcaattaactaattgtctcttcgcaacgacatctgctgtttgcttatgtgttagcacttatacacacattaattcattcattcatttgccgattgttccctccccctcatttctgatcaatcgataatcttatcaaatcaatcaatggtaggaaattaaaaagtgatcaaaatgataacagtcaatagacaaaatactttttttttgtctctccttgttccattagttgcctatgctgtgctccgaatttatttgttaaaatgatacattatcgaagctgtttagaattgtgcctaaaatatttttttcttcccatttttggtgtcgtaaacgtcaatcgtttagccctaattgtttttttttataattatttttgtttcaattacggtatttaccatttaatcttttttctctttttgtttcttctatcaaagccttctttttctccagttacaaaaaatcggacagtgtgagaagaaaatatgaaattgataattttaaaaatttaaaatttgtggactttataattttttggaaattcgaactttaagtctgccccctcccccccccccctaaaaaaatagaaaaactttgaaacctaaaagaaagcatctaaaagcccttcaaatgagggaatcaaaaaaattcatggccatcaaaaagttattttgaaaaccgtaatgaattgaaaggtcaaaaaattaaggaaaccattattcatctgggaccatcgaaaattgcggaaaccggaaacaccgaggtttatggcaaaaccgcaggaatttcttcgattctcttcctcgacagtccgatttatttacccatctcttcgccccttccccctttctgttcccaaaaaatgtgttagccatctcttttttccaaaaacgagtaccacaagcaccacacacacacacaacaacaaacatatgcatacatataaaataataatgaatatatccatccatccatcaattttgataaagccaagtcaaacgcgaaaaaataatggggaaatgggcaaaaaaaaacaacaaaaaaatccattacggcgggtcaatttcatttttatcaattgatgaaagacaaatgatgatgatgatgatgatgatgattacgatgaagttaatgaggctacaccatagcagcagggcacagtagcaaaaattgaaaatacttttgaaaaaaagttaccgtaaaactgagaatttttcggaagacacggaaaagtgtaaaaagggtcggatggttaactcttggaaaattttttaatgtaaaaaaaggggaccaagattgaaaataaaatttaaaaatcaaaaaattactgaaaaacccaatcattgtttttctaagctaatgatcggttcattaattctttcctctgcttaatgggtcattagcatcatcattagtcctattccctttccccaattaatttttaaattaattttcttcctcttttatttgtctcccaataacatttttatgtaccggggaaagaataaaacagaaccaaacaacacaaaacatgcttttgttcattcatccataaatgtgtaaccaccacacaatttcttctgctacataaaataactgtttaattttttcaccatttcatttgctcgtataataaacatttttttcttttcgattttgcattttttaaaattattttgattaaacaattaggaaagccaattaataaaagagtgggctgcctgatcacaaattgcttaaattagtttcaaaatacataaaagtgacaattttgtgcaaaaactgaaattataagaaagtttttacgccgtacacctcatataccgagatcccggtatttccaaaatttcgtgtccaatgttactcattcaaatggctttattgcagttttcaggaccaccaattttggccataacttttttgaaacctaatgaattttcttgaaattttgcagaataatagaggactcttaagactatcgaataataccacgaatatttattttggatgtttctagaaaaagttatggtgcattaaagttttacaattatttatagtcgtaatagagccggtcaaactgcctaaatttttgggtctctagtaccgtggaagaatgctgttcccccttttcttatcactcaccagccaaacattttccgccataaaagaggtgctttgaaaaaaaattttattaccacaatcatcatcattaacaaattgtctcttcgcaacgaccaattaatcaatgataggaaatgcaaaaagtgatcaaaatgataacagcgaatatacaaaacatttctttgtctctccttgttccacactgccttttgcccgaggcaacgagttgtctgtgattgatcactttgcattttgtttaaggcaaaaacacgagcacttattattttttccctaaaaaacgatcggattggctgatattattattcattgcctgaggcaattatcaataatatacggatcaattaataaccgagagaaaacgataggaaaattcggaaatttttcatatgccagagttggaggcggagcggaagggcatgctgaatctgaccaacgggacggtatccgcaccgggcacggacaagcagctgtcgctggaggaggcggtcctgcgcaaggatagaatacaccgaaaaggtgagaaatagcttttagtttattctaagggtacaaaaaagcattaaagtcaattcggatacaatgctttctagctcggttgttgtttgtttgttttacggtaatatacccggacgggaattcccggtcctccgaggtcccggttcccggatattgaaaatttagttcccgtcccggaaaaacaagcactggtaagaatgggggtctgagtgaaaattaatatattctttaaaagtaacgctgccaattgtgcaaatggcctagtggctgatctttttgattttctagttctttcccatggttcaatccctctacgtaaataaaatattttgaattttctttttgtatattcgtgggtttcctatcgataaaatatgattcctcatattttttttattgacacatattttatcattttttaaagaaatccgccaaattgagcctagtaatctcaaaaaaccagtttttttgttgaaaatctgttaacaaatcacaaatcaaattttcaaaatttctcgccggaccccttctttcacaaaagttttttgaaaaagcgcgccgaaaaaaagtgatgtaaaaagcaaaataatattcgatcatttagtccaaaaaatgattattgtttgaaataattgaagaaattttatttgaaaattttcattaatttatttatctttaacttttggatttcataaaataaataacaaaataaaaatttatttttgtgttattttcacttgaataaaatttgaattttcttaattttttgattcttttaaattctaaaaaattcccggttggtcctggttcccggacaaaaaccgaggtcccggtcccggcttctcaagttccggcaagtcccggtcccggtttttcttgcggtcccggcttctcaagttccggcaagtcccggtcccggttttgcccaaaattcccggtcccgctctactctaatattcatttataactttttctttttttatgataagacaaaatctgtcaatacataatagcctttgcaaatgtgctttgtcgatacggagattcaattaaactaaaagatgagtgagggcgcatctaagagatcgttaataaattggctgattttttaaaaactttattctttcattatatctacgaaaaattaaaaacaaatatgtattagtatttttgacctcatttgtattttttttaattttaggctttttcctgctagtttgggcatgccttctctgctacctcctcagttatttgcccggtgcatctgctgaacaaggcactgttgaagccctccacacgcgctgggagccggaagcaattggccccatcactttctctgacatcaactacgattatgaagactacggccaaacaacagaggagccaccaaccacgactcccccgccgccgtccacaacaagtccgcctcccacagaaccggaaccgccctctgcgaccacgccaaatccaacagtgccaacaccgacgtggtgccctgttgccatcactggtttggcagcgctggtcgtccttctgtgcctctgtttgtgttgctgtccgtcagtgccacaatcggttgcaaattggtgccgccgttttgttcatcgcttctgtacatgtgccggcgaaggtgaaaaattttaatgaactaaaaactatcaaaagctacggcacaagtgccacgccaaactttttccgcctcggtctcggatcccggtagagtgaattgaaaaaatgcacaatttttaaagcaaataaacaacgaaagatgaatattttcgcggtaataatttagatggtgccacacatttttgaaaaaattcaaaaaattttaaaaatcaataaaaacaagtcttatggtgtttcggaggttccgggttcgggattcgaaatcggtcgaaatggatgttatattcgtgatcagcgacctccgaaaccccataagacttgtttttattaatttaaaaaatttttgaattgtcaaaaatgtgtggtaccatctaaactattaccaagatatagtttaattttatttatttatcactaatttgttgca

SEQ ID NO: 9558 - DNA, 1729 bp, Heterodera glycines
  misc_feature (911)..(911): n is a, c, g, or t
aatacataataagcttttgcaaatgtgctttgtcgatacggagattcaattaaatctaaaagatggagtgagggcgcatctatgagatcgttaataaattgggctgatttttttaaaaactttatttctttcattatatcgacgaaaaattaaaaacaaatatgtcactagtatttttgacctcatttgtatttttttttaattttaggctttttcctgctagtttgggcatgccttctctgctacctcctcagttatttgcccggtgcatctgctgaacaaggcactgttgaagccctccacacgcgctgggagccggaagcaattggccccatcactttctctgacatcaactacgattatgaagactacggccaaacaacagaggagccaccaaccacgccacacatttttgaaaaaattcaaaaaattttaaaaatcaataaaaacaagtcttatggtgtttcggaggttccgggttcgggattcgaaatcggtcgaaatggatgttatattcgtgatcagcgacctccgaaaccccataagacttgtttttattaatttaaaaaatttttgaattgtcaaaaatgtgtggtaccatctaaactattaccaaaatatagtttaattttatttatttgccaccaatttgttgcaattaatatatgcttcggtaaaaatttgtaggtctcccaaggacgactgcccaaaaaaaacaacgttcactctttctattttaacggtgacaacacttttctttgaaatcgatgaaaaaaattaaccgtttcatggtcaaatcgaaatttagaagacagggatgttgtctgcagtacgtgcgaaacacccggacacactgctgtgaattgcgaccagctgaacccggacgtgtgaatgggaaaaaataccgatcnaaatgatgagtagggcgaggatttctagttttttaactattttttctgcggcattattttgatgagaaatgcacgaaaaaccacatttttagctcggaaattcttagttttaacgccactattcatcactagaaaaaattattttgtaagttggccactaaaatccgcgtcgaagaggtgtgccaccaatttcggcatctgctgcggttgtcgcctcatcaaagcgagtgccaaaacgagttatggctcagcgcatcgcaagaggaaaactaaatccggcttgcccattaataatgaataatttttttttaattttgccgaaatttggccgcggaggctcgagaccgagataaaaataaacgagaccttttctcgaagcctaagcattgagcaagctatacgagtcaagtacacccttcccggaattgttttcggcattggcactcacccgtttccgtgccttgctattaattaacacatcaaattttatcaattaacgtttaattgcttctcatcaataatcaaaaatatggggactggatggggggatttacagggaattagtccaaaattggactaaaattcccttaaattttacaaagattgcggcaatggctgccgagaagagcagcacaacaaggaggagcaccaggagaagaagaaagtgaagctgaccaaggacatggaggaggcggcggagaacggaggacggcaatgaagctgctgtctgtgattttgaaaaaaaaaaaatcaaattttgaataattgtgaatcagcctcgggggtggtctcattttttgcggcattcagcgtactgt

SEQ ID NO: 9559 - DNA, 1270 bp, Heterodera glycines
  misc_feature (1222)..(1222): n is a, c, g, or t
  misc_feature (1243)..(1243): n is a, c, g, or t
tacattgttccctcgtcccaagcacaaagttccgatgcttacggctgtccgttcggataagcgatggtcacgtcgagaacgtatttaatgggagggcgagtgtctgtcaaaggaacagtcccttcgactagccaaaggagagaaagaagagacaacctttgacgtatttcttttctcgaattgctcccactgtgtcctttatcagtttaattttgctggaggtggaggcagaacaggcgaggccattctgttcttcgtcttgccggggaccaatctctatgcaatgcaattaattgatgataaaataaaaggaggggaatgtccgaaatgctttcctccattttgctcatttcgcattaaaaccaatcacaatttttacttttgtcatcattcccttttattttaccttcaagcacagcttttatcgcaccttaaattaaaatgagtcattttcacagaataattttgtaattaatctgctgctcacccattcgcggcaaagtgcaatgctccaagtggggaaagttgttctccttggcatatctgaaaacaaaaagttcacagtgaaaattgagtaaaagcacttttggctggtttcttttcttttgtagtagaagccgccctccgggaaaagaatgacccaacgtcggtctctgtcccaaaacacctgaaagtatcgtataattatgcccagtgtttacatgactgacaatgagtgcccaccttttggaggtgtcccttcagtctgatcagttctttgtctcgcgtcgctttgccctgctgaatgaaataatcgccatgcattcgtccgataatcccaaaaggtgtccaacgaaacatcacatccatcaaccaaatcgtctgaatattgcgccccatttgaactttcagctgacccaattacctttcgagtggccacgccttttgtttgaaggacagtgaacaaagtgggcacatcggcggtgctctgatggttcacaatgacaaggacgcgatctttttcaccgtacttcctgatgtcttcgccatattcgtagactaatgggaacgaacgttccaatatcgcaacaattgaaggattaccgtcataatcggcagtgtatccccaataagcgatgaacgcttgcaaccacatgtacaattttccctcgtaaaaccaataaaatcgtggccatactaaaatgggcaattagcaaaattgttgttctttattatgaatganagtttacgaggcttagcccanagaacgggaaacataaagccaaaatac

SEQ ID NO: 9560 - DNA, 1374 bp, Heterodera glycines
attttcccttcaaaatgagcataaaatggttttatttgctctagtattcaccaagttataagctaaaaaaatttcataaaatcaagggtaaaatatagtgtgtaccttttactgtttgtatttgttcttttggcgttctgtatttattattattttatttatttgctttaaaaaattgaaatttatacacaaacacaaggaggacttgaacctgagacccctttttgttgactaactcacagaccactaagacgaaaaatccagcataattgtacttggagcccaaatttgaatcgaattatactgtacgatttaataaagtaaaagcgaagttaaggaatcctttatgacaaattggaatattaattagtgaaaattgcaaataaattatcaatttttctcataaacgtcgtccctggtattctcttataatttaaacattggaacccatccaattttccgggaacaaatatctgcaaaggattctttcgatgatccttaataaaaatagaaggcggagaaccaccagtgcgaaattgaacaaaaattctcctaaattttaaatgagaatattcatttcactgctttcgcttcactttgttccattttgattgcatgtgtaaaaagtcggtgcaaaattcccggtcgaatcgaaggcattgctattggcgtgaaacaattgccaaccgtaggcacgcgacaaaccttgggaggaattgagcagaaaatgagcggcctaaaggcaaaaaatgtgacaatacagcaggggaaaataccattaaaagcaacgcattttcaaccatttccatgtcgcgacggcactcaatctgttgcgcctccttagtgaccaaagtgatggacgagtcgctgattcggatgagagtggtgaaccttgaaaataccgtaaactgcgatcaacccgagacaatgaaaacgaaaaaacagactttccgaggttttcatatccccggttcacaaaggttaaagcaatcatcgagaaaacaggtgtgactcggatccatttccagttaaactgcaaaagatataaatgatatattcaaaaccattcgcactaaaacctgtgggtcgttgaatttgatcatgtgattctccaaaaattcaactgtcctgcttataagtacgtaatgggaagcacattggataaatttgcgaattaacaaatcggacgattgaacgtcggagggcgacgatgggccgacagctcgcgcattaatctgttagcaaaaacattaaaaactaaaaactcagattttgatttggcacttcttccgccgaaagtgcggttggtcccctcatgtccaattcttccgaatgagaaacgagcggaagagtgacaaagtgttggactctctt

SEQ ID NO: 9561 - DNA, 1612 bp, Heterodera glycines
  misc_feature (1494)..(1494): n is a, c, g, or t
acgaaccccaaaagggtggaaacgagcctccactttcagcaacaaagaatcgaacatcgaaaggacaatcgaattctccgttgtcagcgtaatgaggtcgtgttgcgaaacggactcggacaccaacttaaaagcggaattcctttcccagtcaatcgaatggaatgcgtaatactcgtgccaaaatttctctgcaaatcaaagaattttgagcccatggcaaagccttgcgccagtgcacgtgtttaacgtcctcttcactagtcgatggtctgttggtcactttaaagaacgattcggccgtcttttcatcgtctcaaattattgaaaatgaattttagaaggaataaaacatttaaaaaagttacctttttcgatatataccaacaaatcggtgcgacacattaaatacaaatttcatagaattgaaagaaaaatactgaaatgaaataccttagattctgaggcagtcgcagctcaatgaacgaccgattgttatgctttatggtactttcacgtctgtttgatgctgatttttgtgtaacatcgaaaatttcattgggtgcaaattttgggacaactgagaaaaatgtcaacaaaaatattttgtttaaaaatggtattatgaattaagggctaacaatgagtgacctaatgaccaaaaaaactttgggaattcgtcgctctttgccctactctctcatccctttgcaataattacatgttttgtagccgaggtctccaaaaatgttcggtcccacttttctgatacgccaattctcgcgcaattccctcagttcattgaagaagtcgtttttgtcagtttcggacgatgctccgcgccgtgcatttgccatccgttcgatttcccgtgccgtttcgtttagcactcttcgtcgagtgtgcagttggaatgccttggacacggccacttgttcggcctccgtccgctcgtcttggaccaaagcggtgaccatcggactcaaataatcagtgcgggcgattcgcatgcaatccatcagaatgtccacttcctgcagcgaattgctaaaatctttacaatcagccattttttggagaaattagaattgggttgactcactgcaaatgtttggccaccattgcccatggtccagcaatgggctcaatgaatcctttggtcgtctgagccaatccgatcggacttccttcgagttggctgtcatccgagtcactttcttccgttaaagtgtccgcatttgtcttttccccaattattttgctccattcgatgttttgtgcatttttcctcagatggtctttaaatgcgagcggtcttaaagaaaacaaagaaaatggggagaaattctcacaaactttctgacgactaactttatgtatttctcgactccgtcatatccaacctcctgtatttcccattcattcaaaggttcaacacaaatttgaactccacttccattcgcatttgtttgtcctccgtacattgcaacttanaaaaattaaatttaaaaaattaaaaacaaatttaaaattaaaaaaaattcagaaattgaaatttaaaatctttgatttcaaaaatctataagttccattgtttagggacctgatctga

SEQ ID NO: 9562 - DNA, 1799 bp, Heterodera glycines
agattcatagagctaaatctggcaatcgcatttattactacccataatgattgagtggtcattacggtggcaaattgcataaaagatttgatcacctgctgaaataatcacagtcataaattccaacacactaattgcctaattaatccacttcccatccatgcttcattctcatcggctgttagcatataataatttaggccaagtacctgggtgaaggagtgtggggtccttcccaaataaatgtaattaggcggtgcattatcgcaattaggagtaggtggcggagggtgaattgtcaccaccatttcgaccgaccaacgatccgtccctgctccgccctcgaaacactaattgcccaatcattcccagttgaacaaatacataatgggtgcatgtgaaaaatgctgcagcatttgctgctccgcgatggcccaacccggccgagccaagtggcacttcaattaattggattgtcatgaataccaacgcagggcagaacagaggagtcactgactcatcccatcgtcacggacaattggcgaagaatggacaattaacaattattaattgtttattaattgtccgaatgaggggcaccaccggttgagtattttcacaccgcaaattcatatgcaaattaacaccgcgaatcagcgcataagcaaaggacaacaaaacacacattcatcacattaattgctcatttaaccttctctcttaagcaactcaatttaacaaatcaaaatttttgatttgatgacctcttctgttgttccattactaattagtttggttaattagcgcaaatgatgctgaacaatctgctccaatttgtgcttccgtctccctccaaccgtgacttttcggcatcatcggtgccttttccaccattcccccaaagtgccgttgtcccatcagtccaccacaatgtgccaattgtccccccttctcgattggccatcgtcgccccgacgagtgccgtcttttcccccatttcttccccaaatgggttcacattttccccaaaatcatcctcaacttcaaattcctatgaccattcttctttcatcgaagacagttttttggaggaagaaaatgtcaatttaaaaataaaaaattatttgattggggaaattacactttttaaaaaatttttagaatttgagagacggaagcacaaaaagcaaattgggtgaagaaaagcaacgaaaaattggaacggtcgtcgctccacccgaatttgtggtgagaagtttgttgaacaaaagcaaaaaataaattagataaatggtaaaagattcaagaaaataaatggcatttcaaatgtaaataattgggttcggtctttcgctcccaaacggcgcagaaaactgaaaactaatttagcacagaaacttcacttccatggcgcaaaatggaaaagacattattgcctttgggctgccaacccaacacaaaaacaacaatttggacgacattgaaaatgacaattgcaataatcatgataatgattatgatcatgatcatcttcaacatcggcaacaccagcggagtcgaccgttccaaatttcgacgacggaagaagcgaattggcacatcggaggagaagcggaggtgccggccgcttcatttgttcatttattattccattacaattatttttattattcattttttatttattttccataatatttgcacaaatgcttaaaataaattttcagccaaatgattccctccccgcgtttggtcccttcgcttccgttgcgccgcaaaatgctcaaatttccgtcatt

SEQ ID NO: 9563 - DNA, 2596 bp, Heterodera glycines
  misc_feature (35)..(36): n is a, c, g, or t
  misc_feature (53)..(53): n is a, c, g, or t
  misc_feature (62)..(62): n is a, c, g, or t
  misc_feature (69)..(70): n is a, c, g, or t
  misc_feature (72)..(72): n is a, c, g, or t
  misc_feature (80)..(80): n is a, c, g, or t
  misc_feature (2225)..(2225): n is a, c, g, or t
  misc_feature (2239)..(2241): n is a, c, g, or t
  misc_feature (2245)..(2245): n is a, c, g, or t
  misc_feature (2254)..(2255): n is a, c, g, or t
  misc_feature (2257)..(2257): n is a, c, g, or t
  misc_feature (2260)..(2260): n is a, c, g, or t
  misc_feature (2263)..(2264): n is a, c, g, or t
  misc_feature (2266)..(2266): n is a, c, g, or t
  misc_feature (2270)..(2271): n is a, c, g, or t
  misc_feature (2275)..(2275): n is a, c, g, or t
  misc_feature (2279)..(2279): n is a, c, g, or t
  misc_feature (2291)..(2291): n is a, c, g, or t
  misc_feature (2294)..(2298): n is a, c, g, or t
  misc_feature (2301)..(2301): n is a, c, g, or t
  misc_feature (2303)..(2303): n is a, c, g, or t
  misc_feature (2314)..(2314): n is a, c, g, or t
  misc_feature (2316)..(2316): n is a, c, g, or t
  misc_feature (2320)..(2321): n is a, c, g, or t
  misc_feature (2328)..(2328): n is a, c, g, or t
  misc_feature (2334)..(2334): n is a, c, g, or t
  misc_feature (2338)..(2338): n is a, c, g, or t
  misc_feature (2342)..(2343): n is a, c, g, or t
  misc_feature (2353)..(2354): n is a, c, g, or t
  misc_feature (2359)..(2360): n is a, c, g, or t
  misc_feature (2363)..(2363): n is a, c, g, or t
  misc_feature (2368)..(2369): n is a, c, g, or t
  misc_feature (2374)..(2374): n is a, c, g, or t
  misc_feature (2381)..(2382): n is a, c, g, or t
  misc_feature (2392)..(2392): n is a, c, g, or t
  misc_feature (2397)..(2398): n is a, c, g, or t
  misc_feature (2404)..(2404): n is a, c, g, or t
  misc_feature (2410)..(2411): n is a, c, g, or t
  misc_feature (2431)..(2431): n is a, c, g, or t
  misc_feature (2439)..(2439): n is a, c, g, or t
  misc_feature (2450)..(2450): n is a, c, g, or t
  misc_feature (2461)..(2461): n is a, c, g, or t
  misc_feature (2468)..(2468): n is a, c, g, or t
  misc_feature (2471)..(2471): n is a, c, g, or t
  misc_feature (2473)..(2473): n is a, c, g, or t
  misc_feature (2477)..(2477): n is a, c, g, or t
  misc_feature (2480)..(2481): n is a, c, g, or t
  misc_feature (2484)..(2484): n is a, c, g, or t
  misc_feature (2487)..(2487): n is a, c, g, or t
  misc_feature (2491)..(2491): n is a, c, g, or t
  misc_feature (2498)..(2498): n is a, c, g, or t
  misc_feature (2519)..(2519): n is a, c, g, or t
  misc_feature (2522)..(2522): n is a, c, g, or t
  misc_feature (2545)..(2545): n is a, c, g, or t
caaatgatcagtcggagagggcaaataatttgttnnaattagtcaataaattntgaaaatgnactattnntnacgttttntaatgtttactcaaaagcatatgcttaggaataaaaataaatgttggcttcagtttgtatttgtttagtacaaaaaatgattgtttctcaagtttaatcaatcattcccccggggggggggggggcttttggctgtaagcaaagcgccattaaagcaacaaattgcccgtataaatgccaacggatcatttttcaacatcctgaaatgccatttctatttttaattgcataacaaacgggggaaaggggcacagaattttgaagatttggtggttatttgagaaacctaaatgctcaacttattaagcattttcatatttctttgtgcagaaattcggtgatgtgcggcctttcgttgttttattcaatgcttgttaccatattcggtatcattttatttttgtgtttattgtatcccgagataaaagcccatacattttaatgttttagctttggttttggagctgtcccatttaatggtgacaaataacagtcggcgaaatttgggcttcaatgacatggtaattaacgtaatttattttttttaattgaattttcattttgctcagatgttcggcatttacatgtacggctgttccatcctttttctgctttactgctattgtgcgcttcttctcaatccacgatggaaacgcaaaattggaaaattactaagaaaaaagtatttccataaaatgcataaatttaatttataaaatttatttttttgccgtttttagtgccgaatcttccgcaaacattgtgaaccaatgcaattccgagcagttccaggaattgcgcaaggttccttccacttgtgtgcctttgtctgttttgtgtttgatttttgcttttcccaggttagccacgacgggccaagtgccggcagtcttttcctgcgcctcggctgcgtcgttttcggcgtaattggcactgtgtattacggtatcgcaatcgcttagagttgtaccattttgtgtgattttggcactctctttttcagcttttaatgtttttctgtgtgccagcgatggcacatgcccacattatgtcattgttttggacattatggccattgcgtttgtctttgtgcaaatgcattttgtgttctgcaattggaaggcatttttaatttttcaattataataaataaatcatatttattaaacgtaaaaaatacagtaaccctaccattgtttagttggccataagcgattaccaagtgatttgccgttttggcactgcgcatttaatcgcgaccaacctttggacttggatccgttacattctcattgaagaatcgctgatgggagacgaaattcggtgggcaaaatgccaaactgaaaaaaaacatagaaaaaaacaaatcagacaagtgtttgcccgtcatgccacctttccgcagccaatcacaacagcacaatcgcaactgatcgaactgtcccaaacggcggacggagaaggcggcggagagtttgtcaattgggacgcaccgtcggttgaaaatgccgaacatttgaacggggcaaatttggacatttccatcggtggcaccggccttttgcttggtgccggactgaccgtcaaacgatcggtgcgaaaatgccacggggccgagtgcgttttgggtaattatcgctgaatttgaattgctaaatgagggataaagccgaaaaaaagaaaatgggtaatttttaatgacagcaagcttcaacgaagtgatgtacacaagcattgtggagtattcgctgatcggagctgcggtgatgttcattgtgtggaaaaacatcggacaacgccaaaaaaagtcggagcaaaaggaaaacaaaacaacgaccgcaaaagggtaataaaataattgaaaaacagcaattatttattaattaattaatgtttaattgctttttgagttatgtgagtcgaaagcaccgaattcgaatggactgctcaaaggtaaagccaaagaatgggccaaaagccgaattgaatttctattttaaccccaaaattcagagcacaacaggtgggacgatgatgggaatggcagaatgccaacgaatgaggattaactcaaaaacaaccaaggactcttcttcggattggcatttttaaccaccactttcacctcaatatccattttctccnattacacaatcatnnnacanaacacacanncnatnatnntnttcnnctcnaccnacatcatccatntannnnnaantnctttacattananctcnntattttnaaaaancctncctnnattccatttnnacctnnatntcctnnaccanaatccannaaaaatccanacctnnatccanttccannccgaactctactttacatantaaaactnaattaaacctnttccttttcantatatcntcncnccanttnnctncgnttcnttcttcncttttccttcttttcaaggcnctnctttccttcccccccctcttacnaatcccttagaagaggtaatgccattgaaaatttcattttaaatttaaatg

SEQ ID NO: 9564 - DNA, 1192 bp, Heterodera glycines
ggcactcctttggcactttgttcagacagccaacatgcctggccacgaggcactcttggcagaacattcctgttcaacatatgagattgttttaaaagttttaaattcggggattttcttggttttacgaatactttttcctgaaaggtgcaagaaagcaaatttaattttggtcagttgtttaaattgtttccggacaagaattttggatttgtctctcattgaagaggaaaaatactaaaaaaaatcatataaaagagtaaaaatatttttaaaaaaggcattaacatttgtcaagaacgaaaattcgcaagaaaatattaacatttttgaaaaaaatcagacgagaaggaaggatagggtccaatcatcggcacctatccccgtctaaaagcaacctctggtccagaaatgaacaacaaatttgtccaattgatagattagtaattcctgatcagtcaaaagtcttgattcttgagccggttcccaatagccagaacatctgaaccctaatcacccaacaactacaccaacaataaacaccttgtcgatcggcaccgatcagcaccgatgtgcacaccacacatttggtgggtgcccgtagactggcattcacaaaatggtgtccctcgccgttgaacgcgctgttcagcgattggatgcttttcgggttggcggacgatggaagcgggcggaaaatggacgaagcggttgtcggcgcgggcggagtgccgtacgaagtgtaaaagcgggcattctcgtagaattgtggatggaacggaaactgttgttgttgctggtgatggtgttgtggtggtggtggaggacttgcaaccgatgtggcggtgaagctttgattcctgcttggaggtggggacccataatttaatgagtttaaataattttgccaataattataggaaaaaaccacccaaaaattcattcgcatgccagacgtattcattcccctcgcccagcaaggttccccattcttttaaacataagtttttttaggataaaatcatatttttgtataaaaagcatactgtgttttggaacaatttatttattttcaattgataagaattcagttaatttaatacagaaaaaaagagtgacgagaatagaggtgggggggggggggaggtgaaaaatttactgaaaatttttcattttttgggtttcggggggg

SEQ ID NO: 9565 - DNA, 2734 bp, Heterodera glycines
gcgacgacgttttgtcctgctccgggtgaaagcaccggcaaaaacaaaaccaaaaagagacgaattgaagagtgtagaccaataaaacaaagaattgaagagtgtaggccaataaaacaatgacttgggctcacaatcagggccagattggaacaaaatcaagcaaaaataactcaaatttcgaggcttaaaaatttgaaaatccaattttattaaattttgttccattccatttcataacagatgatagataatgaacataagaaaagaagtgaaatagagaataactatcatcattatataaaaaacaaaagtatattcatataaaaaaaatgcgacaaaaaagaaatcaaaacaaaataaaataaaaatcagtgatacgcagcatctgctggtgatgaaagcattgggctcaataaatgcaacacatgctgccggaggcaaaaaatgtccaaccctctaaagcagagaaaaagttttggttatttaaatatattaaactaaaaaaagaagtcacgacagaaattgtgaatgcattaaaatttgattataaaaaacaacaaaatccgtaggcaggtgaaggtggttttataaattccggattctgtagcgaaaatttcaaaaatcctgatttttttttcatttatagtaaaagttttaaatttcatatacatttggctgtaaataatatatatatatatatatatatatatattggtaaatttctaagaattttttaatagtgaaattaaataaatccaaagaaaaacaccataaatttcctgaaacttttgctctggaataatccttaaaatacatagaaacgaatgtgtccactctttgctaattgggcggtctaatcgacaataacaaagtgaaaaatgtgaatgacttattgttagaatgagaaaacgctgaaatgacaaatgctggctttttttatgtgaataaataaatttatgaaaattataagttttgattttggtattataactaaaacaaataaaatattggaaaagcaaaaaagaaacaacaagttttttacacgatagaatgagatatttaagaaaattacaatgatgaaatatacagtatatttatataaatgagcatacggcggaaatatattataaaaaagtgcgattaatacagaaattcttaacgctgcttatacatagaatacccaataacgcacataacaccaaaaaattcagccaaaaatcccccaaatcccattctcacattcattcactcacatttgtgccggcgaccgtgaatggtacagcagcagcgagctgtcgtactcgtccagcgatgatgacgcattgttgtatgtggtgactgccggcgagcgaagagaagcagccgcgagtgccgccgtcgttggcgttgaagtgatggccggaggagaagcaattgccgccgccaccgatgacggcatcgccgaattggaggaggaggaaaagctccggttgaacaggttggcgttgaagcggtgctggtgctgagccatctccagcagaccgggcacaacaatgccgccacccgccgtcgcggatgacgaaccgctgaccggggcgccgccgccggcgtcaaaaagtgtcgctgccggtccatctgctacacgctgcggtgcccagttacgcatggcccaatgctgttgtcttaaacgagacggtacagtgcgtttaagaagtgcagtgatcaaccgaatttaaaacagtatagtaatatcaaggaaagagcactgtaacccatcggacatgtatccaaccaatacattagccttgaattatacatacatcatcttaatattgttagacaacttcacgcttggaactttgtcaaactcgctcaaaaaatgatcttttcgagcaacaagaaaaataaatttaaaaaaaatgagttatggtaccaaatctttttttcaaaagatagcagaaaaacgtgctggggaaaatttatttcagaaaaaaaaaacaacacaataatctccatcagtcaaggagatctgaacaacccatgacaaattgctaaatttttaatggaaagaaaattattaattcactcaactctaactttgcctaagtcaattcgatttgcattggcatttatgtctgatcacttttgtcttgttgtgtcaaaaaaaagctaaagttgtagaaaatccaccatatgcaataacaacagaaaaaagggaggattctcgaacattcccaatattcccaatcagcagcaagcggactgcacctcaacagcgacgcgttctcctggttcatgcgttccatttcctcctgctgttggcgcagcttgcgcctgcactcgtccaactcgcgctccagccggtccttctgctcgcgcgcctcgcgcagctcgtcttgcgcctggcgcttggcgcgcatttccgcgtccagctgctgctgggcctcgaaccgcccgtacttggcctgcttgttcatccgtcgggagccccaggtgcgcaacggactggaagaacaagaaagatgaattcggtgaactgttgcactaataccggtaacttcagggaccaaattaataatggttttccggggtcccgatccgggtgaattttccaaaaattttcggggcaagagtacgaatgcaaataaaacgctgactggggtccggtctgggcttgtttttatgaaaatttcaaagaagttaaggttaatttcaagtgatttttgaaagttttaaaaatcgtgactctaga

SEQ ID NO: 9566 - DNA, 630 bp, Heterodera glycines
cccccccccccctgggaccgtccctgctccaaagttgttgctgctgttattacagtagctggttaccgtatctgtatcacacgactgactgacctgtcgctgactggcgtgttagcgtaactgtttgccgctgcctcgccgcccctaccgttgccgccgctggccaactgttgctggtactgtagcagtggcggtgttgacgttgttgtcgcggacagttgttgctgctgctgccgcttgaaacactccaactcgccggccaaccgcgtggtcaagtcctgcaacagttcctggcgctctttgccgtcgctgacgaactgcacaatctcctagaaaaaatgacacaattagcatcaaattatgccattaaaagatttaatggagggtgagggggggggggggggtaaaaaaatttcagttaaaaatttttcaaaaaaaaatcttagaaaaaattttcatacgaaaatttcaagaaaaaaattgtagaaacatttgcctgaatttgggcgctcatccgctgctggcactgcaactcctggcccagccggttgttctccgcccgcagctgctcattctccgctcgcacatccaagcgctcggactccatcgccttcacccggctgctgcaca

SEQ ID NO: 9567 - DNA, 1317 bp, Heterodera glycines
  misc_feature (5)..(5): n is a, c, g, or t
aaacnttttaacacaaaaaaaattaatagaatcaattaactgtttttcgtgtcttcttttaatattgtatgaattaaaaagtatataatgtaaatatataaatcagaaaaatagttaaattaaaaattaatttaattaaaaaataacttatttataatatattaatatcttattattccaacaaagctcacgagcctgctcaattggataaaaaagtgaaatatgaagaaaatattcagtaaaaaatatttattaaaaggaaaggctgtttttgcttttcaacaccatggattagtagagatcggaccgatcgattttttttcggtttttttcggtatttttcggtttcggtttttgaccgaaaaaccgaccgagaaatttttgactttttcggtttttttcggtttcggtttttttcggtttttataccgaaaccgaccgaccgaaataatcaaaaaaccgaaacaaccgaccgacttttatgaaaaaccgaaaaaaaaccaaatcaaattggaacgatataatctgttaataataattaatttattgcttttttgtgctctttttcattcaaggtataaataaatattcaaaaattgcaatattttaataatttgttttgcaactattaaatacttatgaaaacgtttaattttggtgggagaaaaagaatattttaaaaaatctataaatgctatataattacgccacaattgatgtgtgccaaatactaagacaattatttggtaaattattcttcattatgcttgaagaatgaaaaaatttttcacaaaataaaatttgcatctttaaatgacgatgacgatgacgataataaaataataaaatagaatagagtcattccgccaaaaccatacaaaacggtatattttacaacacgaaaaaaatacccaattataatacaacggtaaagcagttttgatcatgagaaatttcgttggagataagagaagaatccttaaagccaagatataaattaagaataaaaaatatcaaccattttaaaacaataattttacattttaaacacacttcaaaaaaataattttaaactggagaagtcagataaaagtcgaacacagcaggacaagacatttagaaatttaaattttatatacgaaaattaaaagtataattttatatcttataatttaaaataaaatttataaaatcacaacaatttcctcattagttaattcaaataaaaaaaaatttatgcttggttacaatgttttaacgattaaactaaactatttcaacgaaacacgcaatctcattagtaattgatcacactct

SEQ ID NO: 9568 - DNA, 1861 bp, Heterodera glycines
  misc_feature (42)..(42): n is a, c, g, or t
aattttcaatttcatttcttaggggtgcattttcccgatttnattccatttttaatgtaattttccttaaaaacgccaaaaaaggcaccaaaacggcaaaatgccaaaaagccatttaaggcacaaaatcccgaaaaaggcaaaaaaaggcataatgtgtctcgagactccccttttatatgtatgaaatgtacccccctacctttcggttgccatgccctcgcgctccaccacctccatctcggttggcattggcattttttttgcccttttttgctccatcttctttgccatagttactgttgctggtgttattgttggcatttccgctgccgttgttactgttgctggtgttattgttggcattttcttcgccgttgttactgttgctggtgttattgttggcactttctttgctgatgttactgttgttgttgttattgttgttagacattttttttggtattttaaaagttctgtctaaatttttaaaaattgtgtcaagtaggtccatatctataattaaattaagtaaataagttcgcgctataatcagggcttcgatttgttcttatttctaagaaatgttctgatttggagggtccaaatcttagaaaatgaaaatgttcttatttctaagaaatgttctgattttgggttattgttcttattttgttcttatttcttaaaattattcaaaaattttgaaattttatggcgaaatgtcactatgtatcaagaaaaaatttaagatttgtgtcaaaagttggtaatttttgacaaaaatctgttaacaatcgctttaaaaatcgcaaaattttcccggcggcgcctttcggcaccgccggacccccctgtccatcccccaaaattttttgaaatgtgcggcaaaaaaagcgttgttaaacgcaaggaaaagccgtctcttgcttttaattgcaatttggcctttttttggtgaaaaactattaacaaatcagaacaaaattacaaaaaatttttcgacggcgcctatcggcaccgccggaccctccctcttgcccaatacccaaaagtttttttggaaaaatgcgccgcaaacaaaattgtttaaaatgggattttttgatcccgaatgctctgaaatgtacgatttgcttatttcctccccaaaattgttaaaatcgataatgggaggcgaaaaatataatatttaatacatttttggccgaataaattgtaaaaataactgatttgaagccattttgcaaaatgttcttattttggaccctaaaattttatttttttgccttgatgttcttattttgaaaaattttcgatcgaagccctggtttaaagtaaagttatgaccaaaaatgttcaaaaaaacttaattttttgagtttctcagttcataactcttttgaaacaacgaatttttttgaaattttgcaggataataaaaaacacttaagactatcgagaagtacgaaggtttaaaaatttggtttattttggacgaagttgtgaataaattttggtcaaaatttttccatttgatgaatttttgactaaagcacattttgattatttttgactaacgtcccagcacctattctcacatgggtctattttggtaagttatctgtaaaaaataatgattattaaatattaaatttcattagaacttaatttcaatatatggctttctttattggcaagtcgctcttaaaaatagaattaaaaaattatttatttatacctaacttaaaagtatttcaatgttttttaaagataatccataaaaacatttattctctttattcaaataagcaagttaattattataaatttcattttttcaatatttggtaaatgtaaa

SEQ ID NO: 9569 - DNA, 1375 bp, Heterodera glycines
ttttgatttactttttatataaaaagtgctcttttagggtactcttttttttacttagcgattttatgccacttttttttttgctcaagaaaatagtcacaatttttttttttcaattttttttttttgcaaaaacattttgttgctctatcgccatattttcacaaaaacttcttttttttagttttccattattttttttgattgctttcaaaatttcagttgcgtttgcatggatgtttggatggacattctccccttatttgaccgtcctcagctcggcctctaatttggcattgctttcgtccagtttcaatgcacttgtggacaaacatttcaacggcaaaggcgaatttcggcaagttttttagggttattgaatgttttttaaggattttgtgccaaaaactggcctccattttcaaaatggctctaaaaataaaaaaatttccaaatttggccagtttttttaaatttattttttgtaaataaattgtttttttgttgtttttaagcattttttgcccaaaaactggcctccattttcaaaatggctctaaaaataaaaaaatttccaaatttggccagtttttttaaatgtattttttgtaaataaattgtttttttgttgtttttaagcattttttgcccaaaaactggcctccattttcaaaatggctctaaaaataaaaaaatttccaaatttggccagtttttttaaatgtattttttgtaaataaattgtttttttgttgtttttaaggattttgtgccaaaaactggcctccattttcaaaatggctctaaaaataaaaaaatttccaaatttggccagtttttttaaatgtattttttgtaaataaattgtttttttgttgtttttaaggattttgtgccaaaaactggcctccattttcaaaatggctctaaaaataaaaaaatttccaaatttggccagtttttttaaatgtattttttgtaaataaattgtttttttgttgtttttaagcattttttgcccaaaaacggcctctaattttcaaaatggctctgaaaaaattttttccccaaattccgagtatttttattaaagtgtccggtttttaggatttttggtactttatttattgattttttcaaaaaattgtattttttggatttttaaatgttataaattattttgtgaccctgctgagtagtgtggtttgcatgttttttaattcacttaacaattcaagttatacccaaacattttttaatataaaagtttatttttaatatgttatttttaattaaaaaagtttttcattagcataagctctttctatataagcaaactcataattatcttttcataatttcgaacacttttttt

SEQ ID NO: 9570 - DNA, 808 bp, Heterodera glycines
  misc_feature (797)..(797): n is a, c, g, or t
ctttgcagattttttgaggcgaaaaaccgcaaaatcgatagactaaacctcgggacgaaaaataacaaaaatttgggccctttcacttgaaaatatccttgtattcaaaatgtccttaaaatttaaataaattgcataaaaaatccaattttttttccggtggcggaacctctttctatttttttaaacttaaatataagcaataaaacacagtaaatttcactatttaagcaatataattcataaataaacatttttgttgcatttgctaaaaatttttgtgtccgtgaattaaaaagaaatttcgcgctatatccttggaaatcagtccttgggaaaagggtttggacaatcctaaccctgtttttgttcaaactatcaaacagtgacaaattttgattgtttttcaccgctgcatatattattcacaagtaatttcgaccacccaaaaaacaatctgacagaatttcatactttcgactttgaatgatcaggggagttacagtttctccattcttaagaaagtaaagagtcaagtacgagcttaatgacacggcactctcggaattgcccactcatttcacagactttgcactttgagggcattgcctcccaggcttttcgtattcatttctctgcttttgctccaaccaatgtccgctcgcaattgtcaattgccaaggtttttcccgtctgacaagcgctgaaagctgtggcaaatggacgacggagggaacacacgaaaagagaggagaagccgagggggggggggaggacggaccaaccgcccccggggnggggggggggg

SEQ ID NO: 9571 - DNA, 5999 bp, Heterodera glycines
  misc_feature (5145)..(5145): n is a, c, g, or t
  misc_feature (5153)..(5153): n is a, c, g, or t
ctcatgctgcttggattcttgaccaaaatgtggaactaccgttccttcatgatgagtccttcttgaaaattgatcagaatttgttgtgttacattttggagcgtgatcagctgaggatcgatatggaaattaaaatttggcgagccgtaattatttaatcatttctttacttttttattttaaatgttcaatgattttaggcacttcgttgggccgatgaaaaatgccgtcaaaatggcattgactgttcggcgcaaaatcagcgtgcgatgctcggcccggcactgttcaaaattcgttttgcgctaatccctcacgaagaatttgtgagaaaaattggtaaataaataatatttcaaagcatctgaatagtttttgtctttgtggctgccataatgcaattctatcatttaaataaggaatataaaaaggtataattttatatttcaatcacttgattgaaaataaaaacacctgttttctttttccccgttattactttaaggacatttgatttttggcaattatcctcatttataattttttggagtaggcggagtcaaaaggatttttttgaaaatgaggatttgtgttttttcaatcccatgagtttacattaattagcccatcagaatagagagagtttccacaaaatgattacaataaacgagtgacaaatttgctattttttatcattatccatacttattttggcttggcactttattttgaattcagttccttccggtctgttgtcccaggaagagttggacgacgtttttctgtgcaattatcagctttccgtgccgaatttgccgcccgaaagggcggcgcgcaaatttctattccccgcccagcaacggtttctgtccgcgccgattgaccacaaaatgcgcatttcgacagcgtgcaaaatagcaggacaaattatgatgaaaatcaaaaacttttccgggtttgccagtgaaaagggcgggggcgagcagttcagcaaagcggtgtatgtgaagggattgccgtggcgtattttggcactttcacaagcgggcaaagggacgaagaaaagcctgggcttttttctgcactgtgatggaggcaaaggtgggggcattttagatctttgatgctttcattttgattttttgaattttgggtgggcaatggcgattctcatcgagcaaatcgaaacttaaaacgaaactgcataaaattatcaaaacgaaactcggaacccaaaaaggcctgaaattctcgaaactttcgaacgctcgaacccatttttattattatttttttttaattttggaattaatttattttgattcctttttattccattaaaaaatatcaaaaatttgatttttaatatcggatttaaattagggtaggagccagaaagaaggggcgggggaggagggggcgaatcgcgctcaaaccggggaacggggatgaaatatttttatcttataaaagaaatattttattataaattttactcctatttatattttcatttactaattaattgtgatgcgccattttatttttatttttttgcattaaaaattttcaaataaaaatcttttcattgaattaagctgtcgattggagctgtaagtgttcagcttcgcttcgaattctttctcgatcgcaaaatgaagaacgcgagaatttcactcggagattcgataagcaaatttttaatccaatttcgaacatctggggcttcaattcgttcatcactttcaaggcaattagttataaaacaattacaaatggtaaaaattaattaaggaattgatggacacgcgaaacggactgtacaataagaaaaatacagtaaccctgggcattcaatttactgtggaaggcgaagacggaggtgaacaacaagcgatggaagccgactgaagaagcatttcgaaacacaaagcttgaagccggacactatcagtaccaaaataaattccaaaattttcgtcagcaatttgctaacaatttgctcttcttttttaaaattggacattcattggtgatgcttcaccacatccgtgccgaaggaaagaaaaataaatatttattgaatttaaaagatttttctcgaatgcaaaatttagaggttttaagtagagtagagcgggaccgggaattttgggcaaaaccgggaccgggacttgccgggacctgagaagccgggaccgggacctcgatttttcttcgggaccgggaaccgggaccaaccgggaaattttaaaaattcaaaaaattcaaattttaatttatttcaagtgaaaataatacaaaattaaattttatttctttttatttaataaaatccaaaagttaaagctaaattaaattaaagaaaattttcaaatcaaatttcttcaattatttcaagcaattaatcatttggaccaaatggtcgaatattatttgaaatttagatttacttatcacatcacttttttcggcgcgctttttccagaaaacttttggggaaaaaggtggtccggcggtaccgataggcgccgccgggggaaattttgaaaatttgagtgagacaattgtcagtgtccttttaaggaatatattaatatattttttaaatttttcccttttaactctaattttcatctctaatttttgactcagataaagcattaagcacaaaaatccgctttaagtatgaaaaaattttgggtctagaagccgcaaacaaagtcatattcgtttttcattcttcttagatggcctaaagttaggcaaaaaaatgaagtacatatatctaaagccggtccctaataattacctatcagtcattttcaaattgtcttaattactattcaattacctcttacggtttttcgacgattaaggtgttttataaggtgaaaaatgcgaaattttccacagtatttcccaacaaattacagaatattcaaaaatttcccggagacgcctttcgattcaggtatttatttttacggaacttttgcgtttttgagcgccacttcaaagactcacgttttcatcatttttcaccgttattggctttatcatcggcttcgctgtcgatgcggtggacaatttggaaatgttgttgcattttgtgccgttgcactctttgcaattccacttcaaaggcttttcacagaatttgtccattgtgccgttgccgcactttccgtccgcttcagcacaatcatttaacacaaacatgtcgttgcaatttccttgcatttttaaagttaattaattctaattattaatgcgtgtgccgacgacctttcgccaaaaaaggcaaaatccgacgttttcatttgacccgcaaatttgcggtgaaaattgaaataaaaaaccctagaaaattacgtacgtactctgattctgtgcggttatttttttaacactgtaaaaacaattcattaatcattcaaatcactttaatgagttgggatcggagtcaaaaaaacgaaagcaaaaagtgttcagtgaaaggtgccgaaaggcattttcctcaattctataaaattaagacaatcattcccaattgtttgccctctttttgtttgcccaattttcaccgtcttggcaagtgaatgtttggcacttctctcccttgcaattaattgtgcttcgcttcttgtaattggtgaacagctccttgaactccttgggcaccttgtaatcattcgaagggagaagggtgccgtagcatttcgtggctggggacaaacatttcgttaccaattatcaaattaattaattggcatattagcgttaacattgttgctctttttccttccttatttttgttaccagttgacaatttgagttggtccttgttgcataaagaggtggtacagtgcgtacaattccccacaacttgcacttttgtcaatgattcgttgcaaaatttttccaattgattgtcgaggcattttttctcccaattatcgcacccattgatcacgaaaagatcgcctccatactctaagtcaaattattgcttttttccatgttaaggaagccgaaaatttttcaaaaatttcgagagaatagaaatcggtttttgaattagcttttttaaagatttttctcaaaaaaagaataccactttgaaccatctgtttttgatgctctatcggtttttgcaaattagagaaattccgattctttgagaaaaatttttggcgtaagcggccagggcaattaccgtgtcatttttactttttctaatttcttactgtctgagcaacggtatgtctggcagctgcccacgcatctatgcgcttcctgagcttcgccgatatcccattgtttgagtatatctgtcatttctttgggcggattgaaattgggatggtaaatttgggcatgcatgcattcatctacgaataaaaaaataatgaaaaacaatgccaaaatgcgcgagtgatccaatattaggaattaattaattatctatgaaagagctgggaagccttgaaggaaaataagggggaggggcggctctgagggttacaccctgaaatctcgccgggaccaaatctcgccgcagaaatttaaaaaaatatataaaatttagaaattttttaaggaaaaaaacatagaaaattttttataagaaaatttcaagaaaaaaaaattgttgagtttttttgaaaatttaaaaaaaacagtaatttattacaaaagttcaaaaaaaatcgctgtaaatttttaaaatatttttctttctgaaattttcttataaaaaattttcggcgctatatggaaagtggccctttttgaaaattttttaaaaggggggacccttttgttttgcaaaatttttttgtgatagtcataaaaatttattctctggggtttttggggtccccgatcacgaacccttcaattattttgatcaattccgatttcctaatctaaatttgaacaaaaaatcataatttgaaaaaattcaaaatttcgatttttattcgagttcgggttagggattagaaattagtcaaaatacatgtcagattcgtgattagcgacctttaaaaccccggataacaaattatcatggttttttatcacaaaaaaattttgcaaaacaaaagggtcccccctttttaaaaaattttcaaaaagggncacttttncatataggccgccaatattttttaaggttttttcttgagaaatttctgtttgaaattttttttgaaatttcggcggcgagattttgtcccgtccccgctttgagccggcatctctggctttccatgctctatcagctgatgaaggctgccctagcagttcatgtttggggacaaacatttcgttaccaattatcaaattaattaattggcataattagcgttaacattgttgctctttttccttccttacctttgctaccaattgacaatttcagttggtccttgttgcaatcagagccaaaacaatggttacaatccgaccggacgtactcttttgtgaatttttcgtcgcaaaatctgtcaaaatgagcatggaaggcgtggcacttcattctccctcccggaaagcccactaagtccggtgagtcgtcatcgcacccattgatcatgaaaaggtcgtctccatacgctagtcaaattaattaccataaaatgtgcaattacaaaccatattatagagccctaattgttttttcacgttaagaaagttgaaagattttcaaaattttcaagctagcccagggatgcgatctgttctgatttatcagaaatgttctgatttggagggtccaaatctgataaaataaaaatgttctgatttgtcagaaatgttctgattttggggtagcgaccaaaatttgttctgatttcttaaatctcataatttttgaaattttatggtataatgtcactattttatcaagaaaataagctttttggcaaaatttaaacaattttttggacaaaatctgttgacgaatctcattaaaatcacatttttttccc

SEQ ID NO: 9572 - DNA, 2481 bp, Heterodera glycines
attgtgcagttttgcgcctttcccaacccccggcttttcaggtgcccccaactccctcggcttaatccaatcggacataaaacgtacagccattattttagccaattattctcttcttttttttgcatacttctcttatcccattattcgtccaactgatccaatcacagcatgccttttttccatatctatttaaacattcatagaattttcccgttatttacatttgtcggatcacatttttgatattttgcggcatacataatgaaagaaataaaaaaaatataataattttattttgaaaaatggaaaatttatttcaatgctaattgatttaaattttatggacttcaaaattatttgttatttttattcggatcatttttgtaaacatatcagtgattggtgacaaatttgatattttaatttgatcctaaatttaataattattataatttgcgcaaatttaagacttaattgatttttttatattccatttaattttggacataatttaattttaataatttttaaatttcatagatgaaattgctttcataaagtccccgaattccaaggcgcaaattcacttgcaactttctttggcacggcccgtagtttttcaacatattttcttggcattttacttcgactgaggggcacctccattttctgctaatctcatattttgtgtcattctcaacaaaatgccgacggcaacttccaccggcatcaaattgccaagccaaagggcaaaaacatcattaacaaaacaatcatcttccccgtcatcggcacacattctgcttctgatactgcttcatccccttcttttgttcgccatgccggcgcatgctgccgtccatccgcctctccaacttcgcgcattcgtcggacgccctttcacagtgactatcgccgaagggcatgccgttgacgctgaaatgttgccaaaatggtaaagaaaaaagaatattatttattaaattgttgtggcgatcacttataaagaattttgaagaaaaaagtaaacccaaagtcaaattatcccatagaaatttaaaaaattcaaaatctttaaatttgcatatgaataaagaaataaattattaaaaaaaataacgccaattatgaatccgtaaaacttgtagaccttaaactcgtattggtcgaaaaaacatacgggtctctaaaaactgcatttatgtcctcgatatttaattaaaaataattcaaaaggcatatataacttatcttttattggtcctctcctaaattaacttttattatttaaaaattaaatttaaaaatatttatcaataatttgtaattaataataatctccccaccccaccaccgcaacaggtgcggcttcaacacaaccgcccgcccacaaatctattgcattccccagttgcgtgatctcggcttccacatcattgctatccatggtatagacatttacatgcaaattaaccatttaaaaatattttaaataatttttaaataaaattttactattcccgaaaacaaattttgataagatggccacgtggaagtcactgtcatggaagaggaaatggaccattgtccggaggacacattgtggctcgaaataatggatgttcgcaatctgagcacggtgtcacttgaggaacaattgtgagaattagggattttccccgaccatgttcgggaatttgtgaaccttgtctatctattacactccaaatgggatcagaatgtctttaaatgagttaatttttttgacttttttgtgaaaattttctcagcgacaaggggttgctccccaaattgttaaaactttctccaaccattctcgttaaatttgttagtgaatctactccccaatccacgatttttctctctcccgcccggaggctcgaggaggaaccctagtgagaatggattggattatttattcaacgatgaattgaggctagtcgcagccaagactcttgatcttacggaaccgtccaaaaatcacttttaaaattttgagaaccattttacttaaaatttcctctaagtacccatttttatacctccatcattaacacggatagaagcaatttcttctgattttcgagccaaacttatttaacaacactttttttcttgagcatgaaattttctaaatcatcacttctgcatttagccaatcggttcacatactgatcaacacaatgcgcaaggatgccgaggtgcgcatgagcgatttgcgcgtgttcccgcgcaattatctgcgccgctaccgtaccgtgaaggaagtgaaattgatcaaccaaatggatcagctggaaggtgatgataatgatgatgaggatgagaatggagaatcgaaaaatgggctgaaacggtcggcggatgaacgcatggtgcacgtgttgaacatcagttgcggcgatctgactgatcaggccagcgatgtgatcgacacggccattgaggaacgcttca

SEQ ID NO: 9573 - DNA, 2581 bp, Heterodera glycines
tgaattagggcaactaatgatttatggataatcgggctaatctggtatcttcaatcaaagacattgcaagggttcttagtcggtcagcttcatctctcttatatcgatatctaaaaattttaaaaaattagcaactttttgaaaatcactgagccaaggataaattttacgttgatcagaatttgtaaataccatctgagaagtcttgaaattcccattgaatcgcatttaggagaggagaggttagctagaattatttttacgggattacaaattgaccctaaaaattgtggccgagaaaacacaaaaaatccgggattaaaaaattcgacaaatttaaatgagaaaaactctcaaacaaatttccaactgaaaaaattaataaaattaatttaaaacttataattggtttctataagaattttcaaaccaaccccgaaaaatgcaaactttcccaggttgtccaaggcgttttgcacaagaatcggctgccggttgcggtggaaagcacaacagcgagcagtacaacaagacgaactacccggcgagtgcacaacaaccagcgaccggtggtgctgaacccgttgaagacgttccattgccaacgccggctgttgtgccgactgaccgtcgacgacaacacgttcatggacccggaggatgggccaacctcacggctcgccctttcggcacatgccattggcaaccacagcaactttttggtgccattgcaaggcgacaaccggatggagggtgtgccgttggagaacggcgagtacagcttccggctgcaagcccgggaccggatgggccaggtgggcatcggctttttgaataccgtttttatatacgagagttggaaaatgacgagaattttatttgtttttcattgccccgatgtgaaatgttgctttcataaagagttaattaattgcgattttttttttgaatttattagttaaataataattagtaaattttaaattaaatttaacccataaaaagttttgaacttcttttttttgataattcttaatttatacatttcatatatatttaatggcacttttcctatgccgcaccccccccccccaaaatgtcattatcccgacaaacgaaaaaacttttctaaatctttgagttttttattttgacatagattttgattagcacctcaaacagccccggaaattgttttggtttgtcggggtcatgacatttttaggggcgggggcataacggaaaaatacaaatttaataaacagaaataaaaatttaatttttttcaattaaattcattgtcttgcaacaacaccgtattcttggagtcatacaagaaagcacaaattagtacaattctgtacaatttttttactatgtaatagcttaatttgagaaaacaattttgtgtcgctaaattttaattttaaattttattaaaataaatattcaggcaaattcggtgccattccaagtgattgtcaaggagcacagctcacgtgaaaagccaacccacagctattcattgctgatggatgtgccgttagaacgctttttggaccagccgcagtttatgcgcgactttgtgtaccgccttggctcgtctgttcatcgaatttcggatgccgaagcggccgcagaaggtggtgaccgaatggcacgaattgccagcgaaattcaggtgggtttaagaaaataaataaaattactgtaccgattcatactcgattcatactgtaacgatttatttaatgtaagttgcatgaaagatggatatgtgagtttttcccaaactcggttttcaaatttttaactgattttggcccaaagtactggactataggagtctattatagtgattctcaaacgaattttttaatttgattaggttattttagagaagaaattttaaaagattttgagattatagaatttaataaagaaataaaccgctcaaaaaacaacgataaaaaaaatctcggaaaatatttttcactttgaaaactagcccaggggtactgtactttatgagtgtaaaacaagacgaaaaaagtactaaattaatttaggtaggttatttgtgagaaaaattttataagatgcgagaccgagaatttatggtgccgggtcgttgttactcaaaaacatcaaaataaaaaatgttgacagaaaaattgttcttaacttagcccaaaatgaatcaaattttataatcttgatattattcgatagtttaaatgttttctattatcctgcaaaattttaacaaaaaaaaaactcattagcagggattccatttttatgtaaatacatattttttctggattctccatagcctaattagtaggaaaaacactttcttttttgtgtttgcgaacaaaagttgggacttatatttacatatttttacatatttcggcgtttttctacatattacatatgtacacatattttcatacatattttggactttttcgcatttcttcgtacatattttgcaatttttgagaattttttaaggaatttttattaaatgccccccccaaaatccaaaatcccccaatttcttcgtacatatttt

SEQ ID NO: 9574 - DNA, 1831 bp, Heterodera glycines
tttgagttttcgtcgtcattttgagattttcaataaatattttcgtcatttttttgcgaacatttctttttttttaatgagaattttttcgaaattgggcaaacttgtaggtgtttttgatacgacgaacaacaataaaaaatatgcatttttaagttttaaaccccattttttggatgtttattgaactttttaggtttatttaagcaaatattaaatatgcacaccttttttgggatttttggggggttacaacatatattttggcattttttatccatattttggaccatatttggccatttttggcctttttagtccatattttggtccatatttggccatttttggcctttttagtccatatttcgggcttttttagtccatatttaatgtccatatttcgcgttttttagtccatataatttacaaccctagttattattacctgagaaactcaaaatagcaagttttcttgacattttgccataactttctttaaacttaatgaaacttttgaaattttccatgattataaaaaactcacatcgtgctactgataaaatttggttgcttttgatcaaagttacaaaaaaatttttattttgatggttttttgagtaacatcatagcacagaatttattacgataataaaggcagaaaattctcgagtcatgaacagagactctcgagcatatttcttaatcatttcaaattttatgttttggcaaaatgttttaggttgaggaactgttggacaatggtggtcatcaaacaatgctgaaatggtccaatgcgacattgagtcgcaaaatttgtgatgatcgtcagatcaatgccacccgtgatcggatgatgcatgccagcacggagcgggtacggcacgactttctcaaggccatgggcagcaagttccacgtgcgcaaggtcggttttaataaacatgaaacaaaaattcaaatgagtttgactgttgcccacttgcgcgttcataatgacatcattttaaattttatgtgctacttaattaaacaattatgtaattgacacttacttaatgacctctgtttggacactaatcaattttggaagagcaaaatggtggacttgagatcaggattccagagcagaactatttagaccaaatttttaaatgatcaatgttgatcgtcaaatttaaaatcctttatcacaatactgattgatgatgctgggtcgttactaaaaaagtaatgggcgttactcaaaaaacatcaaatggaaaattttggtgaaaataattataactttgttcaaaaataatcaaattttattctttgatatcattcgatagcccaaaatgttatctattagactttaaaatttttctgttgactttcaaagaagttggactcaaaaaccagcattattggccataaccaatttttaaagttaatgtaatttttttgaaatattgtaggctaatagaaaacacttagagcaatcgaatggtatcgaaaattcagacccttggcttcggtggggggggctgaagtgaaaaattcgatttttaggggtgtatttttcttttttcagtcgatttttaggggcgtatttttcgttttttgaaagcccgaattagggggtgtattttacaaaattgttagccgtttttcgccaaaaattactattttttgccattttggtctccatttttcaaaaatatggtaaaatggaggtccggcggtgccaataggcgccgccgggaaaattttgagtattttaatgcaattttgttaagaaaatagcttaagacttcaaaaaaatttactgaaaatttttacttttttg

SEQ ID NO: 9575 - DNA, 1158 bp, Heterodera glycines
atggtcagattttttcgccaaatcctctgttccgctcttttgtgaaacaattcgaaaagtggcagaacatttgtaactccaatttttagctgaataaataaaaaaagttattaaatttaacatttatgtgtgtcgtccaccttcttttggagcggtgaacaaaaggtaaaatcccagccatttttcattgcttttttcatcaatttttatttctgccgacattttccacgaacgtccccttatgaacacttcgatttcactgtttcgcctgctccccacttcctctttcgtaaattcagaaaatttctcaatttctatcgccagggtccctctttttcccctgattctgttccaatcggaaattcgtccatgccatggaaattccaacggtttaaggccgggcacatcacggagattggggctgcaatggaactgataaacggagagaaattcatcggttgtcaaaacgccagaaggaactgcaaaaataatatatgaaactaatcggactcgctcagttgggccccagcggggtttttgctataatttttttctttgccaaacaaatccaacaaacttggtatcattcttttttgaaccttagcgaaatctttcaaaatttttcaggctaatataggacacttagggctatcgaatgataccaagattgttggatttggttggcgaagaaaaaagttatagccaaaaccccgcttggcccaaacgtgccggggcccaactgagataaaccggaaaactaattttattagcttaaaaattcaattgataccgatgcttttggtaaaaaattccgtcgagatgagaggaaagcgaattttgaacagtgccgggccaagcgcagaacgaccattctcagcggaacattcgacggcattttgacggcacttttcgtcggcccaacggagtgcctgaaaaaataattttttaataaaaattagcattttaatagaatataatcgttaattagtacagcattccaaatgatgagttcgtcggcgattttcaattggtcacgcccgaaaatttcgcacaacaaattttgatcaatttgtaaaaattcctctgattcaaataaagtttcggcattttggtcaatgtaatccaagcagcgacgagagaattccttaaaataaaata

SEQ ID NO: 9576 - DNA, 1841 bp, Heterodera glycines
ttttcacccgcgcaaagcactgccattgcgttgtctccgttcaattcgctcaaatcgtccgcgtaaatgaagctgagcatcactttaaacgctgttggttcaacgtcgggcacttccacgggattgtcgacagaggctaaaaacattgaaaaatcaaaaaaattttaaacacaacgcatttttcctttacccttttccggttttccatttttggagtcaaaacggaacattgcctcaaaaacgtcggaagcggacaccaaaatgagtttatgggccgacaaaagcttaaaaaatcaaaaataaaacttagaaatatataaaaattgaaataaaaactcgcctcctttccgtcccccaccaaaaagtacgcatccgcaagtttagccgtgcccaacaaatgcttcatccgatccgccaaaatgcccgattttgacgacgccatgtaaaaattgtaaaagaaaaattaattttttactgaaaaacaagaaaattttaaatgagacaaattgccatttttgattaaagaaaaaggttctgccacgaatcgaataaaatctcaaaaaatttctcgggtcgcgcttacggcgccgctgggccctaccccttgaatttgctagaaataattcattaaatcataaaagttcaatgccatcaatggccggtgaaatataattgaaggttgcgtcttttagaaaattcagtggacaattaatgtaatcgattaattcattgtccagcatcactatgggtcaactccactgtgcagagaaaagcctagtactatctcgtcgttttctttttctttgtaatttctctcactttggcgtactatctctccggttttaatcatgtaaaaaaacaacattcacttcgctctatagaacttttttttcgccttacagattttctttaaattttccaaatcgatagacaaaaaaattttgcatcgaatgttctataaggatttaatgaatttctatcctattttaaagttaagggatgatgaaaattttgcatttcttttcctctaataaaaataaaatgtttgtctttaatttagaaaaataaaataatcagaacaaaaatgtcgcaacttggatgtcggaagtggtgaatttcttttcaaatttccgaaattttttcggtgcaaaaattttttaatgttctcttgaattgtttaatttgcaaaattggtcatttcacttcacttttgctctataattaaaatttttggaattttaatggaatatgataaagtaaattttttggaaagtagttgatttcgactgtaatttttaaattacttttctatatattaattagagaccgataaaaaaatttcaggagcgggatcgggagttaaaattttccgggacaggagtcccgaacgggaatcccgtaaaaatcccgctcccgttaagatcccgtccatttttaacgggagtcccgggattttattttcgactccctttattaattttaaaactttttttgcggcgtatttttgaaaaaaaaacttttttgcaaatttcagccattttttaaaaagaaaattaaggattttaagggtccggcggtgccgataggcgccgccgaaattttttaaaattttggctatatatttaactgattcgcaataaaaaattatgaattttatcaaaaaactcaattcataccagtgcatctttagtcccgttttttgggtaaaattcccggagcgggagtcccgaacgggaatcccgtaaaaaaatggaattccattggaatattttgtgtcaattatgattagggaacggatttctaagtttttgcttattttttctgcggctttaattcgacga

SEQ ID NO: 9577 - DNA, 1691 bp, Heterodera glycines
attttcgacgaaaattttcgaaaaatttttactagggaaatggcctaaatacgtgaatagggaactggccatagggaaacggtcatagggaaacggcccatagggaaatggtcatagggaaatgagtcgatcccttgtcaaacacttgattataaatattttttagagggtcacaaattatctatgcaaaaccaatgataccaagcacaagggcgtagcagccagacccttggcttcggagggggatgaagtcaaaaactcgatttttagaggtgtatttttcttttttcagtcgatttttaggggtgtatttttcgttttttctttaaatccctggggtgtattacaaaaattttagttttcgccaaaaaattactattttttgcaattttggtctccaaatttttacttttttgggtttcggggcgggctttagcccctcagcctcccctccccctgcctacgcccttgaccaagcattagccaaatatcggttaatgccgaattactttttgattagtataccacacctcattttaagtgatgtaccactttttaatctcgcatttgagagctttacattttcttccattatctatttaagcatcgttttcaatattatggcaacttccgaagcacccaattatgcattgtatgaacatgcagtgggttacacactattcaagatcaaggaatatgaagacattggtcaaatacaaccagaggttttcatagatgactaagggttgtacatttgttttaaaatttataggtgcaaagtgcgatgacagatgctcagcgttttcaaacgattgtccaagttcatgcatttgacccattcagaaacactgaggcggcgcttgaaaatgcgaataacattgcggaaggttttgttttttattttcttgtttgattattgtttttagggattatccacgttgatttgctgaactttttggaggctaatctaccgaaaaaaaagaaaaaggttctgcttggagttggtgatcagcgtttgtcagcttctctagtagaggcattaccaggtacattttatttttgcgaccaatgaaagattatagcaatcatcgaagcacgaacccattcgctctttcatggaatcataatttaagcgaaaaccatttaatttttcctcattttttatgtattcgtgttgctttcaatggcgtcgtgcaggaattgcttcggggcattcggatgcattttcgcgtgttggccaaggatttgccacatgcacaactcggaaaggcacaactttcattgggccatagctattcgagatccaaggttaattcaataattggtaacggatggataatatgaagttctacgatttaaggtgaaatttgacgtccatcgtgtcgataacatggtgatacagtcaattgcactgcttgaccagctggacaaagacatcaacttgttcggcatgcgcatcaaggcttgtccattccatcgcgaatttattcccgtattgtttgaatttaggaatggtacgcttaccactttccagagttgattaaaatagtgccggaattatacaaatacgtgtgttgtgcaaccgcaattatgaatcgagaaaaaatggatgaagcggggaaacgaaagtcaaaggtactaccgagaaaatttgacaaagtttaaacacaacatcactctgtacactaatt

SEQ ID NO: 9578 - DNA, 886 bp, Heterodera glycines
  misc_feature (51)..(51): n is a, c, g, or t
cgctccttaccaaattcattatatgtccattaattgatatttctataattnaaggatcgcatggattcgtgtgctccgtctttgtcttcattaattggagaacaggtacaataccaatttccgtgttaagaaacaaatcgctttgttttgggtcggtgctcgactgatctctcacgcgggaagtctcacaaaccttgccaaatatcccgcgtcgacaatccaaattttgggcgcagaaaaagcactcttccgagcactgaagacgaaatgtctgattctcaaatatcatatttttgaaattccgattttcagcaaatacgccgaaatatggtcttttgttccattcgactttcattggacgcgctcaggccaaacacaaaggtcgtatcagtcgtttcttggccaataaatgcagcttggcctctcgcatcgactgtttctctgatgttcctgtgccctctttcggcgaagcattgcgtcagcaggtaagcatatccgaaaataaccaaacatgaggaaggtcaacgagaaacactaagggtcgggtttcgataaacgaatataaaacaaccataggtttatattgaaaccataaaaaaatatatgattaaaaaggggaagcaaattaagattgttcaaagctgcttttttctaacaatgaatgagttatttatttgacctatgtaataaatgtttaaatcttaagatgtcaattcctgtttaggtggaagagcgtttagtttattacgaaaaaggagtcattccgaagaagaatcttgatgtaatgcatggagctgttgaggaggcgacagtcgaagttgaaaaggtgtcttaattaaaaaataggttgaaaatcaagaatttttggttttatagtcattccggc

SEQ ID NO: 9579 - DNA, 2827 bp, Heterodera glycines
gtttttagaaaattattttcaggggtaattcgaggcgccttttatgaatccggccccttctttaggctcaatttcgaaccctgattcgaacacacgagaaaaaattttggaaatttttttcaaaaaatgggggctacaatcggtactattaccaaggaattgatcgaaatgtataataatatgaagaaaaacataagggattcagatatgtataaaaacggaaaaagacattggctgcattcaacaagcaatatttgtaaaaaaatgagaattttaaattttcaaaacttgttcgaatccgggttcgggttcgaaattgagcctgtgataaaggccagattcgtactaattgtaaactttattatcaatagggctgccaaaaatatgcacataaaatcgtaaaatatgcaccaaaaatcgtgaaatatgcatataaaaagtgaaaaatatgcacataaaattttccaaattgagggtgtaatttctcaaaatttcttcaaatttgttaaacataaaaatcttcaaaaatggctaaatgtggtattaaaaatcattttaggagaaaaaaaaacatgataaagcaaaaatttactcattttttgcgaaaaatcaaccaaaaagcgaaattttgctttttttgcttatttttgacataaattaaccatttttttgagaaaatttatttattcaacatttttcgtgaaaattttgctaaaaaaatttttttttttggaaaattttccggtttttgaggtcaaaaaggccaatttgtctgttgggggccgatctattagaggttttttggaaaaacgccaaaatatgcacataaatcgcgaaatatgcacaaatatgcacatggaaagtcatcctagaagcttcaaatcaagctaaaaacatgtttttcgtgcgcttcaggcttcccgcaatccaggaaaaaaatatgcatgtgcatatttttggcagccctaattatcaatatgtatgtgtgtttgtttttgttttttcctactgaccctttgcatttcaatttgttggagcgattgcattgggcgggggttgtaaacgaactgaacgaattggcgggcattggcggcaatgaaaagggtgaggaacagcaaaaaaaaaggtggcggagagaatggaagacgaagcatcggagggagggaaaggacggagaaaccgacctaaaggggaaaatgccaaggaaaaatgccgaaaagtgacgaaaggattttgggaccatcagggaaatttgagcaatttattctggttatgcatgtaaattaagagatttggcgacggaaggtcatttgggggtaaatgcgaagcaaaggaaaaagggcggatgggcgagacggagcaaaaggcggagggaaagggggggagggactggttttggtgttggtatttggtacatccgacggtttggcgccgtcgcaacttatgggatgatgacgaacgctcaatgcaaaacgatgacaataaataagtgaacaacggagcaattgcagaggatgagaaaggcgaaagaaagcgggaaaaagggacaacggaagcggaaacaaacggagaagcggaaaacgaacaacaaccaaaggatggataagccaattgcgttacttctgaacaattaattaaggaaagaaagtcctctcccatttgatactctaagcaatcggaatttcgagaaacaaataaaaatattgcggtgagaggtcgccgaatcctttttcattagttgagggatgttatacttacaattaaggttatagaaaaaatcggcagattgggctttatagaagagtaaattgggacaagtgtcgcctctccatcctttcagctttttgttgtgcaatccttcacttaaattttcgcttgaagagagaggtcattgagtttcgatttggtgaatccagaaaatgtgagaccagaacaatatttattttttgttcaaaaacaatttcctgtaaaacaacttatatgaatgaatatttgcaaaacaacagtaaagtcgcttaaactctcacttccttctatggcgttattcttttcgggtcgcgcggaaaaagactggccaaacgcacgttgggcaacccaaggaaaagcatcgtcacgcgttccaaacctggtttcaaaatatgtagtaaaattacggagaaaagatgcggcgggaagggggggggggtggaatttcgacgaaatttttattatgattttgatttaaaatgttgagaggattaacaaatttgtacactgaatgttggatcgtcaacaccaatgagaaatgactaacagaaaagagggagaaaagggcgttggcttaagaaaatagcttataataaaggagagacgagcagacgatgaatgagagaaaaatagtggtaaaaatggtctactgctgcattggcagagtcagagaggggtcacaaagagttcgcacagcatcgaatatttccttcattttgggcgtcattcttccccactgcacttctttcttcggtgtattacccacagttgaggtacttggagtgtcctgcccataatatctgtggcatggaataattttggaactgcgctgactaacggcggtgcttaaagtgcgctaaaaaatgatcaaatgattatcaattttatttttcttattccaaaatgaattcaaaacgaaaaatttaatcataattcatgtgggaaaaaatgcatttaaaaaaaaaaaaaattcttgatttgcttctgaatttttattttaaaaaaaaattattttttcaaaaattttgccaaataaaaaggggaaaaattccccaaaatttttttaggattttgttttaaa

SEQ ID NO: 9580 - DNA, 912 bp, Heterodera glycines
caattaggcaatacctctcatgaacatgtcgtaactattggaatatttggtgtcatttgggtcgggcattgtatagaaagggcggacagccaatgggtatttgtccagaacatagaaatccttcaaatttttttcatttccctcaacactcattccgtcactcaccgtttgatatttctcacgcaccaatctgcccaaaagcttttcatttggcgtactcaagtcttcttcatctccctgctcaacaccagctttctttaacatggccaccgcttcggggtatctttatgaaagtaatgaaaaatagaatgtgagggaatttgcagaatttaagtcaatttaaatgcactaatttataataatgtaggagccgtagaacatgatgagcacatccactattattattttacccgtagaaagcggcaatagaatagtctttgtcggaaaagtttatgtaaacgaattttcaagggcaaacgagtaggggaacaagcaaatggttctacgaaaaaatgatgccaagaagattagacttaaaagacccattggagaaaaacaaaaccccataaatataaaaacgacggaatgggagaataaatgtgaaagtgtatttaaaataactcactgcaaaacgagtggactttgtgtaaagagaaacggctcggctgggtattgccgacggactgcttcaatttcagcaatgtaattgccttgcaaatatttgaacaggtcaatgaacatctcagcaatagtttgaagaaccttcaaagcacggtaaaagaattagacgatctaattatggtgtaatggcctacttcgtggtaatggaaattgaaagccatctcaagatcaaggccaataaaatggctgggaggacttaaaaccccaatatgaaatgatacattacattag

SEQ ID NO: 9581 - DNA, 1137 bp, Heterodera glycines
ataaaatggcacctcctccacccccgccaaaaagcaaatcgtcaattgaggtaaatttggtataatgctgattttttgcctgaataatgctaatttttttacaggaggatcaaactcagcagcacgagttggcggcatcgcccgaatgggcacaaaatgatgtgccaacaataaaatgaatttttggcattttgtttcctttttgttacttttaggtggagcaccccgtagtgaaagtgttcggcttccaaccgaatcgattgggccgggaatggccaccgaacccacaacagcccgaagacacacagctggggttgggagactttgtgttctttttaatcttcatttatccataaaaattattttaggcaggccaacaaacacaaaacgttgggggacattgactggatgacagtaaaatgaataacaaataaatacaaccaaaaaaatcctattaggcctctattagaggaaaaggcaaaaattaattattaattgaacgcttttgaacagagtcctgctgaagcaacgccagtgcgagaacaaattccactcagaggtaataatataagaatgggattttttaagtcaaaacaattttcaaaaattaaacgcctaaaaacatcttccattaaaaaaaggtaaacttaatgctcaatggcctccgccagaaaaagaataccgcgtcgaagtgttgttgccggagggggtcaaacagtgatccgctgctaaaagtgatcggaaaatagcacagatttataaaaaataaaatatggaataaactcgaaactttgatcagagattttgctggccatttgtattgcatttttcccattttttataagtcattcaatggaaatttcattcactaaaccaatttctaatggcaaaaataacattgaaaaacatgtaaaaagtatgtaaaaaaacggagggacttggaaatgtttacgaatcttccgttggttttaccaccgagagaagcgataattaattagtaaatgaaaagcgtaaaattagtaatggacgcctctgctttattaacttttgggctaactcctccgttctttggatgcaattttgaaaatcgcgcaccaagtttcgccccgtcgtccgtcccatttctctttccgtttt

SEQ ID NO: 9582 - DNA, 2518 bp, Heterodera glycines
ttgtccattttaagattattttcgttcgaattttatcattaaatatccataataatatatctcttctcccaatcaacaaaatgtgccgtccttcgttcccttcaatgtttgcttttctgctgctcgttgctgctgccattgctctgatcattttgccttccgcttcttgtgcccctctcgacaatgcccaaggcgtcgttcccgacgctgcccccggcatcggttccgccagtgccgttggcatcgctccgcgacatcggaggcaatggctgtcggccgcccgcggtgccggcggagactccggcagtttttggagtctgttcggcaaaagatgaaaagccgtgaagtttccgtgccaatcgagacaaaaaactggactttcaatgcccagaaacaacgagattgatacaaaatcattctctttttgtatatttaagccaaaaatagctaaaatctctttgcttttcatttaattggaattttaaatttattacaactttttcaaaatttgtgtcatattggcaaatattcagaataaattttacaaaaagtgtttgcattttccattacttacagaaaatgctctagtaaaaaaggaatataattccttttctgttctttcagccataaaatgaaataatattaaacattttcactttatttttcattaagtttatgaatttgaattgtttttggttgatcaaaaagttctttcttttcatctaaattcattatcacttcattccgcagcattagtgagcaaatgcacagtcataatcacttaaagaatattatcattagatttaatgatgtaatttaatgggatttaaaaattaataaatttcgtaccgaaaatggatgaaatagcgaaggcgaagtcggacattatcacagtttcagcagagtccggattaattatttagttcacatttagctaaataatgaaaattttgcataatttagccagtttaagaaatttttttagtataattgtcactaaatacggtgttcttttttgtgccgtcgtatgaaacggcaacagtttcggcactggtaatgacacgggattcggtttcggcacttcgagtggttgtcgtttcagatgactaataagggaaattaagtttaattatgccggcgtaaacctaaattatataatttaaatttaagttttatgcaattctattttaatttcctgataaattccccaacttctatttaaaaatggattctataaaatagggttcggaccccgcgggcgggggtcagagtcgcaggggcggtggcgggggcatgataattccgccccgcggggacgggggcgggggtttgatttgaattagctccaaaaaatctcataaaaaattaatttttatgaatgatgtgttggctcctgaagcactaaccactaaaccacaaatatattggaaattaacagcaaaattttctttatttcataaaaaatttgtcaaagatggttaaaaattcaaaattgtataaatttttgcctttaattccacgaatatgccattcttaggggtgtattttcacccccgcgcccccgcgggggcgaaggtcgcgggggctggggatggcgggagtcagagtcgcgggggcgggggtgaggccaaaaaacctgtcccgcccccggcgggagcgggggtgacgggtacggggtccgaaccctactttaaaggcaaaaatatcgaaaagtctcatttgttattcctccttaaaagcatggcttacgctttgcttttcattgtgtccgttacaaatgttcccgttgcaaaagtcgcgctctgccgtcccattcatcgcttggcattccattagtccaaattctttaagtggcagttcaacagcccacaacgttttcatggtaacacatcctttggtgtggaaaagcgttgaattgttcgtcccaacgcaacgcactgagaagcattgcgcatcttcacaccttaatttgtctaacttctttgactttccctaattagggctaattatgtaattagttccccgccccccaccctcccacaaaatttcttcacctaatttcggaaaatgcttcgtccttttcctcgccatcattcactgttccattcaaacaccacacaatttctttacaaataaaattacatcatttaaaaataaaaatttaatagcaccgtttggaattttgttgttacaataagagttgtgagtggcattacaaaataaacagtcgcccaagggtttgccaccattggttaagcacttctgttccagcaaaacgcactgcttagtgccgtttaaagtgcaaccctttgacacttttgtccaactttttcccgcaatttctgttcaaattaattaattcattcattttttaatttactaatttatttatttaattaattaaggatgaaaaagcaataaaatataaacaaagaagcaattttgaaatgagaggctgatcatttgatatgataatttatcgcactttaccaaataagcagctcgactctgcacaata

SEQ ID NO: 9583 - DNA, 1472 bp, Heterodera glycines
gggctgctaattttatgtaagaaaatttgcgaattatttaaataaaatatgtataaaaaatactaaaatatgtatgaaatatgtacaaaaacccctgaacatgtactaaaatatgtaaattaaaatttttaaatgataattttttgaataaaaattcttcgtaaaaagtgaaacaggcacaaaatgccataaaaatgaccaaaataggcttagaatcacattttagtactttcaatattaatttttggtatctgttttttgaaaaaaaattcgattttttagggatacattttcaaaaaaaaaaaattaatttttcacaaaaatttctataaattctcaaaatatgaaaaaaatgaaaatgtgtacgaaaaaattgcaaaattttggatttttttggggcatctaaaaaattttccttaaaaaatccccaaaaattgcaaaatatgtacaaaaaaatgcgaaaagtccaaaatatgtataaaaatatgtagaaaaactccgaaatatgtaaataaaagtcccaacttttgttcgcaaacacaaaaaagaaagtgtttttcctaatattcaaagcatggagaatccaggaaaaaaatatgtatttaatataaaattaacagccctaaccattaaataataaaaggccatattggtcaattttccaaaaaatatttattaaatataaaataaaataaaaaataataactgaactaaaaaaatcacaatttgtattagaaacaaaatctctgtaaggacggaggttcgaaatgacaaagaccaaatttaaaaaaacaatttgcagaatttgtaataaaagtggataagaattaatattcaatgtgttaaaaatttaaaaatataataataattaagaataatatacgcattagaaggtgattgatctgcagtgccgagcaggtgaggaaaatgagcaaaattggcgactcagttggttaaattcgcatttttggagatcctgggttaaaatccaacaaaataataaataaattttaattttatttattagtaaaataaaaaagtcatcagaagggcgaaaaccacttactctgacgactgttcagataaatatgtcgtagagtaagtgacaaaatatatgggtgatcacaggaattttttccggtcttataattccacaattttgttaccctcacagcaaagggcgtagcctgaccttggcttcgggggggggggggggctgaagtcaaaaattcgatttttaggagtgtatttttcttttttgactcgattttaaaggtctataacaaaaaatgtttcagatctgttcggccataaacaattttatgcgccatgaacagatcaaacagctttcgcctattctcaatttgttggaagttgcgtgtattctaaccgattttggtatggaattggggaagggtatattaaaaaaactcttttggtgaaatatttctgacacttttcgatttttaaaa

SEQ ID NO: 9584 - DNA, 1493 bp, Heterodera glycines
  misc_feature (9)..(9): n is a, c, g, or t
cccaatttnagaaatttcggttagactaattattttatatgctaaaaattttacattaactattttaagctttcaataaatagttaaaagaagtcttcacattcaatatttttatattaccatgatgcgcattttgaactcataaaacaaccacaaaagataaaatagttatttattttatttttaagtaacaatatgtattaaatttatttaattttcccttttgtaaattgcaaagaaatattgtggtacgtattgtggaacttcatttttcgactcttgcataatagcccctgttatatggttttgcaattttaaaaaaggttttatatcgagaagcttatttaaaaaattttaaactgtagttgaccgatgttgctacgaacacgatgtgtgttacataaataaatggcaaaaacgttacgattgtgatattaacttttgcaattgtctttataaaactactgattgctttctaacaaaagtttgccagtgttttatattttttaatatttattatgtttaggatttgttatgcttgtcagttcatatttttggagaaagttttaaagagcaataaaagtttgcattttactcgattatttatttttactatatttaaattatataaaaattgataatcacgcatatgtacaatattttgtttacattggcggttttataaaacgcgactttccattgtggcggatttataaaacgcgacttgcggttttataaaacgcgactttccattttggcggatttataaaacgcgactggcggttttataaaacgcgactttccattttggcggatttataaaacgcgactaggtggcggtttttataaaacgcgacagcacgccctaatatcaagaattaaaaatttggttgctttggagcaaaattataacaaacattttaatgtgaccgaagtcctcccctaattgtaaggggattttttcgtgttattttttaactttttggcgttctgctgggcgaaaaatatcacttttcaacagttttactccattaactgaacaaattgagcatttttaggtgaacaattaataagcttattatacacgatttgtaaataattgtacaatttaaataattaaattttttgtcaataacattctcttttatcatcataaacatcaattaagtggagaaataattcgtcggaattattcaaattagaatcatatattaaataaaaaaaatttttatatcatcatgcaaataactttattctaggggtattattcattattgtctcaatcaaagaaaattcttcaccagcatcacgtctcgaactgtgcatccgcagtctgcagcaggttcctcccttatcagtcgccggaatgggcaaatttggagttaaaaaaagaaagattatcatttccatcacacaagaaaattattttgtatattctggggagtgtacagggaagcgtgaagagccaaagtgtcacaagtatcaatgttcat

SEQ ID NO: 9585 - DNA, 4353 bp, Heterodera glycines
ataattttcagccaaaaattgagcaaaaataatttttattcactgattgcattttttgaaaatttttttaggtcaattcttatgggtgtattttttgatttattgcaattttattaaggaattttccaaaaaatgtcgaaatagtgaaaaaaatagtgacaaaactccaaaatagtgaattttcactattttagtgacgaagcgccaaaatagggatttctagtgaccgataatgacatcagaatcgaaaatttttaatgcagaaatgcgtttttgagctcctttcttcaaaacaattgcgcaaaaaagctaaaaattgcgaccctaataatcattaatgaggcatttgcaaatttcttttaaaggattatgatggaaattggaaagacaaatgttctcgtagacaatctgatgggagatgtaccaccagtcgctgggctccatgcacttttgtagggagtaattgtaaatttttcaacctgttcgacttttctgatccttaaacttgcaaataacatttgaaaaatggatgaaaaaagagatttgtgggatttagtgttgctgatttatggaaaaaaacattggatctatttgttgttgtatgctattaaaatcatacgatatttttatttatgttgataaaaaattgaatgtaaatgttgacaaaatcattaaaatttttgtttttacgtcatttatctttaaaagtccatcttttaagagatatattttccaaaaaaatgtttttacggacatattcatgccaaatgttgacagttattgatcgctacattgaatattttatgaattagtcataatttaatgaaaatttatgcatttattttctccgcaaatatgtaatgtaatttccgtttttttgattaataaattttcgaaattaagaattgcccatccccccgaatgccgagtctgatttttaattataagtataaattttaaatataattttttccctatataaaaaaaattataaatttagaatattattattggttatttattctgatgaatttaatcattttgttatgttttttttcgctttataccgacggcattctcaactaaattatggacaaataatgaaaatgattcgctaattgactcctctaatcgttctgctgctgatgctaatttggacaatgttttgccaccggaaaaaggaaatcattttgtgccattccaatgaagaaaaagcaaattgatcaatttcttgaagaaatttatgacaaatgtggagaagaaaaggtggaaaattcagaaataattaataaaatattaaaaaatggaaaaaaaatgatgaaaatcattgaattctgaaaataaaagatgaacaaagaattgaaattattaatcaatttgttataatgcaaaatgaattggacgaaaatggaaaacgaaaaaaatatgaaaatgagaatgaaattgcgaaaattcaaattttatttcaacaaaattccattttttttactaattattgagatggagtatggccagccccaatacctttgaagtaagggtaacggcgcccaaaagaaaggcgcgccctgggaaaatgaaaaattttggcccggtttgcaagaaaatgaaattttgtaaaatttacccctcaatttggaaaaaattatatccatatttcgcgatttttggtccctattttatggccatatttcgcaattctatatccatataattccaaaccctaataatgatattaaaaacaaaaattttaaaaggaatgtattggtttgtgttggatctgcatttttggcttaattcattttttccattatttatttgtttctcttttctccgtttttggcatttgctatgttgtaatttccctggcccttctgttcctcactcactcataaaagggaccccttcgtccaatccatcgaaaaatattcttctaaacaattttgtgtaattccatctgtttggcccctcccatttgtcattggtatttaagtctttgcttattctcttatccttaggatttcactcacccattcgttgactcaggttccctgcctaaagcgatacaactcacttaacaatttgctttgtttttcttactatttaaaaagcgatcattctttatttaactttgcatttccacttttgatttccattttaataaattgtcttaaaagaagccttgctgaaaagtaaccgggaaaagttcagagtttgggtacggacacaacacattttggtgccacgacccgggacccctaaaagagtattttaaggggcatctcaggctttgtgccgggagaaaaaaagcaaggaaaatttgagctggtcaaagctgtgtgcttccagccgggctgttgtgccgtttaaaaaaaagtgaaaaaggctggtcaaaagtgtgtactttccagtcgagctgggtgcttaacacgagaaaaaaagaagaagaattgaatttgaaaatggaaagtgaaatcaacatttcacctaacaacgtatcggactttgatcccgttcatttcactcccgaagaaaatacttggtcgaatgcgagcatttgaactggcagtttgtcgccaatttcgaacaatcgagaatgtattttcacaaatctcgagtcaaattcagattcagaacaccgctgactgagtaagagaattggaaggttcgataaaggaactcgagaactttacagaaatggacacatttgagaccaaagaaaagtttattgaagtggaggaagaaattggaaaggtaagtaatcatatggaacgttatgagacgttcacaaaggttcgatttgggaaaattgttggaaaactgaaggaggaggttcggaaaattaccgaaaatttggatgttctaaaaggccgagtacatttgttggaatttgaacaagataatccagaaagacttggtgaatggtatgaggacaatcccaagaacataatcgattgcctgatgacaaaggggcaacggaaggggaagacaatatccaaattggggacgaaagttgcgaaattatggttgcagctccatttttagggggaatcacccccctcgagggttatgatggaaacccaagtgtatcattctcacggtgggttgcacgtttcgaggatatgctaacactatacccacagtattctgaagtgcaaaaattgagcagattgagaattttactcagtggacaagcccgagccgactttgactcaagtgaaccctcacctgtctctctttctgatgttctaaaccatttaaaaagaaaatttgaaaacgaaaatactcggtcaattgccaggcaggcaatggcaagttgcagaaaagcaccgggcgagcgtgtctatgagtttgcaaaccgactaaatgaggtagtcagaactgctctatcaggagaaaatgaggagacaataagaaagagacttcttgaagaatttcttgaaaaattaacccccgaattgcaattcgaggtcatattcaaatgcttatgaaattgctcaagattttgagcttcttcttgccactaagcggactaaccaagtgtctgtggcagattcattcgctgaattgacgcataaagttgaagcattgtccatccgccaacattctgtacctaaaagaggaatagaacggcgcgtctgttactattgtcggcgtccaggccatgttctaaaggattgtagagacaagaaaagggacgaagaaaggagaggacatggtggtcaaagggaccgaccgtttatggggaaagaaaatggaattatgagagaaatgaaagagaacaccggcataggcatttttcaccccacgacaggccaactatggaggaaatgagagggaacaccgacaacggcacttctcacccccacaacaggccgagccatggcagaaataatcatcggtcaccaattgcttatgaaggaatggaatatgaaaatgagcgaactcagtcgccggggaggcgagttcaatttggtggccatagaataggagcagcaaggattgctagcccaatttttctagcattaatggttattctttcattgttaggtgcaaattttgcgacaaattcggtggagagcccaatgatttgccatcccgattctcccgcaactttatggtcaatcccaattgacccggtttgtccaagttggacacaacggaattgcctgtggcaatgaaattgaacgtatatagagtaaatacggttaagtacaaaacaaatgcaactgcatgtaaatgcatcaagacaaaaatatccataaggattggattttttgggggaaaatacgaggaattatcaaccgaaaatgttgaaatgcctacggcaatgtgccgaaaaatgaaggattttga

SEQ ID NO: 9586 - DNA, 1838 bp, Heterodera glycines
caattctcaaaattcatcgacatcccgttgaaataaattgtgttcccctgacagaaagatggctttctgttgatcaactgccaacagcagcgactcacaagcagaccgagcggaagtcagaagagcggaaatttgtcaccattgctcaagcagctacaagtaaatgcgatgagaaatttcgtatcagtggatttgccaattgcttgaaaaccgttttcttattggacacaggagcccacgtgtctttatgtagcaaatcaactgctttacgattgggaataagacaattgaaaagggcagatattgctggagtgattggaataagtgacagaattgtaccaatttttgattattggcagaagcacactccgacaaatgcctttactcttggatcttcagttgggcacattaacacgacaagcggatgggaaaatttatgcgttcgaaattgaaagggaaacgcaataaatggcaataaagagttaaaacgaaaggggacaagatggtcaaaaagtaaaaacgggaattgaagaatgtctcgaaaaacacaaaaatgtattttcgacccacgattatgaccttggggattgtaaagtaaaagcacctcctatcttgaccatctctgatgtacctgctaaaacgaaaccgtacccagcgccagagaaatatgaacgaaaattaaaatcacagatcggaaaaatgctggaagcgggcgttataactgaaagctttacaccttgtgctcataatgttgttttggttaaaaaatcaaatggccaattacgtccttgcgttgattttcagccattaaacaaaatcacgattcccgacccatatccaataccgagaatggataagacaattttacgggtcgctggtcaaccattttattcaaccttggatttggcttccggattttggcagattccattggattccgaaagttcttataaatgtggcattgttaccccttggagactttatcaaatggtaaaattgccattcggactgagaaatgcgccaagcatttttcagaggaccatggacaaagctttggaaggtattcggaatgtaaccgtatacattgatgacattatggtccatacaaatacggaagaggagcatttggagactttggaaaaagtattttgccgattgaatgaattcggattaaaattaaaaagagagaaatgcgaacttttgaaaaatgaatgcacatatttgggacatattttaaatgggaagggctatcggccctcattgaataatcaggaagtgattgaaggattcccagagccgaaaaatgcaagggaagtaaaaagatttttggcgctatttaagaaaaagccactgaatgaaatgatagtccccgaaatattatcctacttttgtacagactgcaatcgagcacgacacgagctcgctcctcgaggccgcgtcgtcaggaccgccaaatgatccaccgttggatgtgagtgagattagattatcatgagagaccgatggtgcacgaaggcgcggttatcggaccccggttatcgacgtgctcgcccggggaaatgcggtctgaaggcgctgcgaatggtttcgcttccgatgagagttcactcgagacaacctttagaccgcagggtcaattgactggttcgaaggaaacattggctcctcgcaacgctatgacaaagaacacttcgccaacgattcaaataccgaaaaactgttaaggtacaacaaatgccccccaattagtttattttgatttgtattttttcatgatcttcagaaaatacgtcggtgtgcccaccgacggacgcctcctttccctacgatttgcgcgg

SEQ ID NO: 9587 - DNA, 1983 bp, Heterodera glycines
tttatggcgccgccgccatttgcattaatgatgagattgatgatttattacggcactttttattgacctaattgacagacgactgccagcagcacaacacaaaagcatcacatggagcattgatcaaacgatttttttgttttttgttttgaacataattcattgagcgaaaacgatgcccccttttttgttaatcgaatttttaattttgtgattctgcactttcatatctttcattatccaattaattatcgtgtaaattaatgggaatttaaagttttaattattattaaaatttatttattattttggcaaatgattagattatacaagatcattaattagaatggaattgaaagtttcataatttgaagcaagaaaattgctaaattttattcaatgtaggcaaggtaacatatgtatgtatctaaggctaaaatttagtagtttttttttcatttttcttagaattttttacaaaatattttaaaatattgacaatcgtgttcatggcgcgccgcatttgcattaatgagattgatgatttattacggcactttttattgacctaattgacagacgactgccagcagcacaacacaaaagcatcaaaaagcattgatcaaatgattttgttttatgaacataattaatgaggggaaaacgatgccctttttgttaatcgaatttttcctttgaacttttagacactttcaatctttggtgtatccaataattatcgtgtaaattgcattttttttttattttactaaaagattatatggcaaataaatttgcatgaaatttaatttaattttttaaataaaaaattttaatttattattttcctaaatgattaaatcgttcattattgaaaggaatttaatttaatttttaatttgcggtaaaaaattacatacacataatttgaagaatgaaaaatttaagttttattcaaattttttcacaattaaggccacatttaagacgaagattagcagttttttttctgacaatttttgataaaaaaaataaaggatgggcaaaattatgtttatgggcgccgccgccatttgcattaatgatgagattgatgatttattacggcactttttattgacctaattgacagactcatggagcacactactcattcattgaccaaatgaaattttttgttttgttttgtgaacataattaatgggagggatgaaaacgatgcccatttttgttaatcgaatttttccattgaactgttagcaattttaattgtctgtgtgtaacaattaattgtcgtgtaaattggcggtataacaaatttttttttttaccaatattaatcattttaattttttttttttttgccgtttccatttaaagcaatggtaattagtgtttttttcatggaattttttattgaagaaaaaataagttcgcattattcaactaaacattttttgccaaaacaaaaaatatataacaatatacaatataaatgaatacattttcattaatttttaaataaaataaacaaaaattttctttcatttccatcttatgcattattaggcatatttccgaacaaaattgggttaccattctgttgaaatccggccaacagttgactatacagagcgcttaacttttgttgttgaggaatgcttaaataaataatattatatctgggaaaatttaaaaatctctttgaagagatagaaaataaatttgaatggggaaagttttcaaaaaaatgaaaaaattcaatattttaaaaaatggttaaaacttttttaaaaataataaattattaaattccgagaacgaaaaaattttattttttaaaaatataaaaaaacaattattaatttcccaaaagcaaaaaaaaaaaaaaaaatattttccaaaattatataaatttaaaaatggtaaaaaataaaaaaaattataaaaaatgaacccccaaaaaaaaattttaattaaaaa

SEQ ID NO: 9588 - DNA, 2362 bp, Heterodera glycines
  misc_feature (853)..(853): n is a, c, g, or t
  misc_feature (2201)..(2201): n is a, c, g, or t
  misc_feature (2240)..(2240): n is a, c, g, or t
cgatggtgttgtcatcaatgattgcgcgcagtttgcagaagttgcagtaacgaccgaaattgttgcatgctgttgttgttgttgttgctgttgctgtactgcaagcagctgattcagaaactgggttgtaactgcactcgatgaacttgaagcagtagtcgggctaattggcggcgatgcctgcaattaaaaaaatgcttaattaattattattaaataattatataattatgttaaaaaatttattaaattatgaataaaaattaagaaaatttgattaaataaatttttaaatttcgaaatattaaaaaattgctcaaaaaatcattttatatttattagaattgcgattaaaaaaatttataacaaattttattcatttaataattttattaattatacatgtgtttgaagttatattgtgggtttttattttgattttttaatatattaaataattctattttaatgaaaaaattaaaactaaaataatttttattaaaaaaacaaatttttacattatttattggcatcttatttgcttccactacaacaacatctgtatcattttgagcagtttcatcaattttttcagcaattttattttctttcacaacattttgcgcctaaaaattaaaaaaaaaattgcttttcaaaaattttaattttaattttttaaatttttaccgaattttttggcatttccaagctcactggccttgcttccggtgatgagtttgaatttgaaacatccaaatttgcgacgccttttggctcaatgccaagcatttcagccatccatttattttgtgcgattgcctaaaaaatttttaaatttattttaaaaaaattntaaaaattttttaggacctgtccaattgtgaacaatgcaggcagtaacagaagcattcgggccaaacacacggatgcttcagtggtggaatttccagcgaccaaaatggcacgcaaaaggccgtcacggttttggagaatcctaaatttgttcaaaaaaccatttttttgttaaaataaatagtttttcatttaaataaattaaataagtaccatcgaagggaggagataagaaaaattttaaaatttaacccaattttttaacaaaaaaaatcaataaaaatgcctaaaaaatttccccggtggcggcgccaataaattaaataaataccattaaaagaaggaataaaaaaaaatttaaaaattttctgcaaaaaaaattattaaaaatgccctcaaaaaaaaattttccaagcggcacctatcagcacaactggcctctaaaaaaatactaatttctattttcaaaaaattggctcgaagtcgcaaaatttagaaaaagtcgtttaaaaaagctcgtcaatttaaaaaacaaattttcgattttgtaaaaataagagggaaatttatttagaaatgaaaattgtttaaaatttcattgttttctaagtcttaccaattttttgcttgctcactcatttcagcaacgtccggttgcagcaataaaatcgctttaagacaagcaaaatcaatgttttgtgcattcattcgtcgaagcggattaatcaattcatccttaaggccaaaattttttattttcttgatattatttgatagcactaagtgttttctactagcctgaaaaattttgtaaaatttagttaaagcttcaaaaaagttatggccaaaattttttttgcaaacctggttgcttgtgtactttttgcaataactttgttcaaacttgacgaaattttttgaaatttttatgataattgagaactgttagtgctatcgaatgatatcaagaataaaatttaagttgggtttaggttataggtagttgttttttgtttttttgaaaatttcatttgaggttttttataacgccctattttatggcttttttataacgacatagcaacgataaacggaccctaattttggcaattagcatgataaacggacactaattatggcaattagcataaaaaaacgtaccctaattttggcaattagtatgataaaagcattatggcaattagcataataaatgtaccctaattttggcaattagcatgataaacggacactaattatggcaattagcataataaaagtaccctaattttggcaattagcacatgaacaccatcatcatcatcagttgttgtagaagcaccaccgtntttgcggaagtgtgaaaaacgtgtcatttgggagcacanaaatggctggttgtgatggtggccctgcaaattgctcgcttttcatgcccatcacatttacagagcgttgcacggaaatggagaagggcaaatggggcggcacaatggtgcaaacaaatgag

SEQ ID NO: 9589 - DNA, 1596 bp, Heterodera glycines
ggcggcacaatggttgcaacaaaatgagctaaattaatttaaaaaataatttttgaattaattgaaaataaaaacgaaaataaaattaatgtgttaagaataattaaaaagttgttttaactgattttaaatataaatataataatgaataagaaaaaatattttcttaataagaattttttcagaaaaagataaaaaattttcgttttcataagaactaggaaatataaatataattttttttttaatttaatatttattaaaatagttttcaattatttaaaattaaagaaaaaatttaaaaaaatataagtttaaatgttatctacaaaatatttatatattaattatttttatataattaataaattgggcaaataattaaaatcacttttaaagggacacaattaattattttaataaattctctttttatataaaataatattttttatgattttattaattttactttatcattgaatttcaactcagaaaatccgtgcaatgagtttgaccatttgttcaaatattggaaagttcgatctcgaattgctgttgacgagtgcaaaacgggcgcaaattggacacccgactcaatttccaactaagttttttaattaaattaattaattaaaatttatacatttaattaattaatttttttttaccaattgttccaaaattaatttgctatttgttcccatctgtccgacaaatgaataatgtttttgatgttgaacaacattcaatggcgatttgctattatgattattttcactatttgagtcctataaaaaataaaattaattaggtaaataacaaaatgaattttctttattttttttattaattaccccaattaattcgtcggttattccgtctgaaattgttgttggagatgtttgcgcatcatcaagaacctgtttcattatacgacgagttgaccctatgcgatcacctttaaaaaattaaataattatttataggtaattaaaaaataattttacaaaatatatttaattaaagattgatacactaattaattaatgcgataattattaaaagaaataatcctatgtaactaatgttaattaatatattgagaagaaattttatatattatttgccataaagtaacaatataaaagaaatcaatttatatatatataatattttgaattgattgacgaattattattatttttttatttaaattagctaaaatattaaattaataaaaaaggaaaagctttttttcctacgctcattttgaattgcatctggtcgcattccgttcgcaacacattttcgaaaacggcatgaacggcacgcgtttcgccgttctttgtccacacggcacacatttgtaaaacggctaaaaatgtattaattattaatttaaaattatttattttaaaatataattagtaaagaagtattttaaaattatttaaatgcattttaagttttattgctttttaccatgtgtattgcaagttttgccacacagaacggcggaaaaagcctttgcacccattgcatgaaacaccgcgttgggaatttacaaaaattaaattcttactgtattaagta

SEQ ID NO: 9590 - DNA, 997 bp, Heterodera glycines
attaaaaaaaagatgttgttacgataagcctctttgttgctcgacttagatgaaaaatgtcagaaaatttatttccgattttcaaaaaaagtaattgcattttttccaaaaatttttcatgccgtgcagagagagcaaccaagagagctgctaaaaatgccaatattttttatgaaacaacgacaatgaaaactttttttttacaaaactaattaaattgtgctttttaatttgattgagtttcagcaaagtaatgaaggaaatttcgtgggaaattccattacattagcacctataaaacgctaaaaatggcactttttacaaaagcacgacctcagcatgttaattaaaaaaaaaactcagattctttaaatttcttgcgtttaaacaaaggtaatgaaagcatttttcgtgggaaatttttttagaattggcacacaaaacctcataatggcactttttgcaaaacgacgcaagcatttttaattataaactaattaaattgtatatttaattacggtcaagcattaatggttggatcatcagcggttgcgaaattgatgctccgttgaacaaaagtgaatttgacgaaggcataaacatttttacaaaaataaaaaataatttgcttaaatgaaaaattaaataatttttaggtaaattaaaattacatttcaaaaaattaaaaatgaataaattattatatataatttaaataatgcgaaaaagaattgtaacccaacaaaaattttttttaataatttcttaggcgaaacaacaatttttaactaaatttttacgagagggaatagtgaaaatttaataaaatttaaaagtttattaattataataattaatttgctttatattgtaataaatttaacttttcgaattattttttataagcgataaatattaaaattataaaataattaaataaatattatttgcattaaaattaataatgaatgaataaaatctaatagtgaaataattc

SEQ ID NO: 9591 - DNA, 4631 bp, Heterodera glycines
ttttcattttgggctcctttctgtgcggtttttgtgactaaaaatcgaatccctaccaatgagaaggcttaatgttaatcattagcacagtatataattaattataacttatgattatcagacagtaataattcctccatttttcttcctttttgtgaattggcccattttattgctcttcgtttccctctttttgttcttgctcatccgccaaaaattcgtgccacattttgcagtgctttcggcacaaaaaatcggcgtccattttggccaactcgacatttgcaacattgcgctggagctgctgattttgatgggaaaattcgaactgaaaaattcataaattttacaataaacggctttaaaaatcggtgtcgttaatgcttaaataatttaagttatataattatgaatttcattaactcgatcatttgattatttagttgttttttatattttaaagaatgagagatttgcattttaattaaacgtcatttaatgagactaatgagcatcgatcctattctaattataattaattaatgaccgcatattccatttgcaacttttctcgctcattgctcacgtctgaaatttcgcgcagccaaatatcaacctgcagctccattgcatggatttcgcgctgaagccgtttaagcatgacggggtcggcttaattatgcaattaagttaatcaccgactccgacattcccattctcgaatttgcaggacttccacaatccgtgatttcccgacccagaaaaaatttttatgactttaaagtccaaacattcaatttttttctctaattttacccgacttcgaagcgagcatttcaacaacggatttgtgccgggcatttaaaatttgagcagtttcattcaaaatgttcagctgcgagttgttctttaaataattaattcatttttaaaaggcatttatttcccaattccacttgttccatgccgagtttccatgatgccaatgtttggcacaacaattcgtgccgtgatttcaatttgttcagaccattcagttcaatgcaaatgtcatcaattggctaaataaaacttttataatatatctgtattttaaattaataaagttttgataaatttaaaataaaatattttcaaataaatgaatgtttatttaaaaattacctttgtaacaattttgcactcaaaatcgttgaaagacatggagaaattggacaaaaatcaaaaatattcaaataataaaaaatagataaattaatttaaatcttaagtaaaaatatgatttatttttacactaatttttaatacaataaagaaataaaatgaaaatcatttattttaaagaatttttcggggtcaaaatatgtaaaaaattgaaaataaaatgccattgtctcccattggcacatttgcaatgcggcgatgaggatggcacgttctcctaactttggcactcgcttaatggaagttttagggtattttttgcggctttttttagcttatggtcacacaaaaatggggaagataccaattctttgctcttggcgccggcggaattcactgcaaattctcccaggggattttaggggatgggaaaggccgaagaatgagggccaaaaaaggaacaaattaattggcaaaagtaaaaaaggcattaaatttgcaggaagatgtttgtatttgaaatatgaaattaataaatttaaattttgtaaatttttaaataaataaatgttaaaatattaattaaaaaggagttttttatttattttttatttttattaaaactttctaaaaaaaattcaacaaattttatttatgtgtaagacttaaaataaactttaatttacgaaaacggtttaaaaattgaagggtttttttttgaaaaaaacctttaaataatttaaaggtaaaattatgggaaaacccatcaaataatgaatttgacgaaaaagagaatttagcttatactttttattgttcagatttttcggggttttaaaaaaataaagaaataaaaatttattaataatttttcatcaatggaaattatgatttttagaaagtttttgcacaaatttgaaatttaaaaatggaaaataaaaaaatggatccaaattattgaattaaacgtcacaaatgggagcagaaaacccaaatttttgcactgctttttgtgcgtctgacgtctaacaaaacggataaataatttgtgctgtgatctttggcctttgcgcgagaagacaccgccagtcgcccgagggcataaatttcattgcggggctgagcaaatgtgcctttgaggcgaggggggggggggattttgaaaaaaatatccctaagattagcagaattttaatattatggaatttcataatttattttttcatttaataatctgagaaatttataaaagaaataatttacaaaaaaaactaattgtcctgtgaattttagttttgataaaaataatttttgaaaatgttaatgaaaattacatatagctaaattattcgtaaagtaatgaggccaagcatttttaagcggtatgaaaacgtaataaattactcatcgccacccgccggcggtcgaaggcaaaaatggaaaaatggacaagccgagaatgggctatttttgggcattaaatgagcagttcccatggcacgaagaagcagcttttgaaacgcaagaaaaaggacattaagtgcaaggataaattcagcaactaatttcattatattaaaaaatctaattttaattttggaacacttttgcgaaattaaatttgaattttttaaattttggtgtaaaaataagcatttgacaacatttgatagaatttatgaatttttcgtttccttacaaaaattttaaaacaccgaaatttggaattgctaaaaaaataaaaatcactaaaatattttaatatttttatggtttggctgtatttaaattagtaaaaatgactctctctctctgttttttttttcaccaccgactaatgagcctttttggtcagcaaaagcagcagtattccttttttttgccaaaataatgtccagcagcccatcagcagacggacactttcgtcgccgtcctcctcatatttataataaaaagggtcgaatgcttagggagggggtatattttgccaaaaataaatgtgtacaaatgggccaagtggggaacggctggcaaaatagtggccagcagacgatggccggccggcgccacccgttttagtgccaaaaacaacaaatggtggccggccattagtccggcttggtgcctcgttttacaatacgacattataaaaattgtcaattaattaatattttttaataaacagggtccatgtttttatgcacaaaaaatctttgaaaatacattttaaacccataaattggcaaaaacccacaacagaggcagtgcatgtgcctcatgacgccggcaaaaatatttgtgtgcaaatccgagttttttcgtggccatttttggccctaattgagatattttttacagaattaaataattctgaattcatatttatactaaggtaaaaatgtgtaaaaaataaataatgataataataatagaactataatttgtgaaaatgttcaaatgaaaaaattaacagacggacgacacctttccgtgccagccgcaaaatttaaacgtacaaattgggtgggaatgtttttttgtttgtgccagaaagcccacaaattaatattgtcaaaatgggcgagtgaatgaatggtcattagccattagccagggcaaacaaacggacacttttcggagtcaaccgaaaagtgaagtgtttgtggccatgacaacagcaaaaatgagcagtagccaggcacaaaacagcagcggcggcagcagcggtcagcttgtgtcattagcaaatgagtcagcttttgtctgcaaaattaacattttccatctgtttaaagcactaaacaccgccagcaatgggatgccgaattacaattattaattaatatataaatgaaaaaacgaaagataacaaaattaatttggctaaaaaaaaaaaattaaattcatgctgttgtgagagaaacaaattttggaattgattcctatgatggatttaattagaattttattgaatgaatcaatttaatcagactcagaatttctttaataatataaaataatttaaaaaacttatattgtcagatgcattcaaattaaatgatttggttggcagattaaaaagtgtgtccagaattcaatctttgtctgcaaaatcaaggctggaatctgaacaaaatctgaacaattccgagaggcccccagggccatgaaatgtatttaactttattaacaacaacaataatttttcaacaataaaaaatttccatttataaaggctttgacaacattgttttccgttttcgaagatcggatgaaccacattttcggcaatttgacgcacgcgggggaagtcgagcataacaatttctggcaaattaataaatttaaatgaaatctcaattatcctgtggcagaggagaggaggggataatgggtgcaaaattaaattgtcaaattgttgtcatttgaaatttgaaaacccgaaagtatttataaaaaatttgtga

SEQ ID NO: 9592 - DNA, 3475 bp, Heterodera glycines
  misc_feature (10)..(10): n is a, c, g, or t
atattgtcanaatgggcgagtgaatgaatggtcattagccattagccagggcaaacaaacggacacttttcggagtcaaccgaaaagtgaagtgtttgtggccatgacaacagcaaaaatgagcagtagccaggcacaaaacagcagcggtcagcttgtgtcattagcaaatgagtcagcttttgtctgcaaaattaacattttccatctgtttaaagcactaaacaccgccagcaatgggatgccgaattacaattagtaattaatatacaaatgaaaaaacgaaagataacaaaattaatttggctaaaaaaaaaaatttaaattcatgctgttgtgagagaaacaaattttggaattgattcctatgatggatttaattagaattttattgaatgaatcaatttaatcatactcagaatttctttaataatataaaataattaaaaaaaaatatattgtcagatgcattcaaattaaatgatttggttggcagattaaaaagtgtgtccagaattcaatctttgtctgcaaaatctaggctggaatctgaacaattccgagaggcccccagggccatgaaatggatttaactttattaacaacaacaataatttttcaacaataaaaaatttccatttataaaggctttgacaacattgttttccgttttcgaagatcggatgaaccacattttcggcaatttgacgcacgcaggggaagtcgagcataacaatttctggcaaattaataaatttaaatgaaatctcaattatcctgtggcagaggagaggaggggataatgggtgcaaaattaaattgtcaaattgttgtcatttgaaatttgaaaacccgaaatatttataaaaaatttgtgagtttttttttctaaactaattatttaggccaatacaattaaaaataattaaatttaaataatatatactacaattgatgctttttctggttcagtctagcacaatatttacaatacagctgttttcacattgtgtttgagcttaattagctaatagagcatgttaagaaattttgaataatttacaagtttgagtgggtttgacaattaaaaatagttaaatgatgctctaaatggctgggacggaattggccaaagttccgtcggcactgaattgtctggccaagcgccacaagccattttgaatattaaaatacccattttgtgtacctgcaaatcagcttatcccatcgaaaacttttggccaattgcaccaattttgggtcgcatcgatcgtacgaaccgccgccatcgtagaagcttcaaatcaagcggaaaatgcgtttttcttgtgcctatttgggcgtatcaagtgcgcagaaattttaggcatttgccgaaaaaacgaagtccgactaataaacacttttcgtaaataatgccaaggatagaaaatggaccagacaaagaaaagattaaaattttcagcttatttattttttgaaaattaaaatttaaaaaataatcagaaaaagctgctgcccgtggtggccgaatttacgaaatgacaataaaacaaagacaataaatcaaactaatgtcactcatcagcagtaaaaatggtgaaaaattcataaatttcttttttgcaaaaatttattttgtttttcatccgttttcaatcttccattagtccgtttacaaattgtttcttccaattgccaatggtatttatatgaattttcaacatttttccaatttctttgtcactcattttcggcttttctttttttatgtgccaataaattttcattttctccattttttctttctccgttatttttcggctaattccaaattgtttcatccattttttaattatgaaaaggctaaccccgattttcttacaaatttcttcataatttttgttccattcttttcttgaatattttcttttttgcttaaattcattttgcatttcaatgaatttattgataatttcaatcttttcttcttcagtttttgatttgtagcaattcttttgatttaatcccaattctttgatccattcataaatatattggcgatttgtgcccaatttttttgctatttttctttcaatttgactccattcttttgctgaatattttcttcctttttgcttaattttctcttttatttgataaaattttccaattatttctctttttttctgttcttcgtttcttttttcttcccatttttctccaaatatttcgtcaaatgttttttgttccatttttttcttttctgatccaacattattattactaattaagatggtaatcaaaaatgcaaataatgaagaaattaataagcatcctttcatttttatgcaatgacagtctaaatggttttaaaatattttcaaaatttatacaattaaatgaattctttttgaattataataattttatcaaaaaaaaattactcagtttggcagaatttgtttaatatcgaatatatattattgaaataatattaatctataaatttgatgacgttaattagaaaattttcgcctgtttattcattatttcaaaaccaggacactttatgcaaaattcaaaacatttttgatttttagattaattgcttaataaattaaacaaaataatttaaatgtttagatttaaaacatttcatttcttttaatttaatgtaattatttttttataaatatgcaaatgttcaaaaaaccaaaaataaaattcaatttacgacattttatgttcttgttagcttcaaatagttactaacaaataagtgtgggttctctaaaagaagaataattttaaaaattatgaacaaaaatttcaaaaatagtttttccttgcgtttttatattgaaagccttttttaaagcataaaattttaattattaatagggcttccttttttaggcaaatgcctaaaatttttgcgcacttgatacgcatagatgagcacgaaaaacgcgttttccgcttggtttgaggtgtctcgatgacttttataatgcctatttttgcctatttcgggggttttgtgcctaaagtgcctatttaaggattttcgaaaaaatccttaacaaaaatgcaataaaaacgaaaaacacaccccctaagaaatgacccaaaaaaatttcagaaaatacacccttaagaattgaaaaaatttttcaaaaaattgttcacaaaattaaatattttttcttaataaaaattttttggtttaaaaatttgttcatattcgaaaaaaactttaaaatattttataatttcatttacaattgaaatatttaagttttaacgtgttttgttacctaaaaacgttaataaaaaattttatttgcctattttagtgcctatttgaggatttttgtgcctatttaatgcctattttacgatttatttatgcctttttaggtgcctatttcgcaattttttgtgcctaaaaaaggaagccctaattattaat

SEQ ID NO: 9593 - DNA, 1151 bp, Heterodera glycines
aagttgttcagcctcgcagggccggtggaacggccaatgagcaaatttacgactatgatgaaatttctgctacatttaaagtccgctacatgacatcaatggaggcatatttgcgcttgcattcctacaaaatagtgtcgctctctcaccaaatttaccagctttcgatccatgatgagcttggtcaaaccattgtcgttgaagaaggtcacgaagagcaggggcgcaaaaaccttgaggcacatacgcgcttaactgccttcttcgctttgtgtacaactgatccgaatgcatctgagctaacatatagtcgcgttccatatttttatttgtaattttctgttttcttatcaaaattaatttgatttttttagctggaacaaaaaaaaacgttattggcaaaaacggacgcgtccattgtatgagggggaacgagctcgtatgtttgtgcgtgtctacaccgtttctcccaaacggcatgaattgtttgcaataaggtttcaaatccacaaaaactctttgaagattttattgaccacatgcgtccccaccggtcgggagttgatgaagatgaccaagcaagttcccttgaaactcgcaggggcgaagttatgcgcaaccttgagtattattttaattgcatggacacttcatgcaggtggttcttcatagtgcggctttttaaatatattttttcagtcaaatgggcttgcctgggttaccttcagactactcttacactcaacaagcatcttttttgaacgatgcacgcttgcttatggatttttttggtgctgaacaatcaaagcaatggacgcctattcaattagttttgcaacaaatacgcaaacttaattctgaccaacgtgcagcatttgaccgaattattactgcattaaatggcaggggcgaacatcgttgcttttttattgagggagccggaggatgcggtaatttaactctttgttttgtttattttctcattttaggaaaaacttttttatacaatttgtaatccgatggtgcctagcaggaaaacactactggataatataaatgaagaaatatgtcagcagagcaaaatggtggacaatcaaatattttaaagttacgctaaaatttagctacgctgtgggtctgtcatctctgca

SEQ ID NO: 9594 - DNA, 1797 bp, Heterodera glycines
aacatatatcttaaagttttcagtcacaaggccaaacgctgcagaaaatgggtcttgtgctcagtgggaaacaatgcttttctcacggccaagtgtatgtggcgatgtcaagagtgacaagtatggaaggagtccgtatttgctctccacagacatgcaggggcgaaaacaattatatccataacgttgtgttccatgaattactcgatcaaagtttcaatgcgcctagccaacaattttttcatttagacacacatacagcgaccttacaagaaaaattatgtagtgatgaagaatctgatttgccatgttgaataaatattttaaataaacttttggctaacaaaattatttaacatactttaatcatgcatattttttttatttttctcttattttttatttttgttggaaaaagatatggatagcaacgagtttggatgttctttgccaccaccaagtatgttcaaggatatgttcagctcaaaaatttatacttaattcatttaaggtcttagcaagggcgttggagagcctgcaaacccacatgaaaatatcgatgtctctaaaaatgaaaacagagaaaatggcatgaatgctgttaatccatctaaaaattcgattgagagtgttcttgtatatgtgtcggatgaagaatcagaaataagttagcgtatgaatgcgtttaaaattttccgaaaatttttagttcgtgaaaatgagcacacaaatttgcgtaaaatttttttggaaaaacgcaaaaaattttcatgaagaaagagaagctgatcgtcaaaatttattgctcgaattgggaaaagtgacttttgatgctatacagaacatggactatgcaggggcgaaaagtcaactaaaaattgaagcaatacaaggccgactcattccgttgcgcgaaaactatgagaacgagaagaaaaaattggatttctattacacattacaaacaccgtaagatggactcttttcctattgtttataaactttaaaaaaacattttttaggactaaacaccatctgaaagcagcagctattcaaagcggtaataatcattgaagtagtattaattctttattttgtcagccgctgtaacgaccgcaggggcgaacctcagccttgaacagaaaaaagtggaaattgaagtcaatgctgaactgcaaaggaactctaacgaaaccacacgtttctgggctatccaacgaatgcctattcaacaattatgcaaggatttttttgaccgttggacagtgcgtggaaatgctgagcttatgcccttagcaaagcaaatgaacagatccaagcacaaaaacatagttgtttattttacgatttttttcatctcataattgttcaggaggaaattttgcctgaaactcaagcaggggcgtcctctgagaagagagtgcgctcggagtctccgaattctgctaaatcagtttcttcagacaaggaagttggcaaagacaatgacacaccgctgaccgaaatttagttattttggcattattccttttcattatggtttgtgttttttaaagtattagtttatttcctaatttctctttactttaaaaatatatattcattatttataattgttaattgataaaaataaatggcattacagtagtttttgcagcagattagcttactatacacgaaaattataataaaacattgaacatttttcaaattttattatcccttttataacactcgcagaaatattcaatttataaatatttggttttttttggaataaaaaccctctatacctca

SEQ ID NO: 9595 - DNA, 2344 bp, Heterodera glycines
tgcgccaattggacagcgattgcgttttgcacgaccactttttcttcaactgcttagagcactttggcaaactcaacatctttgcaattgttggtggtgcaaatttaatcgacaaagactggcaggggcgttcacaaattgtggaccagtctgcatgtaagttcatcatttgattgcaattaaaactaaattgttaatttttgaattttccatatgctgtcttttatttaaaccctgttttagtgttcaaatgtgccaaaaaaacacagttggaacaccacaccgaccgagttcctgactttactacgctcccagaacatgagcaagggcgtatgcttagccgtgcacaagcgataagcgttattatcaatcttcttaaaggcgcccataccggcttttccatcgacaaatacatacaaagttttttaaatattaattaaataaaattaaataatactatttagccatggacgattatggcttatgggatgtgcagcttcaagcaggggcggaggaggatgctgaggcttttccttttattctttcatatataatttttatttttagtttgaacacgattatccgattccgcctgctcttatgttgcgaattgagcaggagctgcacaaccctggacccgcaaggggttgttaccattgcagttcctttgggcatcgtgctcgagagtgtcccagaagtggatcttggagacaagaccggcaagggcgattggtgcgttttggtggccgtccaaaatgctttgtctgtggaaacaattcgccgaatcatcaaagtcaagattgtcccttcaggcacccccactcatatgatggtaaacttacaggttttaaggttttttaaaaataacaagaatttgtttgagccatcagttcatgtaataattgttgggccagtttgcatggccagcagcaatttcgaagttcatgtcctcgctgcaaacagtcgctgcgctgctggaattgcggacatccaagtcaccgacttaaccaatgtaccgaaccgcgttaccaaccgcccaccaacaatacaactcgtccgcgcgaagagcgcggacgagattgaaggcaggggcgcgaagaaaaagcgactgcgttgacatttaatgtttttgattgttgaaatatgtttgatactttttccataactttttattaacttttacatacaaaagttaacttttatttattgctttgttaaaaattaaacattatgcatttacgattgctatagttacagtatgattattttatttagacaaaatctacataaagaaaagaagctgtaaaaaataaaggaagcaaaattttttatttaaagttcaaaattaaagatatttaatatttttcaaattatttggcgcggagcgccccctagagccagtgttaaatagcgaagctatttcaattttaaacaaataataaaatttgtcactttcagtgcccatagggcactggttatccggactaaaatgattattgacactgtttccttgactccgacaatttctcgatgattgtctaaacaattcttttctaaatcctagtctattgctcttaaggaaattttcaagcatatataaaacattttcgtatatttttgaagcatgttaaaaaaccgttgatatccgaaatattggactcaataagaagaataaatatgagatataaaaaagaaatacctgcatgaaaattatactaaaatatttataatttattatcaggactaaaataattattgacactgtttccttgactccgacaatttctcgatgattgtctaaacaattcttttctaaatcctagtctattggtcttaaggaaattttcaagcatatataaaacattttcgtattttcattaaaattattaatttttaaagtttatgatgttattgcacatgccctacttttaataatgtccatattgagaactccaaaaaacccacgacgctttatataaaaaattgttttttatgactatgaaaatgcgattaattgaatgctttaatatcagcgaaacttttcgcatctttttgaagtgcgttaaaaaaccgctgatatccgaaatattggactaataagaagaataaatatgagatataaaaaagaaatacctgcatgaaaattatactaaaatatttataatttattatcaggactaaaataattattgacactgtttccttgactccgacaatttctcgatgattgtctaaacaattcttttctaaatcctagtctattgctcttaaggaaattttcaagcatatataaaacattttagtatatttttgaagccatgttaaaaaaccgttgatatccgaa

SEQ ID NO: 9596 - DNA, 4222 bp, Heterodera glycines
cgatgaccaacatgaagacaagtccatggacaacaacaacatgggcaccaatgacgaccaccaggcaaagatggactccaacaaccagcgcatcaacttggacgacaagacgaacccgaatccaatacgtcacgaaatcaagaagccaacaaacggatgcaacgacacctcccaacacaattaaatcggcaaaatcagcgaaaagagacttgggaacgaatcgtgacggcgcggacgttttctggtgttccgacagaggcagcacgatctgggagctcaagggccccgagaattcaccattctgtcgtcctccaccatcactcaccgcggaatggcacagtctcgcaattgaactctacgccaaaagcatcaggccagagcagattgattccgcgtggcattgctccgtcaaacgaactacggagaattattataccaatttgttgggcgacaagtttgtgaccatcgtaaaagaattcccaccggtcaacaagcgcatctgcaagcaaatggcactgcaccaggaatgcccatacgccaagtctgaaatgatcaaccacgagggacagctgtggtcaactaatgacgaactgaacgtcaatttcccaggacccatttccggactcttcaagggctaacagacaagcacagctacgaattgttttgtgcaaccagcaaccatattcatcaaacggcagactctacaaatgctttcgccagtccaccaagtccaaaactgtcaatactctgcggaattctgtcagttgccaaacaacacgactctgatatggaaatcaacgtgctctggagatgaatgcaaaatgtgcgactacgatcgagcggaaatcatcagcggaaaatttaccgcagcttatggagaaacagtagccacgtggatatccgacgatcaccagaaggccttgacattcgccaaaaaggctcccgaactcatcgcctgcgacggcgtacgcatcgtcctatctgaacagaactttgggattgccaaagatcaatacgacgacattgtcagtactatgaggagatggaaaagaggaattcggcccgagcaactcgcatcacaactttcggcttctcaagtagcgacaagcgtggctttgaatcagctctacataagagaatgccaacgaaacacgagagccgcgaacccaacgctacaagccaggaaactgttacggcaagcaaacatccaagctcgttggatcggcgagacgacaatggaagtgtttccatgtgtcaacatttcgctacaggacatctcatacaggccaatgaatgactgtcgcctctacattcccgtgactgcgcactttcccgaccgagctatcgcagctttcctggatccggaagttcgcatcatctcgctgacagcacaacaggcaagctgtaatagctaccggatcaatcatcttcaactgcgaagcaatcccaacatctggttacggatcgactctcgaaccggcacagcacgacgattgccaaaagattacgtgcacgaattgtacgaaacaacgatcaaccaaacaaacagcaacttggaacttcatccgttgatcttccacgcatggcaactcgacaatgagtctgacgcgacacgcttcccgcacatcaacgaattcatcaactcggagcagttcaaggacaagctggaacagcacattacagcaaggactgaagctttgggcgcgttgaagggcggaatagaaggattcaccatgcgctggctaaaaggcctgatcgacgaagcaatcacgtggtggattcgagtcgcctgcgtttattcaaccttcctcatgctgcgcgacattgttctcccatgcactctggcgtatttgctcaatcccatccgagtgactcttctcagcctcgttggagtacgcccgcacccgacattccgacccaccgtttctaaaccactcgggatcgaagagggaatgccgctgcgtgaactgccacgaacccccaaaccaccagcgcgcagggcagagcaccgatccatgtcaccaatcaaattggacatgattgccagaacggctcggtaccaacaaccacgaacacagagccatctcgaccccacagaagactcgccctttgggaggccgagacgaaaagaattctgacgggccccatcctttttcgcgccggaatgtcggaatttttattcctatcgccgatcaatgatcggcggaattaagagggaggaggcccttcaccaatcccccgcccgccgcgcaacatgttttcgccgtttcatccctctgtcccccttttccttcaaattgtcaattgtttttgtgtgttcctcccccgccctgcgcacaaattaatgaccaatttgtcaaaccgcaacttttctgcccccgtccccaatttggcgaatcgactccaaagaacgatgaacctcccaaatttcccgttttccgcccattttgttcattcgttcatttttgtcccccgtttttcattttgtgcccaaattttcggcccattttgttctgctcacatttgccactttttatctaattttattgttatttaagcggccaaaaatgcccccaatttcacaaccaaatttcatttggcaatttttgccgtttctctccccgcccctccatttgcctttaactgtgatggccccccaattgtgatcattctttaaccccccggttattgatttttgttctgtggccccagtgccctccatttcctgtcccatcccggtgcccaattccatttgtgataattccccggtgatggcatttctgtaatcaatttgtgataattcgttcaccatttcaaaattttggtttaattacccaagtttgaggtcatttcccggaataaattttttattaattctgtgtctcgtccctgcctaccccgaccccagtgcccgacctttggccccgaacgcaatcgggacaggcccgttaattgccggcccaaaaaatttcaaagaatttttttgaaacctatccgtttgagttaaccttattaactatattcgggttttgtttcattatggttgaaaatttggttccatgtataaaagacccttatgaggttttttcattcagtgaaaatccaaaacaaaatccaattggattaatcgagaatttcagtttaattcaataaactaagccagaagggataacaaaaaatgatatgtcttttgttcactgtcaatggcaaaaattgatggaatattggaaaaaattttaaaattaaaggaaatacttgcacacaaattaatatataaaaaataaaataaattatcaaaataattaggagtcataataaaataaaatttaattaggcccgttaattgccggcccaaaaaatttcaaagaatttttttgaaacctatccgtttgagttaaccttattaactatattcgggttttgcttcattatggttgaaaatttggttccatgtataaaagacccttatgaggttttttcattcagtgaaaatccaaaacaaaatccaattggattaatcgagaatttcagtttaattcaataaactaagccagaagggataacaaaaaatgatatgtcttttgttcactgtcaatggcaaaaattgatggaatattggaaaaaattttaaaattaaaggaaatacttgcacacaaattaatatataaaaaataaaataaattatcaaaataattaggagtcataataaaataaaatttaattaggcccgttaattgccggcccaaaaaatttcaaagaatttttttgaaacctatccgtttgagttaaccttattaactatattcgggttttgcttcattatggttgaaaatttggttccatgtataaaagacccttatgaggttttttcattcagtgaaaatccaaaacaaaatccaattggattaatcgagaatttcagtttaattcaataaactaagccagaagggataacaaaaaatgatatgtcttttgttcactgtcaatggcaaaaattgatggaatattggaaaaaattttaaaattaaaggaaatacttgcacacaaattaatatataaaaaataaaataaattatcaaaataattaggagtcataataaaataaaatttaattaggcccgttaattgccggcccaaaaaatttcaaagaatttttttgaaacctatccgtttgagttaacggggattaactatattcggggtttgcttcattatggtgaaa

SEQ ID NO: 9597 - DNA, 4018 bp, Heterodera glycines
atatgttgaaggggatcctcgaatcccgttatttctggttggcatcaaaaattgggcaaaaaccagaaacattttgaatggttccggttatttaaacacattcggttggtctctcatggctatgcattattttgagggaagaattaaagcaaatgggttgaaaaacaaagatatgaaaagccttctcataggtttctttgagttttttaattgtttcccattccgtactcatgtgatttctgaaagaggagaatgggaagagagaagacaccataaggaatttccggaagatagacaatctattttcattgaaaatccatacaataaaaggaatgtagcgagtagcgtgcgagaagatgggtttaaaaagatatgtgaggagtttgaaatgacagctaatgaattcggcttaccattagtcagggaagtcaatgtccttgaagaattaggaattgatctggaaaaggaatgggtagagaaaacgtcagtctcatctgatgagaaaagtgaaatgttagaaagggctaaccaaagtcgagagactgaagagctcagtgacgaaatggtcaaattgaaagtcatcttaaatgagcccgtgtctcaacacgagcaaggtaagagaattgaaaaccctgagtctaaacaccacaaacgcatattttggaaccaaagtctccacaattttttatagtttttattttgtccatgataagtacaacaattccaaatccaatgctttgtcatcatagggcacagaaaaattatgtgagaatagatagagacacaacccaatgcaaactaattgccaatttgtttgacgaacctcaacgggaattggaagttgacatttatcaacccaattccgaaccattcacatttaaggcacatcgatgtctaaaggtcaaacaaagtcaaaaattttggaccaatttactaaacgataagttcagtgacccggtcagtgtttctaccctcccaatgacaattgaagattgtcaagaaatgatcaattatgaaaagtgtgaattcggacctctcagtggtcatttaaattagcaatttcatacaaaccaagaattgcaaatagcctattcttggtggaaattcggaaaagacaaatccgaagaaataactgttatcatgcggtaataaccttaataggaaaaccgggatccgaaagtttgggctcacccacagaggaagtgagcaaatgtaagttttcaaaaggttcatgtcgactgggggataatgcgattctaatttggaacctcgattccacggagcatcaaagcgcgtgtctttacaataaagtaacaacagaaaatgggaaattcaccaagagaatgtggatatcaaaaaattcacagttcgctatatcattccaagagaatgctaagagtgtagaatcatgcggtcacacgcttaaattaagcgatcaaggttttgcagtcccctcgtggcaatttaggataattacgggtaagacaacccataggatcaaaagagagcaatggtggccaaaggaaaaaccattagaccagaacgagaaaagctcaacagcagctgcacaattgacagcgagagctatttaccaaaataaagaaacaaaggaattatttcaaaaaatggtgaatctaatttgtggtattttgcaaaatgccaatccaaagcaagatctgagtcacttaaacccaacgcaattaatgcgagaaaagacgggtactgaattggtaaaggcaaaatggatttccccaaatgtacttgaatggtggccgtgctcttaaatgttcattcgaaggactaattaaaagcattagcagaaaaacaacaagcattttcattttagctttagatgtaaaagcatagggatttcaacggaaggacaaaaaatccaaaagaaaccttaatatgacccgaaaattgaaaagtctaaatggagaaaacccaaactgtcgtaaaagtgacaggaaaagaaatttgatcaattttttgaaaatttggaaaagaaagaataaatgaatgagtgggtgagtgacaaacgccactttttttggtccttttaatatctatgacaaatttaataattcattattttttcgctcaaaaacgtgaccggggtagggagtcacggctaaatcccggcggggctccggtccagtccgggctctattgcttatcaatgtttatcggcggcggcgacacgcggggtagcggggaaaggctgacaaattatttggatttcctactttatcactgatttgtgagttgcaaaacgactcggcaaaacgtttcgagggacagaaattaagttgccaggctcaggttccataattctatgaaattgcgtttgatcgaagaaatgatcagtttcttggctctttcttcacaagaactctcgacggatgccaaatggcaactgttggcaaaagattggctcaacaggaaaaggcatcttatcgaagtatcggagtcaaaaagaaatcatattcagataaagcgatattccgtatcaatcaatcatgcctatcaaatgcaattttcattgaattttctcaatggccttagtgaatatacaacatattgatcatttcaaatcattagctgattttcgatataataataatccaaatttatattttattcagtgtgcccaattttccgtgagtccgcaaaataggtatagttttctcggcgaataaattgcgatttttcgtcatttttgcaatttaattttaataattaaaattttgtttgtattaatatttatttttcatattatttatcattatttagtcactctcttaaagagctttgttcgtttgggcttttctgtgccctttacaaatgtgttaaaatttaaaattagataaagtcaaagtcagttactacaaattcatatgttttggcaatggattcaacaaatgttgatgaaaatttgattagcttttttaaattcattgccttgattctgtcctggctgatgaatttcactattttattttatttgattattttcaaaaagttggaagaattgaagaaatctgggccattgatagcgaaatatatattactttcgtgatctgctaccttgaaaatcgcgaattttaaaatctgaaaaagtctaagatgattatttaatctattgaaaaccattttaatttgaactttcccatcaatttttatattgaaaaacttttgtttttcaaattttgaattaagcaatattttttaattttgtgtctctcataattcttacagatcgcaacttcttttcaaatccttctcgatagttagtccaatctttgcattgccaaattacaggcgcctgattaattaatttgcacttttaatgacaagtaattaactaattgccgagaaggtgttttgacgtgctgacaaaatgcaaaagattcgctgaaaaatgaataaagcatgggtgacgggaccacacaaaaatgtttcatattttttttacaggttttagcgtattgttccccgccaataacctacttcatatataaaaattagataatacttaatgtttttttatttgggtttctttaatttaatatttattaaattattttacatttaataaaaaattaataaattataatttaaactcaattgacaaaatatcaataatttcaaaatttaataatttattttctacaaatatgcttatttaattaagatgatatataataaatgaaaaaaatatttaaaattatttatccaaaatccaaagctcaccgatcgcaaaattgccgaaattttaaaaatctcaaaaggatcattagagaaatacaaatctgaattaaaagaatatgtggagatcttctgaagacggggaagatcgtctataaaaataaccaatttgttgctatgaaaatattacaacggaaaagtataatgaaaaaacaaattttgttttattgaatttgtatttttaattttttttctctataaataaaaatttcattttcaatacatttacaaattagagttttcaggtgat

SEQ ID NO: 9598 - DNA, 5682 bp, Heterodera glycines
tcgttgtctgtggagctgtccacccgtcggttcatctgctactcattcgccgatgggccaaagttttgctgccaaagggaaatgggagagcgtattaattaagccagaaaggaacaactaattaattcattaatgtgatcataattaagagaaaacgaaattcattatggctttcgacacatttttaaacaatttttttgactgaacgaccgaatttagcataaaatgtttacaatttcaaattcataaattgggaacaagaaaatgaaagttgaatgcctaaaaagcagttagaaaacggaaacccaattcggggggccaatcgaaaaatctgtaccatccctactgagcaccgattgatgaaaaaacattatcgaaccacgctcaaaacgtaccaatctcgcatttgttggcacggtttgtggtggcaaatcgggcagaacggcacgtggcggcgccgccggaggggtgacgacgggtgccggcggtcgctgcggaatcggtgtcgttgtcaccgttgttgtcgtggtcgttgttgttgtcgtactgcgccaaggctgcaaccccttggcacgttgcatcacggcatcaattacgacctgcaaaatttaatttatattttttattggtttaatttgtgtggcgacctttacgccctcccacgtctcgcggccggtcgggatcagctggcgccggtccaacagaaaaccgtcctaaattcaaaaccgagttaaattgtaagtcgagatacatgaattatttcaattacttgtagtaattctgggttcttgggtgtgagacttagtttttgttgaaaataatagccaataggtttgagacaacaatttcgctaatgagaaattggccccataattagtgcaaaattactcggtttaaaaaaaaattaaaatccgaatgaaaaatgcgaatttcaaaatatcagtacaaccatggtccactcctcacccattcctcctctcccggcctcagttccaacagataaacgtatttgacgccagctttggattttgcccaatcatccgaactgaaaaatcagtgcaattagaggatgtaagcataatttaaattcacatcacagagatatgatgtggtttcttgcaaaaactaggacactttatcccgccctgacagctctattcattattatattagcacttgccctccggcggacgggtacagtatgtcggcgccggtaccaaaacggtagcgagtaccgtacaattgttcaagcgcacggacgccacgtcggccaacttcttgctaaaatgtaaatttatacaataaagaaaataaaattggaatataattaatcgattaatgggatttaatgacattcaaatttaaagaatatatttttatgcatttttgtttttttaattttagtagaatttttaaaatttctcccactgaccaaatcttcaatgtcatttgggaatgatttgcgttcatggttgtagggatggatccttaaagagacaaatgaatgaacaaattgaataaaaaaatttaaaaaatcagttttaaatctttaaattaattaacattttaaacattctaaaaatgatcaattctattaaataaattaaaaaaacaaaatatcgcagcaaattaaaccctgttttttaaataattttaattaaatgatgacttatgaaaccattaaaagaatattttgataaaaaaaaaaaccccaaaaatttggggaaaaattgaaaaaaaactcaccacatctgtgagtatgtgtgcagtgtgaggaacgcgtcaactttgccgtacaattccgatgacatcattttgtcgcgaattgcgcgcgactcgggctcactgaaggcgtaggcactgaaatttcagggatttgaaaaaaattgtaaattaaattaaaattctgccacaacgaacccttggtaaatgtcggagcacatgtcagaactggagccagtctctgcaaataaatgggataatgagtgaaaatggactaaaaattaaaggctgccgaacccgccaaggctttcttggaaaaatgacagggtttctacccgaatcccgagcctagtcccgacaaattctcccgaatcctggtcccgatattcttctagtgaaaaactggtcaaagtgagcctgtttttgaaatactgaggcaatgatccagataaaaaaggatttaatttctaagaatcctctcaagttccgttgtttttactcagtaggatcaccggtatgggcaattaaaatttcaattttctcaggccacgcctagcgcaccacttgtcactaatttcttttcatttttccaaagtttcccaaaaaatcctcaaacggcaaaattgaaaaactcaacaactaaggagaccgagagtctcgagcagtcctaacaaccatcaccccccgtgccatgccattccgtacctccccagtggaagtcgaagttcctattgaggtccaccccgccgcagcatcgttcccgtctccagcggtccttcttgcacacttgctggcctcggttcttgcgccaaaagcgcgtctgcgggttgacgtcagagcgcgagtatctgtgacaattaattaattaattagtcaatcaagtggaaatgattgctgatcagtgatcacacaactttgccctaatcgatgttccaacatttaaatttaattactgatcaagttatgtttgtcaataatccaatcgtttctttcatttgaaaatgttggcactcactcaaatccgtccgggttggccaacggcaaaacgtaaaagttcaacgtgtccatgtaagctgtgacttgcgggtccactccatacagtgagatcagctacaaaagtgtacacaaataatcacaagagatttaataatcaatcacctgatcgatgaaccaaagtgccgtgtgaattgaagcccactgaaaggcgggggattaagcgactggcacgggataaagtcataatttactaaatcccttttatcacccaagaactggtcgaatgccatttaaacaatttagaagatcagttttttaaggattttggaaataagttttaatttccaaaatatgaaatttgttccaaagaaaattgtgaaaatccataaattcggcatttttttaaaattcctatttggaaatatcttccaagaattcaaaaattttcaatttttggtcaatgtcagggaggctctattcccatagatgtcgcctatttttttgaatgcgcccaaaaagccacaaaaaatgccaacgattgacaacaatgaccaacctctctggcatgcattcctgaaattaattaaaattaatgaccgtttttccaaaaatcccgcctcctctccctcccattacctccgtcaatccaaacaatgcgcttgtttgtgtccgaaactgggctcccaatctgtgagcggagggaaaagccgttaatttggtttaaattaattttgctttcatttttaaaagggatggaggagggaggagagccatggtctatcaactggtcaatttgaggctaatcttcttatcttggtgagataattggtctcagcagcaatctcagaaatagaaaaatgtcactcaatgttttcaaaaaaattcgctttaaattttaatccgaaattttctgttttgacaaacccttcggattttcgcggcttttccccgacttaaattgtttaattttcccaatgttgttttcccctaatttgctgttttttacatatgcccgttgtgccgggttgagtaatttctcgaatattttcccgattttctttgtcatgccgctcttttgactcggcttgcctttatgccgcggatggaccggccctcgtatgtggtgccaattgtgaaggtttttgccagttgcggataaaagcgctcaatgtcatccatccaagtgagcatttcgatgtacgaatggtaatcgcctattttgtgaggacacacaaaattatacggctgtccaaaatcaaattagaggctctattgcagttttgacgcaattaaattttaaatattctcataaattttcccaaaaaataaaaatgataactttaaatggccagcaaaatatcgacattttctgatcagtattttttctcaaatcgtcttctgatcaaagttgacgatttaattcttttattcttctatatctgatcaatgacatggaaaaatcagtaccagctggtcatttacatattttgacattgatcatttggtgtggactgatcactatcaaattatattggggctattttatatcgtcattgacggcagggcttttgaatcgctaatattgcacccaccgaatccgtaaacggctttattcctcgatacaaaggatggcgacgcatcgtcacgcatccgtttgccgaacagcttgaactggctgagcagcaacgactcgctgaggttgcccttgtggtgatggtgccgtccgccggttgccttttcccgttgaacaatcatactgtaaacagtcatactgtaatcttgtttacttctagagatatcggcacacatcttttcatttatttgaaaaaccagcgaaatttttttaaattttcattttctgcaattgcgcatttaatcctcctctcccattcatcagttgatcccaatttttgcttatgccatccgttcaacaggttttggttaattgaccgtgactaattaattagataattgtctctcctaaatagccactcttcactggggcacataaaaaatagctcacggagagttccctttgaattgatggcagtttatcatttatcatcaattaaccgcattaataataatttttgtcgtcattcatttattaaaacttccatcccattaatttgcccttaggcaattaaaaagtaattaaaaaccgcgtagcgacaataaaaaatggcgtgaatttctcaatcagctgtttttcccctcgatgaaaatttttttattgtttttggtaagttactgttaatgaattttcaaatctatgtcattaccgtgttctattttctggaatatagtaaataatttaagatttttggaatactgtaaccagtcataaatacaatatttcggcattattatgtatttggccacccttgggaatacagtaacaagacagcactatttctgtaacccaatccctttttgtcccacctttgtacgtcctcaatgattgtgttgtattgaatccgctgtttgtccaacaattcgctcaacgagctgacaaactccggcgccaccatcacgtcgacaaatgaaccgacatttgtcggcgctttccaaaagtcgagctgaagtgccatttaacgccaaaatttaaatggaatatggaattggggcagttgtgccgttgaaattagggcttaaaatgccatttccgactccactgacaatgcttttggcattttcattgcgtttgggagtttctcccaagatttttggtgtttaattttcccaacctcaaactcttgtgcaactttgtacaatgttctcagcaatgtcaactcgtccgccgtggagggcactatccgcaacacttggaatttgctgaaaaaggacagtgggaaataatgatggcctaattgataagcaggatatgtttaatagatagcatgcaaagggctaactgatcaaaattcaatttgccgatttccgaaatgattattatgggacaat

SEQ ID NO: 9599 - DNA, 3921 bp, Heterodera glycines
attgcaattaattggactttttctacgaattggccgaactattaataagcgatttaacgaatgaagggatattttcggttgggtgggtccgttcatttgaattgaattcaaaaataataattggaatattttgccattttcattttcattttcattttcattttcattgacattttattttattttattttgaatggttttcctttgccctcactcccgtccaattcgctttttgtccattggcggtaattccaatacaattcaaatgttttcttctgctccttctttctgttagtacaccgtgcactatcacccgccgaccgaccaattattaattacgcccggggggagagggaggaggaggcgaattgccgtaaaattgggagaggaaattggcggcactaatctgacagaaagagataatgggcaagagtgagtggattaaaagtgaatgaattggcgggagacacttttaattgggaaacgtgccgaaaatacgagggggagggcagaattaatttcagattctcagaagcatcgcttaaatcgagtgaacatgggcgagaacagcaaaataacaccaaacaaaaacaaattaaatgaatttttttccgccaaagaattgaaaaagaaatgccattgttttggaatgccattgaaaattgccatgccattgtgattcgcgtttggcattgccatcggctattttcttccctcgaaaagggcactcccttctcgaaatgtactcgtaatgcttggttaatcactctcgactacttctcgaaaccaatccccgcataattgcccttttccgcccaatcatccaattttgtctgtgagttgccctgtggaataattgccgagaattgactgaatggccgaatgctttcgcatgagactgtccctccctaattgcggacttagccggaaacgtggccacattcaagcggacaaacaaaactcattgggccaaggaatcgtcgaagggaaagagaaatgggcatatttagggaggtgagggtgggaatgggcagggaatgccgtggcattggcagccgaaggagcggacggccgactccgccaaaatgcgcgatccctttgaacaaaccgcgcaaatataggaaagaaaccccaccagcagcagagcaaagggagagattagcagctaacacacggacaaatccccaccttcgcattgacacttaaagaaattccaaaacagccaatatccgtcccaccctcacattggactaattgggcggaagaattatcggatttggacgtgtgggtggagaggggaggcaaaggggcgggggaggaaaagcgggggaatggcaatgccaaagcgtatcatcgcattcgcgggggatggcattacaaatgccaaaagaggaagtcgaatgggagtggatttgttgtcggatttgatgccgcgcggtttatcggatcagagacattccgccgccccttctgactccttccaattcgataaggtaaaatgataatcaaaacaattttcaaccaagtaaaaatatttatttgcgtccttccatttttctttccttccgttttccattggaaatccaatttcggtggcttaatgaagcgaatcgaattaatttttgtggtgaattaaaaagagcggtaaattacacaaaaaaacacacaaattggactttgttgtgccccgcggggaagcaaagagagaaacaatctgagaaaaggaaaggatctctgcacattcagccgaaagtcagtcggtggcggagacgacgacaatcagcaaaattaggagggaaatcattgctttgtgataagggaaagggacgagggaattcatgccaatttcagcggaattttatgagtgagggaaaaaggggggagggggaaagggggagaaaagggaattgtgtcctttgtcccttttgaaggtgggacaaatgccaaaaaacggacaaaacaaatgcggaaaaactgggaaagacattcattcattcatgtgctgacggttttgctgataaagcccaaatggcaaagtgacaaaacggcaattggggccaaaatccgttgggctgaacctgtttatggccaaaggaatgcgggtttggcacggcacacaaaaacacaataatcgccccgggcggataaaaaggacatgctgagcccagtcggatgagattcagctgcaatcctcttacaactcctttcattcccatccgctaatccttttttctgattatcaaataattaaattcccccccccctctctttagcacactttcggcttccctccccgtgccaatcatcgataagctaatgccccccccccaatttggtggcttaattcctttgcttccctttgtcgttcattattttattattacccccgcaggacactaattaaaatttaaatgaacacaaaaatacgagaaaaagggaaataaatataatcggtccgttttatattcacagaaatgaaccccttcttaaggggccgagagggaggggaataaatgaaaaggggaggagagagaaaagagagaggaatatgaagagagaggggagagagagagagagagactggggagagagagagggagagaggggagcgatgtaaaaggggtggggttgcgaacttttgagcacatccaaataatgtatttattgtaaatggttgggatggcctgagggtgatttggggggggagtcattcgagaagaatgggacattttggggagttaattggaaatgcgaaagggagaacatgcacttaacttacttcgatgaaactctccccccccccccctccgatcactttttcgttctttcctcccttttcctctgatctgttgccttgctggaggcgttttgtgtttttttgtttctctccaatttttacgcattctttcccgtctttagctgtttttgttttgtaaagggaccttctgggaattgtgggtagaaaaatttaaaaagggagggagagaatgaagaatcggggaaatggcgagtaaattttggagaaattatttaatgaacggagggacaccaaattagtcgctgaacggatcagcagatcaaattttggaaaagttggggaaggagccccaattaaatacaaaattcataatattgagggacggccttgaacaatggagaagaaaaaagggaggatattgctaaaatagggagggaaaaagggggagggacggcatgattttatcggttctgccaattccgtctgccaattgctcattcattctttaataaattgatattcaaatttggattaaggacagtgaaagccgagaagaagtcggaaaaggcacaaaattcgggaaaatgccaaaatcagaaaagtgaattgaatttagcaaattgtttgggaggaacattaagcatccgtccatcatccatcgttgctctgcattttgtaatcaaaatggtcaattttgtccctcccctcctctgtccatgatgatcattccctcccccccccccctccccctcattttttgcttttcctcaattgcccgtcttcttccatttttgcctccattttatggccctcacctcccacgaagagcctgcccagatttggcaatgatcattttcattttcattgagttgaggtggcgggggaggaagctgaatttggaattcagaaaacggacctcgacagaattttgaaaaaaaacatttttttgccattttatgtgagggcatttcggcgtttggttgggggactttttctgaattcgtcacccaaccaaagccataatatgcaaatggttaataacccagaagaagagactgacatggccaaaaagcgtgggaatggctaaaaaatggaggaaatggaagagggggaaagggaggggaggggaatggcccctgggggaaggatttgtggaggggggg

SEQ ID NO: 9600 - DNA, 2001 bp, Heterodera glycines
  misc_feature (823)..(823): n is a, c, g, or t
gaggctgatcagcaacaacccgagggcatttcgacaaaatcctccccgaaattccgtcccaatgggcgtaatagtgaaatttgaaacgggacgaaagtgatctctcgcctgctcaaagcaaaaattgtccaacatttgtgccctggccaaataaatggacactttcgggcggtggcaactgacggatggcaacaaaaggccaaactcggcaaaatcagatattttatactctcgaccttacgccaacaccgaatggtacaagaacaacacgaaagtgagtttaaaggggagatcgactcggatcagttgatcagcttcaaaagggtggccaaatggcacgaggcaaggcgaatgggacagacggagggagagcattggagggagaggaggacgaggtcgcagagggagggcaccgcgagacggacagacgacggcacacagcgcacctgagaaaggcattttgacagaaaagaaaggggaaagggagacgaagggccaaattggccatttgacagcttaagtgaatgacaagaaagcttaaggctgatgacaactgatcagggtccaacagggctgtgattctgtaagggtttatcctcaccttggggctttcgaggggcaatgaacactttttaatgcggatttgttggtattaatgagaataataacttaaaacgaacggagtttaatttcttaaattttaattaagccaaaaattattataaactgacaaaagatttaattttttaaataaagtatgaaatgttattaagtattttggattttttgtgacaaatgagatttttaaagctcatatgatgtnggaatttccaaaatttaaagaccgcaaaacggaggctatcctccccctgttccccccaccccaccgtcttttctgctttgatcagatgggctaccgtacctctctgatcagctttgggccgtctaataagtcagttcttgtcatcgcgactgccatcactcctccatccgtgctgagcattgtctccacactttccttcttctcttccccctcatccgcttgctcccaatccgtcaaaggctcatgccaactcaaatcgaaagtgtccaaacggcacaatgaccagcgaaaagtgccaaaaaaaacagatcggaacaaagccatagcgaaacgaccgccggaatgggaaaaatgccgaagagagccggcggggaaggaatgagagggcaattggaagtgatttgcaggggacgaacggatgggcaaaatgcggaagggaagcgaagcggagagagggcacactctgagaaaaagtgaaataaaacggatcagcacagaggtagagaagagactgatcagaaagaaaaacggaccaatgaaggacacattattaatgagagagaaggagagagagactgaagagagaagagagagagtgagaagagagagagaaagaaagaaagacagacagaaagagaaaaaaacattaatcgctgatcaaaaacttacgggatagcaaaaaattgcccgttctggggattttgagcagcgaagaataatttttcggcttgtccgcttggctcaatgtccgttccgccgttggcaatgggacggccgaggaaaaagagggaattgagagaattcgggagcaaagaggtggagaagccgcgcagggacacttccgaaggccaatcggcacaattggggagtcgcgggacgaaaagaatggtcggaaaagctgaagagagagagagaggggaaattgaaatgagagggggatttgggggattaaaaaaatgagaagatttatttgtaattcggtggcatacatccgtcttctgttgtgtcttctccgacaatggcacaacgaacggagcccaacaccacgcgcagaatgcgcgagatgcttcccgtgccatactgacgatgggtgggacccgcccaaagtgccgtccttcgcgaatggtcaatctgaagggcaaacaaacgaaggcaatgagcggacaaaacacagatta

SEQ ID NO: 9601 - DNA, 3017 bp, Heterodera glycines
  misc_feature (31)..(31): n is a, c, g, or t
tttttcgaatttatgttaaaaaatacccagnccatgatgaccgggatcacggatttcatgatcaatttggggcgcatcaccccccatggaacaaatgccgaccgccgactttgcggtgccataagccgcgccgaacacggtgaaaatttgcgttgatgcagcaccaatgtagccaaagaatggcgcataagctttcagcgttctcgaggtcatacgacattttctgcttgaagtgatttatagaatttgaaacaacaacgaaaacgcaccaggctgaaaatttgggaaatggctttaaaattaatggacggatgaaaaaacaggggatatattaaatgaaatggtattttaaatagcttaattgataaatggatagaaaatcgaactactactatgtttcgagtgattcggaaattactagcaaaaagaatgttttgtaaggcctgacacattagaggaccaaatgaggaccgattttaaacattgaaatttttagacaaataaatttcagtgaactgtgaatgatacgcagaaacagaaaggctttaccgcacgacgcgggcgccgctgccaccacaaaataatgttaactcacactgttcaactactgctattttctgtttctatttgcctttcagcagtgccgaaatttgaggagaaaattgagagaaggaaagaacggggaaatatctaatcattgggaatcgattttggagtcataaaattaatttcggatttattcgcagcagcaacaacaactatgaacgatcgcaaatgcatcacaaaaacatcattaaatgcatacatatcatgaaaaattcaactccctatttctcaacattttttttggaaaccttttccggtttctccttcttttcgtccgctttcttgtccttcttttcgtccactttcttgtccttcgttttgtccgctttcttgtccttcttttcgtccgctttcttgtccttcttttcgttcgccttttctttggtcgtttccgccacggccacgcctttaaaaagggagaaacctttaatttgtaaaataaaactcaaaagcttttgccaatatccataatggcttttttgtccgaaccccgcccctgcttccttaccagtggtgccgagctgcacctgcgcaacgttctcgttgccgccgtacacagtcagcgtgttgtcgacgggctgcgcctgcacaacgttctcgtcgccgccgtacacagtcagcgtgttgtcgacgggctgcgcctgcgcaacgttctcgtcgccgccgtacacagtcagcgtgttgtcgacgggctgcgcctgcgcaacgttctcgttgccgccgtacacagtcagcgtgttgtcgacgggctgcgcctgcgcaacgttctcgtcgccgccgtacacagtcagcgtgtcgtcgaagggctgcgcatccgcaacgttctcgtcgccgggcggtgtgtcttgtgacgccattttttcagaaaataaagaatttattttagaatttctaaaaaaggattagttagctgcttcggaaaacgggaatattgctgtttacaattttaacaaataaggtccttttacaagattgacaaaaaagggtgacaatttgtacggatgtgtaatgtgtatttagtcagggttgcataatgaattttgttgcgtgtccaatcatgaccatacatagtttcttaggccataacttttttcttacttggtcccgacctaaattttttagtatcaatcggaagcttgaaaggtacagaagtttttgtgtaactaaactatgctcaagaaaagaaataaaaaaattgttactgaaaatacggaaatttcgtttctcatcaacgcatcatttataaattcagagactaagattttgtttgatagctggaatatatgcaatgaccaagtacggaaaaagttaaggcctaagaaagggaggataatcatcgttcggtaaaagattttcgtttcaaaaagcaccgccgttgaaatttttaaaattttctaatactagaaattccttaaaaatcgctcgaagaacatttccagaaaatagagaaattacaaatccaaataattgatgaaaaagacgaatgaactcaacaacatcctcgtaagtgacgaacgaaaaatggaaaaagtattgaaaatggacccttaaatagctcgttcatcgtcgcccaaaaatgagatatggacgaataatggagatgcgaatttagatgaccgattatggcaaaaatgacttgtgatttttatatttagaatggtaggtattatgtatgtattgcacctatctttcttcaaaaatgaaattatttgggaaaatgatcagtagggctgtgaattttaggttttaactaaattttttgctcgattgatttgaagaaaggagctcaaaaaacagcattaaaaattttcgattctgatgtcactatcggtcactagaaatcactattttggggttttgtcactaaaatagttaaaaatcactattttggggttttgtcactattttttcactatttcgacattttttggaaaattccttaacaaaaatgcaataaaaccaaaaaatacacccctaagaatcgacctcactatttcgacattttttggaaaattccttaacaaaaatgcaataaaaccaaaaaatacacccctaagaatcgaccttaaaaaattttcaaaaaaatacacccctaagaatcgagctaaaatttttcaaaatatactcctatgaaatgaaaaaaaattttctccaaaatttactttcttggcaaaaatttttaattctaaaaatttttttaggtaactattttgggttttttggtcttaaaaatcgcagtcctactcatttgcaactgcaatcagtgaataaaaattatttttgctcaatttttggctgaaaatttgcactattcgtcactctatttcttcactattttggcatttttactcactattttagttaactattttgggatttttcgtcactaaaattcacagccctaatgatca

SEQ ID NO: 9602 - DNA, 2727 bp, Heterodera glycines
ccgagttccgacatttttggggtcggaattccgatttccgaaaatttttggggcctcggaattccatccctggcaccaactacactattaccaatttttgaattactgtttcctcggatgtccattatcccatcccctgttcttcacgtgtacccgagtatataaagtcgaccaaatcccctcagcccattcaattacatcaactgaaaggagcagacagtgttttgttcaaatttccgaagaaggaattgatggcaatacatggcgatacgacgaatttcattaaatccgcctgacacgctacatgacttcaattgaggtatttatgtcacttggggtgtaccgctgtacagcagggatggcattccgaggccccaaaactttttggaactcggaattccgggggtccaaaatttttcggaaatcggaattccgaggcccacaaatttttcggaagtcggaaatcggaattccgaccccaaaaacgtcggaaatcggaattcggaagtcggaaatttttcaaaaaacataaaacataataaaaattttctaaatattttaataggctaaattttaaattcttaaccaagtaaaaggtgactcaaaaaattttttggatctatttaaaagcatattttcatggtcaaatgtttatctacaccccaaaaaaatcaatattttgtaggcccaaaattctgaaaaaattcctgctaagctaacttttgatgatgatcaaaaaagtgttttacaccaatttgatcagatcactccttcatggtgatctgaaacctcaaaaatggcaaaaattccttcgaattcatgattagcagaccgtaagggatcgattggtatctatttggtcgcaattccatgcgtttttggctttggacggttcagtcccaaagccatttggccatttcagtcccgggtctgtaacgacaaagggtaaccctggattatgtgcattaaatagaattgttttgaattttatattaatacatgtaggtatgcaaataatgttttttggaaaatatcggtcatatggcccgaagcccaaatggccgaaaaaatgagcaagggctcatataatgcatgtgacgcggaaactgtttttggacgtgaaaatgtatgtgataggacgcgcttaaaaccgacaagaaccgcctttatttcttccatattcaatgccgaccgtgatggcatgagattgaattttgaggatttgaagccctacaaccaggaaaaaaccgtggaggaagtgttggaccgtttggacgtggaagtgtgcccgcaaatggtctacaggatgggcaggagtagtgacgaaaagaggaaggggccgcgcttggtgaaggtggtcctgccggcgtccaccttccaacgcttcgcgctgatgcagtgggggcgtcgtcggacggagctgaagaagagggctggttgggagcgtcttctggtcaggtcatccctgacgaaggaggagctggaaattgaacgtgaacagcgccaaaagaagtggatggaatttggacagaagaaaacggatgaaaacatcacgacgcgacgcggaggcaatgaaaaaaacttttgaggtcacctccttttttaaattgtttatattttaatgcacgaagtttggcgaacaaattggacaagttaaggtttttgttattagaaaataggtttaaaatcattgctgtatctgagagttggttgagtaacaaaatagaaaacccccaaattttggaaaatctccactattctataataagatcagatcgacttaacaaaaaaggtggcggtgttgctttcataatatcgaatttaattccttttgaaattatcaaaactgcaaaaaacaaaaattccgatattctttgtgttgacctattctcacctcttaaccacacaaaaacacgttttattttgatttatagacccacttcacatgaaaaacaagaagatgtcgaaaaattggtcgaacaactctctggtttaatctcggcttccgaaaaatgcattttgttgggtgatttcaattttcctcttttaaaagcaaaagactttagcatccaaaatttcgaaaaaagatacaatcaccttgaatcatttttcatttcctttttagagggatttaaactaagattaatggtaaactctcctacacggggcaataatctattagatttattatttacaaacaataaaaatctgttgaataatgttaaagttggacctccattcgggaatagtgatcataatgcaattcaattcagcataaatttacaggttaatagtgatgcctctgaaaaattttataacttcaaaaaagcaaattatttggaaataaatgccatactctcaatggttgattggaatttatttttttctgattgcccggacatagagcgtatttaccaaaaatttatgtttttcctaaataatttgataaggaattatgttcccatacaaacaacgaaaaaagttgaaaaactaccagaacatattttgaaactaatcatctatcgtaaacagctttggaaggacattcacaaagaccatataaaaataaaattcttagaagtttcgaaaaaaatcgatgtagaaataaataaattttataaaaatcgcgaaaataagtttttgcggaccttggactctaaaaaacgttttaatttataaattctttccttaagactaaaaatactatgatacctgcatttactgata

SEQ ID NO: 9603 - DNA, 4372 bp, Heterodera glycines
tgtctgattgtaaggtcatggcaatgggtcggcggccaccatttgaagagcaaagttcaaagggggaagcaggtgtgcatgccttgcccagggtttgactgtttcaagacaagaccacaacagccattcgatgtgtttgtttccaaaattcgagtgccgaatcgcactgaatcggttctgaaaatcggctctattcactttgctgaccgaattcaaaagccagtaacaaattatcagttaatctcttcccaaattacacgacaaatgcccccacccgattttcgcattctctcctcccccaaatattaatgatttttctgcggcgatatgagtcagtcattttcatatgcatatgtacgatgagtgatgggatggataaacgaatgaatgagaatgaattgaatatatttttgtgtactttgtacgcgttatttgctgagaatggagcaaatgctcaatccattttcaactgttcgactccaattttaaaaatgacagtgaatgagtcattttttcattttcgggttcttaaatacactctttgccgcatggcgattgattgtccacactttttcctctctgtccccctccgccccctctttttgaattttaaattttttattgtcttttatcccaatttcaatctctccccgtccccgtttcagtttgatcaattcggctaatccacccatcttcgcttcctccaccgttttcttttccgcttccaatccgtccgcttccgtcttctctccgtcgttgttccgactgttcaacgcctactctcttctcgtgatgaccatggacgtgctgccctcctgctccgcgccccacgacacgaacttcatgagccaattgatcgagaagttggccgccgcttccattctctccagcgccggttcgctgtgctcctccacatccgcctcctcctcctccgttccttcctcttccactcatcccccgtcgcccccaccgtcgggcgcggcacgcaatttcaatcagcttagcggcgcccgctcaaagtgcgtaatgtgacacaaaactgatctgaaacagagtgctcaatagtgctgtcttggttctttttgtgatcagactcttccaatgatgatcaattgttttcatgagcctgatcactcatagggacaataatagcctcaagcgttgatcaacagatcaccctgttttgtgacccttatccaacttgggtctgatcaaatcaacttttggtgccgttgtaggcgattcgactcggctgctgccgttcccggcgagttccactcggtgcagaatgcaatcgccgtcgctgtgctggtgcggctccaccagtggtgctgccggctgttctggctcaccattgtgtgcctgatgagctattacagtgatcagcagcaaaatcagaggatgagcagtggcggaaacgccgaaaatggggacaaatccgcggatgacggaggggcggcagagcgacagcggaggacattccgcgaagtgcgcaaaagcattgtgcaagcgacgcaacggcacggctccaaaaaggtcaccgacttggaaatgcaggtgggcaaggcaatccggcaaaaccgggcgatcagagtcgctaaccatggatgatttgcttgagatggttgcctgatcagacagtttctgtccgatcactcctgatcaattccccattgcgacagccaaaacatattcacacctgtgtttttgaattgtctgcgtgtcttcatcatggtgatgatgatgatgcggcgtgtttatctgtatttgattgatcggtcgatcaatcattcgcggacattgcgtctgcgccacacctctcccgtggggttgggcaaggacaacacagtccatggggacccaacccagccgaaatgtgagggcatattgcctgggtaataataataataagtggagaatatagacggataattaggagacttgttttgacaatgatcgatccaattcttaaaggaaatgaattgattcgttagttgattaaatcaattattctttaaaattgacccaaaagttcttcataaaatcgcttattgctgctatgtattagattgatcagaaattttagaaagatatgacaattttcaacttcgagaaacaagcggagaataattaattagaaaataagaaaatcattccccaatcagtgatttgttagtgctgctgctatttcaagcaaatccatcccgctgatctctgctctgatcagcaccatttcctaccgccgatcaaattcattttgcttatttctgatcactttcagctgctccgccacttgacctgcccgcagacggccgttctgcgcccgctgcgtcctttccaccacaaaaagcggcacttcctctcccggcccccgtcgccccaactgttcgacatcagcgaggagaacgacgagcagcaacagtaattgccggaggacagtccgatcgatcggtcgatcagtgatcagccgctgcttctgatcagtcagtctctccaatccccgcaaccaaccaccacgaggagcagcatcagcagttgttgtttgttgtctgttgctgttgactacatccttcttttgtctgaacaaagcgccttcgtgtaccttctcaagcgctactgagtgatgatttataccaacacctcatttgcttattattaacaagcctccctcattagttaatgatcattaattattttctacccgacgtctcccaaagtctctcccctcctcggcagctcacaattcaaatttatatttgccctttcttgtgtctctatttccttcacccggcgggtaattaatgctaataacaatttggataacactcactcattaggccgtccaaattgcgtttgtttcttctaatcacagacacttaattatgtaatcactagagagagattacttttgtgacgcctttttaacatttttctcaccatgttgcgctgctgttctattttggcctaataaaagttgaaattttttttccgtcaagactctcgagacccacaaatttcttggcactattgtagcaggccaaacaacagcgcttgcaatgttagctttttgttttccttttcggtcttctgccattgtttttgtttttcataccatcgcctttctcatttgaccaccgccattcatttttagtaatttaatttaattattattatatttacatattttgcttcacttattctattttattttcgttccattttgtccatgtgttaattaatcctttctcggagaaaggaacagagataaataaatgaatttgataaatatgtaaatacaattaatttattttctgtgttcgccccctcccccaaaaattttattgttttatttttccattgccacccaaaagaggcaaaaaaagaattttgttttaaacattccccacagattccgttggatgaaatgggcaaaaaaggcaaaaagaaaagataaaagctgataagggaaaggaattacaattacctaatgaaaataatttaataataatacgataacaattcatcatattttattagtgctgtattattattttattatcgccatcaaaattatgatggaacgaacggcgggggcaaaggcaaagtgatggacaacgacagtgaaagaaaagattgcttctctgctgattttctgatgggtggtggtgccaatttttgcttagttcggcacaatttaacaataaaagttgggtgggcccaacagataaagggagagagggagatgggaccaaaagatacgaaaattaatgggtaatttgagggtgccgattttttatgtttgaaaaagtgtaaaaaaataaaaataataataaatgtaataaaaaatttaatttgcaaaaccaccatttggtctgttgcttctgtgtgtggctctgaccaagctaaaggctaaagtctgttggttgatcgttctcgttcaaaagactaaacacggaaccaacaataaatgcccttttcggtagataaatgcctttgccgtctgcttttccctcccatccatcaattgatctattgctactgctgctgcttgtgatctgatcagagtgaccagccaagactctcccatttttttgtcattacatcaaaagccaatccaagggaggaaaaaatgtctgttgtctgtgcttcctctcttgcgctctctctatgcttttatgaagccaaaaatacgcgaggacaaaagcatggcttttccttgcgattgttcgttccaccgctgctgctgcttcttctgccgctgtttgtccccaaaagcaaatggcagcagccgatgaatgagtggcggtcatgcaaaatgcgtgtgaagtgcacgtgcaccgcacccgcagctccaacaccgcccccctccccc

SEQ ID NO: 9604 - DNA, 1752 bp, Heterodera glycines
  misc_feature (169)..(170): n is a, c, g, or t
gaaaatgctaaaaaagagacccagttggttcaatgcgaataattgggctaaagaacggttgtgaagggttagtctcgtcatcagagaattgatgtcctctaacttcttcgacatcgcttcgttttgatcatttttgggcgattcttgctttgttatttcgtccgtttgnnggttgacttcggacagctcactagtgagcaagacatctacagtatacatcacgttcaacagcagcagctctactcaagaggaggaagacaagtcaatatatctgtcggacggccgaatggttaatgttcatatcatccaagggaagtttttgggcggcagtgattgtgctgagagagagataacgattgatacattaacttcctctctgatagtattgagcagtggctgatcccaaagcggatgtggaggtgaaagagtctcaaagaaacggacaaaagtgaaatatagagggaatcttgagacctagtcatgcaatttaaaaatagcaaaaaaaacaattcaatgaaattaacttctagagaaatactcgttggaaaatatcgaagaaaaaatgggcaagaaatttaatcggggtacgcaagaaagaaagaaaagtaaataaataatgggaggatgacgatagttagttgtgatcaaaaaaagttgtttggatcaaatcggtgagaaaattagcagaatcaaaaaaaacgcattatgttaattagtgccacgccaattttgcaaaaagaattaaaaattaattggttttaattattgtgtaattcatcccattttattaaaattgatgcgaaaaaagaactgcatttgtgcagctctccgactcaaatgggacgagcaaatttcagaggccgagttgagtttgatggattaaattaaggaggaggaagcgagagatgggtcttttaatgagaccaaagtcgagagtatgcgcgactctcgggtcgaaaatcaaaattggctggggaatgggacattcgttgttccgctgggattccttcgtcccattctcggctaatttcttgtgtgaaagtcgagagcgttgcgtgtgacttatttttgttcggtatttcattgcgctgttttgatcaaattgaaatcatgtgtctgctgctctttggtgttccgtccgccattggcacttggcacttgccgtgccatggcattcgagagtctcgcccactgctggcgaatgccctccctacaaaacacagtctctctctctctctctctgctgttttctcgaccatttcggcggtgccattgttttgccgaaccaaagggtgggcaaacagtgaaataaaaatgatgggaatggtcaaaaagtgtcgtttatatttgtcctttttgcctgtcgctgctgtgtccacccctcggcggtttactttcaatgcgtcgcttcgccgatggacaaacattgcgacggatcggaccgatgagaggggtcagaaaaatgtaaaaattgggctaaaattggtggtgagaaaagggggcagcacttaattttaccaaaaaaaaagaatttgaaaattgacaaaatttttgagtgttttaaaattaattgaaaccaattaattccaacgataccaaacaaattacttttgttgtttctgagaaaactcattaatatttttttcaaaatctttacaactgggaatttttacaaatctcataaatagtatcgggaaaattatacaaattaataaaaaataataattaacatttaagttggatttgtcggag

SEQ ID NO: 9605 - DNA, 1747 bp, Heterodera glycines
aaattcagtaccaactttgtcccttcagtcccaggtgctcccgagtcagggtttgatctgagcgagggggctccagcggtcttattgtagagctttgaaagctcgatttttccaaattttaaaatttcgaaaattttcaaaaattttcgagttaggcctaaaagtaggttttggggtttttgaattttatgaatttttaacgaattttcctagagaaatggagaccacttccaaaacatagtttttcgagctctatcgactggtatttttttcggaaaaatttcgattttttcccggaaatagaaaaaaattttggcctgagcgggacatttgagtcccgggctcataactcgttaggggttggttttagccaaaaattgtcttagaacatttttgtagagcttttaaattgctatctaatgaggtactataggtcggaaaaatttcaaaaattttcgagctaggccccctagaaattttcggaaattttttttcggacgaaaatgggggtgaaaattttttttctggggtattttgaggtgctgagcacgaatatgacctttgtttttcgtttcagattttttgaattttttaaaaatttttgaaaattcgtcaattttttggccttcgggattttgagttaattttcgaaaatcataacaaatcgaagggtggatcaattttcatgcaattatattataaaaatagagaaaaatcaggagaattttatgggatttatttgggatttctatcttaaaaagaaaacaagttattccagaatttctgaaaattttcgatttttcagaaaaaaattcataacccccttctgaaaagaaatttttgaaaattaaaatactacaaaaatccgcaattttttgctctattaaataaattttatttggcatttttatcacttttttgagagatgttacaaaaataaaagtgattttgactttcgggaccaaaggggtgagcataggatttttgagctggaaaattttttcaccaaaaatcttccaaaaatatgtctttaggggttatttcggccgctgatcatgaatacgtaatcagtttttacttttgacatcgttaagacctcagaatccctgtgtcattggggattctgaggcatcattttgagggggggggggcaggttcggatccggacggtgtacattaatttactatgcattttttgcttacttttacattttttaattaattgttttgcattattaataataaataaaaatttttaatttaaattaaattattttggtgaacaaatgttttaatttaaattatttaattttttatttaatttaatattgttttattaattattttaaattattttctgatgaataaatgttttatttaatttgaattttcgagaaattaattcctttcaatttcaataaatattctatattataaatttcgaacttttcatagttgtacttctttttatcactgttgtgcctcttttaatcccttttatatctcttaatccctgtgtgattgcccgtctgagttcaactaaattttaaaaacgggcgcgaagcgcccgcccaagcccaataaaattttaaaaacgggcgcgaagcgcccgtccaaggccaaaaaattgaaaaacgggtgcgaagcgcccgtatgagttcaatggatttaaaaacgggcgcgaagcgcccgtctgagattaacaaatttaaaaaacgggcgcgaagcgcccgtttgactccgaaag

SEQ ID NO: 9606 - DNA, 2438 bp, Heterodera glycines
tcactttttcttgcgtttgaaggcccctaactttttttctgaaactcggatcaaaaaattcccgctgtgagggcactccgcagaagtgtcctctataatccagtattttttattttttgatcagaccaaatcccggacctgtacagacacggagactcagttaatttttttttcccacttcagtaccaggcgaataactcattagggtttgacctgagcgcagggtggccagcagacttattgtagagttcaataagctcgattttttcagattttaaaatttcgaaaattttcaaaatttttcgagctaggcctaaaaaacggtttttgggtttttgaattttaggattttttaacgaattttcccagaaaaacggagaccacttccaaaacatagtttttcgagctctatcgactggtatttttttcggaaaaatttcgattttttcccggaaatagaaaaattttttggcctgagcgggacatttgagtcccgggtccataactcgttaggggttggttttagccaaaaaatgccttagagcaaaattgtagagctttttaagctctatcgaacggtgtactacatgatgtaaaattttcaaaaattttcgagctaggccccctagaaattttcggaaattttttttcggacgaaaatgggggtgaaaaatattttcctggggtaaaataaggtgctgagtacgaatatgatgtctattttaattttcataatttttggaattttttaaaaattctttattttttggcaattttttggccctcgggattttggcctaatatttgaaaattcataactcagttcagatcaggtctattttggcgaattaaagctttaaaaatagcaaaaaatcgggaaaattttatgagatttatttgaaatttatagcacaaaaacaaaaaaacttattccagaaattctggaaattttcgatttttcagaaaaaaattcagaactcggttctgtaaaggtgtttttgaaattttaaatacttaaaaaatccgcaattttttgctctattaaataaattttatttggcattttgatcacttttttgcgaattgttataaaaataaaagtgattttgagattcgggaccaaaggggggtgaccaggatttttgagtggaaaattttttttcacaaaattcttccaaaaatatgtctttaggggttatttgggccgctgatcacgaatacgtgatcagattttacttttgacatagtcaagacctcagaatccccgtgtgattggggattctgagtcatcatttgaagggggatgggaggcaagttcggatccggacggtaacacattatttttctatttattttttgctattttcaatttttattcatttaaaatatttttattttattaataataaataaaaaattttcatttgaattaaattattttttggtgaaaattttatttaaaaataataattttttaaattaaagaatttaatgtttttttaaattagaaattgtcaaaaaaattattttcaatacaataatacgcaatcattgtaaattcaaagtttatttttaattaataaaagaaagcattttttaataattttttaaaaaatattaatacattttttaattctatttttcataaaccatttactaattttttaatcactgttatacctcttttaatcaccattgtacctcttctcatcactttcgttactgccttctgaaaagctatttgagaaaagtaaaatactacaaaaatccgcaatttttttctctataatataaattttattttaaatttttatcacatttttaaaaaaagatataaaaataaaagtgattttgtgattcgggtccaaaggggggggggggagcacatggtttttgagtgaaaaaatttttctcacaaaaatcttccaaaaatatgtctttaggggtattttaggacgctgatcacgaatatgcaatcagattttactttagacaacgttaagacctcagaatccctgtgtgattggggattctgaggtatcattttgaggggggggggcgaagttcggatccgggcggtaacacattatttttctgtgtttttggttaaatttcattgcttttaattacttttaacgctttgttttattaataacaaaaaataataaatttaagtttattatttttggtgaatgtttatttaaaattaattttttttttcattaaaatttaaaaaatttcatgttttaatttaatttaaatttgttaaaaataaatgcatttcaatttcaaatattctataattctgtatgctttatagtttatttttaataaagaagtgcagaatttattttgtaaaatttaaaaatattattaatattcaatttttactttttttaataaaaccatttccttatttatttaattttaaactatac

SEQ ID NO: 9607 - DNA, 1506 bp, Heterodera glycines
ccttttgttttgcaaaattttttttgtgatagtcaatcccccagtctctggggtttttggggtccccgatcacgaatctttcaattattttgatcaattccgatttcctaatctaaatttgaacaaaaaatcataatttgaaaaattcaaaattccgatttttattcgagttcgggttatggattagaaattagtcaaaatacatttcagattcgtgattagcgacctttataaccccggataaaaaattatcatggttttttatcttaaaaaaattttgcaaaacaaaagggtccccccttttgtttcaaaaaggcccacttttacactagcgccaaaaaaaataacaaaaagaagggacaataaatagggctcggacaaatagtccgaaatatggagtaaatacatatttaagaaaaattacgaaatttgtggtgtaaaaatttttcgaaaattatgccaactgccaaaaaatgtgatcgtgtcaaaaaaattttttcgcattttttagggaaaattcgaaaaacgcctaaataaaagcatccactgcgtttcggcgccagcatgtctttccaatctagcgattgcttcgcgattagacaattactaaaaagtttatgcatgaaaattgcgaagtcgaaatttttgaagttttttcttaataaaattttttccaggcttgaaaaacttttcgcatttagtaaggctaatagtgcatgttaagagttgaaataaatgccttttttgagctccttccttcaatgccataagcaaaaagtattttagacggcggtcaaatttattaataggatgaatccgttaatttgacaattttaagctcaatgcctgcttgagtgttgaaactaagattttgacaacaaaaataagatttgcacatttattacagaaaatcacaaataggtaatcataatggcataacacaaatccatgttgatcagtcgaacaaaaaaagacataattttctgaagcacgtcaataattccataattcaaattgatcgatcacttcgcaacaattcattcattcacttctgctgatcacttgggccgggagttgtggcgagaagcctaaaaatagaaaacacaataaatttaagcttttaaataagcattcgctgacccgtctccgatttcgtgctcatcatttatttgaatgtcaatctgatcacattgatcaataaatttccatccaatcgcttcctcctcccattctgcccatttgttcacatctcgcgcaattggagaacggatcagcagaaaacggcggttattgttagtccttttcaatgccaattgttcgcgtgtcaattcgttggtcagatcaaatggctcaaccgacgactgatcaaaatacgacggaaaccaaatgacgacaatgaaattggcgggagatgaagcattggtaaatgcctgaaatatgaaaaaaaagttataaaaaaattgaggggttgttggtaagccactacgcaccgtcctgaaggctgca

SEQ ID NO: 9608 - DNA, 1592 bp, Heterodera glycines
ttcgaatccgatgactttgtgtggcacttcgttttgcggaattggcaattcttcaccatcgtaattgacaatttccatctccttggtgccattctcgtcaattttgcttccaattcgaagaaaatccaatccccatttgcgggttttgaagtgttcgtccacgtagatgttaaaacggtggctgatcatcgaaattctgaggccaagttgataagccggaagcaaatcgaacacggctagccaacagtcaccagagataaagctgaaaagggaaacaaaatttaaaattggcattttaattttacattgctttttccatttttgcctccacttttgccatttcttcctccgccgcttcttttcgattgtctgtcattttgtcgaggcaaatttggtctgctggaggttttggtgtttttttgaatcggtcccaaaacatccaaagaatggtgcaacagccgacaaacaatggcacgccatacaaactataaaatgagaaggaaaatggtaaatgtgtggagaagaaatgcacaaaacgtacaaagtcatttttgaaggcattgtcagagagaaaatcgaacaaagagacgaaaaacggcgaatagataataataataataataatgaatgtggcggaggaaaagcaaccacttttatactaattttttcggttcatattcgaacgccttggagaaaaatttcacattccaacttaaatgaacggattttgattttaagtaattgctttgttctgctatttgtatgcttttagtggaataatccgctcctgcaaaattttcaatctcaacaaaacccacattttttaaaatttgtttttattattttccatttgtatgcttttgcagtagagaccggacaactggggtcggagggatcccgagtcgggatcccgactgaatcccgatcccgaacattttggaaaaatgatcgggacggatcccgggttgggatcccgaccgaatcccgatcccgatcaatcccgaagatttttttcgagatcccgcgggattatcgggatttgctcaaacccaattttttttacattttgtgtggtattagtgactctttgaccctttatttgattgtttgaatttgtttggcataatgtttgatttgaattgacccaaattgtttcgtttttcttcagttgtgtgggtggatttttggttatcgtcggtgataattttaggcgttttgttggtcgtcgatttatttgtgttttttattaatttgttgttgattgaattttatttattttggattgtcttttaattattggttgcataaatttattttgtttggtgttggatttttaaagcaggttttgccaaattcatagactattcgtgcaaaatttagaagtgtggcaaagaaacccccgacaaattgcttcttctttttcaacttggcgctcctggtaacaaaggttagctcagtggcggacggctttatttttcttcagtgaatttctcattttaaaaaagcgactacctaatttggcaaaaaccctcgtgttgggttcatcgactgttcttcaaatttttaaaaccctcgtgttgggtttatcgact

SEQ ID NO: 9609 - DNA, 2393 bp, Heterodera glycines
  misc_feature (2260)..(2260): n is a, c, g, or t
ctcgtccatctcatcaaagcagaatcaggatttagttactcaatttctgcacctcaatgaggaagcacgcaactttttggagctggataggctgaaaaagtccgaaaaaatggagaaaccggtaaaagtgagcaaagaaaataagaaaggagagggaaagtcaaaggaagtgaacaaggaggaaaatgagtacaacgaattctgcaagtcaacgactaaaaacattgacgagtcaatagtccatgtgcaattttttgctgaatttgagagctccttcaagtccattttttacgtgccggaaacgttgaccgcagacgaattccaaaatcaaaatttggcattttcatcagggacgatggaaaattcgagggaggagaagaaaattggcagcagcgagacggacaagaaaaatggcctaatgagaatttggcgatttgaaaattgcagtgtgaaagccgacggacgaatattagcggaccgtgcaaaatggctcaaaacgtggatcttcatcaaaattcccgataaaattcttttggacaaaacacattaaaatttttcgaggacaagaatgacaacattttttaaagccgtcacgtcactagctgaaaaccttgaaccccaccattcggatgccgaattcgccgttatttttacttaaagacgaggggaccgtctttcttagaggccggggatgtggtattagtgactctttgaccctttatttgattgtttgaatttgtttggcataatgtttgatttgaattgacccaaattgtttcgtttttcttcagttgtgtgggtggatttttggttatcgtcggtgataattttaggcgttttgttggtcgtcgatttatttgtgttttttattaatttgttgttgattgaattttatttattttggattgtcttttaattattggttgcataaatttattttgtttggtgttggatttttaaagcaggttttgccaaattcatagactattcgtgcaaaatttagaagtgtggcaaagaaacccccgacaaattgcttcttcttttccaacatttgtgccaagttttgttcaaagggggggggaaggcccacccgagccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcattatttatttatttttttacagaaattaattcataagtatttttacagaaactgctctgaaacgcaccaaattttatttacatgctagtttaggcactctgatgctttttctatcaaaaagggagatgaataaatttttaaaaatttttaattcctttttaaacaggccaaaaagtttaggcttaacttttaatgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaactttttgtttcactcatttttgaaacttatcagaagcgcaccaaactttgcagggatactgaaaggaaaagaattaacctgttttatcacattagcttgtcatcagtttttataaaaaattttcaaaattctgagtctcctattattttatttttttttcaaaattttgaaatgcgagaggggggggtgtctgcaaaaaattttcaccggggtttanaaaatctaggaaaattagtaagcatttgtagtgttccgatacgtatccctgcaaaattggtgagcccctgatcaatacaaatatttatggacgatcaatttttagaattttttattatttttgcataattaat

SEQ ID NO: 9610 - DNA, 2559 bp, Heterodera glycines
tattagtttttaaataaaatatagtaaacatatattcattttaacaggccaaaatgagcatggtcattctgcttttcttggctgtcttcttcggattcctaccatttcttcacagcttagacaaagcatacgtcaccgaaccgtaaaattaaaaaatgtttatttaattttcaaatattttaaaattttagctttctcttaacgggtggaaaaattggaaaattttccgtgccatactttgcgtttgaccaatgcaagccgtaccacagcatcactcatgacctgaaggttgaatcccggaactttggtctgtattttatgatgaagcatcgaggtggacactgtgatgaggggtaaatttttgaagaaatcataataattacaaattaggcctaattaaatttttaaatgccatttagcttactgatctgctacccgggcacattgatgcgcaatcatatgatcaacgagttcaaaaagatgtccgatttcagattgaaacggacattccaagtcggcaacaaagaagtaatgggaattttaattaaaaaatttatttaaaattttttaattttcgaacgattctctttcattggagtgcgcccaaaaaacggaacaatttgttggcatttcaaacccaaaacaatggcgtggcatcaaagtgtacacgaaactgacaaactcatcaaatccgctttcggcacgagaaatgatcctggagacttcattgacaaatcggaggtagaaattttgggtaattagggttaattaatagcatttttaaatttaagttactcctttgagccaatgactcgtcaactttcgcttaactttggcaccagagtttcaatgttcacttgggtcacaactcattttggtatttaaatttaaaaaatatatttaaatatatttttaaatttaggacaaccatttcatgacgaagaatttgatttggctgaacagtacgccaagcaaatgggctatggaccattcttggaacaacatgtcggactttggttgcttggcatggacatgttgccatggatggccgaagagtttgtgagtctgtacgtctaccgtaactgctcttgtacgatggacgcttgggtactgtacctttatttgaattttctataatttatatattaaaaaaagttcacccggccaaccgatgagaatgacccaattgagccgattgtgccatcggccggctcatcgcaatgcccgatgaagcaaatggacgaaacttttgaacttggccaattggacgcgcaacatttgcaggctgatcttgtgttcactgtgctgacggatgaaaaatggcaaaatttcacagtggaattattacaaggcgaaaaaggtgtgagctgacaaattaaattttgattaaatcaattatatttgtatttaatgaccgttgaatgggggaaggaggcaaaacaattagggtggctaatgaatggtattggaattaatcatttatataggaggtgtgaagacagtcaatgttggcctgattaaattttggttagatcaattaggcacaagtaactaaatcagtatttggattaatgactgtgtatgggtgggaatggaataaataattaataaaattactgatccatattgtactaaatcatttaaaaatcccgtatgtgaagatgaattatatggattaatgacccgttgaacattggacattcatttaaacaaaatttttgcaggtacaaacctcacaatgataatgatgaatttcacaattggaacaatcgacgacatgaaagtgtcatttcccggggtaaatttaataaatataaataaaaaataattatgtaattaattaatgtagattaacacatcggtggtggtcaatggaactcagatgccgaacggaacgcaacaattgcgttttgacattttcctgctgaagcattggtatgctatgatggtgaacggtgtgcagtttggcgaagtgttttggccaaacgaatggtggcacgcggcggcatggaaaaacatcacggcaattagggtgagtgaaaaagaaatccatacattttattggtttgagccgattccgaaaatttaattttgaattgaattcgtcagaattttaaaaatagtttttttttctcaaactacgaatttttttttctaagttggagtttcgttattgcctccttatgtcaaaaagaaaataagaaaatttttaaaaattattttttaaatttttcccagctattactttttttaaatttcattaaggtggagcgagtcttcccaaatttttgatcaagttcccaaataaaatctattttgtctaaattttttaagatttttggaaatttttaattatttttttcaaaatctgtcaatttttctgcatagattaggaaaaagacgagaatttaaattgggactaagaaaattgagcagaaatttgataatagattttttccttacataatattattatatatatatactaaattagttttattttgaagcttaacggccaggtatattgctttatgggcctgaattggatgactacggtat

SEQ ID NO: 9611 - DNA, 1450 bp, Heterodera glycines
aattaaaattaattgtccttattatttagttcaacctatctgtgccacttccattttcacagaaaattgatggttttcgagtgaattcaacattctttttccgtgttcaactgcttaatgaaacgcataacacagtgaacataacatttacagatgggaaaagcagtaagaaaagcataaatatatttaaataaatttttattaaatttataatcaaaaataaaattaaaaatagtcgatttaaaaaaataattttaggtgatgtaattgatcagacggaattgaacatcgaaattgagaattttgagacaattgaaatcactgcttcttatgtaatatttaaatttgtttatttttttgaaattagctaattaattaagtactctggatggaataaaacatataaagtggaaagaacaaatacgacaattcagactacaaatagcaacgtatttgaattttttttgaacttcactgatgtgattatgtttaatggagaacacattttacaaaattacactgatgacataccattctgtcatattaaatatgttaaggtaataaatatttattattattattttttaaatttaattaatcaagtaaattagtctgccaattaattaattagattatttattttaattattttattttatttttattgttttacaaaattgaaaatgttgattttttttttttatattctagtatttatcaaattataaccagtaaattagttagcgttctaataatattaaatatttaactattgttattattatatttaatttattaattagtttaatttttttttttattattttgataattcattaggtgatttttcattctgttattatatatttgtaatcaattaatttaggtcactggtgatgccattttattagattcgccaaagctgaatgtgccaccaccaattgtaagtataaataattcttttttattttattttatttttttattttctaggtaaaaaagggagaacaaattattttggcagtgaaagaatttttaaatttcggcgacctaattgttattagtaattataagcaaaaggccaacgaaacaattgttgtcaaattgttgcacggcccaccggaatgcagcaaaaattgtaaagttttgtcatatatttaattttatattaataagtgtctcttcattataacatttaatttgaaatatttgtaaattttaagaccatattattgccaaaatggagttcaaagttgatgctggaggaaatggcaaacagtttttctgtgaacacaagccgagcatggttaaccaataatttttttgtttaattacatataaaaataattaaagataatggatagaatcgaagttaaaatacgaaattcataagcgaaaaataagattttttggtcaaaaataaggacattttgtaaaaaataaaggaggg

SEQ ID NO: 9612 - DNA, 766 bp, Heterodera glycines
aaatgttttctctaatttgcatttttgaaattaaacagagaaactcatagtttatggagtctctctcaactctctgcggttaaacaaacattttcttttggaaaaaccaacaaaattaatgagcaaaaatgagcatcaaaaatgatcagaacagaataatttgtccaatttattatatctcaaaaagaaagacaactcatatttcaattaaaaatggtaatgctgctgttgttgaggcggacgatgtatttagactagggtaggtcgggaccgggaattttcaagttgaaaacctggatcttttggctgggaaaaccgggaatttcccggatcggtactcaattgtccgtgttttggtcccggtcccgaccaatctttttttcagcaatcagaaagatgtgtccctgcgattgtcaggggtgctgttcaagaatccggcatggcatcaatttctaacatattgtaaccccggacccgaattctaataggaagtttataaaaattttcgcatttcaaattttggatcaaatttgtacacggaacgaacttaaagtgcattaatgcttcatttaaactatttttagactaaacatgaaaaatgacacatttgaattaccacttttttttgttcgaattgacccggggtccggaattgatcgaatggatggatgccggattcccgatcggtgaccccgataacccttgaaatatgttttcatgactcttgacaagaaattattttttttctaatgggagcgaggggggg

SEQ ID NO: 9613 - DNA, 1915 bp, Heterodera glycines
tgtcagcttttcattggtccgttcgttcaccaattcaaatggcacaatttgcgttgatttgggcatattaaattgaattgtgtagcaggcagaagaagaaatggcacggagaaatgcctaaaacaatggaaaaagaaaacataagcaataaaaatgaattccaaatgttaaagaaaaagttggacattttaatttgatggcttagcggttctgtgatactcaaaattgagaattatattgttgaaatcaatcttgttttatcaaaaaccaaaaaaatacttgaaaatccctttagtaaatttgctctcattaaatttcattttctattttatgactagcaaaatatcaaaaagaaaagaaaaattgcattataaataggatgaacaaagcgtatgggatggtcgtgcaaatagcgcagttgttactagcgcagccacaggtcacattaaacacgggttcagtcccgctagcacgcaatctttttttaaaatttaattggattacttaaccactacagcatcatttaaagcatattatatattatttaatttattgttgaaatttattttaattataggaaactagtttttcaatatgaaaaattttatttttcaaagaattactttttcatttgtcagcacagaattggtgaagcggaaatgccgtcgacaacgttttcattatgccaattatttataataattgcacaaaaaaataaataatttttaaatattctatttagggcttatattttagtctctaaaaattgccaaaatagatactaaaaaatagaaaataggctctaaaaagcctcaaatttaggagtgtaaaataacaaaattttagtcaaaaagcaaaaaaattaagccaaatgaattacaattgttgaagccaaaattcttgtcaaaaaacaaattaataattttaagatgaatttttgagaatattttcatttcttagggatgtattttcgtttttgttaaatttttaaataaattttgaacataaggccaaaaggcaaaaacagttttttaaaggtttttagactttaagctctaaaaataaaaaccttgaataggcttacaaggcaacatttcgaactgtaaccacccagatcagtttaaaaccacttctatcgtatagagaatgatcgatttactattgccaatttttggcttttttggctccggcgccaaaaatgatcagaaaaaagtgatcaaagtttcgaaaaatcgataaaatagtaaaaatttttaaaaattcataaaaaatttaaaaataaagttagagtaactaaacttattttaaagtgatcagcaaacatttctctatcaaatggcatcataaaacaaatttaaataattgaataaaaatgtgttaggtgaacgaatagtttgaaaaaaattcaaaataattcatcatctgtccagcgggtttgaacccatgacaaatggtaaagagtagggttgagcggtaccggtaccggtactggccggtaattaccggtttttttggtaccggtaccggtaccggttttttcaaaaatgaaattaccgttaccggtttgtctagtaccggtaccgccggtaaaaatttgcactggtaagaatgggggtctgggtgagaaaagagtagggaatggtgaaggagaaattttttgagaaaaaaaaattaaattatttattttcatttaaagcatttgttcatatgcataagtggtcaagtggctaaaccttctgattttattatttctcgcttgggttcaattccccacttggatagaatatttctcacattttctttaccattattttaattaaaattttaattttaattaaaatattccaactttttttctttcatgttaagcatcctaaaaacccaaaaacttaatcaattggtcatttttttttta

SEQ ID NO: 9614 - DNA, 2764 bp, Heterodera glycines
agaaagcgttcccgaataatgtgctaaccggggaatgaaaaggtaattaaattaacttacctatattaggtgaacacaccgtaattctgccgtagagaatgtcgcgttgtccgaccattgaaaccaattctgaaaaatggaaagataaatgtgaatcccatgctgtcgagaaagtcaatcccattcttcctctgcaattgccttggatgtgttttttctgtctccgccccttccaactttcgctggtaaagaaatttgtttgtttatcggtgccattcgcagctgacagtaataagcgctccttctcgtaaatgtatgcgtcgagaacgggttcaatggcctccgaaaaaagactttcgtttctaatccaaatttgttgcttgacagaaaggctgcattggtcgtaaaactcctgaaagtccatcattttaaactatgacattatttgttattttttaaattcattttcattagtctactttgtcgcagatgatcagcttcaaatacctaaacatttaaaaagcatcaaaaatccgatacatttaccggcgctagtttaaagaaggggtcttttgaaatttttttcatttttttgacataatttttttttaaatttatttatacattatgatgaatattaagcattaacaagacaattaaaacgaataaaaagtatattcacgattttttatctcaaaaaaattttgcaaaacaatagggtcccccatattgtttttgataaaattaaaaatctgtcactttataactagcgccaaatttgcttaataggcccaaataattgtcgtatccacgatcagcgacctctaaaacccccgggtacttgggtttcaggactttttaaattaaaaaaaattagtcaaaaaaaaagtgaaaaaattttcaaaacgccacgctttgtaactagcgccaaaaaatgcatgatgaagcttcaaacaaagtttagaacactttttaagtcattttaaggccatttagagtcagcaaaaaaaagtcattttacttaaattcccagccctacttatcattagggatggtaaaaatatggatataaaatcgcgaaatatggccataaaatatggactaaaaatcgcaaaatatggacataaaatggcaaaaatctcaaaatatggaaataaatggcaaaaatgtcaaaatatggacataaatttttcaaaattgggtgcaaaatttcttcaaatttgttggttgaaattgcatatgaaatacatttccaaattttttgactcggtaaggcgctttgacaaagacggctttcgttttgcaattagtcggtcaacattcggaaattggtctcgaattttttcggcaattacgtgcaatcattttaaatgaaaaaaaacataaaagctaaaatttattaatttttttagcgcaaaatcaacaacaaaagcgaaattttcgcttttttgcttatttttgacataaatttattaatttttaagaaaatttaaatttattcaatattctcgagaaattttggcgaaaaaatgatttttttgaaaaatttttcgggttttgggctcaaaaaggctaatttagctgctggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccttcctagaagcttcaaaccaagctaaaaacatgtttttcgtgcgtttcaggcctcccacattccaggaaaaaaatatggatttccatataattaccatccctacttatcatttaactcttttctaaaccagggccctgcgggccctgtgaaagcgccgggggcgctttcaacgctggctctagtgggagatataatttggggcgtgcaaaaagtatctattggccgctaagcgatcctcatagtttaggaatatgagaatttggaaatgaacaaataattaatttaaaaacgatattgttttaaatttaatttaaatgcgatatttttatttatatgcttgtgattttttataagattttttgttaaatgttataattctaaaataaataattttcgagttgtcgctcttgctgctctgacttcctcttccactttctcttccactttctgttcctcttccactttctcttccattttctgttcctcttccactttctcttccactttctgttcctcttccactttctcttccactttctgttcctcttccactttctcttccactttctgttcctcttccactttctcttccactttctgttcctcttccactttctcttccactttctgttcctcttccactttctcttccattttctgttcctcttccactttctgttcctcttccactttctcttccactttctgttcctcttccactttctcttccactttctgttcctcttccactttctcttccactttctgttcctcttccactttctcttccattttctgttcctcttccactttctgttcctcttccactttctcttccactttctgttcctcttccactttctcttccattttctgttcctcttccactttctcttccactttctgttcctcttccactttctcttccactttctgttcctcttccactttctcttccactttctgttcctcttccactttctcttccgcttcctgttcctcttccactttctcttccactttctgttcc

SEQ ID NO: 9615 - DNA, 2246 bp, Heterodera glycines
agaaaaaaaatgagggagagagagagagataggagagagagatagggagagagagagagggagagagagaatgggagagatagggagcgagagagagagagggaaagagagaatgggagagatagggagagagagagagaatggaaagatagcgagggagagagagagagagggagagagagagagagggagagggagaatgggagagaatggaaagatagcgagggagagagagagagagggagagagagaatgggagagatagggagagtgagaatgggagagaaagaaaaggagataagagagagaaaataaataaaaacagtaggcacaacaataatcactgtaattttataaaaaaataaggagaaaaaggtgaccttgtggcaatgtctttgtggacaatgccgaacttctgcaggtgacaaatggcactgatcagctgccttcccagtgagactaagtcgtgcgtgcgcagcgtcgtctccgtttcctcctgtgagcccaccgaatgagtgccggccaaaactgtgccgagaacggacatttgcatttgggcgcttccgtgtgacttgccaattcggacggcgcccgcgttggactgtttggcccccgtcgtcccctgtgccgctccgtccgtttcgtcccctctttcgccagtgttttggtggactccgaaatccatcgaccgactaacactttgacttgcgctactttggcacgagtgtaaaaagtttttcagcactccgaacccattgtgcgcataacaaatgagtggcaaatccttcactgattccggattcagaaaattgccaaaagtcgcagcggcaacgacctgagaaaacgggggggggggggtaaaagacggaaaggaaaggaaggggggggacaaaagggacaaaacattagcagtcaaccaacaataacaattcatcagtcaaattatgtaaatttgtgccatttacctgtgccaaattcgaatgcgcgggaacgtagtgaaattggagcgcattgcgcagaaagcgttcgaactgagtgcgtccggcaccgggcttcagtgtcttgcagatgagcgccttgtcctccttggcgtcgtcctcctcgtcgtccacttcgtccaccatcgccccttgccccgtggccccaatttgccgccaatttgcccataataattctccgtattttcctgcggggaatcattcgcctgtcaaaatcccttttcgcctttcactgaccttccatttcagcacgcggagattgctcaaaactaacgaaaaaagcgattagtattgaatttactgataaaataatccacgaacaggtttctgtccgcatttagctcaaccaatgcttgattaatgtccaacaattgggcctcggacctttcgaaccaaattcggcacaaatggggagggagcaaagctaaaggacggaatgccaaatgaaagagacggagaggaattgagtaaatgtactgaactgttcgaagggtccgaagtggggaagggggcggtggaggtggacggcatttgcgggtccgaagcagaggatggcatcggcactccgttgagcagaaaagcgggcccttgcggggcgcgcttttgcccatcggtcaccgaattgctgcgactgctcagtgccaaactgcttggcgttcgtcttccaatgaatgtgccatcgtaaagtgtgtgtccccccccccttccgtcctgttgtcccttcttacggtatcgttcctccgattgtgtgctgactcggcgaaattgtcgtcgttgttgtcgttgccgtgccaattgtcatcgctttttgatggcattgacgaaacttttgacgcagcgatattctgccggaagcgtaaacagaaccgaatttcccgcctctccagcgcccttcccgcttcattcctccgccgggggccattcgtccgtcgcttttttggcgttttgaacgtaaaaaataaaaacagaaaagaactgatgaccagagcagaagcgagagaagaagagagccgatagtgagttggagaagcagagagggcagcagagaagcggaggaagagggatcagagtcgagcagagaggggcggtgggaagcatcgtcagctgggaggggatgaaagggtaaggaaaaccccgggggtgagaggaaaaaccaagtcgggcgaggggagtggaatggtcaaaatcgaactaatcggggtttttagtgtgcaattcgctgagtaagactattttctcacaaaaatg

SEQ ID NO: 9616 - DNA, 1669 bp, Heterodera glycines
aaaattatgcgaagcggacagagaatttgccgaatacgccaacgcgtcaatgttttatctgccttggtatttgtttaaaacgaaagtggttagaaccaaggacattctggtggcacaggtcaatggccatctgttgccataccgtaccattgaacaaatggtaggcaattggcactaccaattcaaagcattgatggaagaggaatggcacaatgccaatgccgaagagaatgccaatgccaacaatgacgaggaggacgcgcagttggaacagcagttgcccaacccatgtgaagaggcaaagctcagagtgaagaagtgatggctgctagatcaattacaatagtgaaaaatttcgacaaattttttaattttttatttaaattaaattttcgggctgccatcgaaaattttcaaaaacatggactgacttattaaagaaagattttgggagcaattttggctctaatggaattcctccccccccccctacctccctctccccctgtacccttcccctccgcgctcctccttcccccttgccctccccccttcgcttttcatcctccttctcaccttggcttcttcgcggaacattcccttcagctggcaaatggaggaggggcaaaacgtcaaaatgttcggaaatggcgcggacggaataacgaagctgaagggggacaaacattggaaaatggcggaagagcgaaagagtggaaagagggggggggggggggggggagacaacaacttggtccgatcagtgcttttttacatttcgatcccccgcattattccatgtgaagcgcaagtgggaaacattctcagccacgcggtaagggaatcggatggaatattcgttgatagcgcctgctgagacgtaatccatccgagcggaaatacctcaaaaatgtaaagattggaagttcatcaatgatgaaagaaaacgggaaaaaagccgactgaccaagggtacgctgcatttcctcgttggaaatgtacaaattgaaggaacagcggacgaacaccgggaacaaactgacaatgaggatgaccaatttggagatgagaaacggaagggagggggaggaggaggagaagtgtgacgacgaggcacagggacaggacgaggaagaagaagaggaagcggaagatgaagcggaagaagaagaggaagcggaagatgaagcggaagaagaagaggaagaagaagaggaagcggaagatgaagcggaagaagaagaggaagcggaagatgaagcggaagaagaagaggaagcggaagatgaagcggaagaggaagcggaagatgaagatggaggggagaaaggaatagccgcagtagctcttcctcttttcatcacttcttctgatggaacacgcaacaatacttttttggcagtttttttttgcttataattcactaaaaatctgtcgcaaaatatcaaaaaattcttttcaaattttcctaaaacttttggaatttcagttcataatctaccaaatggaaatcgacggcattttccctggcataatactcaccgccccctctccccttagatgtgccaagcgtcgcctacattttctctcgctctctgcaattgctccgccacaccctttgtgagtctaccgcataaggtggccgtgggaatggcaaaaagtggggggg

SEQ ID NO: 9617 - DNA, 1832 bp, Heterodera glycines
actgcccgaagaatgggctgctgatgtcaccttaaagcaatttaatttaaataatttttcgaatcgaaaaaaattgccttaaaatgtcatttaatgaaaaaaaggaagaaaattcagtcttcaaaatgaaagaacattgtcgcttttcaatgtcaaaaattaatttcagttctgcccttaagctccacgagggacaacaaaataaaacaaaaaaaaagtggtgataaataaatgcggggacgaaatgccattgaaatcggaaagccaccaaaagtgccaaaactctgcaaaccaccaaaagtgccgttctctgctgacaacccacttcgttttgctgttgctgctccagcagaggttgttgttgtttgtagagcaacgaagatgatgaagcggatgaagcggaggaagacgaagaatactgttgttgatgatgtttgaatttaatggtagaagactctgaaaaaattaaaatataaaaataatttaattgctttttatttaaattttaaaatttaaaattacgcgctctgatgacatattgtggcgcgtgagattttggtgaaaattttggccacacattgcgctgcctctgctgcggcggagtgcgaacctataaacatggagttgttgaaaaattgtaaaaaaaaacatccccagtcaatttgggcaattattgaatagaaaataaaaggttactcgcccagtgggactcgaacccacgcccttcccataccaaagaatgctcaaaccgactgagctacgggactcttcagagatcctctcaggcctttatcccattctctcccacactctgcttccttaaggcctatcagttgcatttttaattttctaccaatacaaagttaaaaataattttaatattcagatttttcaaaaaatttctttcaacgaataattcctatttttttatatatttaaagaaatatttgcaaaaatccaagttttcaaacaaattaaggttagaaaattaatattttcattttttccaatttttaatttccgactttttgttcgaattctgctttggagcttacgtttgtaaacagcgagctctaaaagctcggaagtcatttttgtaaaaaggcacaaagcaggggatgggccaaattgaaaaataaaaagcgaaatgcgaaaagcgaaatttgcgaaactgaaaaatgtgaaatgaaaaaaaagcgaaatgcgaaaagctaaaatatgcgaaaatgcgaaaggcgaaatgcgaaagcgaaattttttctacaactttttaatagttaaaatcataaagcaaaaatcattttttaaaattttattccaaatttaaaaatcaataaaacgcttttttgaggcgcgctttttccaaaaaaaaactgggaagagggggcaggcgccgccgggaaaatttttgaaaatttgattaaaatttgttgacagattttcactaaaaaatgatcaaattttgtgatttttatcatttttctaatgagaaataagagttttggcgcgccgctgagaacagtttttcatcaaattaccaaattttgcgattttgggccattttctaagaaaaaataggagttttgggggcgcggcggtgccgataggcgccgcaggggaaaaaaattggaaattttgatcatttataaacagtttttcactgaaaattagccaatttataggtaaaattttgaaaaattttatgggaatttaatccaattcttaggggtgtaaaagtcgcgtttcgcgccaaaaagcgaaatgccaaaaaatgcgaataatgcgaaaggaaaaatgcgaaaagcgaaacctaggcacatccctgctacaaa

SEQ ID NO: 9618 - DNA, 1022 bp, Heterodera glycines
  misc_feature (124)..(124): n is a, c, g, or t
  misc_feature (254)..(254): n is a, c, g, or t
cccccccccccgggggttcatgacgacgaccacctgctgcagctgttcaagttgcgccgcactccccggccacgcggtcagcatgacggcgagcgtcgctttggtcggtggtgccgtcgtcgtncgatgttgcgtaaacagcaccaaccagtaaccgttgtggttgtcgcggcaggtgtcgttgacgctggtgccgtcgtcgttcgtcgccgccgttgtcgtcgcgtgcgatgtgccgccaccgctttggcccnaacagcgggcggccgcggcggcgatgccagcaacaattgttttggtggcgccgacggcggtcgttgttgcccatctttgctgccgctgctgctgttgttgtgctggtcgctgatggtgtttgatttgccttagtttttagaatatttttaatatatttattgtataaattgatttttaaaatgattttttcttttcattttttaattttcttgtcacaaaatatcaaatacatttttttaatgcaaattgactttttttttaattttcgaaaaagtccattcttaggggtgatttttctattgatttttgttaagaaatttttcaaaaagtcaataatgccaaaagaattgcaaaacgccaaaataatgacatttttatgacaaaatccaaaataatgattttcagttgcgaataaagaagttaaatcagaagagtaaatacgctaaaacgtgtttttttcgtgcatatttcgtcgaataaagtcgcaaataatcattaaatcacttaaagtatcagaatatgcttaataatgcttacttatatcacatgggctttatgtctttgtgtttcaatttttgttattattctggatttataaaatttcaaccaaaaattggttcggtttttccacgcatttcaatagcaaaatcgatgcaaataaacggtttaatttttggtagaaaattgttgtggcatttttctttctgccgccgccatttctccctcaggggggctggtgccgccgccgctgttccgtttcaacggca

SEQ ID NO: 9619 - DNA, 2240 bp, Heterodera glycines
aatggcatcatcttagctgtgtgatctaataggttacaggtccaaaatgaagaactgtacttttttataaagcaaaaagaaactatatataaatctggatacataaataataatccgcgttacgaggagggttatatatttttgtgaattgccgcgcaaagccacctcgggaccgcacaaattgttggtttcgaatcaacacggacgcacacagttcttacatggaccaagtacaagtcgatttttcgagaaagtataacaaaaaataaatccaaatatgtcgagataattaataatgaggcaattaacgggaggatggagtttctgattttttaaattataactacataaataatatactaaaaataatgtttggatttcatattaataaatttaattttgctataattaacaacaatacatttgtaaactttttcaaaaacagaaacattggataaaataattaatagtaaaatataagattattctgctcgaaaaccaaaaactaataaaattaaatcagtccaatacgttaatataaatttaaatattgcgacgccaaaagactctgaaagaagacaacacatcaagaaaattttaaaactatatttacaactaaaacaaaaggaaacaaattaaaaaatagcaatataacacgaataaataaaatcaaataaatttttgtttaaaaaataataattaatttaaaccttgaaaaaagatttattgattcatacaaaattttagtcgtaagactaaactgattattggagattattggagaaaaagcaagattaattaaagtttaaagaaattattttaattttctcaattttaaatcaaaaaaaaaattattatattttttaactaacatcgaatttaaaaataaattgaactattataattttttaagaattttcgaagcaaaataaatgacaattttttaatttacccaacaaaaattacatttttaacaaagaaaaaactaaaaaaattattaattaaaaaatttgtgacggcttaaatttattaaaattaatacttattcagtataaggctgaaacacaacatgtgggaaaattccatgaataaaaaaatgcatttattaaataaaatgcaataacatttaaaatgtttcatatatgaatttgagagtgaaatgaggaaatgaaacgtgagataacaaatgagcccttaaagaaattaaattatgcatatctgaagaacgaactgaatttgaatataaaatcacagtaattttatagagataaattaactataaaaagaaaaaatatattaaaattcttcacgacgtaattttataattggtaaacaaattataaactttcaatgtcaacagcatataataaaaaatgcactgaattatgtatatgccaattacaaaagaaaactaacatcatagaactaaacaaataaacattttattgatgatgtaaatttattataagcactaatgatcatattaggaataattaaactacaaataaacaatttagtaaaattaaaaaaatattaaagtgttttcacaaataaaatctgaggaaaatttaaaaaaaacattggagtactggatgtgctaaaaacaataatacatggcgagaaaaatgacccttgcagttgactaagaaaatgaaaaatttatttaaaaaatttataatttatattaattggattaaaaaattaaattggcaagaattgttgatatgcatattacaataaaaaactaagttttgatgttataatgtattataagcactaataatcattaagaatattaaaccaaaaaaactatttagcaagatttaaaattataataaaatctgagcaaaatttaaaaaacgttaaagtagtgggtggatatgataaacccattgttacgtggcgagagaaatgacccttgcagttacttggaaaatgaaaaatttgtaaaaaaaaatattcttaaagaaagcgatgatcaaatatgaaggtaatacattcaaatttttctatttaccttcaattatttgaaaataattgcaactttaaaatagttttcaatgagaaaaacatatttaatataataaatacaaatattaaataattaattagactaatgaattaaaacaaaagataaaattctttcttaaagaaggcgctgaattaatattaaattaaaaaaatttaaatttatctaaatttggtaattgttgaaagaattacaaatatgaaacagattt

SEQ ID NO: 9620 - DNA, 1968 bp, Heterodera glycines
  misc_feature (1900)..(1900): n is a, c, g, or t
  misc_feature (1927)..(1927): n is a, c, g, or t
agtcgagatttctctagttgtttgtcaaaaaaattaatctatgcatgttataaatatattttattatttaagataatttgcttaataatattaaaaaaattaattataaaataattttatttgattaatttgcttagtaacacttaaataaataattataaaatttttgcggtttccgcaaaatacccatttttgcgggtttcgcgcaacgacaaataaataattctatcaaaaaaatttaaattttaaaaattattttctaattaaacgaattaaattttgtcctcctagcaaaaatttaggggcttaagtaaattaatgttttacaattttttacctttttaacagaaaattgaattgacaattttaagctcatttttcactttcattttgttatttatttagctaatttaatgtattttacttcagttttttgtgatattttctctaattccattaaatttgtcttcaaagcatcaattcagtgattcgattaattgtttttcctagggctgattgattcatcggtcaaaatgtttatgattgtattattctgattgaatgagcctatctctacaggaatttaaacacaataatttatgtgaagcgtaagatttaattgattttaaaattcacaaattaataatatgtcataccaaataatttaggtttcaacaaattttgcaaaatatttaagagaaaaacttattaaaataagtaaaatttatatgtattagtaatttaaaatttatcttgtaaattcttatttttgtaaacttttttatctaatcattggtccattactaagtctgccaattaaggtcatttatgctttcaggcagacaagcggtcggacatatccagccagcttccagcaacatagtataatattcaatgtttttctaaaatatttttgtttacgattaattctcttattttttctttgtgatttcgcaacctttaattatttgctgatctgatacgataccctttcaaatatctataattatattatattacgcaagaataattttttagaagtttagtttctctttatttttattcttgcaaatttccatcacttttaaaaatttattgtaaaaattttaagtaagaaaatttatttataaaaattattttttgaaattttattaagaaattatgcttaaagagattaattctgtctgcagtcatttttccaattataaacttttttgccgagagaagaatattttctctcattcattttttttaatattgagaatattttttattaatttctaatgacaataatatgtttttagaaaataaaaattttattaattagaatattaatatttcgagttttctatttttagcatcactttaattttttgattggtagctttaatacttgcccattgatgtggttcggcaagccggcattggtgcaactggcttttatgcaatttaatctccattttttagtatatttatcaattattcactaataattctaatcatttgtttttcgtcatttttcttttgattataaaacatcaactaaattatttttattaagttgtaaatttaaaacatttttttcataaggttggcttaaattttttgtaatgtatattaaaatttttctaataataaagaaaacataagacaaatttctcgaagtgatttagcttggcggtgtttaagtaaattttaaatattttgttgaattaacttttaaaatttttacaaccctccgattcccggatactaataaaaatatgattgatttattgcaaagttataagcaaaattgtcgatgattttttgtcccaaaaataaaattttcaattttttacaaaatttcaaaaattaatacataaagttttagggtttatttttgtattttttcttctanaatgcgttgagatatcaaactcttatnttttcacatttaagaacgaaaaaatgaaaaataaataaact

SEQ ID NO: 9621 - DNA, 1155 bp, Heterodera glycines
  misc_feature (46)..(46): n is a, c, g, or t
  misc_feature (54)..(54): n is a, c, g, or t
aaaaatgaaaatataatattttaagtattaataattaaaacttaanaataaatntaatatagtaagttgtttaaaaaataagaaactaaaataaataaatttaagaaaaataaaaattaattaatttaaaaaattagagtagaggggaccggggaatttttggctgggaaaaccgggaaaaaacccggggactgttcccggtcccggtcaaaaccggggacctcggtactcagttgtactcagttgtccgtgttttggtcccggtcccgctctactctataaaaaatataataaaactaaaaactttacaaagacgaatattatttacttaataaaaagagcaaaaagaattaattaaatttttaacactttcaattttttcaatcaatcatctttaatctgcaaaaatgttaggcctttctcatttaaacatattccttcagctatttctatctgaaaaattaaatcaaaatacaatcctgaaatgtaactaaatatgtatttcatatattcggttattaccatagcaaatttaaaaatatatgaatgattaatcatttttataaaattcatattaaattgaagaaatattaaaaataaatctatttaaattatttacgaataaatttccgacgaaaattcaattacaaaattaaaaattttcagtttcgaatttttccaatcaaacaaaaaccgtccgaaaaaataacgctaggacgagaaacttaagaataataataaaaataagtaatttctaatttaaactttaaaatcaaaaataattaaatagaaatcaaaatatgcaaaataaaaagagttatataaatagaatgcttaatttaaaaacttgataacacaattttgacgaaaaaatggaaattaaacattattattattatcatttattattaacaagaaaaaataaatactaaaaacgctaaaaatacaaataaataagctaagctgaatccgggagaaggggatttcattttagctataatatataataatattcaaaaaagggaatgaaatattgaaaaatactttatccccaaaccccaacgtgaagaagaaatcccactttcctatgcgaggttcgagcactgctaacacataagaattaatgaaagctgctcaaatataataatgtatcta

SEQ ID NO: 9622 - DNA, 1460 bp, Heterodera glycines
  misc_feature (1443)..(1443): n is a, c, g, or t
ggggtgctgttagttttcgacagtggtgatctcgacagtgttggtttcgacagtgattgatttcgacagtaaagcttgtttttaaaaaaacaattaaaaattactgtcgaaaacacctggtacggttcttagattacaaaaatttaaaaaataaaattagtcttttcgttttgataatttcgtttcccttttccttttcttattatttttctccaagtatttctgcaaatgttttttttaacttttttcttttccattccagttttaatttgaacaattaaaaatgcaattgaaaagaataatagacacaatttcattattgacaaatattcataaaaattaaatgtgtttttcgtgaattttttggcgaatttttaaaaaagaataaaaattttacgtggtgttccgaactaggcttttgaagggaaaggctgtatattcagtcccaaaattattataataaattctttaattgttttaatttacttttccttataattataaattttaatatttaccaaaaacaattattcgcagagattggacataatctgttaaatagccataacaaaattttttttacatctataaaaaatatatttgttagaaaaatatccaaaagtgttttttgaaaattgttggaagtttagatatttggatttttaagtacccaataaaaattcttgagaaaattctacttctcgagcctcggggatgagtctctgtttaaaaaaaacattttattttttggaaatgatttcaccccacctcagccatatacccccacactactcgcacgttaacaaaatctccaacccgactcctcctcctcctcctcttcgtcaactgcgtcagcagcggttggtggcggcagttcagcggaagacagaggcgacagcggctaagggccgttggctctacgaattggacgccaaaaaatatgccaagaatgctttgcgtcagcagcgcatcaacctgaaaaatgggcctttgtactgcgccggctgtcatgcactgggcaaccacgtcatatcggactgtccaatggacaaaggtgtttttgttttgcttgataaaaaaatatgctaagcaacttttttaggaagatatgccgccgcctcagaagacgcagcgcaccaggctgaggattgtgtgcttttttgccgctgtcaatgctgcaagctgcggggacacaaacccaaggactgtgagacccttatggcctggcgtaagtttccatccatttgtatttacatctatatatatacatataattgtactattcaggggaacacttggcaatggcgtcagccggcaaaaagcacacattccttctcggacacaagcggttcagctcaagaacctacatggaggagcatgccgtttccgctgcgtcagcatgggaaggtcatgggtaatagtgctagtggttatttgtttaanttaatttgttttaaaaa

SEQ ID NO: 9623 - DNA, 1754 bp, Heterodera glycines
tgaaaaaatacataaaaaatgatgtagtaattaagcaaatgatcattgcatacgatatcaaagagaatcgcaatgacgctgatgtgctttcccacttgtacgcattacaatatcgtttagggatgaagggttttgaagcgtgggattagaattttaacgatgaaaataaaagaattgttgttgataaaaattttgtcactgtgggtgggcgccgcaaaagtcggcgccgcaagtgtcactttggctgggcgccgcaagtgtcggcgccgcaaaaaaaatagctgcaaatgtcgggccgcaagtgtcagcgccgcaaaagtcggcgccgcaagtgtcactttgggtgggcgccgcaaatgtctgcgccgcaagtatcggcgccgtgaatgtctgcgccgcaaatgtcgcatcacctatctatgcacaaaaataaaataaattggcggcgacagtccgccgtccccgttttcgtccgcttccacagcggcggacctttcgcccgattggtgctgattagaattgccaccggcgccgcacccgtcgaactttgggcctcaccatcagctgcagcagaataatccgtcgttgttcagacagcatcagataatcgtctcgttggtgtttctcgaaactatgaaatgtgcccgtaatcattttcaatgttttgttattttttcgttgttaacacattgataaatatgttgttattgattttaaaaattttttcaaaaaaaatctgagtagaatctattttggacaaaaacagcttgccgtactaaaccgaccctccgactaaaccggccggactaaaacggccggactaaaacggcccgactaaaccggcccgactaaactgacccggtccgccgtttcaaacatttttggactcaaaatttttaattataaaaatgtgaatagaagcttaaatatgtatgtgaaaacagttaacattttgattaagaattaataaaggaatattaaaaaaaaacttgacacgaaatttatgctgatttaaatgtaaatcttccaaaaataaagatatggacaaaggccagggccagcagacttaaattaaagaagcgaaattaaatgaatgttcatttaaatgtagttgaattatttggccaataaaagttcattttaaagttgagattgacttttttttggttcgggattcgaaatagatgtaagactcgctgtgtaaaaagtggagaccacttgcaaatgttcaattattttggccttttgtttatgtttgtgattctcattttgtgttatttttgtttctcagacttggaattaaatttggatttgcttccaataaatgtgaagcatccttccatagaatcgtaggtccggcgcttcttgaggaagagtagaattataaggatttcaaatctaaaggaaaggccttcagggagtgggccgaccaagcctgagcgactgttgacactagggttgagcctcgacccctcggagggcaaaaaatatcgggggacgggggccatcggcggggggcgcaatgtcgggggtcgggtcggggggagttaaattgtcggcggtcggggaccacgaccgggaagtgatcaacaaatttttaacataaaaacccaattcttctttttaatgctcgtaaataaagttttaagaactcaaaatcatctttttcttcacattcatcatctgattctaattcattccgttggtggccagtaaaagtgccgtcctcgggcgcagggttggcggttttacca

SEQ ID NO: 9624 - DNA, 1258 bp, Heterodera glycines
  misc_feature (136)..(136): n is a, c, g, or t
attcattcgtgggtgccagtaaaagtgcgttctcgggggcaggggttggcgttttaccatggtacatgggttaggtacccataaaccatgtcttttactgtgcgttcacaaaccaccaacatcatggtcaaatgancaggttaaatgaccatgaacccgtggttgctcattgctacgggtaaccatgatggttgtggttatttaaccataacctccttcttttactcggccccagggctctaataatgcgtaggtccaatcatgatttaaaatttgtacttgtgtttgtaaataaattataaaaaaattgaaaaatatattttaaaaaatatgtacaaaagcaaagaaacaattatcgtaaagaaaaaagcggtcaaaaaaacaaattttatctcattaattcagttctccttaattacttctccaaattgtttcttccatctgcaaatggtcccttgattaattttcaatatttttgcaatttttacgtcactgatttttggattttcttttttatttgccaatattgtttcgttttttccatttttgctttttcagttttcctttcgcccataccaaattgtttcttccattcatcgattactctacgactaactctaattttcttgccaatttcggcataattttgttggcattcttttctcgaatattttcttcctttttatttttattgccataaatttttgcacaatttcaattttttgttcatccgtttttgatttgttgtggcatttgtataagcctaattctttgatccatttataaatatatttgcgatttgggcccaatttttttccgattttcaattcaattttattccattctttttgtggaatatttttttccttttttcttgattttctcttttattttgttgaattttcggattattatttctctcgtttcttctttattttgattttgatcattccgtttttcttcccattttccggtaggtgaagattcattgccgccgtttcgctgccgccctttcattgtcagccgtttcattgcccgccgtttcattgccagacgtttaattgcaggggtcgtttcattgccaaggtgggtctcactgccaatatttttcggtaccatattatttcactataataattaaattaacacatttgctactagattcgaacttaaagcaatttaatttcaacaatttgacaataacaaaaaatcaggggtccatcgaacaattgtatgagacaccagcaagaaaatcaat

SEQ ID NO: 9625 - DNA, 4595 bp, Heterodera glycines
  misc_feature (4591)..(4591): n is a, c, g, or t
aatttggtgatttgaacgaagaaaattgacgacagagtgatcgatgtaactgcaaaaagggaatgaatgaatgcttttattgccaagctcagattttgaatctctttttttttaaacccaaaatattttaataaattctcttcatatttttctcattttaactacaaatatgctgaagaaattgttggggtgttctttaaaattaatcaacatttattatataattgatgtgttaatttgttttgtttatttatttttagtttttattgcatatgttttttgtttggcgcaaaatatgttaataaaatagataaaattttcaaaaattatgtggtcaccaagccaaaagttgtgaattttttaattggaattggccttcccccggtcgcggtccccatttttgtagattactatttttttctgcggctaccaaaaattttcaaaaaatcaatgcaggatcctgctgaatcctgcataaaaatctaatttgcgggtcctgttgcaggattagaattcaaaattttttacaggacaggatccggcaggattaatcctgcaaatcctgtattttcccaaaatatgcaggattgcggactgggatcctgcaaaatcctgcgcaggatcctgtcctgcgccggtctctacttgccattctccaaatagtcgtccattgtttttgcattgaaatgaccttccaaaaggccctggagagtgaaaaagtgccaacaatcaaaaattaattgctcaattaataattaattaattaccctgatgaacaaaagaatgtccactgattgtgagccgaacacgagaaatggtcgatagataacacaaaagttgaccatcccatgggctgctccgtcgttggtagtcgacttcttcaacagactgaacttcttgccgagttcggcgtgtctttcccggtccccaaattgtgcccggccttggccctctttctcccccaattctctcagcaatttgatttcttggtcctcattttgctcctcctcctcctccccctccccttttccgtcctcaattcccccctcattcgcctctttttggccttcctccgcatccatcgctgcgttcgccaaattttggtcgaaatgccaaagcatcgtttgccattccgtcgggtcaatgttcggccacattttggcagtgaacaccagcagcagtggtgccccgttgtgctgctgctgctggtcaattagcggacaaagatggcaaagatcatttgactttgacttcaatttatttagttatttattttcacattattttgtctttttaaatcctgtgatcatcactttactttatcacttactctacgacacatttaactgaatagtcgtcagagtaagtggttttcgcccttctgatgacttttttatttttatgaataaaataaaaaaataaagaggttttttccataaaaaacattattaccactgataaattatgatcgatcggtcattcttaattaattcatttcttctgcttatcattgtttttatttgttgctttgtccgtcactcattgtcagaagacggctcatttgtgatgctttgtcccgcttcgtcttcttcttttgctggtggtggcggagacaatggccttaattaagcgcaattttaattatttatttttattgctcacccaatgcaattagtgccatcaacaagccaaaataacacagtgttccaattttcatctttcttttgatgctgaatcgccgcggtctccccaattttgcatcgtttcattatccaacagttgatccattcattttcgttttctttggccaatgtcagcttttcctttgtccattcgttcaccaattcaaatggcacaatttccattgatggcacatgaacataaaaatgaatttggtaactgacggaagaaatggcacggagaaatgcctaaacaaattggaaaacaaaaatagaggcaatcaaaatcagtaaagttgtaactaagtcgcagaccatttggccaaatggtctgcgactcagccataacaaaaaaaaacgaaatttaatcaccaattccatcaggcaacagaccaaatgaatgaattgaattcagcagtttgagatcagtgagaattgttggcgaaatgcgacgacgcaaattgtccaactgatcaccattggtaaagcccaagtggcgaatgtttgacgcaaaaattggacatatttcacgaacgaaaatgtcaaaaatcagctggccatccgtgatgtgtgcggaataaatccacaactctaaattggtgcctcttttgtcgaaaatttggtgatttgaacgaagaaaattgacgacagagtgatcgatgtaactgcaaaaagggaatgaatgaatgcttttattgccatagctctaattttaatactcaatctgaaggcgcttaaaacgaatttaattcgcttttgccatcaaaatgtttgtccaccaacgaattgaaacgtggcgaaagcagtgccaatttgaggccgagttgggcatggtcaaaacaggggaaaatgtccatccaaacatcattggaaatccaactgaaataatgaaaatacctaataaaaggatatattttcatattttttgtagaaaattttaactttagtaaagagaattttaacaaatattaaacgataataattggcgaaacattggcaattcggaaaattgccttatttcttaacaaatttcattaaaaattcaaaatttttacgatcgactaataccgatttgtgaggaaaattgtcgatcgtaagaggagaggggtagaataattttctttaaaatttggcttaaaagcataacattgttaattttttggtgaaaatttgctagaaatatgcaaaacttaggcattttttggcaaaaatcgttaacaaatcgcattaaaaatggaaaaattgttcccggcggcgcctatcggcaccgccggacccccttttcccaaagtttttttgaaaaaagcgccgcaaaaaagtcgttgcccgggtgggaaccccggacccaaacggaaatcttgaaaggaataggcgttaaaattttttaataacactggagaaaacaatgaatgaatgtttgtttgtatgtatctttagaatctgttcggatactgaccagggttgttccgggacgagaaaaatatcgggatttgggtttcgtgattcgggtcataaatattttttatatatgttcaaaaatcaataagaaaattatattaaaactttttgggaatatgagggagggggggggggggcgtcggcggtgccaataggcgccgtcgagaaaaatttgaaattttgagtgagattcgttacagattttgtcaaaaaaccaaatctttggttaaatttggggttttagactgttgaaaaaagaaaaaataataatttttaagttgaaatatttgtctttaattaaatttcaattgaaataatgtgaagaaaatataaaaaattcgtgatcagcggcaccagaaacccctataaaatgtttaggtatacggctttttaaactaaaaatttaatgggcaataaaaaggtgaaaaaatttcaaaagagtactctcttaaagtagcgccgaaaaatgaatgaaataagaagagaaaaatgagtttaatgagggggaatttatgctctgaccgaagtggggtcatttaaggattagtcatgaaggagaacactaattagggtaatttgggagaacactaattagggtaatttgggagaacactaattagggtaatttgggagaacactaattagggtaatttgtttatgcaaaaataatgacatttcatttgtccattttttccacctttttttgcggtgcgttttttaaaacttcggggacagttggggtcgggcggtgccggtaggcgccgctgaaaaaattttgaaaattgtcttcggatttgttaacagattttattcaaaaaatgaccaaaacttgttttttttattttttgtttttaagtcgctttttttgtggcgctgttttttcaaaaaaacttttttggaacattgggagcggggtccggcggtgccgataggcgccgccggaaagtttaattgagaacactaattagggtaatttgtttatgcaaaaataatgacatttcaaattgggcagcgaaatgacttcgtccgtcccttcccatgcccttttgttctttgttgggtcatttctttgcttttggcagagaatttataaaaatgcaagccagcagaagacaacataaaatgcattttattaagggaatgaaacaaaccatattgggtacagtgcagggctggccctgattgaatttccaatcacgggaatccgtgagccgtgatcacggcaccacaaaacccccgtgatttccgtgatccgtgattataaaaaaaattttcaaatgatttttttaaatttaaatttattaaaaaagggaatttaattgctggaaaaattcccaaaagatatttttaagaaacaaaaaaacacaatccgctttttttgcggcgtaccttttccaaaaaatgactaagtttacgatgtgaggaaaattaaaactttttgtagaaatttccanagaa

SEQ ID NO: 9626 - DNA, 1391 bp, Heterodera glycines
  misc_feature (1358)..(1359): n is a, c, g, or t
tatatatggtcaaattcgttgtcaaaatatatatattttaggttagtaggcgaaatgaatgttttttggttagtaggcgagatgtcgagtaggcgaaatgaaggtttttggcttagtaagctcaatgaatgttttcgggatagtaggcgaaatgaatgttttttgcttggtaggcgaaacgaatttttttggcttagtaggcgaaatgtcaataggcgaaatgtcggtaggcgagatgtcgagtaggcgaaatgtccgtacaccaataaaaaatcgtgaaacttttaaaaggatttctcggattcattgatcattttgaccttatggtgaacatttttgaaacattattttttgaatttgatttagtggttgttttttttcagtttgtttatttggtttttgtgttccttgcgtgaaataattatgccgatgcttaggcttaatgtttaattgttattagatctttgtttttttgtctaatttttctgatttagccaaaattgaagtgaataattaaagtaaatttcaacaggtttaaagtttctgctctgccggttcggcaatattctcattccacactaactgccggtcggccattcatcatagtgcgtagcatttctgaataagttaaagtaattgtcttttgtactcagaattatgtaaaaagtgagctaaaatttgtatttgtggctgagactgtgatttagtttttccatatataattgtatttgcaaaatttagataatgaactaagtgtcatggaggcctaacatttgttgaatgcattgggatattagttttgtgtcagtcaaccacattagtgtggtgtgtggttcgtgttagacaatagtgtggtgtgtgatttatgtcaaacaaaaaattcactaacaacggctgttaccagcatcatctgcagtcaggcttttgcaagcggtcgaaaaagtgcatacatccaacccattgagccaaaggagcgcgacccctaccgcattgttgcatttgatttggaaaccatgcagcacatgccatctaaaaagcccgaaaagcgtgaacatttacccaatttcatcgctgtgcgtgtcgcatgcccctactgcattgaaaatgagagctggcgagaggcatctgaagggtgtgaagtgtgcggtccaagcagaacagtcgccttttgccaacgccacttcactgaaacaacagtcgacaagcaagtggtagcggaaaacccattggaagcgtttgtcagttggctgattaacgacttgcctttggcatacgacacctatgccttctcgcactttggcggccgcttcaatatggtgctggtgttccgcgaactgttcaaacgcggatacaatccnngatatgtgcgcaaggtaattgactatttttca

SEQ ID NO: 9627 - DNA, 3428 bp, Heterodera glycines
  misc_feature (17)..(17): n is a, c, g, or t
  misc_feature (124)..(125): n is a, c, g, or t
  misc_feature (201)..(201): n is a, c, g, or t
agagggcgagaaaattncatattatgaattcacgtcccctctaacccgtacgtaaagtgagtttgtgtttcggtcctttacaatttatacttttattttctgtttctccacccacttacccganntgaacatccaaaaggtgctcatcttgaatgaggatgtggagtggacaagagcacgggacaacccttacaaattgtnctctgctcaaggtgtgggtgatccctccgcggaagtgcgatgtgccagtgctgcccgtcaaagtcaacgaacggctgtgcttcccgttgtgcatgcagtgttgtcttgactacccaaaaggaggcgttgattttgactaccattgtgaacacgacgaccaacaacgcggctgggtaacaacatgcacatcaattgaattggatgctgcgcttaatgagggctaccgtgtgaccaaagtgttccgggtgctaaggtacaagcatggcgacgacaagctattccgcccatacatcgctgaattcatgtcgcaggaaattgaagcctccgggtaagagttggagcagcagttcatcacgaaactcggaatttcaattgacaaggacaacatgaaagttaacaagggaaagcggtcgttggcaaagctgtgtctcaacaacctatgggggcgcttctcacttcgaaactttggccttgcccagacgctaatcaccgacgaccactctgtgttaacggaatacttggataaccgtacagttgacgtcacttccgttgatgagctggacgacgaacaccttttgatcagctatgtacagaagaaggaatgggtggagaagcacgattgcgccaatattggtgagattttttcattaatttttgcataatttttgaaattttttcagtcatctaactctggacaacatcaaagtcacgccttctgctgttgaaagcgatgcagaaggtgatgagaacgcctggatgctgactgctgtacactgacaccgactcgttgattttcgtccatccgatcggcatgaatccactggagacaggaccacatttggggcaattcatcgatgaataccccaagcatgaaattgtggagtattgtagtggcggagcgaagcaggttaatttacccttttaataattcataatttattcatttcagtatggactcaaactccgggtaatgggcaggacgaatttgtactgaagctgaggggcatcacactgaactacgacgtgatgcagaaccagtccctctgctacgacacattcaaagaagaagtgttgcggtacgcccaaaccggagaatatgagccaatcaatgtgatgtaccccaactttttgagacccgacattaggagtggcggacacgtcacttcaggccccttccaaaaatgttacgttcaccattcattgtatctctcacacacgcataccctatacacacacacacacaccccatacccacgtaccagggctggccgtgatcacggatcacggaaatcacggggtttttggggtgccgtgatcttggatcacgggtcacggattttttcaaattttccgtgattttgatccgtgattggcattttatatagggaatttttattgagacgaaaataggaaagtggtgtgaagaattttttgagaaaaataaataaattcttttctgcttacaaattcgaaagtaaacatatatatgtagtctggtggttaagccttctgtctttcgttgtctgtcccttgggttcaattccccattgggataggacaatttatatattttgttttgataattttaattgaaatttaattaacaagaaatttcataacattgaaaattatttttctttattttttaaaacgtccatataccaataaattaaccaatgattggacatattttggacaaaatctgtcaacaaattcactcaaaatttcaaaatttttcccggcggcgcctgtcggcaccaccggcagacggacccccattttaccgtatttttgaaattttgaccccaaaatggcagaaaaattaccatttttggcatataaactgctaaaaaccctatttcttctctccgtcgcttaaatttaaaacgacaggcctaatcaaaattttcagaaaattttcccaaccctctaagaattttttctaaaattttcctgactttcagtatcttttggggtgttcagatcgtcatgaaggactgagcatgttggtccaaaagatttttttcagcatcaaaagttagcttacaaattagaggaaatttttttctctacataaatagatttttggttaaatttaagaaaaatttgaaaaattttcttaataaattagttaaaaataaaaaattttccttggagatttctacaaaaagctctaattttcctcaaaaaattgccaaaaatcgtaaacttagtcattttttggaaaaggtcgccgcaaaaaaagcggtttatatgttttggtttctttaaaacatttttgggaatttttcccgcgattaaattccgttttttaaataaatttaaataaaaaatcattagaaaatttttttttataatcacggatcacggctcacggatcacggaaatcacggggattttggggtgccgtgatcacggttcacgggtcacggattttttttaaagccccgtgatcacggctcacggatttccgtgattggaaattcaatcacggccagccctggtcagtacggctcttcattcagatatgtataaagagaataattgtatttttttattttcaggtatgcctaagtagttaacaacaacttatttacaattcaaaaattaaatggatatgacatcggctaaacttgaggcgttcaacaagcttgaaaataaaaaataattatttaattgtttgctttttatatttaatttgttgaaatttgctttttgtttatgtgactctacgggatgaatccaaacatcaaattgtgtaataaaaattcaaatttacgttcatagtttatttggatttagaagagccgcactgaagaagaagcccacttttccatttattttttcaaatgaaacatttttcacgaattttgcgcaaatgtccgcccacaaattccctctgcggattaaattcagtgccgtaaatgttttctgatttatcataatgttctgatttgtaatttctccgatgtgccttttgtcaaataaattttttttaagtttcaaagattaaattaaattaatttttttttgtttttccattttaattccccccccccccctttatacttttggctttgttcttaaattaaaacctttgttcgcatggcacctaaaaagggtatggaagttcagcacgcaaaaaggtcatttttgagtaactattgtaacggatacgctgctacaatattaataccctctcctaatgggcatcgatgttcaaaaag

SEQ ID NO: 9628 - DNA, 1891 bp, Heterodera glycines
  misc_feature (80)..(80): n is a, c, g, or t
cacgtacacacgcatgtaccctctttgtttttcatgttttatactcaaattgtgtaattttgtcattttatttgcgtttntaataaaaatgagtgcataattaagcaatggaagttacaatttggaaattattaagcatgtgggaacgtcatttttaggtagaaaaatgcagaattaagagaaagaagttacaatgcaaaatatgcatatggaaagtcatcatagaagcttccaaccgagctaaaaacatgtttttcgtgcgtttcatgcctcccacagtccaggaaaaaaaatatgtatgtgcatataattctgagccatagagataagtttttaggcaaaatattttaacaatcccatcaaacaaaaattttcctcgccgcacgaacatttgctgcgtgcgtatatgtgacgttttgtcggactttgctatttgagtgttgttgtgtttgattcttactagagttgagcgggaccggggcgggaaatcccgggtttttcaggtcccgatcccggtcccggtttttggaaaaacagaaatcccggtcccggttttgccagtcccggtcccggcgggactaaataagcactggtaagaatggggtctgggtgagaaaagagaagggaattgggagggatcagaaatttttgataaaaataaattaaattatttattttcatttatagcatgttttcatatgcataagtggtcaagtggctaaacctttttactttcattatttgtctcttcggttcaattccctgatggaacagaaaatttttttatattttctttaccattattttaattgaatttaattaataaaaaatattttaatttaaaattattatttttttcgtttttaatagcctaaaaacccataaattaaccaaatatttggtcattttttgacaaattctgttaacaaatctcgctcaaaatttcaaaatttttccggcggcgcctatcggcaccgccggatcccgcgccctcccactgttccaaaaaagttttttgaaaaaacattgccacaaaaacagcgatttaaaagcaaaaaatttaaaagattgtaaatttattttaaaaatacagaattttgggactcagaaaattccaagaaccccccctgaaaacaaaatttttaaaaattttcctcgaactcgtcccccaaaacgtaaatacaaaattttattggtacatttttgaatattggcaattttcgtaacaaagtgcacttaaattttcaatttttttcaaaaaaattttcacttgggaaaagtcccggttggtcccggtctcgggtttttcgctgtcccggtcccggtcgaaaaacttggtcccggtcccgacttttctggtcccggtaagtcccggtcccggtttttgtcaaatttcccggtcccgctcaactctaattcttactcataaatatttgaaaaattaaaaacaacacaggaaattgtttatttaatgacagtttttatgattctcccatttttttcgtgatgcgacatgtgcgccgcagacacttgcgtcgcgacatttgcgccgcccagccaaatcgacacttgcgccgcagacacttgcgccgcgttttttgcgccacagacatttgcgccgcgatttttgcgccgcagacacttgcgccgcccagcaaaatcgacatttgcgccgcgacatttgcgccgcttttaaaaaattttaatttcaacaagatatttaatcaaattaaattgattaaattagttccattcttcaaatcccttcattcctgggcggtattgaagggcatgaatgtgtctgatcaaatcatcattgtttttgttctccttggcatcataggcaatgataagcctccttattgcctgatcatttttccgcatatttttt

SEQ ID NO: 9629 - DNA, 2948 bp, Heterodera glycines
cagcttgctgcctgaggtcttttggcactaattcttctgacattttggcgccctatccctaaataagcaaaaagatggcaccaccaaaaattcgattgaagcccgggcgagggatggacttatgctagggagcggggcgagggacgcaaagtcggccaagtgacaaatggcggatgggccaattagccagggatttcccagcggacaaatggttccattaaatttttgggtcgcgggtttggaaccggacgaatgaaagaatttccgattaactgaagaagggcgatttgctgtcagatttgaactgacaatggcatttttcaatttaaataatccgaattcataccgtcggtcattttcataaatattttccgctgtttttttcctaatttttaattgcccctaatttatttaatcgaaatttcgtccttaaaaagggaaaaagcatcaaaagagtctctcctgtgcatttcttctgccccgtcccttttcattccttcattcattcatggccaagtcagctttctcatgttcatttgactggataaattggaccctcccccaaaccgtgggtttctctgctttttctccgcttatcgcttccgtggaaaaataaacgaacgaatgccctccgatgcatttaatcggaaagccacacacattaacacacaaaatgggacgaatgaattgtaatgtgcaaaatcaatctcaaaggaaaagcggcggcgctcgaaaatcgatcgattgatgggccaaaggaatgaatcatttcgaaatgccatctccgaaaattaatttcaatgcctgaatactttctttcactcgtttgtcagcttcttctttgtcccttgtcacctcttcggacgtgagtaacctgctcacaagcgaagagtgccaaagtgttcaatggcacgcaatgcccgcccccacaatgacgggattaaaaatagacaatttttatttttaccaatttaatgccattcgaaaaatcaaaaaaacaatggcaaagaatgcctcgtaaaatccattatgtaaaaaggtgtttttagctttagatttggctaggtgtcagttcgccgttcaatggtttgtccgcccctccgtccgcttcttccgctcgtcggtctgctcaatgtttcgtccgcgtcgccctgccgctgccccgcgtcccctcccctctgccaatgaatgcgttcccttccgttttgcgcctccccttcgtcctcttcctctgcttcttcctcgttcttttctcccccctctctgctcctcttccctcttcctcctcttcttcttcctcttccgcagcgtcgctttccgttttttcgcgcgaggacgtcgccctcctttaccaaaggctcaaagcgacaggggaaaggacgaaaaataacggcacactaaatcgacggacaacggcaaaagttacgacagaagcggcaacggaagcaaaagcaaatgaagaaaaagggagcggcggacggaggcggacgacgccgacggggacgaagacgcggcacaagtggcgcaacagagagcagcagcggaacaacgctaaaatgagtgagaggggaggggggggggagacgacggatagccaaacgaactgaatagcacagggagtgaccagtgactgattaagcatcccatttgcctcttcataaagcatcccccccctttggtcaattggccactcactctctcttcccctctttccctctctcttcccctctttccctctctctctctctctcactcttcccctctctctctctcccttcctctctcgatttcaatatttgtttcggcacttttagccaccgtcgtccgcgcgggtgcttctgttccccgacagagtcttgcgccgccgtcgtcgtcgcccgtgccatcgtccactttgagcagagtctcttcccctttctcctcttcgtccacttcctttctgatcagttccgattccctcctcatatgtgccgatcctcggccgacgagcataaaacgggtcaaagaccaacgcattgcttttgtggcaccgcccgcctcccgaaaagcgtccgcgtcgctcacacaaattttatgggtggttttgatcattttgatcggagtgtttttcaccgtggccacgacaatcggaaatgccctcgtaatggtcagttggacggaaggaagggaagcaaaaaattgaacagctaaaattaatccctattgacaattaaattttaattagcgaaaggaccgttttggagacgggcatcacacgaacaatgctttttttcaaaattgtggcaattaatgcaattttaaagttggatgattgaatttccaatgttaaacaattgaattgcttgttttcctctgttttttttcatcccctcggggggggggggaaagtcccaaatttatcaattaaaattttataaaaatgatttatttttttccattacttcagctttccatttgcgtggacaaaaaactgcagaccatctcaaactactttctcttttccctggctgttgctgatctgacagttggtaatgttcaattgtccgtttttcagtgattaaatgtcctttctcccccataggtatcgtatccattccgttgatgactttgtatacggtgggttcttttcagaaaatttttttaataaaccaaaaaatagaagacactccaaaagtgagaaagaaatatgacaacagacaaaaaacacgagaattctaaatggcaataattatgttattctgagcctacccttttgtccgttcaggtggctcaaagttggggctttggttacgcattgtgccaatgtaagtggcaaatttgccaattgtttgctaactgttcgatcacttccattctcttttttctgtcaaatggtttgacatttcttttatgctgatcacttcttccgtcattttgccgggtttatccaacaaattcctcctcccccg

SEQ ID NO: 9630 - DNA, 2631 bp, Heterodera glycines
ataaaacgggtcaaagaccaacgcattgcttttgtggcaccgcccgcctcccaaaaagcgtccgcgtcgctcacacaaattttatgggtggttttgatcattttgatcggagtgtttttcaccgtggccacgacaatcggaaatgccctcgtaatggtcagttggacggaaggaagggaagcaaaaaattgaacagctaaaattaatccctattgacaattaaattttaattaaagaaaggaccgttttggagacgggcatcacacgaacaatgctttttttcaaaattgtggcaattaatgcaattttaaagttggatgattgaatttccaatattaaacaattgaattgcttgttttcctctgtttttttcatcccctcggggggggggggcgggggaaagtcccaaatttatcaattaaaattttataaaaatgatttattttttttccattacttcagctttccatttgcgtggacaaaaaactgcagaccatctcaaactactttctcttttccctggctgctgctgatctgacagttggtaatgttcaattgtccgtttttcagtgattaaatgtcctttctcccccataggtatcgtatccattccgttgatgactttgtatacggtgggttcttttcagaaaatttttttaataaaccaaaaaatagaagacactccaaaagtgagaaagaaatatgacaacagacaaaaaaacacgagaattctaaatggcaataattatgttattctgagcctacccttttgtccgttcaggtggctcaaagttggggctttggttacgcactgtgccaatgtaagtggcaaatttgccaattgtttgctaactgtccgatcacctccattctctttttttctgtcaaactgtctgatcacttcctttatgtctgatcacttcttccgctcattttgccgtgttttatctaaccaaattccctcctcccccgtcagtttggctttgtattgactatttaatgtgcaatgcttcggccctcaatttgttgctgatcagtttcgaccgttacttctccgtcacccgtccgctcacttaccgaccaaagttttcttccttttctgtccaattttcttcccctccgttcagacgaaccactcgcaaagctttgtcgatgatcgccggctcctatttgctgtctttgctgctgtggcccccatggattgttctgtggccttaccttgaggggcgtttcattgtcgaagagagtgcaatttgcgtggttcaggtggttataataaaagagcaaatcacttttttcatcaattatcaggttgtgttcaattctgatcctctttttcctattttcagttcctcgcccttggtagcagtcgcaattggctcagtcagttggtcactgtcgcaacggctgccgccgccttttacattccggttacggtaagttgggttactgtagattgattggttattgtcatggtacggtaggactttagatgatgattatcctctactacaaagtctatctggagacaaaacttcgccgaaaagagcttcgaaaactgcaggatgggcaggcaagtggctaattctgatcaaatcatcggcgtgtgttaaaaggctcaagacatttggcgaatcgagacaaaaaatgatataaaaagaacacggtagttggcgatttgtccgttgtgtcaatttgaatcccgatcagccgatgaattgtgctgatttgtgagtgggaaactctgtacatttggccaatttccccgttttgaatttgcccccacatttttccaactttttccctttttactgtactttctttccccaattgcttggataccgtaccctcgtttctaatcagtttgatcctaacagcattgacagtgcagttcctggcttatcattcaaacaattaatcaacggcactgtttcagcttttctcccccactcgtctcgccggcacaagtgccctccactcgctgatgctcccattggccccgctggtcttaactttttgtcattgtgccaacaaagctttttgtttaacttatgctagtttttgtttgattgtctttttcagtttttttcaacactgattaatttgagataaattgggcaaaaaaaaagaagaaaaattcaaccaaaaaatggcgagagacccaacgcccaaaaaatgggaaaatgggcaggagcttattctttttttgttggataaataattgaaaatatcggacaattcgaatactaatcggatattctctcccccccccccctccgaccgattgataattttttttcatttttcgccgtccttttgcttttccctccgttgcgtttgcctcttttttaaaatttatttaatttttatttctgtgcttttttaagatccgtggcctccactcggccccccaactctcttccaccgatctgagccttcctacgccccataaaacttcgctcggccaatcctcgccggtcactccatcgcccacgccaatcgctgcaaaatcggccaatctgtcaaaaagcggcctaaactttctcgagttggtcaacatctttcaccaactcagtcgacgttcggcaggtatttccaattcatccgcaatacatataacaaatcttacct

SEQ ID NO: 9631 - DNA, 1262 bp, Heterodera glycines
  misc_feature (1217)..(1217): n is a, c, g, or t
ttgcacaatgaacgttaattgatgtctcctcataatttgctgtgatgagaatgagagaaaatgaccctaaatgttgcaatcaaagatttgtgttaattgataaatgaaaagtatgcttttgtttttttttagaaaaattgtcaaaatatcgattaccattgatatttagtaaactcgccaaaggattattttctaataaaaagaatagagagattttttcctctaatgagttaaaaaaatcgtcactcaaggggcaattaattaattttgttttgacaattcattagcaaaaaataaagattaattaaaatttgaagaaatgtattgtaattttgattaagaattacgtctcttttatgctttgtttttgtgaaacaccaatttttagttaaatattcttaattaattttaatcttccagcaataaaatcataaagaaattgaattttttcgtctattcatttaggttttgaatcgataggtaaaatggttggagaaaatgaaagcagtccaactgaacaacaataaaaagataaaatcattcaaaatatttgtatactatttaggacggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaacccttgtctaaccttaggcccatctgaataacaaaaaactcaaattcgtttggacatttcgtgtgctggacattttgtgggtcagcgtttaggactaattaagaaagatgaagcatttatattaattaattaatttcagcagaatcttggttatataaaattggaaatcaatttatttttttaaataaaaaatttcacctttttttttgcacaaaaaaaaatttattaatcaaaataaatctaaatagaatggactgaattttgcctgaatattttaataatttttattttgtaaaaataaaatattttgttattttctatggttaaaggccataaatttttaaaactttaaaaaggtaataaaaatccaataaattcgactatacattcttttctttaaacatcacctcatgaattttcatttttttagacgaaaaaaatgaataaagtgaagaaaaattctctttgctcattcatttctaaattagccanaagaaaaaaatgaattttctccttttctctttctttttgagcatc

SEQ ID NO: 9632 - DNA, 1105 bp, Heterodera glycines
atgtgcggcgatcaatggccaatgatcttcttaatgccaatcaagcgtttgatcagttgcgaagtcaattggcgacggcaccggcaaatgatttgaacccaaaaattaatcatgcaaaaaatggtcttaatgatgatgaagaagatgaacgcttcagtctcattgaagaccaagaatttccaccacgggatggttttgatttggaccaattaagcgctgttgatcggggtttaatcaacattgcctctaaactattcaaatttctgccaagaattgctggcaaaattgggcagcttttttccaaaaatgttcattacatcgtcaactcggcgtccaatcttgtgattttcaaattgaatgaggaacaacaaaaaaagtacaatttgccggaacgattagaagtgccattgacaccgggcaagttttttattgcattattggcgaaatgttcaaaaataaatcaaaaaaagaaaattgaaaaaatagaaaaatatttttcaatgtttcaaaaaaaaaggaaatttgattctcttaagaattttgtgtttttaattattcaaaattatgacctaatttgaataaatcattcattttattagaaatgcaacaacaaattgaaaatggtcaaccattacaacctccgttagaagcgcaacaacaaggacaacaacaagtgcagcaacgttccttgcttccatctactgcggattatgaggaacatgatgatgatctgatgcgaaacaatgctgaacgttttttgtttctttttcagcaccgctgtggcaaaaattgcagaatgaccgttaattgatggcaattacataatttgctgtgatgagaataagagaacataacacaattaatgttgcaatcaaaatatttgtgttaattgataaatgaaaagtatgcttttgttttttagaaaaattgtcaaaatatccattatcattgatatttcgtaaaccaattaatggcacaatttttttccgtgaaaaagcaaaatagacaaattttcaccggttagctacatataaaagtcataactaggctgggaatttataatggtcataaagtattgaccaaaaaacatgaaatatggaaagta

SEQ ID NO: 9633 - DNA, 2962 bp, Heterodera glycines
  misc_feature (23)..(23): n is a, c, g, or t
  misc_feature (38)..(38): n is a, c, g, or t
gaccaaactttgatgacatattnggcgacggatggacnaaagatgagagtgatcaaacagtaaaaagtgacaaaagaagcaaaataaaaattgaaattgttaatttcttcaaccaaacggtgatgaaatgggaaatgacccaattgatcaaatgaacggttcgaatgatcaaaacattctcaaaagtgttcagagttataaaaagaatgaaactgatcagcaaaagagagaaagaaaaagtgataaaaattgaactaaatgaacgaaatgagaactcacaatcagcagttgatcaaatgggtgaagaaatggaaaatgacccaaatgatcaacaaaaaacagaaatcattcaaaaatttgatgcaattaaagaaaagttgagggaaaagggaaaatttgaatggaaaaatcaaagcaaaattgagagaaaaattgcaaaattattaggaacaaatcggcaattaatacaaaaatggaaaaatgaattaaatctaaataaaaacaaaataaaaaaggaattttatgagatgaaaaagagtgaattcattgaacgatttgatgaatttaaagaattatatggccaaggcaaacagaaagaatttgcgaaggaattgggcatttgtgaaaggacatttcgaatatggaaaaaagaattggcacaaaaataccataaaagtcaaagtaagaattattttagtgaaattaaattgtactttttctttaagaacatcataccaataatgataaattgaaaaagatgaagcattatttgcaaataaaagaagcaaatccaaaaattagtgacgaattaattgccaacaaattggggattggatggacaactctgaaaagatggaaaaaggaatgctctcatccatttgatcaatgatttttagttggtcatgattgttgatgacttttatagtttgaaaatttacaaaaatatttagtcgaaactctaaaaagtcattttttattcttttaaaatgcaactaaattttttcctaattttacataaaaagatttttttcgaaagttggttcttatgagcaacagattgtgaaaccaaattaaacaaaactatttataaaataaatcttgattaaatcaattgactcttttaaaacagtctatgtttgtggacaagttcatcacttttttagaaaaaactttggggaaaatgggaaaggtccagtggtgggggacgggacataatttcgccgccgaaatttcgccggccgaaatttcgccgggacaaaatttcgccgcaaaagatccaaattaataaaaaaaaaaaaaattcgttcgcttcccagcaacaatacagagaagattagcatggcccctgcgcaaggatgacacgcaaattcgtgaagcgttccaaattttttgggcgcgtcctgcgctttgttcataggtttaattacccaagtttgagatcgcattgagtttgagaacacaaattattcaatgtcgcagtcctctgattctctattccccagaacttcttcactcttaaccaacccaaataagcgccttgccaacatcaccccgccacagacaaaaaaacaacatctctctgataaactggcggcggcacaaacaatcatcggtggacttcaacttggacagtcggacggtgcacctcaatgggccaactccctccttggcttctgtgctgagatggtgggaatctgccgcgagcttctctccatggtcaaagagcagcagaatgacaacatggacacgcgagagactagaggaagaacgccgactccactctgtcgtggtcgtgaacctgccggaaagtgaagaaactgtgccctctgctcgtgtcaactccgattttgtgaatgctcaatcaatgctcgacacttgtgagatcgaatgccggccatgtcaggtttaccgaatgggaaagaagtccgaccgcccccgtctcatgaaaatcgaattccccaccaaaaaacacgcccaaaattttctgcggaacaagacaaaactcaaaaatcacaataaatttaacaatgtcttggtccgcccatctctatccaaacagcaactcgctgaacgttcccgacttattggcatttgcaaaaatgaccatatgagtaatcccaattcgaattctctcatttgtgccggccatgttatgtttgcctctgacattccccgttacaaatccaaccccgactcttaaatgtatttgtcatgtgcataatgttgatgactcttaatgtgtaattggtgaccactgtaacacgaaatctcttaaaacgcaagctcttttacaaactaatagaaaatatgaaccccccataaaaaatccaattaccttaaacaaaaaacaaaatcttttatactcaacattgatcaatacgcaatccctaaataataagctagaagaattttctgctatcatagctctaaaagattttgaattggtttttgtaactgaaacttgggcaaaagaaaaaatacctttccaaccatatatcactaacaattacaaaatatatgaagctagcagaagcggtaaaaatggtggtggagtaatgatcttgataaaaactaacctaaattctttttctgttttatcctgttctaaattcaattgcgaaatccaaattatccagataaatggagcaaaaagattaagaatagctctactttacagaccaccaaacacttctgctagtctcactaaaaagattctgaacctcattggtaattatttagaagaaaattttatcattatgggagattttaacctaaatgcaaaagatataacctggaccagtggaacaccttttgctaaatcggaaaagggaaacattttttgtgaattttttaatgtatggcttattccttatgacgaacggaccaactcgaggcagtgcttggcttgatctgattttctcctctagtcctgattttgttaataatgttttaattgaggata

SEQ ID NO: 9634 - DNA, 3117 bp, Heterodera glycines
tttttcagttttgggctttcctatggtgaaatttaagcccgttttagcccggtcaaactgaccgggcctgggaccaggaccgggcttcgaaaattgaccgggacgggccgcccggtaaaagcccgccgggcccccgggcccgtccgggctctaatattcagtgcctattttttttcgctttttttttgccttttttttactttttaggtgctttttaggtacttaagtatttattaatttcttggaatcgtttgattcccacgcggcctcaaataattacaaacaaaaaatcttcaaaaatattgaaaaattttagtcccaccttttgctgtacttgggttaagtgcaaatcttttctttaaaatagttattaatcataacaattcaagacgacacaatttttaaaggatagaataaaaatttccatatcattaatctatgatataaaagatagaaagtgtgtgttaaaaaggtggaaattcgtaaaatggtaatatttgaaaaaagtttccctatttgtcgtcagcagatgatacttctcaaattcatctgttcaaatccaactggttctggtgcctatgaatcaggcatgaagtttttctggaattttgaaacaataattaaaattaatttttaattaaacacttttaaatgctcaaaatggcgttttttccattttatgttaaattaaaaaagggacgccataaaaaattcaacaatttatttaataattattccccaggccccacaaacgttcttctttttccgagtcggaagatgaatgatgatgaggtggtgattgcttcacttccgtttcatcctcagaagaatgatgtttgggtgatgaaggcaaagaagaatgtttgggggatgatggcatcactggtgatgatgaggaggaatgatgcggtgattgtggcttttcagcagggcacgcacatccatcggctattatcaattaaatttttaaaataaatatttaaaattttttaaagcaatttaaccaccaatgtttttatgtaattttttttaaatgattcattaggtttttgcttttccttttatgttgataaattgtaggttttttgcctatttattacgccctttttttttatctattttgtctaatgagcgaataatcgtaagaagaccctaattatattgaaaatttaattatttcgtcataaaaatatttaaagtatttttataaagattaaaaataaatcagaattaataaataacaaaaaaaaatcctaactctacttatttaaatatttaaattgataaaaaaaaactttctataaaaaaacctcgcaacaaactttcttcattatcagcgtcatcggaagaagatgaagaagaatgtttgggtgatgatggtttcactgctggtgatgatgaggagggatgttgcggtgattgtgctcgtccatggacttcaaatttttttattaaatataaaaagtagaaaaaataaattgtacaataatttacattgccattttatatttaaattttgaatttaagtaactgatttaaatattttttaattttatataaaaatgtaataataataataataataataaataccatagcgctcttcgagttttttcaattgtgaatgaattacgccggcatttcctaaattattattattaatttaattaatattgttttatctatttaaacaaaccgaagccaacgaaaacggcagccaaaaggaaaaacggcaaaaatgaaatggttttagtcattttaatttttttggacaaaaaaatagaaattgttttcgatttacaaattaaatgcttacaaattggcattctactgcccattttatatgtttttttcagacaaaaaataattacttttatttttatttttacataaaatgccaacaacttccgctgcaaaaccggaaatgaaattgttttttttaataacaaaatattacctaaacaagcccaatttttagccgcagaaatgtttgccaacatttttaaaaacaaataaacatattttgaaaagcatagattttacattatttgtataaaatattcacaataaaattttttcaattaaaatatccaaagatgataatttatgaatcttggttttattttttttaattttgcataaaaaatgacataaacaaacccgcgcttcaccaaagcaaaaccgcttcattaactaaagttaaataatttgataacaaatgtagaaaccataatttattttttattatttaattccattttcgtacaattttcgcaatgtcagctcgaatttttaattatacttcatgctgatttgaaattcgtaccaaattaacaaaatttgaattaattgttattttcccatttgctgaattaacggaattataccatgctaatttgttgatgacttttaattttgcagctaatccctcagcaaaattttagaattttttattcattcaaagttttaaatttgctacatacaaaaactgtctgttttcaatacaagtcatggagttttgaagaaaaaaaacggcagttttcgtaaaaaaaatttttacagtagttggcccctgtttcaatataaattcaaacgctgattttcaagtcgtctgtgcccgagatgattgcaaatattgtggtaaatggctttagcttctaattaatttatatcatggaaaaaaatacatggaattaattaccttcgcttatgattcaaatttattcctataattgatgatcacacagcttttatttttccggtactattgttttttttttttgtgaatcgttgacgaacaaaaagatgcttgttgatatcattggaaaaatttttagaaaattaaatactttatttcctctaatagagccaccatccgtcaatggacaatctgttaggaaattttatgttttgagtaatgatcaaaaatttcttgcgaactaaaacccgattaaatttattgcttggatttctgcaatattatagttaattaatttaatgaattttatcattttatagaaatttctttactttctttaaatatttttaaaatgacgaaaaatagcacaaattatttattatgtttttatcaatttaaattcaatttcgcgtaattat

SEQ ID NO: 9635 - DNA, 4069 bp, Heterodera glycines
atttaatgatgcattaaaataaaatgggactgaattggacgcgaggcaaaaaatcgtatagtatttttcatatgcttaaacaatcattgccatgtcttagtgttgtttgtcagatgcataagtgcaatcacatttttatacacacattggtgttggcataaatctcatttttatgcgaatttccccttattaggctgtcagcaataaattggcactctgccaaaagtgggcatgccaaaatgcttacaggcaaacaaagatttatggctatgccaaaattgggcgcatagttccatagcgtgtatagtgtgggctataatagtcatagaagtatattattatgagaaaaacagaaatctatttctctatatgaatattggcactgtattttgccgatctctttcactggtgtatctcataattgcaggaacattttacttatgtatgactgtgcatagatattttatgtatgtatggcttaacaatgtatattagacacatggccaaatcattgggggggggcaatgatttcgcaaatttggccctgcgcaatgtgccaacacatcgccaactttgtttgtttctctgcccactctcttcattggcatgtgctatctgatttttgtttgaccgtcttccatgtgctattgcttcgcatttgcatgccgtgcagtcttttcgctgaaagtgccaatataaaagcggtgccaaactcagccaatggcacttcattttcaaactactctctctcactaactgttgcacatcccaattttatttcttccttagtaagtagtattggtgcacaatgcgcacttttctgttcatagctgtagtcgggttggtgttggctgtcatcatggagagtggtaatcaaatatttaaaaaaaaagattttaatttgtcataaatttatttatattattttagtaaatgcgactgggaataattcgccgacaaagggtgatgacgataaattattatttactataattaatgtaaatttaataagcaaatcctagaggaacatttttgaaaatctaaattcttaggtgttagtgggagagtggtaattttttatttaaaataaaatttatttttcgttattttataaatgcaggtagtccgaaaaagccgacaaaacaaacgggctcagggaaattattattagaaatgcaatttttgaaaatcgttgggtcagaaaaatgggattttttttgaaaatgttcatataaatccaacaatcttggtatcatttgaaagctcttaacatgctctaaagtgatgttctttggttctttgatgcggaagagcaaaagatcaacccacggtgggactcgaacccacgaccccagctttccgtgctgtgctctaaccaactgagctacgcaggcatccgctccattgctctcttctctctcctatcttaggaggagaatcactctcttaatctccttcactgccgtcttggcacaaggggagagagtgaccgcatttatcacactattatccttacaaaaaacaaaaaattttattttcttgcaatttcttagaaaaagtttctaaaaagttatagtggaaaaacatgctggcgcacaaccgtacgcgcccaactgagctagaccgccccggggccatggcagtgatggctcagcaaaactgaatttagcggtgccccaaatgcctactataatcctgaccaattaaaataaatttttaaggatgttaaatgaattttcaaaaaaaaaaaaaattggttatacggaagcttatttttcacgattttaggacaaactccgcctggcagtccgaaaggtgggcacggcagcaacaaatcgccaacgacgccgcacagtgccggttcgccacacggcacgcagcatggtaaccaacagaaccatgctaccggtaacacatttattcagcaatcacaaaatttttatctaaaattaacatgaaaattagaaaattttataaatatatttaattattttatataacatatatatttatcagaatggcataacattttactcaaataaaagtgaaatttctgtttttttttgtttcgctccaaatgtgtccaggaccaaaatggcggtgcataaatggcaccgaatcattaaaataaaatgtttaacggtgttaattgaattttcaaaaaacaataaaaattggttgttagttagtaagcatatttttcacgattttaggacaaacgccgcctggcagtccgaaaggtgggcacggcaacaacaaatcgccaacgacgccgcacagtgccggttcgccacacggcacgcagcatggtaaccaacagaaaaatgctaccggtaacacatttattcagcaatcacaaaatttttatctaaaattaacatgaaaattagaaaattttataaatatatttaattattttatataacatatatatttattagagtgccacgggaccgggaatttttgccaaaaccgggaccgggacttgccggaacctgagaagccgggaccgggacctcgattttttttcgggaccgggaccgggaccgcaagaaaaaccgggaaccgggaccaaccgggaaattttaaaaattcaaaaaaattttaaaaattaaaaaaaaaattcaaattttaatttatatcaagtgaaaataatacaaaattatttggttttttataataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccgggcggtgcggataggcgccgccgggggaaattttaaaaatttgggtgcaatttgttaacagattttcaacaaaaaaaggttggtttttgcgattattaagctcaattggtaggattttcatttaaaaaatgataaaatatgtatcaatttaaaaaaaaactatgaggaatcatattttctttataggaaacccacgagtatacaaaaaaaaaattgaaaataatctaatttctgtagagggattgaaccaggggaaagaataagggaaaagtcaaggagactagccactaggccatttgcacaattggttgctttggaagaatatatttatgattatttcttaattttttccctttaactctaattttcatcactaatttttcactcagaccccattcttaccagtgcttgtttttcccggttcccggttgccctaccgggaccgggaccgggacctgagcttttcaaaatccgggacagggaaccgggacctcggatgaccgggattcccggcccggtcccggtcccgctctactctactatataggatagaaattttgtaggacaataattgattggaatttatgttattgatctgggttgaaaaacaaaaaaatttttacattttaaagggttttcaaaaaatagaaaaggtgtttaaccgggattttgaaaaggggaatcagaaaacaaaattatataatgagctatggaattggtaataatttcttttaaaggaatctgatggacattggaaaaacgcttgtactcgtagagaaacatttgtgagatgtaccaacgttcgctggcaagtatgtaattcgatagacagcaattgtacctttcgacacttttacaacttctatgaagttccccaacgtcgtacaaatttgcattgaaaaaaaggaggaaaaaagaaaattgttgatggagcatgtataattaattaattgcttttctttttttgttgtgttgctgaatttatgtaaggaatgatcgggaccgatgcattgttgctacacatattattgatatgttgataaacatttgttgctacatatattttgacaacatcgtttttttttggtgctatgatgtcagtcaaaaaaccttcaaatgattttttttttttgatataactgcataaaaacaaccaaattttaaaatcttgatacaattcgatagctctaaatgtttttctattatcttgtaaaatttcaaaa

SEQ ID NO: 9636 - DNA, 1444 bp, Heterodera glycines
ctaacaaaaatttgtaacttttcccactcattcctcaaaaacagagtctggacacactgctcaacctgttcattcggcacgcaaatcgtaaagcggcaaaggaaccgagtgcagaagtgcatacaatgatttcgcgctttgtccgttccgttgcgcgactgtttgtgctggtggtactgatttcaccgaacgctgtccgcacattgttaggtaagtgggaaattaatggaataattttcatttttgttggtcattttttcaattattgaaaaagcgggaaaccggaagcaaattatgcagtacctaaatatattttttaatataggtaattaaaaaaccctctccttttggcgtactattttctctctctctctctctctctctcgatgttatagagaataagaaaatttcgcttcatcgatttttttttttgcacaaaaaataagtttaaaaatgttgctgttgtggagcggactcgaaccttcactcttttttttttcctttactatgtcttacaaaacccagtaattttgtaatccaaaaacatccattttttatcctgttcctcaccaaatacattgttttttaaaaaatgaaataaaatcctctttttctatacaatttaatctattttttgttacgcctttagccacttccacggagaacattggccgtgcatttgcgcccattgatcccacagcgatgtccgagtcaacaacaacaaccacaacagttgcaggagcacaacagcaactgcagcagcagaaattcgtcctcagcacatcggtgccatcgaccgccgtcggaggggccttcagcacgccttcatcaattcgtgaaagtctgcaaaactatcgagcggttgccatctcaggtggcaacgagtagttttggctgctgctttttgttgtgtggaagcggccaatttaggcgttttttcagcaattttgcttccccattgcataaattaaagaaaaaaaaatgggatgcgaattccgtccaacctaacccattaaaacaaaaaaaattgcccggctacgcggtgcaaaaaaaacgaaatttttaccattttttaaaaattttaaacaaactttttttctaggtgtgctttcgcttgtccgtgccagtttgcctgggctgagcggactgggcagtgccagcgacaaaaaggacaacaaaaagaagagcgcaattgcctttgtgttgaagtgtcgtcgcgtgtttcaggcgagttgccaccgaatgaaaataaatttttttttttgaaaaatattatgttttccgggattgtttcgacttttcgaatccacatatttaaattgtcaggatcaaaaatttattcattaaataaaaaaatttaaaataataaaaaattaaaaaaataattttttttacgactagaaaatcatctaaatttaactagctgatgaacgggagcatcatc

SEQ ID NO: 9637 - DNA, 1333 bp, Heterodera glycines
cctattttatgaattttttttcggggataaccttctttatttttttagacgaagaagacgaggaggatgacgagatggaaaacggtggcggtgcgggcagccaggcggcctcttcattgtaccaccatcgcgcgcgcgagaacagcagcacttccatggaccggttgcagcgtgagcggaccgcgtccggcggtggaagcggacggcgtggcggcgttggcagcagtgccgcggaacggtcgacacaggcggcttcagcggttgcagcggcgtcagccgctggcgacgatgacgacgaggaagaggaggcgatgggcaccaacaacgaggaggaacaggagcaacagcatgacattggggcggttgaggatgaacatgacgaggaggacgaggacgccaggcaagggggggggggaaggggcgactggggtggtagggaggaggaagagcaagcagttcatttgttttgcaaatcgttgttttcctcccgaaaatttggtatttctgaaatttttgggggaaatccggaaacttataaaaataaaaaaagatttaacttggttgaaatcatgaaatttcacattatctggaaaggggaacctagaaatttgggcgaatttttatacattaaattccaaggaaaaaatagacaaaaaaaggagtttggaaacatggcattatcacacccgtctccattgaaagaataagtaaaaatgcttaagtcttggggcggactcgaacttccactcttttttttcaaaacccaccgagccaaatagaattttgttttgaactcgcgcaattttttttttttctttatgacaatttttaattattttttcgacaattttgcagtgaacatgaaatggaggaggatgaagaggatgagccctattttgacgtccacgatgatgaggatgacgacgacgatgatgatgatgatgaggacgatgacgacgatgacgcgtcatcggtaaaaattttccaaccctcggaaaaaaattttcatatttatgtttttttctaaaaaaaaacttttttttaccctccccatttttttattcattgtccttttccacccctcatcccatacacatagaatccatcggatgcggaggcgggcgattccaacgacactgttccggtgatgcgaacgggtggcggtggagcacaatcgacaccatccgccgctgctgctgctgctgcagctgctgcagcaacgacggggaatggtggtggcacgagcggcgccggagatgtacgcattgaacttgcccagtcggcggcggacgctgcggcggtggacaatttcttggccaccgttgatgacgac

SEQ ID NO: 9638 - DNA, 1457 bp, Heterodera glycines
  misc_feature (34)..(34): n is a, c, g, or t
  misc_feature (40)..(40): n is a, c, g, or t
  misc_feature (45)..(45): n is a, c, g, or t
  misc_feature (90)..(90): n is a, c, g, or t
gacgacgacggcaccgtcaagtggaagcagtacnaacacnaatanccattttttggctggcggcaatgaccaatttgatgtcactaacanaccaccacgtcaacaacgaccggcactggcagtgccacaaacagcaccaacaatgccaacgcaaacagcggtggtggtgctgcaggccgaactgctccaaccggtgaccgggcgtcggccattgacagtgcattccgtgaaccggcgctggaggggtaataattgaaaatttgaaagacaatatggagaggtgtggcttactaagaaaattggtattacattttgtgggtgccttggtgttagtttttatcaatggaaaggatcgattttgtaccattatttttgctaaaaattaaccatttttcaaaaactttcgaaaaattagaaatgttaatgttcgccttttttgtgtggcggttgtgtcttggtgtttttttcatgtaccaagtgtacttgttgaacttttattatgggaccattccccgccccttgcaattagccctgacacataaagaaaaagaaaattcgatttctttcccccttatcttggtatcgatttaaaaaaaaattttgttcctcaatttccttacgcaattccgcagttttttcttggtgatacaattttcatttttttttttgggtacttaattttctctgtgttttcccttatttttcgtttattttatactatttttgtctcatttctccaaaaaacagcagggcgttgacccatcgcctttggcgcacctccgctttggctggtgcaccgccgccaacagcaacaaatggtactggcggcggcacaccatcggcaacaacaccgagtgccatcacaacatcaacaacaaacgcagcagcagtcaatggcattggcgcgccgccggaggcattcattgcggaggactaccagtacatgcagagcaacaccagcacacaggcaaacacaaaaaaattattgattttaagcatttaaaaatggatttcttaaagaaattttctctaaaatattcaatgtaaattaaaatatgcgttttttttctttgtcattacttttttaatttgggatttcattcttccaaaaaattgtaattccattgttggtacaaaatttgtcaaaaaaatactttctagttaaaaagttcctcgaattttccactctacagcaaaaataaatatgaaatcacgctttatttaagttaaatgaaatttgaaaattaaaaaaaaaataattaaaaaaaaaatgtgcggcgttttaaaaaaaaagaattatcatttttcgtaaaaaatgttttgcagttggccttatgcttctcaattcttgtcaaactgtgcgatgaattgctcgtccagctgatgtgccatgccaaatggaaggagcaaatgagccgtgtgaagggcatttacacattccctggacattgatacgg

SEQ ID NO: 9639 - DNA, 1793 bp, Heterodera glycines
tcataattatgggttaactgcatagcaagcgcaaaaattttccaatttttttttgcaattaaatatttttgggttatcttttggcaaaaaaagcgcaaaatttttcttaattattaaataattatatatttttaatctttttaaagaaccgaggcgcagctgaagtacagccaggcgatcagtcagtcaattgttggcccaatggtttccccgtgggcgggcactgaacgtgacgaaatcggcggtgcacaaccatccgcaacaggaacaggcggtgcacttggcagcaccagcacatcgaccacaacgaacgcaattgatgctcaacaacaatttccgggcggaggagtgagtttttattgggaatgttttttagattggcatttttgaaataaaaatttaaaaaaaaacaaagaaaaaattcgccatcagtcgggcagattcggacctaatccatgacaaaaaaaattattagtttactttcaagaaaaataggcaatttttttttttgtaaattcaaattgtaagcaattttcttaacaaattgcattaaaatttacaaaaaaaaaaataataatctttttttttgcaattttttatggcaaataactggtcattttttggcgaaaacgctacaagcttctgcttttcctcgactttcctcctccaattttttttattttttggctacggcccgtgtcccgacatttgcgcctttttccaaaattgagttcaaaattatgtttttttgattcctgatcgcataaacagctttaaataagcgattgaaagtgattgttttattggtcctaatgaaccaaaaagatcgtgttttcttaattttatgctgttaggttatcagggcttgaaaaaattcaactttgagtccgatttggacataggcgcaaatgtcggggctccctacggccttgatcggttataatattgccctaaaactttgcaccaaaataaataaatctataattttccatcccaaaaaattcagcaacaccgtccgatcagtcgtcatcctggcacagggcccggcgcaggcgtcgcaggaggcaccggggcgacaaacagttcaattgcggctgcagcgattgcggccgcgactggcgcggatacagctgcggcccagcagcgacgcttccgcaagaaaggggacgcgggcggcggtggtggcggcggacgcaaaccgccgggtgccagcggttcggcagacagtgacgtggcggaacacggcgcggcccgtgccgacttctttgcctacttcatgtcgttgatgcgcagctattccgcagaaagtggttggtatttttttttttggttttttttgcgtggattgaagtgtgacaaaataaatgttttggcactaattgcaaaactgacaaaaaaaaaaaaaaaactttattttattttattttttgtatcaattactgtaaaaggtgcttttcctgctgaattgttgaaaggattcattcacattcgggttctggggtcccaaaaaataatgaaaaataataatccgactcctggcgggtttgaacttgtaccccttcctcactcacaaaaaaaaaaaaaattgacaagcccaaggccgccacgggatttgagaatttattttttttatattttcaaaattttgctcattttttcactcaaaggtgacgattcgccagtgcttgagtacaccgctttgcgcaatgttgcatttgtggccgaagcgtatttcttccacatgatttttggtgaaaaactcaaacaattggagttggagcatggcattggta

SEQ ID NO: 9640 - DNA, 2834 bp, Heterodera glycines
tttgaagatattttggcccttttttaggttttcccctactttttttgtgattttagtaatattatctgtacttacttggcgttttttagcaaatataaatccctttccctgataattatgatgccaaaaaataataatattttgaatatttttcataaactcaacgacagcacacaataccattggtaaggttcaaattgaattctatatgttcaaaaaaattcgcatctatcgtattgttgctgaattcatgcattattctaaaaaacaaacattaattaagggaaaatgaattttttctcattttcgtcgctttttcaaaaaaaaaatatacaaaaaccaaaagaatgaatttccatgttgtaaaaaccaaatattaaatttgtcttccgactatattttcgtcaaatgttcgggtcggaagatctcaagtttttgaaattttattttaaatattaacttttattttttaaattaaatagataatgaaaaataaagcaagttttttaaattttgtattatttttttcaaatctctcaccgttccactgtgcacaattcagtcgaataccgaataaaaaaatgctcaatattttcatcatttttttgcaaatattccactacattggccttttccaataaatttttcacaaaatttgccaagctgcaataattttctttcaccgaaatttgcgtttcttccgtaaattgctcatttcgattggtcaaaagcaataaaactgaaagtaaaattttggggtccgatgggcgcacaaaaattttggcgttttgcatttcgccaagaatttttgccatttttaagctttcatataatgtcgtagaacaattttcaggcagtagtggttgcatagaaattgaaaatccgacaaaaattaaaaataattaaaagaaataaatcttttgttcgcattttttctgaaattatgttatgctgttttaattttaaatcagtctgccaatttgagtttttaaactcattctgtgatcttttttaattggtcgaagagaaatgagttgttgagtttttgtgggtttttcaaaaaaaattacaaaatttaattattttttgaatgattttaatgcttcggcatatctcgatttcaattttctttgtaactttagttatagataattcaatttcaaaattcctatagtcaaaattctatccaaaaattggccatttttgtgaaaatctgttaaagataaggaaaaattccaattttttccaactccttaattttcataaaaaatgagtaaaataccgaaaaaccatttcattatgaattttttaatgctcggatgcgttttacaaaatttagagatttagccttgttttaaataaacaggtttttctaaattaaatttaattttcctaccctatttttggctgtttattaagaaataatttaagatttttaacatgaaaaaaacagatttacaccaaaaaaatgacaaagttttgcgatttcaactcaatttttaagaaaataaggatttttatgggcccggcgtaagaatttgtataaatttttacattcatattaagtaattttccccaaaaatgctatgttagatctaattttgaatattttaggtggattttatgatctttttaacagtttaaatcgtatgtagaaaacccaaattccatcttcaaaattttaaataaaagacctttcgccaaaaataattattaaatttttcacatttggggcagtttcactggtgaaatttagtcccgtttttccgacccaaatggccgggaccgggacttggaaaatggacccgggcggggccccgggaccgggactcccgtttttccgggactcccggtcccggtggtttgtccaaaaaaaccgggaccggggccgggggtcccggcaaaatcccggcgggcccccggtcccgtccgggctctaataagcatcttttatttactttacgacgaaaaaaatgctgaagaattctgccaatttttcttttttatatttatatagcagggatgttactcatctcgtgtttcgtattctcgtttctagttctcgtgtctcgtattttggcacgagatacgagatctttatgcactggtaagaataaggggggagggaattaagagaaaatatcactccatccaatttgtgtctcacaaatttaagcaacaaaaagcggatgcttaaagaatttttttcattatttattcaccaaatttttattttgagaaaatgactcatccattaattttttatttaaaatgccaaaaaacaaacattgacatggtctttcaaaattttatagaagggcagagctttaggcaaaaaaaaaacaaacagccaaattttaattttttaaattttaattccggtaaaaaaatttccgctaaattcatcactgtttgctgttggcatcctccactttaagaagacgcttcaaattgtcctccagcgtttcaacatgcgacatggcctccatttctgcgcgaatgtccgagtaaagggcggaagtactggaaaatttaggaaaatgtggaaccttaagggcagctaattcaggcaatcatacaaaaaacaatctttggaatactgtaaaaatgtacagtaaaatgaaaaaatcaaaaatatcaataaaattttcatgaaatctgtcatttatcttttaaatggatgattaattaatagctcacagatagcgctcgcccgagctgggcaacacggtgacgatcagtttgccggccatttccggcttttgcgcaacgcgaagcgcagccaccacattggcaccacttgaaatgcctgagggggagaaaagtgccaaaaa

SEQ ID NO: 9641 - DNA, 2594 bp, Heterodera glycines
ataatgcagataactaaagttggtcacatatttaatgacgtactctgaattatgttttaaataaaataaattcatttttatatatatgtattttacaaaaataattaattttcaaaaagttttaagtattaccgctcaaaaggccctcttcgcgtgccaatcgtttggccatagcaatggcctcgtccgagtgcaccaaaacgacttcctcgtacatttttgtgtccaaaatgggcggcacaatgccagcaccgattccttaaaattaaataaaaaagatattattattaaaatacttaaaaaaaaaattattttgatttaataaaatttataatttatgaaccattttggtttttgtttccgctgaaattcaccttgaattttgtgaggatttggcttgcctccactgagaaccggactttccaccggttcaaccgcataaaactttaaaaaacaacaacatttatccaattaaattataaaaatttttgttcattgccatattaaaagaaattttagttcattctcaaattttcacttttattgctgggttcttctcacgcagaaaacggcctgacccagtgatcttaactaattaacttaaagaaaattagtaattttttttttcaccgttccgccggtgcctatgccaaaaacgcatgcgtcaacctgaaaaaacaaatttaattatttttattaaataaaaaatgaaacatttattcaaagccgatttgagtagataaataaatgaaaaagcatcaaaaatttcaaaaatgccagaattcttccaccttgccatgagtttgacgccaaatttcgggcccagttgtgcgataatggatttcggggtttgcttcgttggcgaactgaaaataatacattttaatcagtatcgaaacctaattaagatgaaaaggaaaacgaaaaaaatcaacaaattaattaatgctttgactgactattattaattagggaattgaaagattattagcgcctattttaattttcaaatttttaatttaaatttatttaaaaaatgtctttcgctttgcctgcattggaatgaatgagttaggaatggcggcagctaattgttcggcacgctccacagagcctttgacgccaagtgccggatcggtgagcaccaactcggcattgaaagcacgcaaaagtgtacgctttaacaaaaacaatttaatttaaaaaaattttgatgaaaaaatagtactgattttattattataattataattggtatttcgaattttatgcttcttataccaaggttatcctcatgggcaaaatgccaatgaggatatcatccatacaaattttctaattttatttttgttcgagttcgggtcaggggttcgaaattggcaaaaatggatgccggattcgtgatcagcgatcctaaaaaccccttaaaacttattttcattaatttcaaaaacacatttataggcatctgaaaatgtatgttaaaagtctcccgtaaacccaataaataccaattataattttaaattttttgttgggagattcttaaatcattttccggcacccccacaaagtgtccaagccacgaaatgtccaaaagagtaaaaacccacgaaatgtccaaaatttttcaaatttataaaaacaaaatgagtctaatttaggatttttagggttttcggggtcgctgaatacgaatataccctttatattaccccttgcctaaccttaggcccatctgaataataaaaaactcaaattcgagacttggacatttgggaggtaaggggcgtggggaaatcattttaaaacggggaccaaaaatataaatattaaacaaaagttatttctttaatcattttcaatttccattaataaagtcagctttggatgggttttgttttgtcggtccttccatttgttcttccttttctcctcttcttatcacaaatgtcctccattcgttttgttttttgtttgggctttcccccaaattcccttttttcggggggtcgaattgataaaatgcactcaaaagataagcttatcacaaaagtgttcttcttagaaaattaaaaaacaaaaaataacgatgaaaaaagaaaattttgtctgaattttaaccgggcactgattggacagtaaggatgaaatgccgaatcactcactcattggaaatcataaatcgtctcccccctcccgccaaattcgtcgccaaatggcgcactttgcgccgctcttttgcttcggtgccattcttttgtcggagattcgaatggactgataaagcaaataaagaaatggcattgaatgaactgatggtaaagcagataaattctgtcaaatatggaaattgaaattgaaacaattcgccaatttcggtgactttcgcaacctttccctcccttggcagggcatttcttattcttctgatttaattgatcagataatttccatttcagtctttgcttcgatcacatcaattttctagatttcttatcgatttgtaaacacaaaaataagaagaaaagtgaatgattggttgctgttttgagcacggcggaagtgttttgttagctgacagattgtcgcag

SEQ ID NO: 9642 - DNA, 4394 bp, Heterodera glycines
  misc_feature (44)..(44): n is a, c, g, or t
  misc_feature (67)..(67): n is a, c, g, or t
gatcagatcagctgatcagttaaaaactgatataatcggtcacntgatcaatttcaaattgatttantgtaccgcttccatcagtgtgcgcccccttcaaattcactttcagccaaatgttcggctttttctgcgaatgcttcggaagagccggtaaattcggcaagtctaatggagctgttgtcatcgcgaagcatcaaaagacgagacaaccaatggtcaccttcttcagttggaagcattaggacgaaaacatcgcttaaatggaataaaattaattattaaattattggagcaaatttggttcaaaggctttaaattattttgacaatttaaaaaaggttttctaccatttgacataatttcttattaatatgaaaaaattaaggaacattttaatgcttaattaaatgatttgaaaatttaattgatttaattaatataattagttaaccgatttcttaattaattcaaatgccaaattttaactgacttttcaatacggaaaagcaatgaaagacgtttggccaatgcctggatttccttctccaaatctgccaatttgaattctccatcaatgagctcttcttttacaacaggaggaactgaaaataaaaaataaatattaattatttaaaataattttatttttattttttgcactttttggggtcatcgaatggttgtgcttgcgcaaaccgtacaccaatccctggcggttcagccaaagtgcgcggaaggggcagccgctctgtgaaaattaaaaattgaaacttcggtgtagtgaatttaaaaatattttttatcgttattatttttaatttataaaaaatattatatttaaacatttttaggcataaaaatggcaaaaataaaaagcagaaaattgtaaaaaaggcattgaataagcaactttttattaactcttttttgggagcaaagcccataaaatataaaattttagttatatttcaattgtaaacgaaattgtttaaatacatatttggaagattttcgtaggacaattaaatttggcaattctaaggtggtaggtatatttttggatttttatttactttatgctaagaaattttccgaaaaccctgaattacggccacaaataggcattataaaaatcgaaattgcattttccgtgcttaacgaagccggattaaaatataaaaaattaatttattaagaaactattttaaaaaataagcaattttgcgccactcacccgcacacaaagcaggcgattacggtaagtgttggtgatgatgccgcccgcaactcggagcatgttctccttgcaaaagtcggtcagcgactttttgttccaaatgctgtccgtcaaaaagtgccaatttttgctggcaaatttgtaaacggacggactctgtaaatttgaaatacccccaaaactgataggaatggctttatttaaactgtgctgatcagctgaaagtctgatcagctgaatcgatcaacttaccccttcgtctgtcttggtcacaatcttcagctccggctgttggtccgcttgaactccgctcgaaattgaggcgcgtgccttgacaaaagcactgcgcttgatccgaacttcaaaattgttgccaaaggcggtccgcttggttcgtggtcgatatgcagcggagtgatcggagtcataggcggattgatcagtgtctggagagaaaaaaaacaaataaaaaattgtgcagaatgaaaagcgatcaatcagtcaaaaaccaatcagattggttttgaatgatagatgaagaagtgatcagattagaaaatgatcaaaaatatttgattgaaccataaaaaattgctgacatatcactcaaaaaaagttgataagtgataaacaaaataatttgggcagatcagcccgtaaatatttgagttattcaatttgatcattttttcgatccgatgacagtcaattaattaatgcgccgatcattaattaattatctcccctccccaagaactcattagcaaaacgacctgtggatgataatgatgttatttcttcgtcgatgccgtccacctcctcctcctccccataatggcggtttgccccctcctcattttgccgctgtgctcccgtttcgaacattgcggcacgcgctttgacaaatgcctgccgacgcatgtgccgtcggcgggcggcagtgccaatggaccggacatttttagccaattttttggcgattgaacgcgtctcgggccgtcgtctgctgatcggcgaaggcggtgatgaaaagctttttgaaacggcggatgagcatcgatttgcgtttgtgttgttgttttcgttggcattgtgcccattttggttatgatctctttctggcgataaatctgaatgtcgacgcttttagtgattggaaattcaaaaatgagcagaaattaaaggggatcaacgatcccaaatgatcagaagagaaatctcggaccctcagaaatgtttcagtttcattagaccatcctgactagggaccgaaattttgaaaatttcttgatcgggattcgagaaatttgacctggaccggattccaacattaaatagttttaaacatgatcagggagggtctgagaaaccctaggccctgttctggtctctaatcctgaccccagccgactgatcagtagatcatgcataggtcacatatcacgccaaaattttccgggcctatgaatgtgcatattcaaatttaccgtccagttgggtaagcggtttgttcaagagtgtcggaatgtttcgagagttaaatcacgaatagcccctccctcatgctattggtttagctttcagtgtgcttactgtaaggcactgggtggttgtgctgcaggcgatggtacacggtgccctccggcatgtgaacaactacgcggtatgggcacgccacgtccggctgacgctgctgcgcgcaatggagccaaatacgcgttgcgctggaggaaagacgactacgcgacaggtgccgctcggcacacaactgctccaactgttgttccagcggaattggcactgccgctctgggtggtgcaaacgacggcggcgatgtttgtgccaatgccgcggggggtgccgaggcggccgctgctgacatacttcgtgtgcttctgctgccaccactggtgttgaagtttggtggcggtgatgcggaggatccgccgccggcggcgccgccgaagacggccaatttggccaaaaaggtccaccgtttgccaagtttgtccacaaaggatgccgacggagaagcagcggcgacagtttcatcggagactgaagtgaccacggagtcgctgctgctgctgacgcccaatggcattttgccaactgtaaaatttaaagcgatttgttgaaattaatagataattaattagggaggaagcgggaaacacctgctgctggggaaatatggtgtaatgcaaaaaataattataaattaaataatcttcgggttttaagaatttttttccttattttcgcattttttcatcgaatatttaattaaattaaattaaaacataaaaatagcaggtgcaataatgttgaaaaagttcagtgttcgccgatgaacactttcttttgaaaatgtaaatcttttattttgtgtactttgatctcactaaataaaactttccaattatttccgtctcttaatcttcacccaatcatttttcggcattttttgtaaatgtttatttaaatatttcgggatttttaataaatataaatcccatccctaatcatttcttatgtaattttcccaaaaattgaaaatccgagacttttgtcgagtcgagatgagattcttgaacatagctattttcctccgacttaattttaaataaatattgaataatttgaagtgattttgggattgggtcggaggctgattgggagctcaaaccggagtgattaaaaccccggaaaacttccaaacaatttgagaacggaacagtgcagcagaaagagtgaattaaaaacaaacaaagaaaacccttttaagaagccgcttttcctaggccttttaaaaagcttcggtcgataaaaaagtaaagaaaatattttaaaaagacaaaagttaaatggaaataaaacaaaagaaaataaagtgaccgatccgacccaccgatgagaacaaaaaggggcactgattctgacaaaacattcgttcatttgtacaaaacaaaacaaaaaaaatgcaaatgaatttttttgtctgacggcggccaatcacaggcacaaatttccaattgcaatggatgagaatgattaacacacaaacagcaagccataaagctcaccagtagcagcagaaaaagtatccccccccccccatatccattcatattcataatgtacatttatttat

SEQ ID NO: 9643 - DNA, 1809 bp, Heterodera glycines
  misc_feature (396)..(396): n is a, c, g, or t
ttttcggaggaaaattaaaatcaataaaaacaaaaaaatataaacacgaaaaatgacaaaataattgtgagttttggtgctttgtttatgttttttttttgttccgtttcgtcccccttttcggcactttttgagtttttcgtgtttcgtttttgcccttcaaaaaatttcctttcgtttcggattataattcgtttcgtttttgtttccgatttttttcgtttttcgtgcagttcccctggggctccccgtggtcaaattctttccttatcagccttgtcacaaaatcattagcatggcttactaattctgttgaatatacaaagtgattgatcactgatcgaaataggtcccttgtgattggaaatttatggtctcaattcaaacaatttcccnccccccccctcccgcgctctgatcaccgattgttttggcaacaaaaattgatcagataactctctctctctctctcaatttgaggtcttcccaaaacccacttgtaattgcacttcacatttgagcatctgaagtagaatttgccgttttttgcaatgccactcttgtgcacgtaatgcaattggcacacctcgcggcacacctcgtcaatggcgccactgatttttcccaacggaagccaataccgaaaatggccatttcgctgaaattttctttcaagtttttttgttttagagatctcattaaaatgctagttgggcattttgaatttcaattttttgttttttttagagaagaacccgccggtttcgagcagcagcaataattttccatgcttaaagtagaaccggaccaaaattttattttgaaaaatggcatgaatgccatatccaggacaaaatttgcaaaaatttacttcaattttttaaatttctcaaactgtgagccccgggaaaatgccattaaattaaaaaaatatattcatactgtgtttcttttaaattttaaaatattttgcaccgcttttttaaatagtgatttaaatggaaaattcacttttttgccgcgcacagccccctttggagtccgttgtcgtgccgtcgaattcggccgaatttgctccttggcattgtcctcctcctcctccattctttcctcttcctcttccatgtcctcctccaacattgtcctctcttcctcctcctcttcttccctctcttttcctccattctcttccatttcaaatttttcgtcctcggaacttttatggcacaaatcactgaatcgcacccgtgccattgtcatctgttgctgcgcattgtcaacattggcactgctgctgctgaagttagcatcgtcctgcggtttcggaaagcgtcgaattaatggccaaataaaattaaaaagcaaatttaaaattggaccaaaatcggtactaagaaatctcataaaaatgcaaaattttcgaaaatttgtgccgagaaaaactcgagaacactgaaaaattgggggggtttttgaaaatagtagtccatcaaaacaaaaggctcatcgacaggagataaaagaacggaaaatgcaccccaagggaaaggccgagattttttttggcttcctctcaccccgaaatttgtgaccccccggggtgatgaaccgactgatcagtaatgatcacaccattcttctcccgtcggcaccggtcgtgcccttctcgccactccgtctgctgatgcccacaattggcacaattgcgtcatggctgtgcgcgtgccgaatgtaaatggcactttggcgatggtaaaatatcatacggtagggacggtgggccgagccgcgacacctggcaaatttatt

SEQ ID NO: 9644 - DNA, 2640 bp, Heterodera glycines
atcaaaacgaataaattcactagcgagcccgaactttattatttgcgtttgccaaaaaatatttgcaaatacaaaatctttctgatggatgccattgtttcttctggtgtgttttaatcattttttaaataacattgacgccaacaaaatttggcattttaggagccgcggcaatgatggctattcgcattctgttggaccacgacgtgttggaggaggacatcgttttgctttctttgctgatggccgagcgcggagttcattcgttggcttacgcttttcctcgagtccaattgttgacgatttccgtggacaaacagatcaacgagcattaccgaacagtgcttggagtggacgattttggtgtggtttttcgcatttcaatttgagcctctttctatgccagatgagaattgtgttgggcctgattgtgaggtggttcagttggttgcttcggacgacgacccggacgaagacggcgatgacgactcgtcctcttcctgaactgacactttttgttgtacgcaaatgcgtccccacattttgcttgttttcattttcctggttctttcaccactagtaattagagcagctgtttcctacgaaacccattcaggtttttcaactgtttttttatttgtttgtaattgtgagacacggttcattattattaattaatacggtttcaccacacttcgtttgttcttcttcccgaaatattcatcttcattaccactaagtgtttatcatattccttctttgaactgtccaaacactaatttattctgttgtctgttattgaatgtctatctgttatacctaattccatttgctgttaaatacaaacccatttcattgttgccaatttaccaaattacactttcctttagtacggtaaattctttcggttgttgcattgtattgttaaagttactgttgccttaatatccattcgaaaatgtggagaataaagacaatgcgcgaatttctttttttcgattctttgccgtcgatttccttcgatttaatattatttttttaaatttgattcttttttcaacacaaataactttgttaagcaatgtcggacattcaaaaagcgattcaggcactggaacgagaatacgccgaacagaaagagctgttcgaaaaatggaagggttcgctttgcttttggcactttgctttttgggtttgcattggacgcagtctctcctcccgtcctttccccttacgtccatttgtatttgtcattcgtttctttaattagtccttggagattcacacatttcctttacttacatattctgtgctttagaagaaaatgcatccgaagctgatactgaaccatacaatgcatatgtagagcagttccgaggatgggagaaggatgtgatggacaatttgaaggaactgcgggcatccatcgcccgacagcccgtggcgccggagcccgagttgcccatggtcgacctggacactcagctgaacaagtgctgcacttcctgcatcgattttacattgtttttattttcaaatagcttgttggaccgtgtcgatactccgcaattcatcatggcttttatgagtatgagccaacaggacccaacgtttttggcaaaggcatttgaggtcattcatttgcgacaaataaatttttatttgggttctgtttggattagaccctgggacaatgtcaaggattttgttttcacaatattttattaggttgtgatggaagagtgtcgtaccaccggcttctccaatccgattttgccccaaagtgccaccattccatctcttcggcctgtccaccgtctgcccactccgctccaccaacaaccgcccggcgtcccttccgcttcgtcgtcagcgcggcatcaatcggcgagaagtcctggctctttgtacctgccgcctccgctgcagcccaaagcgtatgtgcaaggctcatccctgctggggccatctcggccaacttccaccgtttcttacacgcaaattacgccgtacgccgccatccccgaaagtgagtttatagtgagtgggtattccaatcattttccttttcttaggttgggttgtcgacgcaccgatacgaaaacagccgaagccgagttcaccggcccgggaatatcgcaccccagtgaatttaccgttcaaagacttcagtcaatcatgatgaaaggtatttttattttttcattgccttgacaaaaaatgtttgtttattgtgtctattatgtgttaattatttcaatcagaatttgcatcttttctgcttacttatccatttagtcacatttgattaatgaccatttttaaccgatcagcccaatgttcgacttccatcaattcatgggtttgggcggtggtgctgtcgccacttattcagtgcaattgcgtgccttttctgcgccatttttccagcgacacgatgaacgaagaatcaacgaactcaattacggcggaaaggtgggggatggaaccacctttttttgcggtgcgctttttccaaataccttttaatgaacggggggggggggacggtagtatttacaaccggtttttttcagtacttatgtactttacagatcatcaaaataaaaattgataataaaccttttctaggggaatgtg

SEQ ID NO: 9645 - DNA, 3134 bp, Heterodera glycines
accttttaaagatcgcggggggggggacggcggtgccgataggcgccgccggggaaattttgaaaatttgagtgctttgttgacaaattttcatcaaacggtgctatttttgcgactttaagtcaagttctttaggaaaaattaaggctttttataggcgacgcaagggaaattttttttggaattatttaaaaaataggcaaaattttagggtttttttaccccctctcctcttacgatcgacaattttcctcacaaatcggaattagtcgatcgtaaaaatttggaatttttaatgaagtttgttaaaaaaataaggcaatttttctttataaaatttcttttttcacattaacgatcgactttttcgtggatttttttctctctctcatttttcttttctccctccctcccttcacccccctcccaactttcctcaccccacctcttacgatcgactgtcctgaacccttacgatcgactatgagaccccccccctgaccccccctgtgcacaggtattgggggagaggttcttcttaatgtataaattgggtttctcgttttcagattctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctgggtgagttctcggaacagaaacaattaaaatttcctgttttaattgcattggatcaatttctctattcagatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtttgactaacatttatcgagcggttgataaatcctttttccacaggtcgaactgcgcaagttttcctgtctgaccaaaggcgatgtcatcgcagtgcaggcaagcaatcacgagaattgttttttaaattgttttttgatgtcctgccattccctcccacaattgttcatttgttcatttcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacggaatgagatggtcgcagcggaggaagaggtgaacaattagcgtaccaaaagaaaaggcaaataaattgactaattttgtagcagcagtcgcatccacccaacgtgttcaaaccgttctccgggtcagggtttcgtgtcgatgggaagaagccgcgatcggtctcaacaagttcacagcaggaggcgacgagcagctcatcctcttcggcatcttccgggcgacaggtaaatggcatcggcatttcagaaatggttgccttgccttcatccaagtctaatcacttcctttaagccttcctctgggattgcttcgactgcgtccactgcgcgtgacgctttggaggcaattgctgtggacgaaaattacatccctggggagttgcgttttgtgcgtcgtccgtacaaaagcaaggcacaaagggacaaagaggcgcgcgaaaaggacaacggagggacgatgaagccattcggaggcgaagggaacacaatccgaccgacgcgaggcggacaatgaacgggggatggacaaaagaatgacttgtggagaaaaagactattgacgaacggatgagtaatgataaaagtccttttgacggttgcattggcatctaaaacaataaatgattttggatctatccgatctatacaattgtcccgtaaaaataatattggtgaatgttatatttaaaaatgttgccgaaatgcatgctaaattcatcaaataaatttgggacaaattgaattttgttcagtattgggtagtgttgtgcacatcagcgataatatcgcacaggaaattgttgaaagccaagcgcaattcttccccctctttgtcaatgttcgatggaattacctcaaaagaatagtcaaaaactttcactaaaaattgacattctttgagtttttttaccgaaattccgcccatttcggccggtagtcgaaatgcagcaatggccgaatgattggtgctttcgtttgtgtggtggagaagcacaagcaaatttttggaactgatttcggaacgtaaagcaaattcggaatacctaagaaaaggcattcattccaaaggacaaaaaatgcattggcacaacaccaaatgagcaggtcgtctccggaggatatttcgggattgcagacaaaaatgatctgaacggttctgatcatttgttggtcaccgcgaatgatttgtgccctttagtcctttctgtgattgattccaacagttttggtcggtttcactcatctccttggaccatttaaaagtcattgctgatcgctccccttcataattcggcactccctcccacattttcggcatcccttcctcggctgtgctgtctttccctcgcccaccccattgcatcggtgtcgtatcgccggccaacagccttcgaactttttgtctccgctgcagtcccacaattccacctgcaattggtggactctcggctaattcgagtcttgagcttcccccccccccccccatttgcttttcccacctccgcgttcactcggtccccatccaattccaactgattgctttcgaattcgacgatgcgcaccccttcccattaatggcaattaccatttgactggtcatttgtgctcttttttcaccttgggttggtctgtactccttggagacggcgtcttgcgaatcggccaaataattggcaattgatgttttgccgctcttgaaaacgaattctcgaaagttaattgggtaattgccaacccgtgggggtccaagcacgagtattttgatgttaatttgttgctccgttcgctcttccgtcattcccctgctcattcgttttgttttttcgttttgttacccttaaaaacaaaaaatactttactttccgttaattttgg

SEQ ID NO: 9646 - DNA, 1459 bp, Heterodera glycines
  misc_feature (1391)..(1391): n is a, c, g, or t
cgaattgtcaccagtgaacgacggagggcaatggggcgatgtgagttaccgacccccgggggataaaaaccgcaaaatcatttgccaatttatagtggcaaccgtgctcagtgagttgcggcatcggatttcagttcagagaaagactttgcgcagacggaccatgtgccaacagcgggaagcaggcgaggacatgcaacgttcaggtgaattccaaagccaaagccttggccacttgcctcttaggactgttcccgcgtcctcggcatgcccgtgtggagtgggtggtccctgtggagcgtttgttcccggacctgtggccaaggcattcagcaacgctttcgacgatgcttgaacggactttgtcctcccggggaagctttgagagagcaaaagcgatgcgttcttggcccatgcccgcaggcagttcacacaaacgacacacacacacacacaaaacccttttattttcagtggtcaaattggtcccaatggaccaattgtgcgtcttgcagtgtttttgagacacgcaaaagacacaggcaatgtgtagtgaaagtggcaacagcgaacggccaacaggaagagactgagttaggacaggaggcatgcaattcggcaggtggacaaagcgaaagcacggaaatttgaaaatgccgaacaggaacagggttgaaaatagtgccgaatagtaaccagcggaaaaagatgtttttactggatttattttctgcaaattcccctcaaaaatgcggcaataggaccgggattcctggaaaatcctgcacggctcatgttcctgtccgggctctacaaatgaataaacgagcgtaaggggcagaagaaataaatggacaaatgaaaattagggaaagggaaaagaatgacagaccaaacactgaccatcaccaattcaccacaggtgctccaattgaattcgacaattgtgaaaggttttgcgcggagaatgaatttgccaaagtgcgtggagaaatgcgaagccaatcaaacggaaatgaatcgttggcagaaaaagggacagaatggggcgagtggtcgccgtgttctgtgagttgcggggagggaatccgtcggagagagcgaaaatgtgagatgggagagacgggagaatgcaaaacgggaggaggggacggcacggcggaggaaaagtgccgggggcaaaagtgtgcggaagagacagcggaaaaagcggagggagaaggtaaagcggacacaaacaatcaacacaggacaccagcagctcaaattcagcatcttcaagctcagtccgtcgcttcccgacttggtccgattggtccgaatggtccgcttgttcctgcttctctctcacgcgctacagacggcgcttctgccgagtccatgacccacangttgaggtgatgctccgggaaaagaaaatccaacaaattcttctcagggattctgtgtggggtctatc

SEQ ID NO: 9647 - DNA, 1275 bp, Heterodera glycines
cccgatcgatggtcgttggactgagtggtcggagtggtcgcagtgttcgaatccgtgtgccaatggcaaaggtcgcgaacgcggcactgctccgacccgcgccctgaaaatggcggcaaacaatgctcaggaacagacttcgaaatgcaggttgttgttgttgttgttgttctttgaagctccatcccaatggacatccttcaggcttgctccgaacccgtgctgtgccttctctgtgagttttccaaatgctttttctctctctccacgcactgccattcactccttagcccagtcgcctccgctcactctttcggccaatgcttcttcccccgccccttccgacttttcctccactctctcacgcctctccccccagtggggcccctggtccccctggtcaaattgcacttccacttgtggtttttccctccggcgaaggtttcgcttctgcgaattgtctcacgaatcgcaactgtcagagcagaaatgtgaagggattgcccaaatgacggcgatgtgcgacacgcctttttcttgtccgaatggtgccaacagaagccaaaattgaaacactgacaaagaaacgaactaacaaagcacagatactgcggtgacggacggacgatggtcggaatggggcgaatggtcgaacaattgcgaatgggacacctgtaaagagagtgagccgaaggaaggcgacggaatggcgcagaaaggagcaaaagcggaaaaggaagaggaaaagcaggaggacataaagcaggaggagaacactccgacggaggagggcgaggagagggagggggagcaattcgagggtcacccgatgacattggcacgcgaacttcgcattcggacgaggtccggtaatagtgaagctggtgcctccccccccctatttttatttatatttttaatattctaaaaacatggttcttagggttttcggggtcactgatcatgaatataacatccgttaaatgtagtcaaaaacaattggaacatcaaaaaatggtaattttgtacagatacgaatataaaagtgagtttcgagattttgagtttacgactttttggtagagttagggtcaggggttcgaaattggtcgaagtggatgtcatattcgtgatcagtgacctcaaaagcccaaacatgtttttagaattttttaaaattttataaaatttaaaaaacgggggggggggggggcgggcacctgcttcactattacaaatgccccttttatgaggggttgaacaatacaatgcccg

SEQ ID NO: 9648 - DNA, 3067 bp, Heterodera glycines
ccccctcctcaggacccgcttctgttctgcgccttctgccggcggcagtccctgcttcggcccttactcacagcgcttttattgttcatccccaattaaatgcgacagcttctcccatttccatttccagttgatttacaagatttggcaaatggacgccacaatcattcatcggatgataaatttctgagtccctcatggacgataaaaaaaaggaaaagcggtaaaaaaatcgttggcgtaaaaacaaaatgccaatgtatttaaatataaaacaaattgtcttaaccgtgctactaatcactaatcaagcgtggacgcccccaaatccatttctttttctatagatatgcaagatatgaagtggatttaacgtgtaggataaaacttacgtcacgaaataaatgttgttttacattgttaaaaatgaagagatagcacgaaagatgagagggaaaagggaaaaaaagattttatgtaatggttggcattttgttttttcgtcatttttttgccgcttttttttaccgaccattccttgttcggtttgaagatctcatttttagaattacactttcacaatttattgatacaatgttaaaagtaattcgtagagatgatggttctcgtgtttctttttacgcatctaatatgtaatcagacaaggttttgcctcaagaagtaacaacaaacacaaacctgtgaaaacaaatatattgacaccctgaatattttgatttcaaatgatgcaattctcattcgtgatcagtgatcagcgccgcctgaagcccttcgaagaatattttcatgatttttggaaacaaatttttcgaaaaatgttcgagttcggattcgggtccggattggccaaattattttcctcttatataaatcatttaatttagcaataaatcctcttattttttccggagagctgctaagccgcaaataaattgccatgactcaggaaagcacaatgatttggtttaacattggaaagtgctaacaatatctgtgtttgatcttgatttttttagtattgacaattcggaatggatgcgaaatggagaccttccaccaacgagattcaattgccaacaggaggccgttcgcgcacttgtccttcttaaattgagaaataaccctgaaaatgctgtcgggcttctttcgttggcggagtattaactttaaagaattttaaaaatttaatttccctttcatttagtatcaaaagaaattcgtcattattttttcaatttgttttttagtcgtattgatgtgctcaattcacttactaccgaagatcgcaagttgatggtccgtcttcacagtcttgaaattcttgtaatttttttctttttttcatttccacttctttttcctaattagggcgtttcgaaagttttcgatggaatcagaaccgcatacttggcactcaaacacaggaagaatcgcaaccatcgtcagcgtattgtcgtattcgtgggcagtccattagacccgttgcttgaagaaaaggaaacggtaaacgttttaaaaaataaaatattgtatttaagaaagtgttttaagtttataaaattcgctaaaaagctaaaaaaggaaaaagtgagtgtcgattttgtcttgtttggggaggccaccgccgagaataacaaaatcattgccgattttgtcgaccttcttaacggggctgaagagggaaattcgcatttgttggtcgtgatggttggagacaccaaactgtatgatgttttgctccgttcgcccatttttgcgggttcgggggctgcattaggcgcaggcggagaatttggcatcaacgaggaggacgacccggaattggccatggcattgcgcatttcattggaggagcagcgtctccgtcaacaacagcagcaaggcggcgaaggaacgggtgaggggagggcatttgtttaaagtcaaacagtaatatttgagaggggttcattgaccacgtaagcagggacggtccaaaggggtatcccccttcctacccaaggggcctccgcacccgaaatttttaaggaaaaatagtatttttgctgaaaattttagattttccttggtggtacccccccccccccctccccagacctagcctctcacccaaattttacaaaaaatcgacaatttttggtgagtctcctaaaaatggctcaaactcgcaaaattcgtcactttttttggacaagattcgttaacaaatcgcattaaaaatgcaaaagttttcccggcggcgcctatcggcactgccggaccccttgttccccaaaagtcttctaaaaacttaaacaaaaagtggaaatatttttcttcaaattcacatttacacaacaatattttaaaaactagggggaaggaacaactgcgagtagagttcagtttgttttaagtattaatattcaaaaatttagactgaaagattgaggcgcattcaaccccaatttacaccatcctagacaattctgaaacattggacggagggaaggatgatggtataccaaacgatcatgttgttgggaagtttcggactcactttattttgtgtacgaataaacaaaaattgaaataatgtgttcgtggaagtattatgcacaaaacagatggaattttgggttttgttttgaaaaatacattatgcagtttgtggtggacgcagagggggagggggtgggtcatagtcttgtcgcttcattaattctttttcaactgtattaatgttccatgggagaaagtctgcaaattgtgctgtcgtttcttcttttgttgacgactgaaagtaatttcgtgtatcactacttatacagtttgacccacatgacaattttaagattagattaggggtcctaagagtcggagaatccgaatctgacattaatttcgaacccgaattcgagcaaaaagtcgaaaattcaaattttcgattttttatttttggtctaaaaatggcttacgtatcgagaagcaaactaaaattggataattcactaataaaaattattcaaccatttctagacaaaaataaaaaattagaaaatttgaa

SEQ ID NO: 9649 - DNA, 1108 bp, Heterodera glycines
tttgatatttgaaagcaggataaattggaatgagctcactaattctcctcaggcataagtaatttaaaatgttttaatttgttaattttataggttcttgtcctgaaggcgcatttattgagcaattaatgggacttgaaagaaacataaatattataccaagttttcagtccactttttggttgatcattagtcatttagattttctaattagagaggattttgaaaaaaggaccgagcccccgcccccaagtcccagaacggggacaaactctaggatttcggttttttggcattttggagcggcaaaaagcttttcctcacatgtgatctgttcagccccgcgtgttggactgtctgcattcgatgtgcgaggactgtgtgattgcgcagctcggcggggacattgaaaatgccaacaaacaccagcgccaccatcctcactttggtcgtgcatccaccgactttgagcttgaacaacacatgaacaatttgcgtccaacaccaccaggcgtaatccgatgcccagtgtgcagccaagtacggcatgcccatgataaattttggggaaagcgatagacggactcttaattaaagtttgagactcgccggagaggcaagcagtacggatgcatttgtggcactgatttaactgccggccggccctttaaaaatgaccgggcgcaaaatgccggattatttatattttctctgagcaatgaaactgttaaaacaatgactatttcttaatttagtcaattaggaaatgaactgtccaattagtgtttaaatcgaagaaaaaaaaatattatgtttctcttcctgcttaaggaaacgcacattggcaatgacatcatgttcgtcaatctgatgttagtttttttgtatttattaggcggagttccgtcaatattacgcatgaaagtatcaggcaaaaaaaaaagtgacgaatttagacattttgttacttagggccaccgatttgagtgccgttaatgttgaaattcgggtgaaccacccagctaaaattatgaatgtaaaacaaatcaaatgagtttaattagaaaatttgatgaattgtccaataaattatatttgccacaaaatc

SEQ ID NO: 9650 - DNA, 2338 bp, Heterodera glycines
  misc_feature (2237)..(2237): n is a, c, g, or t
  misc_feature (2281)..(2281): n is a, c, g, or t
  misc_feature (2298)..(2298): n is a, c, g, or t
tttatattgagacattttcaaaaaatacaaataaaaaatcatggtccagggtccacttagtttttggttttcttacccccatttttaccaaatttttgaggcatatggtagtccctatgttgttgtttcgaaatcactgcaactgttagggaatagaggtgatgggtgtaaacaaaatggtgatgactcacttgcatctaatgataggggagcgtgataaacaagcattgattacgctttccgccccttttttgtttcattgttgccaccacccactcactcaccaccacctttccaggttatgatgttttctgacttgaatcaaccatccgacgaattcacgaaaagcgaggccgagttcaagctggtcgcctgcaccaaacaccgggccgatttcatcgccgtttgtttctcctgcgacgaattgttgtgcaaggactgtgtggacagcggggaacactacgcgcacaaatggtcatttctgaacagcgaagtggacattctctgccgacagacactgcaggagttgggccaacaggcggagcaaaaggtctgctgcttcccgccattttctgacatttttcaatattttccgtttccttacgcctgccgcctaaggggtttttgagtttttcaacatttttttttgtgccaatcactcaaaaaaaaagatgttcagccaattggcatttgcgcaaggcaggcgccgggccttgcccaaaccggaaaaagctctgaaattgggattggccggcccgactcggggcgtcaaaaaagtccgtttatatgggctgccaggccctcgccatttgatgacatgttcagaatgtcaaacaatttttttgttgttataaaaggctgataaaaaagaaatcagtccattttatttcgtcgcgcaacccaatttccgaattatcttaaagtttaactaattcgaattcattcaccggaaatcgaccttaaaacgttttgtccctttcagaccccccactccaaaattttttttctttttattgtaaaattgtgaatctcagggtaaagcgacgctcgatgcacgggagtccattccggaccggaaagagttgctgcatttgtcgtccaacaaatgtcgcgagaaaattgaggaggcattcgtgtattatgtgcacgtgttgagcgaggtgaagaaccaactgttggccgaattggagaagaaccgggacgagaaggaggagtacttggacagtctgtacaagaagatcgacatgcaaacgtcgaagttgcaggacgcactcaggttcacaaacatggatggcattaggaataaaaatggaattttttgggggttcggtaggaccgataacggcattttctatggctctactgccgtttaaaatgtttactagactattcactgcaaaaacgggcagtttaaaaagcgtttttaaaggcaaaaaagggcaatctatttttattcactgattttattgctccgacataatactaaaacgctcgaattaatttctaaaaatgttcgaattttgatttttgcattttttaaattactaacagcattcattggattcatttttttagatacacaaactgtttgctggagaagggcactgtgacggagctgtgcctgaacaagaacaaagtgcgtcagcagttgaagctgttgattcattcgatgccggacgcaaacgcggaagtcgacttggactttgactcgcccaccaaggcggagttcaagaagaaattggagagcattgtcggcgccatcaaatgtacattattaacacttttttattgctctttgaatttgcaaaaattttttgtagtattggctttatttttgcatttaaaaatgcaggcaaacattttgggttttgttaaaacattgtgctactataattatatgaaaaaaatagggtccaattttttgaaaccgtttttctgccataggctaattgtaagatatccattttgatgaaactttgattcaggccgtgtcacgggactgccaaaggatgcgaaagggctaaaccttttgacaaacgagcaacagccgcaccagcagccgaccaaaattgagggcctgtcgctgtcggacatgaaatatggcactggtgctggcgggcatttgtccgccgttgcgtcgcccatttgggacagtgccaacaagtcgacgtccatgattcagcaacagcaggttttgtattactaaacaatgacaaacaaatgccttgaatacacgntcaaagcggtttttctccaaaatgacaatttttgcccgttttgnggtcaaattttcaaaanataatgatgtactggagtctgccggtgatatcgataggcg

SEQ ID NO: 9651 - DNA, 1552 bp, Heterodera glycines
ctcccttatggagtgggcgggaggggaggggtcggacgaaattgttagtcttttcacacattgggcaaattaacaccggagcagcagctcgttcccaccgaacatgtgttaaaggaagagaaattttttcttgaaaaattcgctgcggtatagaaatatgaagtatacccaatgacactgttccatgtttaagagtcgctttggcgccgactctttcccgggcttccgaactccgactggcggtggtctgacttcgccagacgcgatggtgatgggtggccaacaattctgtgacccgacaaatccaatgtttccggacaccaacaattatttgtccggttcacaatccaaactatgggcaggggtcagtttttgggggttttatgcatttaaattaaaaaaaaaatttgggaaacacaaatttctgttccttcgactcattcattaccaattcagcagttcaattcgccctccatgttctcacaatttgactccacgcccgcccaccagcggccccgtgagctaatggagtcgcgcttcaccatgggagagttcggcgcgggcggttacggcaacagcagctgcgacctgtcggccggcatgcgctcgcgttcgtcgctgtgcaacacgccgtccatggaccaatttgtgaccgcgtcgagcatcgcttcgcaacaggtggtgttaaaaaggcgaaaccatgagttaaagtgtacaatttgaccaggacttccttgcacttggcaatggggccggtggtagtggaggtggtcgtgctcatcaacagtttggtagcggctcgcccgcaaacgatgtgcgtttttagagggggggggggtgaattttgaaaattttgcattaattttaacattttatttatttataaaccatttgctccatcttctaacatctgccacctctttaaaatcaagaattttttttatggaatattgcaagaattgtaaaaatattttgagcaaaataagcaaaacaaaagtttttccgactgcttcgatataggcacaatgcgaattttgttttttgattttcaataataaattattttgtcctacgtatacactataaaacttatttatatctaattttctttgtgccatttttggcatttttcatatggcattcattcatcactttcagatgactctctgcaaacatttcaatgccgacaaaaacaacggggcggacactttcaacacgccgcagggcatttgcttgggcttggattccgaaattgccatcgccgataccaacaaccaccgctgtattgtggtcaacttcaacgatggtttgtactgggcgtagacacaaaaacaaaaatataatcttcacattttctccatttaaaggcacttttgtgcgcagtatcggaagttccggaactgaagaagggtccgtttactacccgaaaaaggtaattggaaaataaaatgttaaaaaaaacttacaattcggcaagaagaaatgtagctgcacccggtttcgggaggggatggggggggaaggcgaaatcgaagcaattttgacaaaaatt

SEQ ID NO: 9652 - DNA, 5957 bp, Heterodera glycines
  misc_feature (3486)..(3486): n is a, c, g, or t
  misc_feature (3508)..(3508): n is a, c, g, or t
  misc_feature (3515)..(3516): n is a, c, g, or t
  misc_feature (3519)..(3519): n is a, c, g, or t
  misc_feature (3569)..(3569): n is a, c, g, or t
catggaacaagcaaacagtttgatcagttgcatctcggagagtcaaaaacaaattctttctcctttctgctggtgttgtacaaaagtcgccgactctgcccgaaatacaattcatcacctccgctatcacctaatcatcatcaccatcatcattaatggcccattagcggtggttgggttggatgatgatgatgacctttccctgtcaccgcaatcggcaggccctaaaggggcgcgtttatctgattcatcgtccaccatcgtcgatccccccccccacccctccgatcgttacgccccattcgctgcttccccctccaattgcgctgatcagccaaagggtcccttctcccacccattcgtttcgctgcaaattcagttgttgtcgtttctgcccttttttctttgtacttaatttattcaaatgacccatcggaaagtcaaatcccaattgatcagtccgttccccgccattctctccccaaattcttccgccccactaattttgctctgatcatccgcattagccactcccacgaagctaattaatgatccttgtccctctctcgtaacataaatccaatccgaaccattccataaatctgccgggatcagcgaccatcttcttcctctactccttctcctctcacagtcagtcatttgttggttctgcaaattccaattcaatcagccaattgaccaacaatcagtaatgactctgctaattatcctccttttgcataatttgctaattggacggcttcttcccacttaaaaccttttccttttctgaacatctttcaaatttggcttttttgcacgatcactgatcagagtgagttatcgctgtgcaatcattcccctcgactcccctctaaagtttgaattttgtccctttattttgtccattaacgacatttgcgctccattgaccagcaagcgccgattgagtgaataggcgcgtcaattcgttgcttgtttcgcttcatttgactttattccctccctttttgctgctctcccaacaaatgttagtccaaagaagcagagattagtgacaattttaaagaattgaaatacttggctttatttattatatagcttatactgtgtgatacttttttattcatttatgtatgctaaatgtgacggcgtttgtttttgtccataatttaatgggtgagagaccacccaaattgggaggaggggggggggggacgaggggggaataagcgaatgcgatttactgattcacaccccaacagcacggacagtgttttggaaacgtcattttccaacgaaacaagccaattctcatatgcagaaaaatgcatttgtggattttgcttaaatggctgtttttgtgatctgatcagttggaccagtttattcatgagttgatcattcgaacagattctttttgggtattgggaaatgtttagctgatcatccggggggactgtttttgttgtgttggtctctgctgctggtgaattgttttttacgagctgatcaattgtcccgctttttcgtgtggtgttgaattgtctgttcatttgcttttttgtctttcagacattcgtaacggtcatcttggtgtcattctgtttttgctttaccatttgtcatgccatcactccgtttgccaacatcgcttggcccaacaacgcgctgccgttgaccaacaaaaacgccttgccaatcaccagcagcgagttttgctcattaattcttctccaatccgtccgatcggtcgtctttcccccgctttctctgctcactcttcgccttttgctgcccatcggccccgttccaattgcgcaacaacgctcagttcgcattcgtctgggtacagcagcacatgccaaacaaccgccagctcatcgacgacgccaagcagtaacagaaacaacagcaacagggggaaggagaaagagcagttcggaacaaaagaagaagaggaggagagattggtgggagatgattgattgactcacatggcatatttaagaggattttaaataaaattaatttgccgaagaaaaaatgtactaaaaaagaaaggagcaaaaaagcttcatggtaaatgttttctgttcatttccatttatcttttttctttacttttctcttataattagtgccaaattttccccatttctccaattttcttacgcacattttttcgagttaagaaagaccagcagcaacccaaaagttcgcatcgcgaaaagcgtcatcaccagccgttggaaactcattatcattcaacagttgccgactcattggcacataaaagtgccgggaggaaaatgccacccgactcatcggtggcaccgacggaaggcatcgaaaagggggacgggggagaagaagccaatcagcgactgatcagcggaaacacgcgaattacgaggtgagggaaacactcgaagaaagaaatacattttgttctctccgttttaattgatttccgggaattttaattaattccctctcggagaaataatggccaattgcccacccattcattcccttgggcaacccgcggcgctttctcattttatcggtcacttcggattccaatggccattggattacccgacaatgaaattcaagtctcggcaccgtaccttagctcttcccttctgcttgcgttttatgtaaatgccattcccattttaagggttgggtttcaattaaaatttttctttctttttttttgaaaattttacttaattttccgtccgattcttcaaattcctaagaattgctgcttccccccatcggagtgcccttagcgtgccccaaatttccgccgtgtcttccaaacgttgctccattgtctccacaaggcccccgagtgaagcggcacagccaaaggcagtgggcacaaacggaagccgattggtgccaccagcagcgagtcgaagaagcacaacggcacaaagtgccaatggttcagcggatgatccaatcggcggaggtgacatgacgtccctttccatgccacttaccttccttccttacactcttcctccttttccctctccaattcttccaatcgctctgtctctttctctctcaccctctttgttttttcaatccatcccactctttctctctcccctctccaattcttacaattcctccctctctttctctctcgccctctttgtttttccaatccctcctcttccttacactttcgtccctccctctctccttttttcattgcttctttccctcatttttacatgtttccctcttccgattaatgacgcgcaacgaattcgtgtccccgtctgtctatgctttctcatcccttcctttggctcccttcctcatcatcaccaccaacatcattcacatcattcattcattcattcattcatcctcggcctgttaatggggcgatcattcatccaaaaagtaaagcccccccccccacttcatattacttctctctctctctctctcccactntctctctgcctctgccccttgntttcttnnccntcccccccctttctctctctcctctttctctcttcctttttctctctacnccttctcccccccccctaatttctctccccttttctctctccccttttctctctccccttttctctctttccctctcccccctttgtccaatgtccttggaatgaatgcgcctcgggggaattagtgcgaattccctttattattttgctaagctgcgatggatattattcattcactcacttactcatccgctcttcttctcacctttatttgtcccctgctgatccctttgaatgattctctcctaatcatctcaaaatcggcttatgcaaatgaattcagcaacagatcgtgcattcattgcctttggcattggcatttctcaatcacttgtctgatcactcccacccttccatttcttcatcattttcttttccatgccattcattatctcccctatccccccttttagttgactttgtgtccccaactttgactgccagtcgcatttgtccgcaattttcgactgttttgccaccagcgaggcgacaccttcgcgcacctgaggggataaacaaaagaagcagcatcagcagaaacaacgagcaaaacgatgacggaaagaaaggagaaacgccggaggggtaaaaagaggggaaaaaggggggaaattaatggacaaatgggaaaaagggagaggggagggggatgataatgagggtgtacttttatttgaaattgtcatcttttaatttgcaggtactcattccctcatcttttgcccccccccccccaattcaaaccaaaattcaagccaattacccccctccccacactttttcctttccctttggcccattccattttcacacagatgttatcttcgaacatccctttctcgagcaaaagtgaaaaaatgtggcctcacatttgtcaatgcaaagcgatggttttttggcattttcccggggatcggtcggcggtctctcccccgtcgtttatctgttccgatcattggctaatccatcagcagaaacacctccacaaattgcccctttaagcacacccgtggaagcgcccgtcccccgcaatttgtttttgccctctcaacgggactcatccgtcccgccgagtgcccttcagcaatttgagcctcaaaagtccattctgagacagccttcgacggtcaaaggacgatcaaagtcggcggcactccgagctccgatcaattcgattagcagcagccgaccaattaacgaacagagcgaacaatcgccaaaagtcagtgccgaattcgattgataaaaaaccatccaaatttcaatcggattgtttcagcagtcggatcagtgcctttcgtcttcctccatacctcaaccctctcagcagcagcaatcaaatcagcaagcttctcccccctctgacgctcttcccgccactctctcctcccctccgattctttcgtcccttcctccgatcagtgcctcgtcgtcccaccgaaattctcagcttagacttccatttgtgaccaaaccggcacccccaaaacggcattgctcaacagttatcagaacaacggcagaaagcaaggaaacggaagaagcagagaaagaggagagcgagatgcggttattatttggagggagagaaaaagagaggaaaaaggaaacggtaagagaaaaagagaaagaaattaattaaagcaaattaaaatttaattgggttatttaaccaatgaaagccaaagggaacgaaacattagccattaaatacacaacacaaaatggacatgaaaagaaaaaaaggagagaaaatggaggacaaagtgaaagtgtggacaaacggcggagggaattagcgaaaaaaagggggaaaagagtggacaaaaggggcgaaaagcttaaaaaacaaatgaattgggcggagagggacaatagacagacacttgagcaggcgaaaataacggaacaattaaaataatgattcaattttatcctttgctaattgtctgtccatcggcaaaatgcttttcgttttacgtttattacttttgacacgagtgagtctgcttttcgctgtttttgttttgaacctgccaaattttcgcaaattaaaaaatctcaaaattcctccgacgcttccctcgagtcggtcggttgtcacaaagactgccccccgcccacaataatctctcctcaaacaccaactgctgcctcggcttttgctggtcccccaaagggattttcgcccgattccattcgattgggcattttggacacggcttatgagcagcacagcacaaaacagttggtcagaggcaattcaaagtgatcagacgacgagtaaaacgggcagcagcagcagaagaagggaagggaaaggaaggggagagattgtcggatgaccaacccatcccccgggggctgttttgatattcaaatgattga

SEQ ID NO: 9653 - DNA, 1250 bp, Heterodera glycines
  misc_feature (167)..(167): n is a, c, g, or t
  misc_feature (1151)..(1151): n is a, c, g, or t
  misc_feature (1178)..(1178): n is a, c, g, or t
ttttcgagcttttgcagatcgatttttcgatggttgtcacttcagtcccgcgcttgattttacattgtgacagtttacagtggtgttcgtagcactttcggcatttgaatgtttaaaataattaatttaaaaatacaacggattcattgctttacttttgaacatcncaggcaggtctcgaaaaaattatcgttggagtcaatgcaatttcccctgaagtccgatcaaacacgctggcagttgtgacactaccatttgcatttagaattgtgctggttttggtggctgtatggcatttcacactaaaaaatttttattatcattttttcctttgtttttaatattactccaaaacagtagttcctcgttccaaagacttttccaattgattttatagggtcgtagtgaccggcgccgccatcttctccttctgtaaagagcacgcatagctctttttggtagttgttcacgtccgctttccacaaaggcttcatttttccagatgtcccaaaacagaacagacgaaatgtgtccgggtgaagccggtcataataagccttaattattatattattattattttatgttaaaattggtgtttttttcctgaaaatacctgaattctctctccgtattcctcaatcgagtagaatggcagtctcatattaatttcacaggtttggcacaaagtcgtaatatcattcagctgccactgactgtttcgtttgtattcagtaaatcgctgatgtcgatcccgtagctcatgtttcacacgtagaaactcaaacgcccggaagagacaaaagttgtcattgtttgtcagctcgaaagttgtcccatcgcagatgctgtacgggatgttgaagtcgggtctcctccctttgccagccagcttcttcctctgctttccgctctcgatcgccgtgatgtcgatgacgaaagattcttcgcagattgaaggccgttccttcgccttgttgctctggtcaacaatctcaaagcgggtcaaaatcgtctcagccattgacccatcgatcttcttgacgtttttgaagtgtacggctatctcgtagtcaaggtgtcgtgccgtcagaaggaagatgaaatgattagcaacgatgttcatagcttccgctcctttcgcagcgtangtgaggcacatcaagaataggctcttncacacatgctccgggtaatcagagttccatatgtaatccagcataaagcgacccaagaaacgatatgctaaa

SEQ ID NO: 9654 - DNA, 4061 bp, Heterodera glycines
acggtgtacggacatttcgcctactcgacatctcgcgtcccgacatctcgcctactgacatttcgcctactaagccaaaacctttcatttcgcctactaagccaaaaacattcattttgcctactaattagtaggcgaaatgaatgtttttggcttggtaggcgaaatgaaaagtaggcgaaatgtcagtaggcgaaatgaatagtaggcgaaatgacagtaggcgaaatgaccgattttgggttagtaggcaaaatgaatgtttttagcttagtaggcgaaatgtcgagtaggcgaaatgtcatgtagcccacaccacatgcattgcaacgttttgaggtgttgcagatgcacctctcgattgtttttgtctcttttccctttttcactttgcacggcgtaattttcttgtgatggtcgtagcactccttgctttggaaagtctaaaaaaataatgtagcaatacaaattttaaaagtttactttatggcatcccaagcatgactcaaagaaattgtcatcaaagtttttgcaattttctcgaaatctattgcccacacgctggcagttgtgacacttccatttacagcttgaattatgtcggttttgttggaagtatggaactttgcacttaaacaaaaggataattatttatttatttttatataccccgaaacagtaattctttgagccgaaaatttttccaattgatttgattgcgtcatagtgtccaacagctccatcatctccctccttgtaaagaacacagagctcataccggtaatcactcatggcggacttccaaacgggtttcatcttgccaaatgtgtcaaagcagaagagacggaacatcccagggtgcatttcgttgtagtattccttaaatgtaattttaatcttaaatttatttattttaaattacctgaatttggtttccatattcctcaatggaataaaactgcaaccccatttggatgtcgcactctcggaataaagaagtcacgttgttaagttgttgtccttcatcacgtttatattcagaaaatctcggatgtggcatcacatgcttcatgcgaaggaattcgaaggcgcggaacaagcaatacgcatcgttgttctccaatccgtatgttgcaccctccagaaggtcgtacggaacattgaagtcacggcgacgtccacctttccccgccatcttctgtctctttcctccactgtcgatggccgtgatgtcaataacaaacgattcctcaagaagtgatggccgctctttggccttgttgctttgatcaacaatttcaaagcgtgttaaaactgtttcagccattttgtcgtcaattttcttgaaattcttgaagtgcactgctatttcgtagtcaagatgccgtgatgttaagaggaaaatcagatggtttgccgtgatgttcatagccgaagctcccttcaaagcgtatgacaggcacatcaaaaagaggctcttcaaaacagcttcggggtagtcggcattccaaatgtagtccagcataaatcgtccaagaaaacggtaggcttaaatgaaaacaaaaaataaatgtaaattgtttaattgctcgaagaaaattaatcaacctttaaatcttccactctccgcttgtgcggcatctaggcatttgaaatgctcgccattaaattcttccaagtttaatcgctccttgatcccgtgttcattttttcctttaacatcctccaaaatctaaatcattgattaataatattattttatttcaaataattttcacccgttgattaggcaattggttaattacttccacaaggggcggagcctcctcaaagggctcatcgccatctcgcacgggcgtgtatggcccgtcgaggacaggaggcatttcgtcatcggacgacatgtttcaatacagtaggaataaatgattgctgaagtaagaatgacggtaggattacggtgggggtcagaaaacagagaaaagggggcgtggcctatcagacgcgtacgccacgattatcgattaggcgagagagtacacgaaagaaagagagttaggtcagagaagcagaggaaaaggggcgtggcctatcaggcgcgtacgccaacaatatcgattaggtgagagagcacgcagataagagaggttagagatgcagagacaagggtgtgcagagaagcagaaagtcagagacgcagagtggcgtccttttttatcgattggcgagagagcacgcaaagaagagaggttagagatgcagagaggaaatgagtggcggccatggttatcgattggtgagatagtacgcagagaggagaggttagagatgcatagagcgtagtgagcacatacaaagtgtacattgcgaaataaaaatatgaggacatattgcaaaaaaatggggctgccttataaaggcattgcgcatcaggttcttttataatattattttcctgattgggattgcgcagggaaggaaattgatttattaatatcaaccaatcttggcctgatgagcagcacaccgccacccatgaagcacaagacaacagggcatctgaaatgtctagaatcttagcaaaataatatgagaaacctcatggtctaaaatacaaattgaaattgctgccaggataaacggagctcattaactagaactaccgccctggttaacagcaaacgtggaataattgtcaaaatgtaaccaatcttggcctgaagagcagcgcaccgccacccatggagcacaagacgacagggcatctgaaatgtctcgtgagattagtaatgtatgaataatcacctcaagacctaaaaacaaaataattttgttgccaggataaacagagttcattaactagaactaccgccctggttaacaacaaaacaaaaaaaaacaattaaaaacaatatagaagcatgaaaaaatgaaggaaagtgtgtgacgcatccttttatatgcggcccgtcctcaaatataggtcaagtgttactatttatagaatatatatacaagccatatttgaatttcccgccaattttttgaatttgaatttcccgccatttttttaaatttgaatttagtgccaaaatgttttcgtttcaataaatttaagtgtattatatcatctttgcagcatatagtggacaattatcctttttctggcaagtggtctcgtggcagagtggtagtgtgttgggtttggtggcagagcaaaagttcgaatccgcttgcctgcgacttatttattgcgattttccctgggctaccgtacctctcgcagtggtgacgtcatcatctttacagcatatagtggacaattatccttttttggcaagtggtctcatggcagagtggtagtgtgttggtttggtggcagaccaaaagttcgtgtccggttgcctgcggcagaatttttcgaataaaaatttgaaaaaaaaataaaaattattatttaaaaataaaaaaataataataaataattttcagaaaaaattttacaaaaaaatgtcgcgcacccctgcaataggtttaggcttgcagaaaaaagtcgcgcaccccccctcaataggtttgggttttcaaaaaaagtcgcgcaataggttttggtttcagtactgaaaaagttggcgctcagttggcccgcgctcacccggcggcgctcagttggccgtgcacccctcccataggtatgggctgctaccgtacccgggggaatcttcgcccctaactactaaaaagtatttagaaatttgaaactttaattaattcttagagcattcacggtttttgatgattcaatttaaaaataaaatggaattttgttttgtgcctttttggaccaaaaatttaaaaacattaagcggattacaaggaaaaaatcgtcttgcttttttagatgttgatttaactaaaaaaaaataataacggaattgttaatttgcagtgaatttcctttcgaaaaaggcaataattttgaagaattagaagaaaaacaaatattggatgggaagtgatccaaagcacaaagaaggaacagaaccaagagcgtaaccgac

SEQ ID NO: 9655 - DNA, 4476 bp, Heterodera glycines
taaaggcaaaaattgatttttttttttttcttcaaattttcgcccttttcagagccaaattttttaatttacttttttttctaaatcattctgatattttatgaatggcacaattgctgatcaaagctttttctatggaataaaaaataaaatatatttttgaattattcgaatgttttcacagcgttgaaattcaaaattcaaagtgatcggccgatggcccattaaaatgaagcgtaaaaatggggaaatgaaatgcgtcaaatccttcagcagatcagcccccccccttctccgccatcagtcatttcacatctgttcattattcactcagagagtaaaattattagaaaaataaattttgttttatccccaaaatcccccggggggagaaaaagcacacgtcgttttggcggtttcagcagagcgatggtgggctaatgaaaaagcaattgttgtttcaccacacctttcatcaatcaaaaaagtggaaaataaaaccaattattcttttttttaaagaatcgaaaaataagctattttttgaaaaatttgctttttcttcaataaaaaaatttatgcttttttttaatattttgccacccattgtccgtttacgttaagggacggcatttggaaatttaataagtgccaaaaaaaacaaatgccttcaggcaaaattaaattgacacaggacaataatgcatgccgataatgaactttcaagctatatatggattttctattgcaaaatttcaaaaattataataatttttttaattagggtaattttttacaaaatataatttttatgctttgatttatttttcacttttaaatttctccctaataaagtcaatccgtccatgaatttatagtccaataaaaggacacaaatttttccttttcttttttttttttgcccaattgcacttaattaatgccctccctcggccggcgacgggtcaaagtgccaaaatggccaatttcgtccgcttctccgcctttccctccgctttttctccccgcttttcctatggcatttcattctttctttttatgaaatgttctcttctctctctttctctgcaggaggccaattaaaaatgtcgtgaataattttctcgccgccttttgttaatttttggagtgaaatattttccgataaattctcacaattttttgtccttttccgaattagtactgttccaaaaataatttatttacccattagccaaaactcaaattttccgttcaaaaacccatcgaagtccctcaaaatccatcaaaaacaaaaaatggtttctctttttttcgcgaattcacacgcttctcaaatttttgatgcataaattcacttttttcttgaaaaaaattgattttcacatttttaaaatgccaaacaaaaaatcagcatcttttccaaataaaattgaatttaatttgaaacattttatgtattaatattttcaattttctgtcccattttgaaacatttccccccttaccccaaaagtttcccccttttttttcttttttccattctttccagtcacaacatttcttttgtttgtttttagctcaattttcactttttcgttttattttttctcaaattgtctcacgacacctccgccccaattccttcgacttgcaaaattaaattgaattgtcatcacagtccgtccatctctcatcagtgtcaatgtcatcacatttctcttttttctgtctaatcgtttttcaaactaaaaaaaactttgttcgactttcgaaatgcccccccccccctaatattccctcgggcacattcgccgagttccccttgattaccttatttttgtttggggcgtttttgctgaatttttgactttaattggcacctgctgcgaatgcccgcgagaaatgggtcattaaaaattaatttattattttcatgatgcaatcggtaattgccaattagttttttttgccaattcactttttttacatctgtatgcccgcagcaaatgaatccccctcaaataatgttgcattttgcaattatttcaggccacgaaaaagtgatttcgccgagtccgtccggcacttcgctgtctccctcaatgcttcgctcacaaacacagcaacaaccgactacggcaacaccactggcatcagcgacggcaccaggtaaaggctgatgagaagcagcaattgatatggcttacttatcggcttttaagggcgagtgccattcgctcttcccccccccccccccccccgtgggtttcaggagccacccaagacaaggcaaatcaatttaatcttggggttcatgattaagaaccaaattaatcacattaaatttatttatttttttcaaaattgcctaaggcactatgccattgcgcagcgcggcgtttgcgcgtaccgccaaagcattgcagcaaaatgcgaagcagcagcatacacattcggcgccggccgacgctgggattagcagcgagcacaaaaagcgaattgaactgtgggcacagacgccgtcgacggcattccatcaggtgggccggcgctgaagaacgaatgctccacaaatttgggccaaaaatgccgaacaaataaatttgggaacggggggggggggataggatgaatgagcaaatctagcaaaaaaaaaaaaacgatgatcaagcccagtcaggaagtgcgtaattaatttgttgaacgaaagattcctcccctcccccctttcggcaccccccgttaatccctcggggcttttccaaaatgtttggggcgcaaacacttaacgcctgagctgtagggaatgcacaaaaacacacattttgacgagtattttaacttagggggaatttggacgaaagacttccgcattcaaagggcaaaacctttgaaagtgatagttatttaagctgtgccgtgtcaaatttcactgatcaaaattttggaaattggtctgagcattagcaaaagtttctttcataacctttgctttttttgtccctttcaattttttaaaatttttttatcacacttttctttctaaatttgtcctttttctgatcatttttccgagtgatcaaccgtcacttttttttagccttttcaaccctcaaaagagaagaagacaaatcacacacaaactcctcattttaaacaacccattgagaacacaaattgccgctttgattgattgtttgttgcccgaagcattccttcccccccccccggcattccctcaaagcctttttttgcctttccccccgggggatacctaatggacaaaacatttgccgtttgatttattgagtctgtgcatttaattttgaaattgaaactttcggcgccttttccgccgattggcaaattaccggcaaatccgacttttttgtgccttcctccccttcccaccaccaatcggtcattttcctgcccaagtccatcgacatgcgcgtctccgcgtcggacaccgcctgcgcactgtccaactcgtgcggacacatcggcgcggacgaagcggcggcatgcgcaagcggcggcagaagcggcagcatcaacgaaggcgggggtggaccgacgaacggcggagagctggcggcggcaagcggttaccactcggaacggcggagcgcaatctgttcgggcggcaccagccgcgaccaccacgggcgtcaccagcagcacgggacggccagcggcacgggaagcacccaccaaatgctaatgttctgcacggcatccggtaaaaagtggaaaatggccaaaatatatttttaaattattttttcataggcttcaataaaacataaaattaaatcatttgacaaaaccaacataagacacgacagcacggcacaatctcttacaaattagtcgatcaaatttcaaatatttattagtttaaattcggttggctttttgttcattttttatagaattaattggtttatctctccttttaaattatttcggtacttttctgttcttgactacagaatttaatttcgcgcagttttgcaaaatctttatgaattatgcccctttcttgaaccaataaatcagcttgggattcattttggattttgctaaaggcttatgaagttaagagccatttatttaaaaagagggggatttaaaaaataataattaattctgtgttcacagaacaggaaggtgccattatttcttcccaccctttttgcctttttctttcgtgttgagccgaagtgacaaattgaggttttggataaggccgaggatgggccatttcagtcccaaaaataatttaacaaataaaattattattttaaagtaaaaaatattaaaaaactatctttaggattatttatatttatgtgaaaatgttttttaaaataaataaccataaaatcactaacagtaaattttttcctcttttaataaatttttgctaaaatgaaaaataacaataataaaaataaaagtgcaatttat

SEQ ID NO: 9656 - DNA, 1666 bp, Heterodera glycines
atataattataatagaaatgaattcttttttctttatctcatttttttagttccaaccgatgtgttaacagagaaagaattgctcgccatttatcagttccatgcccttccaaattgtatttgcatttccaatggattttttccaatgcaatttccgactaatggacgaatttctgatcggaaagaaggcacacttttgctggacattgaaaatgtgtccgaatttgctcgagaggcggttgggaacagtcggcacagcgaaaaagtgtacataaatgcatttccatggaaaatcttggcacagataaaaacgaaaaatggaagcactgacaatgagaaatggttcggatttttcttttcgttcgatactacgaaaaaaggtgctaattaactgttaattaatgctaattaacagctacaattaatcaccacttagattcgcattggcgctgctgcgttcgctccgcaacatttcgaattatttcacatagaaaaaaagcggagaattccaatggcacattttgtgaccgtgtttttgacaacaaatcgacaggctggggatttgaaaatttcatttcttttgcagtgagtgccaatttaattatgttcccttaattgtccaattatgacaaattaaggaattgttggacccgaggaacggcttttacagcgaagaagattacaaagtaacattggcaattgatgtcattcttaaagatgaaaaaatggaaaaattcattttgaatcaaagcgaagcgaaagggaaacttttcatggacattgaaaaagtgtcggaatttgcacgagaaattaaagggagtgaacggaaaagcaaaattgtgcacattaaaggatttccatggaaattatggacaaaaatagaaaagaaaaatgaaagcgctgacaataaagagttgggcatttatcttttgtacgatggtccaaacgaaggtgcaaattagttgctaattaatgttaattgtgtaattaattgccattaagacaaaaattggagttgcaaatgttcgacaacttttctaattgtctctcaaaagagcgatgtgccggatttcagaagagaattaagcgaagaaagaacttttaacagcaaatcgaacaattggggatttccgaattttatttcatttacggtgagtgccaattcagttatattcccttaattgctcaattatggcaaattaaggaattaatggacccgaacaaaggcttttacgacaaaagcgaggacaaagtgacattggccattgatgtcactgtgaaagaagcaaaaacagcggaaaaatcataaatatccaatatgatctgctgatctctacatttaattatcaccctattgacctatttttttatactttttctttttttactgctttttacaaaactgatttatggaataaataataaatggttggagttgctttaattagagtctgaatttcaatgagaaactttttctttttagtctgaagccaaaactgaatttaatttcttaggtcaaaaaaaatgaattaaaatattacaattaagaaaacaaattattatcataaaattcaatcaattacttgaaaattatgattcattcgggtttcgatataaaaatgaaaaaaagaacaactgaaaggccatgtacaaaagtaaaagcaca

SEQ ID NO: 9657 - DNA, 1058 bp, Heterodera glycines
  misc_feature (27)..(27): n is a, c, g, or t
taattaatttgaaaactcataaaattntgatggaatcaaaaattccattggtctcataaaagacaattggatattgttataaagtgcatagagtcagaatttaaattaggcaatttatacggaaagattttgaaatttaaataaatttgctatatgttatgtgcctttgttttatgtaagaaaattaataagggtcacataattgattaaaattacataaaatttctttaaaaatgaaaataatatttttcattagaggtacaaataactttgtcgctgtcgcatattatttttgatcatttattgaagaaacttttatattaaacaaaaaaaaacatttgaacaatcaatcaattagctatttttctgctaattgcttttcaacaaatgtgccatatttggtacaaaaacggacttcaagttgagtcccatctgttggaattggtcattattgtcattgccgccggatttgttagacaatttgccgttaaatttaaggaaatctctttttatggcccaatcgaaattgagcaatttgccattaatcagtcgtttttcattggcattcactaactgctgatcagtgccaatcagccatactttgcaatggtggaaatcggagctgaaaaaattggagaaattaaaaaattgcaaaaaaaaaaaatttgcgaaattaaaataaaacgtaaaatattttcgataatttctataaatttttttgtattgtctaccggtttttagttggaatttcctccaatttttgagcgattttgcatgtttcttcgaacagtgccggataaatgtgccaattcgttgtcgtccctctgttgttaatgtcaaattccaactgaagtcgaatacgagtttcaacaaattggcaaaaattttggacagaaattttctcatggccaatgcaattaattgcaataaaattctcatactgaaaaaatattaattaattaatttaatttttatcgaattttataccttttcaacaaaatcaattgaatttggtgacaaaggagacgaccaatcaaataaatgaccgtcaaaattga

SEQ ID NO: 9658 - DNA, 1602 bp, Heterodera glycines
tttattttgtttcgttttgcataatataattttaaaatcccttttttgaaatttatataatataaaattaattaaaattattttaataatttacttcacataagtgacaataaaatgcttttggtgttgacaaattttgcttttcgccttcttctccgttttggcattttttctcaacacaaatttcgttttgttcacccaaaaagttttcctttttgatcacatttcccggcacaacacaaatcaaatcaatgtccgaatcagttgtattcaatccgaacataaatgagccggaaattaaaagtttggccttatccgttgactgaaaagatgggatttactgccaaaattaatttaaaatttttttgtaatttgtaaacccagaggatgtgcttattttttcatggaaaacaaaattgcttataccgagagcccagcattttgaaaaaaaagcctggacctggattccatgtttaaccaggtttgacctgggcctggatttcttggttaaaaatccaggaaaatgtgatccaggtccaggccaagctattcttatgccaaaaggataaaaagttttcttctcccatttaattttctcacccattttgccgccattcctttgattgtgttcaccgccgctttgatttgtttgtcgcgcttttttcgcgaaattccatccgccgttttaccgttaattgccatttcctccacaaattgttcaagctaaacattgtcaattaaattaaattaatttgctaattaaggccagttagctactatttgagagttttgttcgtcgaattcgtcccgaattaattgctgcgaaattttggggaaggaggggcttaaacaacaggcgaattcatttgttaaaccatttgccattatttggtttaataaattttggtctaaaaataatttaatttatttaaattgttatttcttattttatttaaatatttccaatttatcgcaccaatttcaatctgtgccatcattttttgcgcattaattgcatgtttttccaatttcgagataataaaaatattatttttgaataaatgaattaatttttcttccttatctccagtggccattccgtgccatttttgtttaaattcgtccttttttatggcatttgccaaatttttttgatgaattctgcccaataatttttgattttcattttcttctgaattttcttcacaattctgaataaagtgtcctctcatttcggaatgaattaaaatttcatttaaaaatttgaacatttttcgttttaatttttcataattttcattttcttttattttttgccatttttcttttaaattttccaataattttccctccataaaatcataatttacaaagttcaattttccaatttgctcaatgacttttaatttgtcttctatttcgttggcaattgccatgatgtcaacccaaatgattgcattttccgatttttccgtttccataaaatattttttatacactccaaaaatgaaattttcatcatcaaattcttaattaattgatttaatttaatttcaattaaagcccattaaataaacaccttttgtttttagcaattcgttt

SEQ ID NO: 9659 - DNA, 4767 bp, Heterodera glycines
cgacccaattacataaacaatttcggtatcattcaatttcatcaattttttgtatcattcgaaagcccattgaatatgctttcgatatttacatacataacagctgctccttgtatgcaaaagatttttgggtcaattttttaaaattttagcaaattcaaatgaaattctgtttcatagggtccatcacccgctaatttgctgggatttgatgaggaaagtttggataggggctcttcttgtacaaattattacataattaaaaagcgaaataggtacatatgtatatcgtcgtcgtgtctttaaaaatattaagaatcggcaaacggcggaaaaggggggggggggattttatttgtttgtcattgaaggaaaaagggggacaaaatcgatgaatgtaaaacggaaagaaacaacaaaaatagcaagacgagaagagagagaaaagacagggaaattatgttgatgatggggtaacgaaaaagaaaaatggaaaaattgtttccattttttgtaaaaatgcatttgagaaaaggggacataggtagttggagtcggagcatacctaattcgagacggacggtgggataatacggtaagtccgaaaatggaaaatttcgtttttcaattttgcagattttcttcattttaactgtactgaaagcataggagagcagcagaaattcgatgcgacctctgacttaaattcccagccctattgataatgctgcattaaattttgtttactccaaatgaatacatagaaaactccgattaaacgaaatgtatttcaaattgatcgctctgaatgaaaaacaataaataacacaaacttttcaaatttgtcaatgaaattctctcggtttttattttttttattcatcaacacatcattaatactaatgaacatacatacaaatgaatatacacatacgataatatacacatacatacatatacaacaacaattatacacatatatacaacaatgtttatcctctcatttcatctcatttggcagcgactgaatttgcgcgttggtagaacacaatgtatgcatttcgcgtgtccacattgcagctttcagtggcctaaaaagaatggatgaaaagccggcattaattgattcgaaattgttttcttacgagagttttgtcgtcgttgcagaaaacccaattgtcagtgaagccgtcacgcacaaacgagcagtaatggccagagttcaagtggccatgatgagtctaaggaaaagaaagaggggaagaatgattaatgatgtcattcaaattgccactgatcaaaatcactcaactcaccacaattgcaatgcaggaatagagaggaagttgggccaccagcgcagccggcacatcgggcgaaaagtatttgctcaggctgaagttgtccaacgggaacgaaacgggcacgtgctgtttgatgtatcggcgctcaaatggttcatagatgaagcgcttgaagcaaatgatctgtgaagggcaaaaaaggggagcaatcaatcgatgatcaattaatcaatgattaattaatcaccaaaatgtcgggcaatcgcgtgaacatcagctgcttgacaagcgttggtggcgcagacggcggtggcgttgcgttgctgcactgtgcacagcgtgagccttcaatgtcttccggtttgatgaaatccgcgagacaatggttgatggagatcagcggcacatccatgggcagttgaccagcgtccgacgctcccataatgcaatgcgattcatcagtgaagcgctaaaaaaagcggcaaaatgtcaaatggggttagggttgtcctcctggtactgcttgaactccccacctgggccaggctgatacaaatcaggcggtcgccctgtccatcttcgtccttgtccttgaacaaccgcatgaagcaccaaatgtcaattttgtcgagcggaatgtcgcgcagcgtctcctcgtcggatggttcatcatcgtcgtcctcgtcgaaatcgtcttcatcctcgtcatcattttcttcttcgttttcggaggaatcggcgtttcttgtcgttgcgtcgttgaacatttgtgaaaattcttcctgtaaaaaaaggggtgggaattaattgcatatatcaattaaaaaatgaaaattcgctattttaattgaatttgggtccgcgcttttttcataaattgtcatttaaattttccgctttcaaaatggactcaaaaaaacggacaaaatctcaacaaaaatttgtgccgaaaattgaattgggttggtgatggctgtacattgtagtctttgttgttcttgttgagcgtgatgaacatggccttgctgacgctgatgtaagctcgtctgcagatgatcttcttcactttgctcagtttcatggcgagtggaaggcgtatttcatgggacgaacatttgatggggtctccttctcgagagatgactgaaaaaaggggagaaaatttatttgaaaatgccaatgtttgtttgttttttgcatgccgttgaatgtaattgcggtgttctccggaattgggatttgcaacgacagcattgtgaacagctcgaacgtcttggacgaatatgaacacactgggcatctgagctcggagacggactgtccggcgaacaagtcgaaaatctgaaaaaatgccattgtttaatgccttcagaattgagtgttctcctctttcttaccacgctgcctttctttggtgcgagcacttcgtttctccaatgctgaaaatgccaaattaaacggtacaaaaaaatcacaaaatttggcattacgtcgattgcattgcgccaaatttggtcgtcacgttgagcagcaccagcagaagcagtcccgcgccgtcatttctgtacatgtcacagctgacgccttgcgtaacaccgcgcagaatgcccttcatcaactcgtgcagcgcgtccacaaagaattggatgaactcctggctgtcatgttggaacgaatcagcgaacaatttggtaaggctggagatgacttcctgaaaaaactgcgagtcatgaaacgcaacaccaccatcaccacggcacactgttcaccacaccttcagttcgaatggcgccgccggttgtcgcaacaccaaaatgcttttgatcatttgcacatattccatgacgagtttgatgttggacagtcggttttcgctgaaagaggggtgaaaacataaattgatggcattggacattggcattattggcacccactttttcatcagaaaattgctgagtgccgtcacgttggccaatgcttggagtgcagcgcccatgcagcatgtgttgccgatgttcagaattccgcccacttccttctttttgtcgtctgcttttgatggtgtgctcattttttgcttaataaaaagaaagcaattaatttattttatttttttgtttgaaaattagtcagacaaaaaggaaagggagagattggtttgagttaggggctggcggattaaccaaaatcgggttgacctaagaatcaaaaaacatggggcagtcagagaatgaaaatataacgaggagttgttgtgggataaattataatttagggaccggatttataagtttttactgattttttctgcgaccttgccgtttttaatttaaaaattacgcttaaacaaaacagaattgaaaaactgtaaggaaacctaacatataatacttattgtttgtatatttggttcccaaattctgaagggttctcgggaggcactaaccagggatctgacatccattatatccaattttgaatgtctaacctaaattcaagcaaaaaagcaaactccgaaaaacttagttttctatttcactcgagttcgggtaagagatttgtcaaaattggtataagattcgtgattagctactcccgaaaacccataaaacaagttttcacgaaaaaaagggccctcaccctgtggtttttttcggagtgccccaacagcaaaaaatgcagatatgaattcccagggaaagaacaaattgaaaaattttttaatgggtatttttaaattaaatttgtcacttttttaatctggcataatgttaatagttaaaaaatttgaacgaaatatgactacttctggtagataaaaatcagtgctatcacttcaaaatcacaaattccttttcaaatatacagacagaccagaaataatcttttgaactttcctttttgataattgtaatggttaagatgcaattggtccctgatggcacttttcgcaaagtccgtaacaacattgaccgattgtttgacaaaaatttgaccgatttaatccgtggcattcggaacaacaaggaaaatgaggtgatgattgattgactgaatgcaaaagccatttgtacatttacaatttgggcacttttgctgggcctctgaaaaaaaaaattcaagggctcaaccaattacaaatccttacaaaaaagcccccctttggaattttctctcgtgggcctccaacaacagccaaagtgccataatttatttacccaaaatgttctaggcccgttatattgcggcatgcattgacgagatcaaagtggagctacgccaggactccatttttgtgaaggcaaatgccatcgaaaagttggcatatgtaagttttttaaatggacttttttatatccattaacacaaaacggagtcgggaggggtggggcagtgaaatttcgagggaggaacgagtgaaattatgaaaaaaaatttttttttaatttcctcatttgttagt

SEQ ID NO: 9660 - DNA, 4880 bp, Heterodera glycines
tgcttcctaattagtggtagtaataaatcctccttttcccccattctcacttttaggatgggatgttggatcggtacgagttcgtcaacgacctttgtgatttgctgcccgaattcgcaaatttctccatggaacagccacaaactttccgcgcgttgctcattctgatctcccaattcctcgacgttgtcacccaaaaccttttcattgctcgtaaagttgcccacattttgtgtgctcggctgaatcagtataaaaaggaccacgagcgcatcagagagtcgggaatttagagcgtttttgactccgttctcaacccttttcagtaccacgctcaaagaatctgcaaacgaatgtttcgaggacttggtcaattgtcaccatcacagatcgactgtcctcacaatctttggcattcttcatgcgattgtcatcgactgtccttcggcattggtttggactccatttgagtcgaacgaactggccgaggggcttcagtcaaagtttaagccggacagaaatggaaattccaaatccatggagagagaaagcgtacaaaatagcgttgcctgggtaagttatgcggggtaatagtccagtttagctcttcccctatttttcaaaaaataaaaagttttgtaaaatgcctttcctggccgcattttgtgattgctgttttgtgtatttgaatctgaatcattaacttgtaccgttatgtctgaatgttaaatttgccttttgcttttccttagctttgtaagtcgcctttggacaatcttccatgcgaattgagcgtgaccactcagcatttggcggcacacgccaaggccgaactcgaccaacttctgagcatccgaagtgaagagattaaacagcggagtatggccatcgaacagcggtggctgcacatcagtccgacgaacacgcggtccggactcggtgagccatggattattgcattaaacggaggacatttatttcatttaattgacttttctcttttttaatgtgccttaagattcggtcgtcgagaattgtctggacgttctctcctttatggacaccgtcgacctcggggcagtcgatgcgctattagtcctttacaataacatttttagcgaagaggtaaggtattcgggtctctgctattcatccaacttttaacttaaaaatggtcgtgctttatccttgtttatacaaagcaaaccatgataaacagcaaattaatgggtgattttcagaatgactgtttggatattaccattcgcgtcctcatcaattgggctgttaccagtgagcgtgaaggcactcaccgcggacttatcgtcgctcatttgctcaaaatgcacgtcaactttgctcaaaatgataacaaaaagcctccgtttggccatggcttttcgtctctgcaggaacttttggtggactgtttgaacagagagtgggcaaatccgaatggaaaggcaattgcaaattcggcggttagggcggcagaatttgccaatttgatgctgctcttctacgaattgcaacgtttcggtaccaatttgcattattttaaatttgttgctactaaatttgctttttaggtcttttcagccacgacaaatacgtcaaaggttatacagttcatcaggaccgtcttcgcattttatttacattatttatttagcactgatgcgcgacgggactctcgacagtcgtggccttttccttcgtctgaatttgcgttcgatgtccgttgccgcccctaatgtcggtaaatcggcgcctcattccgtcgacgaacgcacaaatcgacgtcaaaacgtaccgaatgcatcgcaaaatgcacaattagcagccgtacaaagtcaacccgagccgaacataaaacaggcgagaaaactgataaagaaccaatggacgatggctaatttaagttgttattggtttaggagcctcaaatgattatttcattcattccgatgtccaaaccaaccacgacgcactcatcactcaccagcactaccgttgaacatcagtttaacggcactttaccaccaccaagtcaacatgtaccaaattctcaaacaccaaaaccagtggaagaatttgcaaaacttgctcctcaatttgaaactgatagtcatccctttttggaggaaccgtccgcattgaggtagagattagttgtcctctatgacgggctttttggaaactttgggtttgatcgttttagcaattaacttaacagaaaaattaataaaaatagaaattttggatataaatggaaaagacccggtataatgtcatataaccttctggggccgaggtgaactaaccgaccgacccattttccgttaccactctataattttcttcgttttttcagttttcatgaacgttttatcgtccatttgcccgttgaacagattgaagccaatagggacgtgtgcaaccaacgcgccattgttctctacggcatttccgaacatcgtgatagtgcacggcaggaactgaggaaaattgctagagaaatctgcaaaatttgggtttttaaatggggggggggattatctataaattatacttcagaagaaaatgactttcgaattgaccatttctctccaaccgaactccgtcgtccattcggaagttcgctacaaaaggcgatgttcttccgaacaactcaacgaactgatgggacggttcaatgcacagacgtactacgaccaattggtcatctgcggatggtgcgcagaaagttttttggactcaatcgaagagtttgtcaaacaagcggaggaattggcacaagagagcatcaaaggcggggcaccaactgccaatgtttcggtgccaacgcacgagtgcttggacatgttgtgcacaatgatcacggtaaatgaaggcggggacgcacatcggcaaacgaccaaatttgaggcctaactatgtcgatttctgttgtttttggcatttaccactcacttttacagtactaatcagttggtcctttcctatgtgtgtgttacttttattttctttagatttgccggtccttcaacaacatcgtctctcttgcgcatgagttgttgccccttctcgtccatttgcgtttcattctccgaaaccaattgaacaccgatctcttttctgcctctatttctgctcaagtatcatttacctatttttatgatttttaatttgtcaattattattcgtcattaattcccccttccctttgtttagtatgcttttgtccttgcgtcgcatttggctgaacatttcttttattttttgtattccccggaagcgtgctcaataataaacgatttttaccgtctcgttgaaactgaattgaccgtccgaaggaaggaaggcggcgagggttcggggtggggcagggccgtggcgatgttcgtctaccacgcccgtcaccttttgctcgtctccaaattgaacgtgcgtggggccggccctgacgacgttgtccaacttctcggccaaagtgaagagtttgaagcgcttttccctccgagtggtgccggttcagtgggcaccaacatcgaataccgccaacaatttgcggacgatgtcagcgcactgtcactcaccgacctgtgggttcccacttttcacttggcatttgcccattgtttttagacgcgctttcttcaacaatcattacaaacgtttggcccttctgatgagaaatgactttgtgcggtacaggtgccgttttgggtgtcctttcggttggccaattgtcccccgtctttttgcatttccttttcctttggcttctccatcgtttcccatcctatcgataatcattcccgtttaagctttgttatcgatgcattcaaagcggctgtcagctgtggtcgcaactacgatcgtcttgtcgaattggccaacttttgtgcgaatatttctgccaattggggccttgccatcgaatggtgcaatgccatccaggagttgtgttacccatctgcaagtagtgacaattggaaggagttgatccaggacatcgatgtgggcattcacttttcatttgcaaatgtcctttggtccgtcttttaggtgaccaaattcgccactcactaccctctcgctacgttcactctcctgctggcttccaaatactgcttctcatcccacgggctcatctgccggctcatgtccaacgttctatttcccctgcttgcgaagcaaggggaacgcaacgaaagcgcaacggtggcacatcgcaaagcggacggtgattcattcatttgttggcattgcgagaaaatggggcactgctttatctcatcctcgtttttccagatttcgggggtcatgacaacaatttctgcctaactttgtacatttgcgcctgtttaatctgtggcaccgacgagccattccaatgtgccgactcttttcatgttttggttatttcttactttattttctcagattgtgacagcaattcaaagtcctcctccacttttgcttctgtgttcagtagggacgccaacagaatggcactcagaattgtccatctcgctgaactcgaaacttccattttcccgttgctttgcgttttggttcaattggtcgacggcctgaaaagaaaagtcgaggccagaaaggacgcggtagttgatgaacatgcattccattcatgcaaatgcatttgccacacaaaggtcaactttcgcattgctcaaaattactttgttgctcgctgtgcccttctctccatttgcgaacaggaatgggttgtccaaagggtaagaaatggggaaacacgaataaggggtggggaatggtccggagcaggacataactccgccggccgaaactccgccaaaatttttttttaatttttcaaacttagaaatttt

SEQ ID NO: 9661 - DNA, 1474 bp, Heterodera glycines
tagcggtctctgttctcgagtcacggagaatttcgactctcggtcagtcctagtgtaacgggctaccacctttttatgcatttattatacagtggagtcattttcggtattcttttaattatataatgtcatctcccattttagctactgtacctctgcatcaagatgctgtacctagtcaatgtagccacccaattcttcgtgctcaacaccttcataggtcgaaacaacagaatgtggggtttcgaagtactcgaaaatctttttaacggagagaagtggcaggtgaattaattgagtgttttgtcggttaaaaatttagttctttatttagcaacaaaaaattaattatattaaatagctgtattactataaatgtttggcttaccatgctggtttatatctaattcttcaattttgaagggattagttaaaaatgggaaaacttttaatgtttagtttttttataatattgaatgttttttaataaaaattacagtaattttcattaaataatttaaaaaataaaataaaaatcctatttgcttatttccttccaccctttttgtgtgcttttaggactcgccgatttttccacgacagacgatgtgtgacgtgaaaattcatcgcttgtcgggcacaacacgctacactgtccaatgtcatctccgcattaacgagtatttcgagacaatctacctgttcatttggtgattttaaaatttattttacgggttttaaatatcgacttatcatgaataagatatttattttgacaacttacgtcaaatctgaccaaagattagtcaaatttagaagaattttttcatttttaatagttttgcagtttgcccatgatttttaaaataagattcctcttacttatttattttttaaaatattaattataaaaacgtgtcaaaacaattgttcaatatgcttaatacaaactcatttttttggagcagggagagtaaccatatgaagtgccaaaaaatcctgttccttttctccaggtatggccttggcctgatcgtagtgcttactgcagtaaattttgcctactatgtttttgttctgctgctgcttccgtcgacgcaggagagctcggtccgcgacatgttgatgcaggacaagcatcttgaaattttctacaacaacaaacaccatgaacacccacttttcagccgcttttcccagcacgcactgcgcaaggacggagtgagtatgtggcatggtggtgttgtacagtttggatgcatgtgtattaaattttttgcacggcgatgagaaaaaagctattaatgattctgtttccctaaaaattaaatggttcgaccaacaccaccgagtgctgcagtcttttttgcaaattttactcaaaaattttttttttaatatacaaattaaatttaaaaattatataattttccaaaaaaggcaaatctttctcttttttaactcccaatttttt

SEQ ID NO: 9662 - DNA, 1457 bp, Heterodera glycines
gatagggccagtatgtttaaaacaagcttcatcatgatatacataaaaaatttcagatgatcctacaactttgttttctcaacgaaagaaaacacggaaaaccgatagtgatgcgcgagttgtgtctaattaatttaatttttgaaaatttcacaaaaaattcttttataaatatttttctttagtttgatgaagcatatgaaagtgaatgtggaccgaaattgaaaaaggcgtttttaatttacggcttttgtttttgattttgattatcatttttatttctaatttacaataaagaaaattgaaaaaattaatttcttgtttgataaaattgaaaaatgaacattaaaataaaaatagcttctttttaaagtttagcaggcgggaattttaggcaaaaaatcaatgccaaaatatggggcaaagcatatttagctgtgaaaaaatgatgaaataattttgtacattcttttaaatatacggactacaaattatatgtagatttcacaaattttaatttagcaatttttttgtctgaaccaggagaaattaaatatatgggttcatttttataaatataataggttaaaacatttttaaatttccttttattaaattttaatctccgtccttcctttggtcaaatcactcaaaaaagtaaggatatggacgaagatgggtcatttcattccaaaaatgcttttaataagtaaaataattattttaattgataacttccaccagctataaataaatattttatatattgatcagaaaagcgtaataattaaaacaaatttcgaacaattttaatcttttgaatccgtaacggataatggagtaccttaccatctgtctagtcttcattaataatgaaaatggtcattttaaaaattactttgaatccaagattttctcagaaaacgatttttataaaaaaaataatgcaaatttgttaaaaaagtaaaatttttgattaatattggtattttggttagtaatttttaaaaacttattataagtcacatatgtacactggtataaaaaagtctttaccaaatccccgaaatttgttcaatgctgattatgtaattaataagttgccaatatacatagctgtataacctttttttttaaaaattcctagggggttgggaaattttgtttcaaaattttaaatatgctcattgtattgagaatatatttggctatcaacgtattcaaaattaaaaaaaaatttcccaaccccacaggaatttttccgaaaatttcccaattttcagtgtattttagtttgtcacgttcactatgaaggaatggtctgatcaaattggtgcaaaagccctttttgttcagtatcaaaagataagcctgcatgattttttttccagatttttatgagtattttgaaataattttttaagttgtaaaagatttttttccgttcaaaagtgatc

SEQ ID NO: 9663 - DNA, 2022 bp, Heterodera glycines
cccccccccccgcccccgccccccccccccccctagtaattttatgaaaaagcacattaaatgctaatctcgaggaaaagaaaaatactattttgaaatttttgcacgagaaaaattattttaagatactattgtttgcttttgtttgatttttttaaaaaataatttaattgatctatttttaaatatttgctgattggtgatctcgattgtgcgaatttttgcttttcaaaataaaattaagattttatcaaacttttaggattttaaattgctatcaaaatggatttagctttgattaatattggcggaattgaaaatgtgcttgacgaagatgggaaaaaaattttgaaaaaaattgagacgaaagaaatagaaagagacgtaattgaagatttaaatttatatgcataatatttaaaattacattaggttgatccatttgtgccatttgctgcggcgacaattgggcatacgccacaatcatacaatgtgttacgaaaccattgtcttgaggcaatttttatttaattaaattagggttgcgactccgaccgtcggggttggaaaactcggggttcgcggttgtcggggtcaccaagatcggggtcaggatcggggtttttcaatttgtcttatgccatacatatagtcaaaagactttctagtattttggcttaaaaaatatttattaattttcataataataataataataataataataattttatttgcatttatttttttaacataaatattttgtatagaattaattataaaacgcctatttagtgcatagaaaaaaaggtcataattcaaaagcggtctctagttataaattaaaaaatttattatattaaaatattactgtggaaaaaaggcaatttctagaaattaccttttaaaaaataaattatatcaataaaaatagtagtattttattcaaaaaaaaaaatttcttttagatcactttttttttgctttccaaagcaacttttttaatttttttaataagatttacgaatttttgggtacggcgatgccgataggcagcgccaggcgaattttataatttaagctcaattttctaacatatttttaccaaaaaatttataaatttccaagaattttttgttttttcttggtatttttcaaaaatatttttaaatatatatgaaattttctggattttgtcaagaaaattgaattttttaatttcaacgaatggaaaattggcttcaattcgtcaatgaattatgccaaggatgttttatagttatgggttggttaaaattcaaattcgtgtaaattttttgcattttctcccgcgaaaatgcaattcttaggggtatatttagccccgacccgagtcggggttaaggatcggggccggggttgtaagcgtaggggtcggggttaaccccgaaaaatggccaaatatgtcggtgttcggggtcggggcggggttaaaaccctaaattaaataataacaattcaaagtaatgttacagcgcggaattttgtacgaggacccggattacggtccgaatcaaatccaattgcacttcaccaacaacattgaagtgccaatccaatggttgcgccctcaacaaatagttgatcacccgcaatttataaaccaaatgccggagccacgtgatgtcaaccagggcagtctgggagactgttggatgttggcagctgcatcaatcctggcgcagcatgggcacctgttttacagggttgttccgcccgaccaaggattcgcgatgggatatgccggtaaaaatttcgttttaaataaaaataaaaattagatatatatgaattgcgaaaagcaaatttattgtttcaaaattttacaattcgttatttgtaaaaatattttaaaatgaatggaattgctcaactttaaaattaatatttgaaatagcaattaatatgctttttttaaatttaacagtttaataatttttttttactactcaattattatatattatttataggtgcatactt

SEQ ID NO: 9664 - DNA, 2987 bp, Heterodera glycines
tttgtttttcagatccattgttgtgcagatatttaaattgcatacaaaaatatccttggaatttggttttcgttttaatgcacatttttttgcctttgtttttctcctcataagtcccccttaagattcggctggtcaatcaaatggtagaagaaactgaaattcaatttatttatgaattagaattgccactgaccaatcgcgaattttgttgaaatcgttcaggcaaaacaaatagcggaagtagtcagttggcactccgtttgtcgtctcgcagtaggacatacagcccggttgaattcctcaaaaagtgccattggtcccctctctgccgcccccctcccccacttctccgacctttgattctgcagcattcgcggtgatcggcgcgacttgacgcgcagtcccacatttggccaacggttggaccacgcgcgacgcacgtggagaggaaaatcagaatctttaatggatggtggccggcaattaagcggaagtgccattccaaaaatgccctttttaatgacggaaccaatggggctgtaataatttatacaggaaaaattcctaccgaactccctactaattgagactaattgctgctgtctatcccttttttgttcccttcccaattaattaatcaactaattaattagttcactgtgttcgaactgagcgcattccaatcgcagaaacggtttttgcagtcggcgtccgcctgatccaacttggcacaacacattttcatcttttcgtgcggcgtgtgccctcgcggcgttttctgcggcaattgctcttgcggttggggcggagcttggaaaagcattgggagcagcgcattttgacaaaaagcaaagggagccagcagaagaagcagcacggaagggaggacgaacatgggaaagtgaccacagggaagggaaggcacaaagtgatcagcggacggaaattcaaatgagataaagtgatcaatggggaaaatgatcaaaaaagggaaagagtggactgatcaaaggggccaggcaaagtgatcgaaacggaagtgatgagagggaagggatcggagagtgaatgattaaaaggttaaataaaaagtgcttatgaacggaagtgatcggaagaaatgatcgaatggattcagagggatgagagaaaatgatcagggagaaaaatgatcgaaagatgagaggaaagtgatcgaaagggtgctgatcaattgaagagaacaattcgttttgctttatgttcaaatttggtctctttgctgagtgtttggtacgtccatcctccaatgtgtaaatccataaacttcccaaaccaaaccctcggctccctcccaattccccccccccctctttctttcgattcgttcatttcccaaatggtcggcgcatttctccaatggatcggatggacttgttctccccccccctcgaaactccgcttattcgtatttacaagtgcttccccctctgtattattattacatggattaccgttattcgttcatccttttgctttgccccccccccctcccgaaacccgtcgtccctttcctcgccgtccattcatttattagtcaactgtcgagtttcaaatatgtgatcaccgattgctttgcattgttttcggttgggaaattacgcatcatttccatgggatttattcaaatggcaaataaattaaaaagggtcatttaaaattggcaaataataaaatggcactgtccgtttttttgggcactttccctcggcggcgtttcgctccattcatttttcctctttcttattctccaaatgtgccttgaaacaatcgcggatatggtcaaaataatccacacaagccctgaaaattgggtggtcaattaatttgcgtgtcaattagaggggtaattagtcggaaatgcgtacacatagtccacgtaattttctggcactccgtcctgggcactacagtactccatgcacttgtcggacacgcctttgccctgtgaatttggttcaacattgtaaacaagcaaaatcactgaggcaaaccctgcagcagtgcgtgtggtcaaatcggctcgacgcgcagtcccacatgtggccgacctagaggggatactgtatcacagggttaaccgtagtcataaagtggtgagcgattgagtgagaaaaacacgggaattaactccattacacaatcatttgagcaatgtttgatcagtaataatgaatgaaggctaataattcatgtcattgctatcgtatacttttgttggaattaccgtatcgcctttgtctttgcactttgacatgaagttcaacaccttaaattcatttcgaatttaattggcgaaacgaattcattgctttctccgcttacattcgcctgcgaaatcgcatcaaaatcacaaaatcgggccacacagtctttgtcgtccttttcgctggtcagtgttaaacaacacttcttgagtttggcattggcatcggcggaagagacaaaggaaaagtgggggaggacaaaaaggaagaggaagaagcaaaggagggaggaggaggaggagaaagaggaggaggagaaaggcatggtaaaggcacagagagagagaaactgaaaaaggaagaacggaaacaaattaaaataaaaaaataaaattattaatttagaaataaaattggggaagggagggggcggggaacagagaatggcggcggtgttctgacgaagatgcgccattcgcctgacactttaaatgggaggggcaaaaggcaaaatggggacagcggacgatgaaaaacggaaaatgatgaagcagtgattggagggggaggagcagcagaaaaagtgatcagaagacggatcaatgggggggggggagagaaataacaaaaaatggggggcaaatgagcgaatgaataaaggaagtggcagaagacgccgccggactgggtcactgtgtgggagcagacagaaagtgatcagagcgatgaacagaaagg

SEQ ID NO: 9665 - DNA, 2564 bp, Heterodera glycines
tttatttttcggttttttctttgccggcttttcctcccatctctttatccctcggctttccctttgtcggattttgctctttatttttcggcttttcctttctcttgtgaaaagctaactaaaactttggtctttttcgtcccgctttaaaggatgtgctcattttgggcactgaacgtggctccgtttactttgttgactctcaagcgtacaccgttctccaacggaatgccattggcggcgcagtgcccgtcaaaatgctccccgtcggttggtgggctttttctcaacaaagcaattagcttccccccccccccccttaggccatttcgatctcgaatttcggctcattgtgtgcactcgagagcacgacgtgtttgtgttgagaaggtccgcgaagggcgaattcagcgtcaattcgttttatatccgtgaacacccatttgacgtggtcctttgtgctaatcaggtgcgcattaatgagaggtcattcactgttattacactgcgttttgcatcatttctgtgaacacaataatggacaagtgatctccgataattacgcgtgattagccataattagcactaatttcccccaatggtcgatggtaatgatcagtttcccatccctcctctgcttaagttggcatttgccacccgtaaacgttgtctcgtcttcttcagcctgaagggtcgtcgtcaaaactcgatgaaattcgacgagaacatcgccgacatcgagcagttttattatgagccaaaacagtgagtaatgagtggccatttttcattttttacatttaattcggaaaatctgttgggcgaaaaaggaggaagaaatatgcggataatgatggggcgattttgaaattgatggggctaattagatcaattaatggccaatcactggaaaaagcatggacaaataaaacacgagaacagcagaaggaattgaaattgccaaactatgtttcttcttcttccttcgtccccctgcagatacagcggcgttttggtggcggttgccaaagaaattcatttgttcgtggatcagttgcgcgtggacacaattcgcatggaccaatcaatcgaatggatgcgatacggacgcatgggacgcgaggagggcgttttggtcatcgccacttttggtggggaaatgggcgggggacgggggggggcgaagggtgtgacggacaaaaacatcactcaattaggaggtggtctgtgcgtgaaaatcttccgccgtgtggccaattttgaggagaaccgacagacaatggcacaacgaaaggcgacaaagggcagcatcgaattgccgaaaaagtcgcgcactttcatcgatcagagtctgagggagcggcaaaatgcgcaacttttgcatcaggtggacaaaaaagcggggacgggggggactcatttttgatggattttggcaaatgccgtgtcattcattcattgactgtccgaagcattaatggcaccacttcatgtagatttaccaacgtgattggttcatgatcaaatggcacgcaaccaaaacatttgccgagctgaagtcgggcaaccacggcgcgttgccaaccgccgactcggacgaaccggtccaagtgcagttcgacctgctcggcttcggccccctcttccgtctcaaaattcgcctcgtggcgagcaagtgagagcagaaagggcacaaaagccgaataattggttgaatgatgggaaacgttgagaaaattggacggccagcagaagcggtggattacttttgtgtacaacgcggaggagtaccaattcgccgatcagtgcgtccaaaattaaattccgatcgaatgattccccaatttcttcctaagaatgcttccaatccctcgtccactgatgccaaaccgtccggtgaccttttgcacgaacattcgttgccttcacccagagaaacaactcgtggaggaggaagtgaaattagtgttgtgccgagaggacaggtcgagaccaatttggacggccaacttccaaatgccattgagtgaagcggagattgtttagggtggcaaattcaacaagtggtagaattggcatacattttaccatttaccatttatatgaaaggaagccaaaatattcccagacttttttaaattgtcatatttttattttattaatgaatttcatatacatatttgaatgatttagttgaataaatgtgaattctgctgaagtgaattttcgacttcttattcgagttcccaaatgcctaattttttttaaattttattatttttaaaaaattttctttccgatgaattaagggtaaaaaatacgctgatcatgaatctgagctcggattttccaaaatcaatctttttatctatggtttttcatcaagtatcataaaaaaaataaactgcagccaagcgggctcgaaccccagtatgccaaattggtccccggtgactgtgcgggtcagcagcaacaaaacgccaataaaaaaccaagcggaacatcattaaaataattttaatggtataaattgctaattagaaaaataacttaaaaattaaggt

SEQ ID NO: 9666 - DNA, 1756 bp, Heterodera glycines
aaaatatataccgtatttattgaattagacccccccccctctttttcgagggggttgaaaacaagtttgggtttttaccatatgtatcagggatggaattccgaggcaccgaaaattttcggaggtcggaattccgtgccatccctggtatgtatataacaactacgtattttaattaaattttaattttaataaaggcctctaaatgaaagcgaaactttccattgtttattttttacacaaatttaccaattttttaatgaaatgcaaaaatgcgcttgagatttaatttaaatgaagcatagattgcgacaatccctgatatgttgtatgactagaaagaatgaaaaagtggtgtgattgatgatcatttcgtttcgttttccgttcgtctgtgatcactgctcagtccttcggtggggatgtggacgacctcagaagcgatcgctgctcagaagagcccgccacagatgccacgctgttcatctcctcctcgcgctcctccgtttctcttcgctctttctcttccttttcgccactttttgtcgactttctccgcttctcctcctccgtctcgccattgttcatcatcgtctgcccatttccctcctcttcaatgcgccgcaacagtgccatgcgttgttcattctgttgaccaaattcaccattgtcatggtgttgtacaaggtgtttttgttgttgaggttggacaacaacgacggggtcggcgaccgagttgctgttggtgtcgggcggagagcaaagggactgtgtggagaagggtttccatttgcggagagattcaatcaacaatttgacgagagtccaatcgcccaatggcacctcaaaatggacaacgaatgaacaaaacaaattggcatatttagaaatcaaaagacggataaatcaatcactttcagtatttgcttcagttcgttgaggtcgcaaatgtgaaggacgagcccattcaaattgttctcataaaaagcattgatgagctgcgcctccctttccttaattggttaaacaatttgcattaaaagggaattcccgtgatatttaagcgaaacgtttgctaatgtgccgaccttaacaatccccaagtgtcgtatgagtgccacaaattcagcgacggacattttggccaaagctttccgcaccgatgcccacaccatcgggtcctgaaacacaaattccgcctctgggccgatggtctccttcagtggtccaaatggatcctgctgctgtgctacgtcgtcgtcctcctgcgactcggaaaggtcaatgatcggttcaccgccgcgctgctcgcgaatcgttttgcgcaggtacgggtccaaattggaggtgcaaggcgcaaacgccttcacatgcgcgaccaggagctgaacaactaacgaatattatggttttcgtgatttgaccatgggggaaacgggcctggtcagtgcgggaggcacacattttacgaaaaagtggctcaaactcctgtccattccggtccaaatcctccattcccgaagccacggttatgcgatttctgatttgcgtgtacaattcgtggatgggcattgactcgtcctttgacaaaggcaacaataattgaaaataaagccaaaaagttgggccaacctgaagactcagtgcaatgtcaatgacccaacacatgcgcctgaaaagacattgggggattaatctggatatattaaatataccaaggccactgctcaatcatgctacaccaagcgtacaattg

SEQ ID NO: 9667 - DNA, 1842 bp, Heterodera glycines
cttttgtcctaataattcaaagaattgagaaagggcagatacatacattgtcacgatgtttttcagatagtctcttcctgtgattccgcctccctccgggcccgcatttgtccgcaaattctgctgaatggtcgacacgacaatgttcgggtcgatggcgagcagaacaatgaacggcgcattttgacgtgaacagaaaaacaacgaaagtgccttaaaaaggaaataaattacccatggaatttggtaattttaatatccaaactgacttacgtccaacatttggaccattttgttcgattcgcaactgtcaagtccatccaccattatgaccagccgtgtctgactcgaagtgaattcatccaaagcgaacacctaaattgatgaacaaaagatcaaacaaaaaatggggaaaataatggcgaaaaaatcaccaatgagacaagaaggtcgacctccttctgcagcttttggatcattcgttcgaatggcatcaaatgcaaccgatcagaaattcgcgtaattcgtctttttggcttaaaaataagggataacttcgaagacttatacaacttccggaaccccaaccaaattgacgaaaatgcgagcactgaaaatgtaaagaatgaaggcgcccgagacgagtgccaaggcgagaaaaacggaggcgagccaatgccgagtttggatgaacagcaaagaagcggagaccagtgagcagggaaatgccaaagtcagcaccaacacgggcacaccgcagtaactcttcaatttggaggaacgatcggcgagaagggaaggcgaggacgaacggagagtggtgaacagatggacagccaaagtgccgaaatgctctgagggcatttcccttttatttgatttataataataaatttgtacaccttcggcagcggtgaaaaacgattggataatgttggccaaagagtgttcgccgccaatgaaagaaaggcggtggtcatcggcaaagagaaaactcaccggcgaaataattctgaatttttttaggtttgcttcgttaagggacagagtgccaatttcatcactttcgactcttttcccttctgacgggcgcattcagaaacaaaacattgagcatcaatttgaaacgggcaattgaacgaccaatcagtcgagcggtggcgattgacccgttccaaaatttgacctaaacgagggcaatttaaaggaaaactgctataaaataggcaattaaaacagaaaggtatcgctaaacatttttaaaattatgatatcacctcactgccgtagtaaataaatccgtagagaagaagaaagagcaaaaaaatgccaactccgacgccaagggaaatgagaaaatgtgaattttgaagaataagtgccgaaagtgcggagatgaacaacgaaagagagacggaggaaaggaggacggacagcacgagggaccaggaccagtacagctcgaccccgtccagccaagtgcgggagaaggcgctcatcgaatcgcgaatccgaggcaaaagcagcgacttaaagagaagttggagagggatattagcaaattttatagaaacggaaggaagcaatgagacaagtcatgaaaatggttagcccacctttcctgaaccccatttggcgtaaagtccaatggtcaatggcaatggcaaatttgggtcacaaacaacatcagccaacacctgaaatggaagagttacaaaagcaaaatttaaaaaaaaggtacatcgctgtaagaatcaaagccgaacaaactcttcatgccaacgtcacttccaattgggccaaaaatggtcgggagaattggattgccattctcttggtctg

SEQ ID NO: 9668 - DNA, 2381 bp, Heterodera glycines
  misc_feature (11)..(11): n is a, c, g, or t
  misc_feature (2331)..(2331): n is a, c, g, or t
ccgagtttgtntggggcgataaagcagcttcgaatcccctgggttcaccaaaaggacctgggcaagtcgtcgggaacggtaacgaagtgccaaatgaagcgctaaaacagtaaattcatcagagacaaaaggaagatgacataatttatgattacaaatggcaattgccttttttcttctcccaaaagtaccgttgtctccgttattgtctgtcgcactcagtttggagcccatattcaccaacagctgaacaatctggacatccttgttcttcacctaatagttgatgaaacataattaggcacaattaaatgcaaaagtttaaaaacccactgctctgatcagtgccgtttcaccgtcccggtttttcaactccaaatttggttttttgtcgagcaaagcgaggagaacatctgaaaacggtttattctaaattgtgtaaccaattgttgttctggcgtttcgacgtttccttctccgaccctcattagtaattaaggcttgaaattttttgggcaaaatttgtttgcttttttctttggaggttgggatgggtttgttgcctcgtttctgacctgaatatgccttgtcaatggccaaatgcagcggagtgcgcccctccgagtctttcgcgttcacatcggcatgtttttccaacaacatacgcaccttgaattggtcacatctgaaacagccttaacaccttcggcgcatccccaccaaacgaaggtttcccgagcggacggcactcgccagaatggaattgccaaaacggtcaaccgtgttcacataggcaccggattggagcagcattgaagcaatttcggtataacctgacaatgcaaatggcattttacaattagcaaaacaccgatgaatttggaaacggagatataaaagtagcatggcgcagttgacaactcattgttagtgccaacaattttcactcaccttcccttgaagcaattccaagcgcggaaagtccattgtagtcaacaacgttcacatttgggtcccttgacagcaacatctccacaacatgggcatggtttcccctcgtggcaagcatcagagcagttgaacctggcaaagggatcaaataaacctactaaaatcactaaattcctttgctcccgtccctttcatttgtcgtaaaggtttctcaccatacattcccactgcgtctaattcagcgcccgaattcaacagttgttccacaatttgacgaaatcccttccgagcggcccaaatcagcgcagtgcttccgaatttgtcgctggtgttcacttgcgcgccggaagccaacaaaagccgggccacttcagtaaagccacggcctaaacagaacacgcaatatcgaaaaaaactcgaaataataatttaaaactttatgtaaatgaatagtaatttgctgacccgaagcaatgattagcggcgtcagcccgtcttcttcgccgactctaaaaaaagaattgaatttaaattagttataggaattttaaaatggatattacaaacatatttatatgcgcattgaactctagcagcacatcgaccacttgcggtctgtttttataacatgcccacattaaagaggtccatcccatctaaacaaagaatgaattgtccaattgaatttgtcttcatacccaataaaattttaaataacccaccctgaaaataggtatattagttggatcatcaccaggtccgggttgtccaccgatgcccccgctgtgagcagtgcgcgtgcgacggccgcgtgcccatggtgggctgcattgagcagtgccgtccacccgtcgttgtccgtctcctccacgtcaatgtccgcaaccagtcgcgccacaatttcggcatgtccaagtcgtgatgcggttataagtaatgtttcgccattgaggttccgcatggcggagacgtgcacgtgggtgttgttgaagaaaggaaaccggccattttcaatggactggaaatactcgtagacatttgacgggacagccacagaatccgattcatcattcgagtagaaaattttgacattttcgctgattggttcattattgccagctacagccggccccatgaggtcctaatttgcgaagccagctaaaaaaaggatgaaagattatacacattagatttgttaatggatattaatgcagaggtacacaaagcaatggcgaataaattgtcgaaaagttcgaacttaaacctaaccctaaccgtttttttaaattggcgcaatgtacataggtatatgtgtaggtttttctttctcttcatttttgattagtttgcttaggagaagcaatcgattaattgttagtncctctgccaagtgaggtattgtgagtaaacaaggttttcagttcagattt

SEQ ID NO: 9669 - DNA, 4684 bp, Heterodera glycines
  misc_feature (3533)..(3533): n is a, c, g, or t
tctcaacacataatatgtagatgtttttcattttcaaaccaatttttaggattacaggaacatctctcaaattagttgcaatttaaaacttaattaagaaattcaatcaccgccaagctttttgctaatttttcttaaaaacaaatcagaataaattttttttgccgaatttataaaagtttacataaatatttgactggagaatatgaattttgtgttctgttcaactagagttgattattttgactaatctgtagtgcatcagttcaatgctaactttccaattcatcaaccgtaatgaaatcacctgtctctccacgggtccattctactcttcgtcaagtgtgaccgttgctacgaccgtttctgccgactccttgttttgcccgttggttgtgacgtgggcatttccctctgatgaaccaaccgtatccaccacgcttccgctcggctgttgtccttcatccttgaccaccgttatttcatcccctttcccttcttcacccagcattggttttgcggataccaaagctttacttccgctaggcgttgctttttgctcattgggaattccgctgtcactcaaagtgtagacttggattttgtgagttgcagcggggtccgactcatttgtaatgatgaaggcatcttcatcgactatttcttcttcatttatagtcgcttcatttttttgttgttgaccattctcaatgggagcatcagaactggccgaatcctttgcctgtgactgctcctgaacaatgccatgaagtttttcagtcttcactgtgtgctcaactgaaaattaataataactttaatttttgatatgcttaagttctgtaattttattctttcatctaatgagtttaccgtaaatttccagcggttgctccaccgcgggcccaacttcttcttgcttcttttccggagtggtctttttttcgtccactattgatttttcctcatcctctgttgataattctggctctgtttcggtgactggttccagcttcttttcctcttccatttttcccttcgattttaattaaattttttgacatttacatttcttactgtttcttgagccttctcgggtgaagaattcgacggcttctttgagtcgctaatagccgtttccgaaggtttcgacttccccgccacgctgccctcacgtgaccccttagcagcagatgaacgacgacttgaacgacgggtactcatagaggttgagggagaagtgacgtctaaacggtaatccctggttaaactaattcaatcactctataccagaaatattgtctttttttgcgcggttaggtgatttattggtgcgtcgccctcgcttcgggtgtggcggaccaaacacaacagccgaagtcgcaagcgctaatggatcctttccaccgctactactcggtggagcacccactgctcgacgcttcggtgctcgagtgcccacacgctgttcaaactcttgaataagacgctcatccaatatattggccctcggctcccatgtattatgcttgctgttccatcctttccatttaacaaggaattcctgttggccccttcgagttcgtgtctgcaacaagcgctcagctgcgtacacctggtctccgtcaattggatcaggatccatcaatttcggaataaataatatgcaaattcctaagtaaaatcacttttggaagtaaaataatcaattttaaaaaaagcaatgaaaatgacaacagtgaggagagaaaagaatggaaaaggcggcttaggcgaaatgttggtgagtgagtagatgaattgagagaaaacaacaactgttggaagagaaagaaaaatggatgaaagtgcacaaagcagagaaatgcagaaaagcaaagggcgccattccaaaataaagcagcactatgggtcaactccactgtgcagagaaaagcctagtactatctcgtcgtttctctttttctttgtaatttgtctcactttggcgtactatctcttcattttaattatgtaaaaaacaacattcacttcgtgatgtttaactttttttctgcatgttaaatccacaccaaattttgcatatcgatagagaaaaaaattctgcatcgaacgtatcaaatatttttttaggttatacatcccattttttcaataaaattcattttatagcttttaatatattcttttttgttctatgggtaaaagaaatttaccacgcaagcttaattgcaaaaaggcgttgaaagagcgtgagaagaagcgggaggagaggaaagcgcagacggccaaggcgatacaagctcgcctggccaagaaaagtgagtttttccattcatttttaataaaatcctaattttccaaatttttagccgctccccagccgaacactgatgcagaaacgccacaaccatccgaagaagagccgtcgacatcagaggcaccggcgcgggacaacgacggacgaccaccatcaactccaacaccgatgacaccgcaggaaatggacgtgccgtcggtggagatggtggacaccgatgtgcaaatcccttcaacgcctgccgatgaagaccaacaagccgagcccgtgccgtcaacatccacggcacgctgtgacttcatggcgacaccatcgacttcaaagtgcgccggtgcctttggtcttgacgatggtgagtgcgaaattccatcaaaaattttgttttttaaattcatttcattattatttttaagtccacatgtttgacgagctgcgacggcgccacgtttggatcgaggaggaactgcagcgacagcgccggtcaaacgccgtcctccgaaaacagctcaaggcacagcgcgatcgttcgacgagcctcgagcgttcggcttcgtcatgtcgtcagcggaaggccctttcagacgtgaccaacaacccgcaggaggacaaaaggctgagcgcggcgaacgatctgctcatcacattggacgcaggcatctccttcaaagcccgtgaagcgttgaagcggtcgttcgccggccagggacatgacgtttgggcaccgacgtgggcagtgaagcgtctgaagagggagctggccgagggggcaaattttgagtgggtgggcgaggaacagactcgcgcacttgtctgcaccgacgtgcgtgcccttgttgagggtcgacttcaagcgttggcaaaaagtggtgagaggaaaataaataatttttcaaatttataacaaaggccgtctgcaactccatcaggaatttgtctcccaaatcgtgttggtgctgacgggtgacaagggggcgccgtcgtggcagcaacaacaaaattggtattactcatccacaacgttgatccaccaaactccccaaaaaatctctccactttcgccatgatcgccgacacgtagacagacagtcagtacagtgtactatttctccctttctccagtggctatgcggaagaaaagaaggaaatagtacactgtctgactgtctggttacactttagaaaaaattgaccacaaaccgggacccaaactganatgcgacgatgaagtttgggcaccgggaagtttgggcaccgggaagtttgggcaccagaaatttgggcaccgggaagtttgggcaccagaggggggatttcaaaaaaataaaacaaaataaataaataaaatgttatataaatcattaaaatttagtaaattttagcaacccttttttcttaaaatttatatgttcttgaaaatcaaaaaatttatgtatgggaacctggcaatcttattatttaatcaattcttacggttgtttaaacgtataattaaacgtgtgctagtttctgtttggacttatacctgaataccggcttagttgggtcctgaaatatcaagagtcccgtttaattctgtttaagctcataaaattttaagtctttgcacagatcgagccttgtaatgttataagttataaataatacatatgtatggcattgatattgaattaattgtaatgagtttagcaaaataagcatgcttaatcgaatgaatattcgttaaagaactttctatttcctaacttgattaaattttctatgcttttaaattagatggttgcaattcatagacaattaaaaatatttttattttttaactctttaagttggtgcccaaacttcccggtgcccaaatttctggtgcccaaacttcctggtgcccaaacttcccggtgcccaaacttccgccccccagatgaagtacttccttcgttgttatgcacgacagatgcggtttgttttaatgacaataatatgagttacgcataaagtgaaattacacgcaatgagtaatgtgaggaaaaaaatggtgcgaagcgaatgagaaattcagtgggaaaatatgcacttttatgcaattggttccaaattagagcgccaaaaagcgaatttttgaaaatttggattttcgatcgactttcttttgctaaaatatttaattcattgcccacatattattatgggttgcacccactcgggagtggcatctgaccttgagcaaggagatggctgccagacggcttcctggacgcgatcatcacaaaggtcaaccgcgcgccgtccgagcgcttcacggacgaggtgaccacactcgatggagacgatcatcctcctcttctgctacaaggtgtggttttttgggga

SEQ ID NO: 9670 - DNA, 2226 bp, Heterodera glycines
gtcgccaccggcttcatttcgccactgtccgccgtttcgtttaatttccgccgttctcggcacgggccattccctcccctcctcccctccctcctccccccgccctttctccattttttccaatttcaaaaaattatttttcaatgattttgattcattcacttcgtttggtttctgtcagctgttgtttgttggtcattatctctcattatccatctcattatccatcattatctctcattatccatcattatctctcattatccatctcattatccatcattatctctcattatccatcattatctctcattatccatctcattatccatcattatctctcattatccatcattatctctcattatcctttctctttctttctctctctgctcatttatttccctttggcctctcttccatctctctgctgagctttgttttatccatttccttctcaatccctttcactttctttggttcatttatctcattatttacttctttttcccaactttgtccctttttctgtcatttgtcgtcgtccactgattttgttgccagtaatttcattcattaattcatttttattgtttatttttcagtgttatttaatatattttgaaaatgaaaaaaaatcttaattttagtggctttttcttataaaaaaaaatgctcattgtttctttattttttgttttctgtcaaattttgctgctgttgacagtaaaaggcgatggaaattacagtcgacaaagcgattacggtagtgccggtgtttccgacggttctccgccgcccatttcttcgggtacagatctgtacaataagcaaaaactgatccaaaataattgaattgtattaaataatctcgttacattaaaacttacaaaaaaaataaaaattttatttaggggctgaaaaaacggtagacgaatttctgtccaaattcgaagcgttgtccgcccgaactgattccgatgatgtcggcgttctcatggcacaactttcccaaaatatttcctccttttttgaattggctcttcccgtcggttctctcatcgcgggggcccttcaaattagcgacaaagtaattcataattatcattcaacggaatatacggtagttcggcgtaatgcatactgtaattgattagaaaagcaattaattaataattgtgccaaaaaatattttgctttgttagcccgaatctgaacaatacaaagcgatggagaaactgcacgataaatttgatgcaaaacttaaagaattggacacgaaaattgtgagatcttggcaaaagattgacgtgagcacgcgaatattcaacagttacgaagatgtaattagctaattatagtaattaaaggcaattaaacactcatcaaaaggctaaacacccaaattaattattattttattttttatgaaattattattaatttgttcaacttttctttttttgcttttattaatttgctttattttaagaacatcgaaatgccattaacacattttcgttatcacttgagttttttaatgaatccgaaattggaaaaaaatgccaatgaagtgacacaatttcgggaactttgtgattcaccagcgattcgtcagagcccatactcattactgaacgtaataattaattctattaaatattagcttaattaccatcattgatatttgttattgtgtttattcagtcaaattaattcgtgctgagccgaacctaaaaaagtatcaatgataataatattttatttaattattattttaaatttatttgctaaataatgaatcataacttagcttaaacttagtcaaattaatgaagcttggtattgggcgacagctctatgaattctcttcaatcttatgtaataacaaaactagcaaaatttttacaaaaagttgtaactaaaaaatttcgtcaaaatttatactcaatattttgtccataactgtttttaaactcttttaaaacatttcagatttatcgtaatcagacgaaattcgttcgggatatcattagtaccacacccactcatatatcccgccatgatacaataaaccccaactcccccaccatagtgtcgaaacaatatcaattaacaacaaccaatcaccacctcaaagtcgcgcatgaacaccctggtgccgcatgttcatcgcgttgatcaccattttgcggtcggatgtaccggtgatttccacccgtcggt

SEQ ID NO: 9671 - DNA, 1804 bp, Heterodera glycines
cctaaaaaagtatcaatgataattatattttatttaattattattttaaatttattgacttaataattaatcatatacttagcttaaacttagtcaaattaatgaagcttggtattgggcgacagctctatgtattctcttcaatcttatgtaataaaaacactagcaaaatttttacaaaaagttgtaactaaaaaagttcgtcaaaatttagactcaatattttgtccataacttttttaaaacccttttaaaaaattttaaatttaacagaattataagaaatctttgggctatcttattatacaaataaaattgttttggttatttcttaaaaaagtgactaaggaaataaatgtgtcatatttttttacgaaattttttagttacaactttttgcaaaaaaattttgctagattttttattacataagattgaagagaatacatagagctgtcgcccaataccaagcttcattaatttgactaagtttaagctaagttatgattcattatttagcaaataaatttaaaataataattaaataaaatattattatcattgatactttttaggttcaacctagcagcaaattaattaatccttttcattcacagtacatttatttttacactgcccgttactgtaagaatgaatacggattgtcgaaggaacaactttcaatgttggcacattttgtgccattgttgcgcaaagttcgattgcaattggacagcgattattccaaagaaaagttcgatgaaatggaaccgggtcgaaaattattaattaattataattaataaataataaaaataattaattgttactttccagggaatttaaactttttcatacatataaatcaaataaattatataaataagttagatagattttaagggcttatcctttggttctcttcgcttgaggattctggcgccagaaatgttctgagaaaaatggaaagtgccattggtacgattgtttgttttttcttaaaaatcaaatttaaattttctcattttccactgattcggctttttctttttcgataatttaccaaaattttactcggttcacgcggcacttagcaaagtcaaatcgtttttgtttgaaacgggcaccgaaaagtacagaagcggcggaacattgtgagcaaaaaagaaaaatgctaattagggacaaataaataaatccaattaatctgtgtgaaaggtgcatgttgcgagacgtaattattgggacaaattaccaacgaaaagcaatcgaagaaatggaaaatgtcattcgattggaagtgctgcaattggtaagccatcaaagtgctaattgccctactaatgtgtttccctttgatgatttccgcagatggcttttgagtcaatttgtgccaatttaacttttaccaataaatcttcttcgtacatggattggcatctcaattatttcaaaaacagaacgatacaaattcttgacggagtgtcgcaattcgtctggacggaacttgtgagtggggacagaaaaagtgaagtcaaaacgatctaagaaacaaaaagcaaagcgaaaggaatggacagaaaagcacaaaaataaggaatacggtagagaaagtcccaggaagatactgtaatgggtaaaacgaaagaagcggagaaagtgaagctgaagggggggggggggaatcgaactcaaaatgcaaatagacaaatatccaaatatgagcaatgaatgcgcaggagaattcgttcccggaaattgaaattggcgtagtgaaatccaaaatcgacgaaatgcgatggat

SEQ ID NO: 9672 - DNA, 1403 bp, Heterodera glycines
ccccccccccccccggtaatttgttaatttttcccaaatattccctcaatttgctttttcttagattcgttcgccgcggtttcgtctccgccagtctccgaaatgaaacaaatttcgttgtccgttgtgctgttgagaattgctttctgttgtccgattacgagggacttgacgtaatggtcacgcgatttgacgccgaaagggacgaaaagcgggcggaaaaagcgaacgagtggcttaaaaagtgccaagaaaacggaacgaagaacaaaacggccgaaaggacaatgagacaattcatcgagtaagctgaaaaacgaatggactaataaaaaaaactggttttggaatttaacttttttaaataatccgcgaatcattcggcacatttcagccaaaattataacattggcaaagtgtctgagctgctggacaactttgagaagcagcactttaacctcaccaacgatgctttgtaccgtaacatcgccattctgcgcgattacggtagcattgaccgatgtgggattacggtctcttcaaatgaccgtccatcggacaatcacacggcaaacgctgctgctatggtggactattacttcgcggggtccttttggcgcgcctgcgaaagttatgccatctatttttacacttgacaaattcggcaccttggcggaggacggaacgccaaaaatttcgattggattatgccatttaaaaaaataataaatttaatgttccaactctcttactcttaatattttttctctaatgcgccataaaattgtcttcgcattgccgtaagaataaattgcgctttgtccgactcgggcgaccactcattcattattcgtttttattgctcacttaaagacaatttgttgccgcttatgggcaaaataatcaccgacaaccgacggacggccaaaaaaccgtggggatttatttgggaattgcaaatggcattttctgatttattagtgtcggccgttttcctttgtcatgcaaatgccaaacaaacctttcagttttgaatatttattttaaaatttgcctccgattgagtgagtgccttttccttttgccatttttcgtattcataaatttcaatttccatttggccatccttttccaattagaattgcacctcatcccttcgttgttttggccaaccttggcccattatcccccccccccccgtttttgtctcccctttttagctacgcccggaggacattaatttcgttttccatttcatcccttttcggccaaatgttccgggtttaacccgggtggccccgaaaggccgggcaaaaggtccaacccccgggggatggccttgctgatggaacattacgaaataattaagccgggaagaatggcctgcacaagcccattccggc

SEQ ID NO: 9673 - DNA, 2458 bp, Heterodera glycines
  misc_feature (6)..(6): n is a, c, g, or t
  misc_feature (2446)..(2446): n is a, c, g, or t
atacantttgtcatatttatttttcacaatcccttttcctcccattctttcgttcatccgtctttttggtcgattaccgtcgtcatcactttgtcgtcgtccatttgtccccccccccctcaattttgaattgattttcacagcaatttgtgtgctttcggctgccccgtgcccgtgccaccaattaatggaccttctctccccttccccaaatttgttccccaattgctaaattcccccgggggacggacaccaccaacaaataaatgcttgtgcgtctcccattttataacccctcaggctaaatgtgcctttttttgcaccatttgccctccggcacaaaaaatcggcactttgccgcaaaagttatcacaaggaaaaaaatgtaaaaattaataatatttttttatttttctcggcaaaattaatttcacaaaaacaatttaataagaaaaacacccaataatttaaaactaattacatagatttttcggattacaaatccatttaattttaactctaattcgatttgcttataattaattagatgaatatgcgcattaattggcttacatttcttttttcattcctaattttatttttgtattccaaattaattttatgcctttataaaccgtttgcgtttcttaaaactttttaaattaattttaacttcaattttttacccttttttacaaaattttggccattttatttcatttcaattcaattcttcccccccccccccaaaaaaaaagttaaaaaaagttgtccatttcaattggcgtcaaaaatgggtgaaaattgaatgaatggggtgcaattgatacggacgaagaagaatgaaattggctctccattcagtcattcataaatcggctgctgctcctcccacatttttacagaacaggttttccactttttcaccctccgccgccgcccaatcgctgggcgccaacaaaattttgtgacatttcgccacaatcttttttttttgttttatttcggcgcgcggagcgcggttaatccgccgacggtggacggacgaccaatccgcgcggtgcagcgaaaaaatgtgtcgaaaaaaatttactaaaaaaaagaaagaatgttttttgattagtttttcgatctgcaaaatgcaataaatatttaaatgagtcagcgttcaccagtgtccttatttcgaagatttttgagagtgattgacagaattaataaaatttgtttttttttttaaatttcaaaaattctccggcgccgccttttttaataaaagcaaaattgcaaaatttcaaagaaattccaattaatgcgcaattttcctcaacggcatataataataaaaaaggcgaaaatgagcgaaacaacctaaaaattttccgtttataaaaacaatttttccatcgcctgtcaaaagtcagttggacattttacgttttttggcattacgtctcttttggcactttgtctttttttttgcttcaaatgccatttatcgcctgaggcaatgtcattaggtcgggggaagtcgtttatgccattttcaaaatggtcaaaaattaaatttaaaaaaaaaattccaattttttttttactcaatcttatccgattaatttggcctgcatagatttaaaatccatttgcgccaaagtgtttggcgttctgttttttcacattttccatccatttttcactaactttcccccattgtcacgctccgttcacgattgtgccaattatcgcgcacaaaaacaattttgtggtgccgtgccgaggcggcgacccgaccggcgccgtgccattggcacacaaagtttttttctttttttgtttctgtcctatccattttatgcacccggggggcaattaaagtgttaattggtgtcaacgagacgtgccaacacaatccgccctcccccctcccacgcgcgtctctcttccgttgtcccccggggggcggacggcatttacatattttgacacaagcgaagcagcggcctagcagcagaacgggcacaatgccaacacgctgtgccaaagtgtgtgtgccgtcggcagtagaacaaaaacagcgccgtcgcctctcaaatactgaatgaatggcatccatttcaaacatccttttttattttaaatagtattattttgaattgcattattttttagggacgatatttttatgaataaaaaccacaaaaatttttatgttgtatcagtatttgaagagaaaaaatgacctaaagtgggaaaatatgttctaaaatgtccaaatcaattaaggaacgatgatcggatattctcaaaattccgaagtaatattgttttcatttgttttgactttttttttgttgagaaaaacaaaaaaaatttttttaggtttttataaatgccaaaatctaatgaataataaatatagttataaaaaaattcatttataaatcanattaattttttt

SEQ ID NO: 9674 - DNA, 1688 bp, Heterodera glycines
  misc_feature (1522)..(1522): n is a, c, g, or t
  misc_feature (1527)..(1527): n is a, c, g, or t
  misc_feature (1649)..(1649): n is a, c, g, or t
gatccataatttgccaaacttagttttttttctcggtaaatttgccatttttttttctctggggttcgttttctctcgtttttccaaaaattataattttaggtttaatatttccaaacctttttaggaacacttacatttttaaattatatttaaatattttcgatttggcctaacataaaagaaaattaggaattttggcaaatttagcgttttgaaataaaagaaatgatttaggcaaaattcgttgagctgattaatagttattttttcaatttttccaattttatttccaaatttgttttagttcgtgaaaaagttgccttgaagcaatttgcccatttttaattccccgctgtgaaaaatatttccttttcaatgtacgattaagcaaatattttcttttcactgaacatttatttttaaggaaaaaactttattgctaccattgtttaattgattttgaatttcaaacacaattaaaacatgattttaattatttattttgatatttttaaaaatgttttttaatgtttaaaaataattttatatgtaaagattatatatataatatttttgtcatataaaattatatataaatattaaaaatgtaagatgcttttaatatatgaataaaataataaaaaatatttatgataaattttttaattctttttttttgtatatcagaaaaacagcaggtcaggtcaggttatctgcccattaggacctccagcaggaggatgtgatgcttctgtttttttgtgagaattgttaaaattataagtttctaaatctttctataattagcattttatagtgtcttgacaactcataaaacagtggttttttgcaatataaaaaagtaaattaaaatattaacaaaatttatttttccatttaatttcgtttttcttataatttttcctcaaatgaattttttttatttgccgctttgtcttcaattagacttacaattttcaattttcaattttaatgtttataatttgatagtttaataatattttttaattgttttttttctattttaatgtttaatatttattgacacatcaatttatttatttttcgtttgccattccttttacattttcacatttttccaattttggacccattgaatttttatttttattttctctccggacccaaaaagctttttcgtccatccggaaaagtgaaagcgccctcactttttgactgtgcaaacaaaaaattttgaagggggtccaattggtcggttcgccgactcattaagagggggcgccgaattggccactcgtccgtcgaccgcggcgggcgggggagcccataaaatattaaaaatcaattttttaaatattgaaataatcttttaaaataatttcccattccaaattacaaaattatttttttttaaacagtagaaatgatcggtacaattaatgatcaatgatcaacaattcttttaaaacaaacaattttattgtttgcataaagcattaaaaaatgcgttgtttanattanaattggcaatttaagttttcaaatttgccgaaaaaattaatcgctttttaaatctatcgcacttccaaacccattaagaaatggtttgtttaactgatcacaaaggatcccaaatttggaangacatttgatcattgaagtttcgaaaattgtatgaaaaa

SEQ ID NO: 9675 - DNA, 2830 bp, Heterodera glycines
  misc_feature (2803)..(2803): n is a, c, g, or t
tcgcgcatcgcatttccgctgttcttcgtcatttttcatctcgcttattggtcattccatttggcatatttgaaatttgataacatttaatgagagatcttttaaaataaatgttatttaatacggttattgttgtatatttttggtgttcaaaaagataaatacaaattttatgtaaactctcatttttttgtttatattttatcaaataaaacatttttttaattaacggaaaataaagaatgtaaatattaattataaataatagctttgtgccatttgtttgtaaaaaatcaaatttttgtgttaatttggcaaaaattcctatgaatcgtaggaatttggtggtccgacaacattgagcattaaatattttttgtaaatattccaatttaaaatcttcgtcaaaaatacatcaaagaaataattttatttattataaaaatggatgtcaatttaaaggattagctaaactaatatttttaatatagctctttaaattggagtgcagcgggaccgggacctgaacacggacaactgagtacaactgagaaccaaggtcccggttttgaccagttttgaccgggaaattcccggctttttccccggttttcccagccaaaaagtcccggtttttcaacccataaagtcccggtcccggtcttgcccaaatttcccggccccgctgcactctaatttaaaacatataaaaaaaataattaaattttaatttgaattattaattaatgcggaaatatcgcgcggcattttttcccgcaaaaattgacacattttgatttaacagcacacatttttaccgtaattatctccatattaaaatagacatttgtttagccgaagtattttgaataattttctctgcaataccactcttttgcctgccccgtgccgccgcttctcatccgccccataaaatggctgtcccacccgcgggagttggcaccggcaccgctggtgccgccgtactggaatggttgcgcaaaaatgcgctggttggcgccacgctggtctcggtgctgctgggcgcactgctcggcaccgttgtacggcaaaattagcaatcgctgattgatcaaaaattaggctttctgatcagttgggctagtccgtaaaacggaatccaaactctgctgatcagcccgaccattggtcggcattaaaaacattttgattcgatgaataccaaaattaccgatgcagattttttggcattttatcgtacaaaattgggaatgaacccagtaaaaatgtcgacaaagaatgtcgccgataaaatttaaactatatttcgaataccaagcatctacccgaattgattgaaatttccaaaaaaaaacgccgatgaaaattttgggtgcagcccggaaattcgaattttaaactggatattttttatgccgtttttaaggggtatggattttccggttcttagggtatgggatatatatgaggtttttatgctaaaattatttataatatatttttttttttgcagattcgttatgccaacccatccttacagaccattatgctgttgacatttccaggagaagtaagctgtggagagagagagagtgtcaaaaacaattaattaattaattaaaataattatttaattaattaaaagacgccaaaaaattttcattgtaaataaatgctcacaacattacaatgcttacagcttcttatgcacatgctgaaaatgatgatcatcccgttaattgtggtcagttattattattctcgaaattaaaatagtctcttaaattaaataattaactaattaattaaatgccccaatttgttaagtcctcgctgatctccgggttggctcagctggacgccaaacagtccggacgtgtgggaagtcttgcggtcgcttattacttggcaaccaccgcaattgcggtgatcaccggcattattttggtaattaacagtagggttaagccccgaccccgagccccccgactcgacccgagacgttttttggacctattccccgacccgacccccgacatgtcgctccccgaggtccccggctcccgacattttgccccccgagggctcggggcttaaccctaattaacagagtcgcatatgcaaaataaccagggaatgtctcggcatgccgatttccgattgccgtaattttttgagcgcattccacacatgtcattgataagattttccaccgctcttcaagaagcaagccctggtctgtgccattgttttgcatatgaatggcatatggcggcgttatttaaatttgtgtcaaaaaaccatcaaaatgagaattttttttgatataattttagtcaaaagcaatcaaatttttattcttgatagcattcgatagcgccttaagtgttttcaattatcatgctgcaaaattccaaaaaatttcgttaaataccaagaaagttatgactaaaaattttcagaaaattttgagtttctcagtgctcataacttttttggaacttaatgaatttttttgaaattttgcatgataatagaaaagcttagggctatcgaaaaatatcaagattttaaaatttggttcatttgggcgaagttatgaataattttttgtcaaaagtttaccatttgatcgttttttgagtaattttcatagcaccggatttccttcatctccatggtccatttgtcaaatccgttggaaaggatcaatgccatgattttaccgggatctttttttttaccgaaatctcgacaattcgaaattttaaatccaataatttccgtgttgaattcgcgnatttttaatccctgtcaagacacaaca

SEQ ID NO: 9676 - DNA, 4348 bp, Heterodera glycines
cgccgacattcttgaaaactaaaaaatttttatttttgcctgcttcaaaatgttttacccgggtgccatgctgaacgcgttggtcaaggaccggttcaccaacgaccagtaccacaacgtggacatcggccaccggtgaacgcacagtcagcagtgagaattccatcttttttgaggttgtatatcggcgcggaaaattctcgggaatttcaaaaaaaattttatttttttgtaggtcgacggcccatactacgccatgattttgccggcttccaaggaggagggcaaaaagttgaaaaagcggtccgtggcattttaatttaaatattttaatggcacaattttgcttttttaagttatgccgtgttcaatttcgaccgtacccttgccgaactgaagggctttgaagtgaaacgacgtggcgaactggccatcatcaagtcggacagcacatttattaataaacatatatttcgagaaaaattcctcgctttttttggcctccattttttgggaaattttaattagaacaaaaaaaaattttttttttttttttatacatttttggactgtttccatgccatttttagggtgttttaaattgtgttaaaaatatgccaaattttgagtttaaatattttacaaagcacaatgcccaccctcaattaggacttattcgagagtcttgaaaactactcacaatcaaaccaattggcaaatattgatgatggtgatgttaaggtatttccaaacggaggtgttcaagcgctttttggaaggcgcgacgctgcaagaaatttacgaaaatgtggccaaagaggcgaactattggctggacattttgcacgacaaagtacacacaatttattttcttcaatatatattttttaaataaatttataaattatggaaatttaaaatttttgatgctttcgatttttcaacaattaattaattccgtttgatggggggggggtgaggtatgagaaaaagacagttggcgagagagcgcatgaaataagagaacagtcagtttgagagcgacgagaggcagaagaagttgctccctcctctcgtttatgagataattaataacaaattatccaatctaattaagttaattgttaaacatatttaaaagcatttcccctcttcacagggccaaacgctgtcgcgccgtgaactgttcgatttgattggcgaaagcaagaacatgagcaaacagttggaggagtacggggagcaaaaatccacttcaattagcaccgcaaaacgattagccgaggtgggaaaagcaattaaaaatttttaattcgtgaaaaattttcaaatttttccagtttcttggcgctgacattgtgcgcagcaagggcagcttggcgtgcagttttgtgatctcccgtttcccgctgggcgactccgtctcggaacgcactgtcagttctttctggaacagccccgtcgttctccatccttaaaattttaattacaataatttacaaaaataaatataaatttctttaaaaaatattttttatatttaaacgaataaatatagaaaaatctttcgaattattttgaaaagaagaaaattcttaggaatttgtcaaataaacaaattttttgagttttaaaaaatttagggttttggcttaaatttaaaaaaatttcttaagtcttgctaaattttcaaaaattaattcaaacggagtggaattaagactcccgtttttgcaaaataagtaaaaaaaaatgtacaaacaataatgtgtcaatgaacatcaacatttcagcttccgttggccattttcgacgcggcgcccaaagagcgcgtcaaattcttgcgcaaatggaccaaagcgaattcgttgggcgaagagttcgggtcggacaaatgtctgaaggaggtgagcttttttggtgtcacctttgtggaattaaataaattaaaaaaacaaaaaataaataataaaaaagccaatttgattttccccgtttttttttgtagctgatcgactggcaatactacattgaacggttgggcagcaccatccaaaagattgtgaccatcccggccgcgttgcagggcatctcgaacccggtcggtcccgaccatttcgcccgatttttttccctcgggttcgaacccggtcgatcccgacgatttcaaccgattttttgccccggggacatttcgatttactttatttcattttcattcctttttcgcgcaggtgccccgtgtgctgcacccgcaatggctggagaacaagcggcgggaacgcattgaaatgcacacacagccccggatcacggacatgttcaaggtcatcagatcagaccaccccgactgtctgtctgacaaccatgggggctaacttacattgataggacataatcctgcggatttatgccgagatttatcagggacttccgtccgtcgacccacggaattgtcggtgcaacgggggtcgggaattcggaaaaatgaacgaatgcccaacaaaatattaatttaaaactccacccacagtctgccaacgcccctgcttccgtcgtcgtccgtccaatgccaacaacgccgggctctgctggccgaaagagtcggggcgcctccgtccatctgacgccgtggtcgttgaagaagaagcagcagcaccagcagcaatctccgctgacaccgacggcggcggcgacgacggcgagtcgacggaagcgaccgttgctggccacaagtgttgatggagatgaacaacaacagcagcaatgtcctgatggtgccagtggtaatggtggtacttaattattattttttttttgtacatgcttggcgccatagtcatttgggatttggttgcgggaattttgttgaacaaaactggcccgtgaaaatttagaaaagaaattaaccaaaaaaaaaacttggaaattattagaaaccaagatattctaaaagattttacgaaatttatgatttattgagtattcaaaagttttttagtttttcttgacatacaatttgacagaaaaaattttctaaaagggcttttttcctgaaaaattcttcaattcttgtctatgtgtattcagtttcatcaaaacgcatttgtgcatctgctgatgttgttgttgaactgctcgaggacgaggaggctgaaaatgcggagaaccgtcgaccaccgcctgcccaccagccgacagggcccatggatttggtcgcgttggacacactgttggagcagcagggtcacaaccaacagccggtaattaattattatacaattgattaattaatatccatctttcatgctaattgtaagtgtatacatactgtaatgaccgtattttagcaaaccgaacaagaaaggcgcgcggaagcagtgcaaaaaacggcaaaaatggacaagaaaaagagcgctgcacagctgaaaaggtgtgccaatcgaaaatgttccggaaaaatttcggaaaatttaaattttccagggaggcaaagcgtgcggctgttctgcaacatgccggccgtgcatttccccggcgctgttacgccgcaatgagtcagccgacgaaacggagttggcacagcgacggatttatgccatgggttggtcggaaaatgcatttttatgcctttttaaatttattttttcaacatttagctcgactatctgaaggccaaatggcttctgcagcgacaagcgcggaccaccgcgttcaatgaggcaaactttgttcaattttcaatttgggattttaaattcattttaatccaagattatcattttatatgataattttatatgtaattgactcgcgaaaactgttttctaactgttaaaaattttcatttatgctcggtctttttcggattcactaagaaatttaaaaaaagaagtaaaaattttcaacgatttttggaaaattttttgaaaaacagtatttcatcataaaattttgaaaaattctctagtttgaaatttaaacaaaaaaaaattccggggagagagaacgaacaaggaactgcttccgtctttttcagtccctcgggattttaaatccccatttaaaaaaaaactaaaaaatgtttaggcacttttggagcgggccatggaagcggcggatgatgcccaagcagcagctggaacagatgccgattccgacgctgttcgcatcggcacttccgctggtggtggtgccgtcgtccatctgtcgactgccaccgccgcggcactttcgttggcacgccgggagagcacttggcacattttgcaggtacacaacgcacatacacagtcaaaacactaccgtacctaatcaaaccaatgctcctcaagtttttttgctccac

SEQ ID NO: 9677 - DNA, 1486 bp, Heterodera glycines
  misc_feature (19)..(19): n is a, c, g, or t
aaaattggtgcgtaaattncaattggtttgagaaaataaacttttgttttttggaaagacaataaaaatttttttctaaatgtgtcactaaaatcaaagaaaatttttaaagaaaatttgaatttaaaaaaaagtcatgttattttttgagacataaatttctaagttaagagagtacaatgcaaattttttttcaaaaaacatagtaatcatcataaaattttaaaaaatatagaaaatttttttccaaaaatattttttctaagaatttttttttaatttctaagtattgaaaatttatgaactcgttctttaatagatttctaatgcacaataaagaaatattacactttcaattttttaagccttcgacagcgtgcggacgcggcggaagcggaatttcccggcatgcgtgagcaatgccaacgtgtgcagcacgtacagtcccatcagtgcaccagcgagaaggaagcggcacggcgcgtgcacgcgctgctgaacgcgttgaaatgggcgcccacggagccggtgctgctgtgcacgctgaccaaccgaccgacgcaggccgagctgttcaaggtgttcaccacagcgtttgggggagcatttttacgaggaaaaacggggacggaacaaaatctcgtcgttgaaaaatcaaaaattttcaagaaaaaatcttattgttagaaattttacaagaaaatttcaaggaaaaaaattttgaaaaatttctagctattttttggaaaatttttcttgaaaaatagtaatttatcataaaatgaaaaaaacgctaggaaaagtttaaatttgtttcttgaaaaatttctaactttgaaacggcgggcagattttgggcgcgatagtttggagtgcacccagaaaaattgccactttttgcaattatttattttataaatttgtgccctcccccgaagaattatccggcactccgtgcgttcgcttctgtccgtttgcgtgtgcccgagccggacggactgctcaatgtgctcgagtgggcaaattcgttggcgcgccgctccatgcaacactttttcaacagtttcacatttttgaaggtgagtgagtgaaaatgcgattaaaaacatttttcctaattttcataattaaataaattaattctcaaattttaaatgattttttgtttgccatttaattcgataattatttttccaaaaattaaattttcagacgaaatttaaaaatgcaattataattattatttaatttattattactaattgaaaatagtttttatattgtgcttatttatttcccttccgtttttgtcccatttttcctattttctctgtcactttctgtccattcctttccgttgctttaaattttcccttcatttgtctcattcctttcttttccaatgactccgtggcgcaatggtagcgcgtctgactccagatcagaaggttgcgtgttcaagtcacgtcggggtcaatagcttttt

SEQ ID NO: 9678 - DNA, 5523 bp, Heterodera glycines
  misc_feature (26)..(26): n is a, c, g, or t
attcttagttcgtttttaatcgattnataagcgcagagctataataaggtacaccctttttctggattgataactcaattattcgaatatttcgaatgaaactaactttgatcctttcgttgttttcctttgtcttctctttgagtgtttgaatactgtgattaatgcgctgaatttcactgcgcattatgcgaatttcgttgtcgagcaacagcgaccgctcccgaatttggtccgtagaccatttgcaaaatttcagcatcgatctaaatttaagaaaaattaaatataataaagtaacggtctctgcataatcttgtgcacctcatcttcagcggtttccatcttctcgtcttcctttttagcaggttgatccgctgtctcaacccattaattttatttaatccgttgtcaaattccacaccttaattaaaaccattagcactgataaaataaatgtaaggaaatgaaaatatatttgaagaacagaaaaataagcgattgttaaagcataggcttaagctaaagagaaaaattaagtcagcaaaagagacaaaacgccaatttaaaaaaaaccgacacagagggttggcactatgggtcaactccactgtgcagagaaaagcctagtactatctcgtcgtttctctttttctttgtaatttctctcactttggcgtactatctcttcattttaattatgtaaaaagcaacgattcacttcatcctgtttaactttttttctgtttcttaaatccacaccaaattttgcgatatcgatagagaaaaaaattaggaacgaaatgtaagggtttttaagagcaaaaaaagggttaactaaaaagttatggagtgattaaaatttttgcatttcttttcctctccttttggcgtactattttcacatctctaacacacaaaaaacaccaaattcgaaaattctaataatttttgttataagggtacaaaatcactttgaacatttagaatcaatagaaaaaagaataaatttagcattttggttagaaagagctgcctaggacttgagttataacgtgatgaacatttgaaactctcacaacttttttctgagatgtcaaattgcttagcattcacttagaaaaagattctccttttcaaaatctttttttagataccaaatttgttcatttttgttgggaatgaagcgtattatggctgatcaaaataaaaaatacaaaaaaggcatttaccagtgtaagtgcatatactttgtttttgcgtgtgttggcgttttgttttacgccaattattttttggcaatttttttcgttttttaccgtccatgggcaatggtaaagattattggtcccgaaatttgtttttttaatagattgcgagaaagttattttcaagggtaatccgaggcgcttacaaattagcacgaatctgatcctctttaggctcagtttcgaatcccaaactcggattcggacatttttcgaaaattaaaattttcatttgcaaaaattgttaaggcattctcgagttgtacaacaatatgaaaaaaacaagggattaaggaattttaaattttcaaaaatattcgaatccggggttcgaaattgagcttaaagaatgttagattcgtgctcagcacctcggattatccctaaaaataataaaaataacaatcgctttgcaaattttaccgaatgtttctaccaaatgcttactcttgttgttgttgaattatgaaaagcaaatggaataaaattgaataggaaaaataatatggtatttgcttttgtttttccattgtcttcatcgtcctttccttttcgctccccgggcttttcccccattttctgtggaatttcaacaaattttggtcctttcgccgccgtctctccccccgcggcattggcgcagtgaaagcattgcgacttggcaaagcgcaattggacagtttgtcagtgcgaaaagccaccaaaagtggtgaacagggtgagcatcgacggcaaatttgagcagaaagggacaggcgacggcgtgggaaatccaagcgaacatttgcaaatggacgggcgacagacggaggacgacgcagtcggcgaaaagcagcgccagcgaaagggcgagcacggtgcaaagggacgcgtcggtgtccgcggaaagcgccgcgtgaccggcggcggacattcccacggcggcgccaaacggcggcaaagaggcgacgacgtgcgcatcctttggggtgggcataagtaattagcccatttatggcctaattagaaggactccggagagtggatttaatgcttacccgattaaaaaaagttgtgaaaagtgcgcaactgtgcgcaacggcagtcagaaagctgttcgtatccaggtccatcagttaaggcatcatggaactcttttgtctaaatttcatttgatggaaaggtcgatctgttgtcatggcaatctttcctccccacccattgccaaatgaattctttgctgaatgtgccctcattgacacggaatttggcaatttcgaagttaattgccttggttccagcaaatgataattgggattggtcgcagtcggcaaaatgaaagggcaaattgacttagtgaattcttaagatacaacaaaagcattctctgctgtctggtgtttgactgtgttgaacagaagcacatttttaggaaatttcttgatacaaaatcacaaaagtaaaaaaagaatcagtcaatcttcatcttgtcagtcataatacctttcgcgcaagagacagttgccagcaaatgtgtgccctcgcatttttcaattgcatttgaatcacccaccgatactcaatgttcaccacgcacaaacaccaataaatatttgcgtcgctaatgccaaaatataaaaattttgaaatttttcttcgaaaaaagggcggtaccatcggtggtattactttgtcgtaattgcttctaatgatacatttcaccgacaaagagaacatatccaaaatttcagtttttttttgttacccaattgaagattattttaattcatcatcttaattcaccgtcaatttcttcgcacatacataaatgtgtatttctctccaaaattgcctcaagccgaaaattagtctttgtaatgggcggagaatgaatgaattgatgagcatgacaaattgacaaacaccgaaaagaaacattaatccgcagcagcaaaaatttggtatttaagcagtgcaaatgcctctccaactgctcattctttctcccaaagtccattcatttgccattttcactgcccttttttaactacaaatttccaaggcatcgaaacatttcagaaaacaagtaaatgtctaacaacaaaaacactctgtcgcttcaaaactccgaaacttcctcgtccgcttcttcttcctccccccgtccaacgtcgccgaacggaattatgaacgaatacgtcaagtgagttgggcatgaataaaacaaacattgcccattccaacggatgaatgaatgcctttcagaagtgccactgagcggatgatccatctgagtgtgttggaggtcggccgcgtgggcaacgacggcgttggcattgtgcaactgcacaacactttcgacttcggcgcgtcggacgcgcggcggacctgcgcttgttgtgccgttctgtgtgcttccgggtgcgggtgcggccgtttgctggcggaaggcaagtgccatggcatcggaagatgggctaatgctttaatccatcaaccccaattttaagagaccatcttcaactacgcaaagaatggcatcgctgcaaagtttgggagcggaggccgaggatttgggcggagatttggtcgcaaatggcgcaagaatggaagggacggacgcctcgaaacgattcgcgaagggacgtacggaagagacacggcaatcgaacagaacggagagagggcgggacacgggacggtgcagagaggcggcagaagacgaggagtgaccgtcagaagaaatgagatgcagcggcaggagcaatcgatcggccagagcgacttccgtcttaaagcgatcagtggacaatgcgacttccaatggcaaccgatcggatgggacgacgtctttcagcgagaaatcgccagaggcaactcttttgtgacgtcatttggaagaattgacgaagaacgtgcagaaaaaccgcagcagtcggtccgtggaaggggaggaggacgcggacgaagtgcaaacggcggacgggggagacgcggaaacggcgccgggcgcggatggtctcgcggagcatcgcgaaactttgaccaaggtggacggactgatcactaattagtgctaatccccccccctcccttcagaatggcagatcgatggtccaattgtggcaggcgtctcaagttccaagtcgggcagtggcactcacaatgcgcgttttgtccgtcgtgaattgcgcagggactccgtcggcaacagctaccgtaacgacagaagggacgagcccaaactcatctaccgtagccgtaaagaaaattcgaacgatcacttttttcactaatattcggcatgaaatgttatgtcaccttttaatattccgtcgttttgttcatattatttgtttctccttatctatttgttgttactcatcggcagtaatctttaccctttaatcattttttcttattgtttgtctctttttgttttatccgtttttttcacttatcaccactaatcaacaaaggagaggcgaataaaattttgttttgctttgacgacttaattttcgattttctttcccattaatcaaattaatctttctattatcagaaacaataaattataggccataaaatcaaattccattcatttttaattgatttttttcattaaatttccccaattttggttccgatgcgtttttgctgttgtgtcaaatggtgttctgtcattgctctgctgattttcggcataatttgcctttgttttggcattttctctctcatttttgtgcccaaattggtcaacaaagcgatcagagaagttggccaagggaattaaatttcaaaaaataagagttttattaatgcacagaatgtttttgttggtcggtttccaaacggaagtgataatttcgcaatggaacagtacagagacccgaaatacgacgtaaagtgagtgaaaaagtaaaggaaacaacggcagaagagaagtctaaccaccggcggcggtggtttgttcatctaccgtacccccttccccgccccaaacgaccgtacccacgcgccaaattaacacatttattattattcattaattaccatttgctccattaaatcaacagccactttaggatgcagatttgggtcttttctgtgcaaaaccctaacgaaattgtgaataaaggagaaaaagcgaatgtgacggagttgggtccgttcacttacgagtgagtgccgccgggcggtcgaatttaagtccaatttttgagtattcgaatcaaagaaacaatgtgaagtttggctccaatgactcgcgact

SEQ ID NO: 9679 - DNA, 2420 bp, Heterodera glycines
ctcgggctctcagttgtgctttctcggtgtaaaagccggtcatgtgttcgacccgtcttgaaacacggaccaaggagtttagcgtatgcgcaagtccttgggtgttcaaaacacaaaggcgcaatgaaagtgaaggcttcttccggagctgatgtgtgatccctggcaatgcggtgttggggcgcaacatactcacgtttcgcttgcatcagatcaggcggagtcagatcgtatgctctgagacggaatagatggtgtggtattccataacagtatgacaacagcagggagtacgagggaagtgggacgagattgaaactgtctgttctgatgcaggcaaattggatcaatttgcgttgccaatcaaaatctgttgtaagtgctttctgattgagtaattcacatatttctgtgcagagaccaatcagcaagcatttgtgttttaaagctcgtatgtgtatcaatttttccacctcttttcagtctcattgacctttctgtgcttacatttctccgtttcaacaaacaaatttgggacagaagtggcaccaatttgcttctgcggattagttacataaaacattgttgagacaatttgggatgtttttgtccgtgtaattcttaagacataactttttctaacttggttaatgcctgcctatcttcttggtatcaaacgaatgcttaaagtctcggggttttataaatgcaagaaaatagcaaataccggcattaaaaaagaaattacaatgagaaaacacgaaatcaagtttttcgagtatgagtatattcgggaattatttttttgcctatagcctttacataggtaaaaataaaaaataattctatatactttaagcttttcaattggtaccaagaaattctcacacaataaagcaaagaaataaatttatgttttgtatattcgaacgagcgaatcaacaaaagatttcggagaaaacgagaacataaaatcaaatttcattttgtgagatgtaaattattattttttaatttacaagaaatcaaaaattgctgttgatgcttagggacttgcgagaagcgatttttaccgggaaccgagaccgagaaatgatcccgggaaacgatacgagaaccgagacccaaaaaacccgagaaatttcccgagtcgggaaccgagactctctcacatccctattgctgctcacccaatgcaattaaattattgccgccccataaattaggcgtttatccatattctgctagaagttgaaaagaacgatacttttggaaaacagcaaatatttagtagaattttatgagcgagggaaagacgtaagaaaaaagtgaattaattggttggaaatgttatcaaattcaattcttccccggaagggcactgaacaaaaaaataatcagccaaaaatacgcatttcaaatttcccatcagaaattggccaaatcgaatttgaagttgggcccaaagttcgcctcaatttggtcgtaaatgaatacaaagaaacgaatggaaacagcggaagaccatcagaagaagaagaagaagaagaagaagcagcagcagcagaagttggaggagaaccgaacaaaaagaaatctgtaaaatatgaaaaaaagaagacacaaaatgacacaaaattaaaaaaggaaaattaatcgaaattatttcattttccatggatcagaagagtagtgaaaaacacttgcaaaccaacccaaacgaagcccattctttgtgaaaatgatctgccgagtggacaaattaatggcaattcccacggtatcgccagcgccgtaggaatattcggcatttattcctttgccttctccgctaatccaaatctcgccatcgctttcatatgcataattgcctttgtggtcaaaaatttcttcatccaattttgtttgctgtttaacggcgaaaccaaagtcgataaagctgaaaaatgaggcaaaattaaaagatatttttcagtgatttttaccttcccattgttttgaccgaaatttcgaaataaaaaatgtcagactttagcaaaaccgggtgttttgcgaagatggaacggcagccttttgagggaaaattaattttaaaataatcagttgaattataatttacccgatctgtgttccttgctgtggacagtcaaattgttttcgtcaataattttgaggtccttgtgacaggcgtcaacgtcccagaaatttggttggaaaatcaaatgcaccttaattatgttaaggttatgctttttcattctttcaaaataatgatcgcttttgaggcaaatttttgcttttctcctccccaattcaccataagattctgtagttttttattcaattcgtaaaattgttgtttctgccatttttccatttcgtctatccgttttaaagcacatcaaatgatgctgtgaaca

SEQ ID NO: 9680 - DNA, 961 bp, Heterodera glycines
taaaaaatgtttgctgaaaaattgtggtttttggaattccgagattccgatcccgaagtttctggtccggtcaatcgccaatcccgtgcaaccctacttcaaatatccagcgtatttaacgtaatttgaacattttattattaaatattagatttaattttattttcaaaagtattattgtcgttcccttgttgctgtaaaacatgttcccgtttcagcgcttcatcgtccaacttgtcaacattcgcctttaatatttacaaaaacaattccaatttgtatcgagaaaaaagatgcgccaattttgagctaatttttcagattaaattcatgttttttttaaaaaaagtgatttcacaccgacagaaattttctaaatttttgtgaatttcgatgattaagccaaagtgagaattattgtaaatctgattcgaaatagtgtggaatttttcatttggtaatgccatcgttccactttctgtggcgcctatcggccattacccgaaaattttcatttgccttcatcatagtgtcacttattttcctaattaaaagtgccgacggaattttcgctccgtgctcctcccataagccaaaaaaacaaaaaacaacaacaattgcttaaatttttattgaatattgagccggatgtttgtaaattattttgaaaaagcatttttatattttagcacctttgaaggttcatcaaagtttggcactttaccatcagcaccagtgcctacgccatttgtgcattcatagcaaagccaaataaaggcaatgaaaaggagaaagaatgaggagtatgaagtcattatgctgggaattcagtgatagcttaactgataaaaaagtaaaataaagtaattatatttaggtttattctgccttttattgcgatagcttttatttattttcttttaataaatcgatttactccatttactgacgcaataaaaat

SEQ ID NO: 9681 - DNA, 1919 bp, Heterodera glycines
  misc_feature (1825)..(1825): n is a, c, g, or t
cagacagaatttttcattttgtttttcaattgtcgaaatttaatgatttaccctctataatatatttacgcatttaagagcttaatttttaaaagaagttaaaaaatcaatgtttaaccattgatatgaatacaattttatgcttattcgataggaatattatagcaactgacataaacatgataaattatcgtgatattatttcgaaaatccggaggccatgagtagaatctaaaatttagaagcatttatttgttatgttttcgaatttaaaattagccttctttttttgaccagcgggatttttacgggaacgggagtttacgggattcccgccccagctcccggaagattctattgaaattcttcaaccctaaaaatccgatccctagagatgacttaagcatcaacccaatattaagcgcaaaagctagctcaagaccagaaaaatggggcgaaaaatcaccaaaaaacgaattaaacccatcgtgaaaatcaccgctttgatttgattaatgaaaaatcttttaagcttaaaataaaaataaaaataattaaaattaaaattgcattaatttcatttttaaattttgattcttttttttagtttcatctcctgtaattgttggcttttgtgttcgatttgcttgcatttcgggtaggcttatggagtctatataaaggaagaggaagtgtagcaggggtgggactactctcgccaactctcgccatttttgggactctcgcctctttttgtagaatcatgttaatttctagattttagacctttgatttcttagtgaacttattttaatttttgtgtcgccttgctaattactagggttataaattatatgcttttgcatattttttctgcgcatatgctatgaagaaaggggctcaaaaatagcattctgcgtaaaatgttttgctttggtgaaggtttttagtgcatataaaaagcatattttgggtgtttttgagaaaatgtatatttggccatttttcgtttttagagcatattttggccattttttggcaaattttcataacaaaatacaaaaaaagcaaaaatacacccctaatttgtaaggatcgagttttttgggaatttaaaaaatatacccttgaaaattgaaaaattttgaattttttgtaagaacttttgaaaaaaaatgttgatatataagaaaaatttaattttcttttagcatatgataaaaattaaaaaaatcgaaattgcatatataaatttagaaaatcaaaattttttgcaattatctaaaaactctccttagttattgttttgatcttttaaaaatcaattctgtatttttacacaattttgtcattttttgagggttagaagacattttgggtaatttttaaggcatattttagtgcatatttgggcatttttcgggtttttagggcatatttggcatattttagtgcatacaacttataaccctactaattacttttccctaaatcttagaaaaacaaatgtacatacaattagctttttgtagaactcattttaattttgcgtaaaataaaaataaatcgtaaattgaaaataatttgtcaatgcgaaaaatgttgattgaatcccgcagtttttcaattttaaagatggtcatcagcagcaccgaactttttgaagccattccgctgcagaaccactaaagttttgacagcgaacgaatgtaaaaaatccgctgattcccgacgattgcaacggacggtttgaactgcgcgggtgggcagggttcagttgggtcaaaaaatgatgggtctgatttaaaaatacataaattattgngaaaaaatgagtaatttgggaccggaatttttgaaaacaaaaccgggcataagaaatgccaaaaagttgggatcggcactttgatttcaaacaa

SEQ ID NO: 9682 - DNA, 1708 bp, Heterodera glycines
gtattaccggcttaggcgccggctttgagattaattttaggatgatgtaattaattctgaatacttcataacctttctgaaatattaaagaggtgttgatgaacctctttaattgagcctatatattgtgatttacaacagtatttcctctccttttttcttaattaagctgacaaatgttttcaattgttggaaaaaaggtcttcaacactacctcgtgcaattttctttcgaaggcattttacgctcatatgagcaaagatgaaataatgtggcattggcctgcgcagagtaaattttgttgtttttttcaattttgaatgtttgtctaaatgttacaaattctcagaatttgaccaacatttcatcgattacttgaacaagccggacattgacgggtgggaaatccgaaaaggtacaaaaccaattttgaataaattacacattttattgtacgctgattccttcttgcataatcgaataaggtcttcatcctaacttttccttttttagctctcactgaactcgggaactttgacgtggtgccagaccccaaagttgttgaagcagcgctcagagctattcgccgtgtcaatgactttgcgcttgccatccgttttctggagcagattaaatacaaatgtggtggacccaaaagccgatccattgtgtatccgtatatcattcaagaggtaatttgtgacgggcattaccgcccggtatagaacgggatcccgcgcggtttgtgggatcgggatcccattccgcattttttggaaaatgtgggattagtctcagcggtatgccattctgcaaaattttgagttccaatcccgagcgggattcgcggtttttagttcagattgcattgcatttaaaaaaaggacattgacaaatatttttctgaataaactttgaataaatccaattacaagatttctgtaaaatttcccggcggtgccttcggctcgccgaatcagcctaacggacggcgtttaccggcactgcaggactatttatttttttttgaaaaagcgtgccgcaaaaaacaacataaaatcgtcaaattttatgagttaatcccattaacaaactcacgacttctctccaaccctcggagcccttaggaaaatctaggtctattttctacacgaaaagtgattttattttttaacaattaacttgtccgaaaaataattaatcgaaacgactcattgtcaggtcaaaccggtgatggatgagttgggcattccgacgctcgaggaacttggctacgacgagcccgaattcttcactcccgaccccgagtggtactgggagaagtcctggtaactttcccgttcatatttaaacgatgaagccgaaaaaaataataggtacaagctttacgggttcgacaaactgcctggatacaaacacttggcctgaactgtttggccggagatggcgtgtgcatagaataggaaagaaattgttggacgactctttggatggatatgttcataatcaaacgtaaaatgtttaatttgttaggataaattgaactgaatgccattttgtctcccgctttacacttttattgtcttaatgcaacaattcgcttgtattttaaatttatttggtaattcaatcgatgggagtgtccgtgctcttccttcccttctttcgcatgtccgtccatttttcattgttggtgcggattgatcgg

SEQ ID NO: 9683 - DNA, 4465 bp, Heterodera glycines
tgttgttgttgttgcagcagttttcgagcgttgcggcggggcctttggctcgactgtttgtgttttgttttgttacagtagtagtcagtgactacagtagtcactgaccgtttttcccatgttaaatcacggggaaagttcgtttgggtaaacaaagaagaggtggcgtactgtaataccaacgtcatttcgactctttggttcccaaattttgcgccacaatccatcgtcagagcgcctgcgcccaccccaaaatccgacgccttttggcccatattttcgcgcatggcattttgtgcagtacaattccgcctcgtggggcgctacgttggtggattccaaaagtttgttacacaattctggaagtcaattcatgaaaacggacaaagggagcctaacaaaagcaatgtgaagagagacggaagcccaaattaaaaaataataaaacagaaacacagatgggcattaaaaactcaccgcacttgaagcagaatttgtgccagtcatctgtaaaggaaatgcgattcgatcgaattatttatgcattattattccggtaatttgaactgacatccgccagcaaccattttttccgctgcataaaccgatttcccacattttgggcactttgattggactggcggtacgaagccgggcattttgtgaagctaatgatcttatcttagagaatgactaaagaaagggagaaggaaacgaaatgttcgatcgacgacaaagctcctataatttgatattcccaaaggaaaggggcaaaagcgcattgaacggaaggctaacggacggagaattttagtgaatggagggagagagagagagaagcacttcctgcagctgctgccgttgatcattctctgtgagggcgacaggcgcacgctaaataggagggaaaagggaggggacaagcgaaggaggagggagaaaacaacggggagacagacaaagaaagcgaagcaaaacgcatttctcaaggatcgctgagagtggcgggtggacaaacgctttgtgggattccctttccctctgtcccttcatttattcatcatcgacttcttccactcaaagaaacggatggatcgactggggtggggtggaccgataagttgagatttcaaaccgccgaagggacaaacagaaggaggaggcgatgacaaatgggcggaccagttgggctactgctgaacgcccaaccaatggcagagatcctttgtgtttggatttggggctttggagtatccgtccggtccgatagggacaaacacaagtgatgaggaggggggaggggtaaaggagagatcaaagcgaccgcaaacacaaatcatttttgttttcgaaaaatcaaattttaacactaatattaaattgattagaaaagaaataaaatggtaaaacttataaaattaatgaggtaattaataaattttcacaaataattataatttaaaaagaacgggaccattagcctttgcccatagcacaacatcgccatcattttcattaacgtaaaaattcattcatcgacttttcattcccaggaatgctttgcagcattagtcattcactccgattacgatcgcattcaaccgtcagtcttttccttcaccgtttttatttataaaaatgacattttctaacgttcgtttgtttgtccactttgtacctttgaacacatacctctctaaatattcatacttttctcattttacattctttgaaaagctttttgcaagtgttttggatttgcctatttttaaaaaattatttttaaaggcaaatcactttttattgtctctgttattcaatggctgcgcgaaagactgttgcacgccgtgcccgaccgcaacgggcgaccagcaatgttttcgccatgttcgaccagccacaaattcaggtggtgaataaaaaaacagtttatcggtaaataaattgaataattttgtgaaaaatttcctttattaacaaaaagacttgttaaggagttcaaagaggcgttcaacatgatcgaccaaaaccacgacggatttatcgatgagcacgacctgaaggacatgttcgcttctcttgggaaggaagtctcggaaaagttcattgaaaatatggtcaacgatgcatcgggttctatcaatttcacaatgtttttaacgctttttggggagaaattgactggcactgaccctgaagaggtgaggcaagcaaagtatgggaaagaaagttttaatttttgccgtttttatgtgcacaattttaagggatttaacaaaaatttataataatgggtcaaatccagaggggatggattgaaaattgagccattttgaatacccttaaaaatttaggtgatcaaaaacgcattccaatgttttgatgaggacaacagcggaacaattgcagagggttggacttaaggatttgattttactaaccgaaagcaccatcagatcgcttgagagagcttctcaccacaatgggagaccgatacactgaggaacaggtcatcatttcattatccatttcggggactattgccaaaacttaatttctatatgagtattatctttatttgtgacgacattaaggttgatgaactgtttcgtgatgcgccaatcaaaaatggccgctttgactacgtggaattcacgcgaatgctcaaacacgggacgaaggaaaaggacgaggaagaaaagtcgtgaaatggaaaagagagatggtgatgtgctttattattccaattgcttaaatacaaatgtcttttttgtaattttatggggtcctgaaaaaaacaatggcggtgctggtggaatgggtacattttttgctgggtcactttgcttttttgcttggcactcagtcggagttgttgtaccagtttgtttgatagataattcgtcattttgttcgatgtttctcaggagggatgtgagtccgaatcgttcgagaagtggagcgcttgaaccacaattttggatgggtcggtcggactgtttgtatccgcaacgtcggtagaagtcgattttatccgttgtcgaacaacaaatctgtcgtttggatatcggagttggggtttttactgtcattctgctgtcaaaccttgtcgaaaccgtgcttcctgaagtgaatgaaacatttaatttggcacggtgggttttacgcgtcccatttttttttgaaattggtgatgcgtaaatccgaacaaatctttccattatctgatttaacctggcttccgtctccaccatctccatcattttgcgtccaattccttgtcctcttattcccttgcggatcaccaccgattcaatccaacactctctggcgcttcccatgcccaacggactgagtcggagatgtcccaccaattcaccggaaccattctcaataaaaacataagccattggtggcgaagtacacaacaatctcttgagcccaactattcgcgctttttgacttcgaggccattcctacaattgtgaccgaaaaaaagccaaaatgagaattccatcacaaagggaattaacctcattaaggagatcgatgcactgatcgatgagttcaggcttatgagctaacgggaccaatgaaaagtccatcgcttgccagtttaagtcaaaatagtcaatatttatcttgaattgatttgaaaatgtatttcggtttaaacaatttggcaaaaacgagaacgatgaactgcaccttgaataaatggggaaaatgaatggactggcactaagttgatgaggtgggcacattccctaagagaaaacaagacaaaaacgaagggccaaaattcgcacgagaaaatagaaaattgatcaggtagataaatctgcaagttcattgggtggggtgaagaggaacattgaaaagaggagattcgaatggatgcgaagggaggagcatagcacaaaatgacatgtgttgaggatgatcaagttgattaggcatgagtgatcgatcggtgatccacttgctaaaaccgtccacccccatttgcagatgcattggatgtgcctccgttatttccctgctgttgttgctgctgagaaagatgctggttgtactgctccaacaaatagtgtgaaggatacattccaagaggattaacctgacagaaagggggaggtaattaaactaattaagctgtgttgaatattgaactcacagggttctcggttatgctggggaaggcaggctggcaaagtgaggtgtagtagaggtccaacatttgaccaggcgtggtccgagtagcagcactaactggcgtggtacccgactgagacattcctccgagcaaagaaacggaggaattagcgacacgctgaggtaacgaatgggattggaggaacgcttgcggaaaggtcgaagccgagccaagcaacggattttggatgggcgaattagaagagatgaaaggtggttggtcacagaacgcactccctgaaggacctga

SEQ ID NO: 9684 - DNA, 1910 bp, Heterodera glycines
gggagcatccaacacggaatgttctcctgtgcccattgtcaattattagaacactttcaaacaaacaaagtcacctttaaggcgaacagtcttgtctcctctttggaagtgatcatctgttgtcaatttgtgcttttatccgtcccaattaccataatccccgcccttcgttattaccgtaatgtgcttcttctggaaatggttggccaaccgttccatcaccgcttcccttcccatccgcgccgtacagtaaactaaactgccaaaatcagtgattaacaaatgtgccgtcccaccgttttctgccggcacaaattcactcatccgacagagcatcagttggcccaatgccccagcgacgccaacagcgccggtggaggaccaaacgacgtttgcgcatcggttggggatgtgccgtgacctgtcaatggaggacaatggaactagcggagaggcaggcattttcacacaaatgcatgctaattaagcattgtgccgttccactgacctttccgacaccacgcgaaggcattggcggaaaagttcgattttggagaaaggtgattgcttaacaaaatgccgacaatcgcaatcgccacttgtatttccaattttatccctctctttacctcaaatccttccaaacgtcggaacatttccgactgaattccgaactgttgcaaccaaactgaatgtccaaatgccaattttacattaaatcatttaaaataaatgactaattatcgcaattaacgctaatcaccaaaccgaccttccattctctgtcccccgtaaagttcgtatgtgttcctaatcagtcggtactttgccgctaatttcctcagtccctcattgctgttgttattggacagcaccggacgtgccgtcaatgcagccggcgaattcgagcagttcgcctgcattggtgtgggtgcatccgacaatatttcctgcttcagctgctgatgcctttgcggtgacaattggaccccattttccgtccgcttcacttcttcccctccggctccgttcgaaaggccaaactcgcggggaattggccccgccccatttgccgcggcataattctgcgcattttgcaatgcctcgtccgaagcggcgtcctccacatttgtctgctcaaactcctcggggctttccagttggaacccatattggagcagttggttcagcatgaacgacatctgactttcccattcgttgcggcacggagcgttttggggaagaacggtgcaaaggtcctcctgaggaggaaaagcggatgaaaagcattggaagggggcgacgaaggaggcgacaaactgaccaattcccagacaaacaccagtgcctgaatgaatgttgccttgtaatttgacccctccttccccctctctcactgtgttgttcggctccgtcggactcactcgtgtccctccgctggcggctgcttgtgcctttttctttttggaccgctctaaagcaaaattttcctcgttgctttgtttcaatctgtgctcacttgatgccgttttgtgttctgatttggcacttttctttgtttggtgtgcccctttgcttcgggctgtgctttcggcaaatgccgtaggttttctttccaccgatggtattgccgacgaatactgctgcatgtaattggccgtgtttccgtttccggcaccgttcccgttgagtttggcgtcgtctcgacgatcacatgccgaagtgtccagctcagaactgggttggctgctgttatttcccgtttatgttcggctttttgatcccccactctaccgtaataaagcctgcccccgtcaggttactgtactgctgctgttgcggctgagttccccccaataagctgctgccattggaaaagaagacagttcggcttttttgatgtcaaatgt

SEQ ID NO: 9685 - DNA, 2902 bp, Heterodera glycines
ggggacctctagagtctgactctttttatatgacattttcccgcttttgtaccataccaaaaaaccccgagaaatcccgacttgtctcggccaactcaaatgagtgcctttatcatgttaatttatggtgattaatattttaattacaatctcttcttttggcataatattgcattttcatattagctcttctcggtttgggcttatttcacggtcttttcttctcaaaaacgcgtgtcaatctgtgcggttccgacactttataaacatttcaccgcaaatttcgcccaaaatttatgaaattttccatgcggcgccaatcgacaccgcaggctgattgataaaaactctcctcatcagaactattatttaaatagttcaaaaaaacaacaaactttttaaaaaaagccaaaaattctacgtcgaaggctgcttgtgcctttttctttttggaccgctctaaagcaaaattttcctcgttgctttgtttcaatctgtgctcacttgatgccgttttgtgttctgatttggcacttttctttgtttggtgtgcccctttgcttcgggctgtgctttcggcaaatgccgtaggttttctttccaccgatggtattgccgacgaatactgctgcatgtaattggccgtgtttccgtttccggcaccgttccgttggtttggcgtcgtctcgccgatcaatgccgaagtgtccagctcagaactggttggctgctgttatttcccgtttatgttcgctttttgatccccaactctaccgtaataaagcctgcccccgtcaggttactgtactgctgctgttgcggctgagttccgccacaataagctgctgccattggcaagtaggacagttcggcttttttgatgtcgaatgttgatgagagtgcggcagcagcgtaatgactcgccgcggggaaagaggcgccgtaatagccattggcaggcgaagagtaagcatctgtcaaggaatgagtggtacacggcattgctcatccggaagcgatcggaccactgatcactcccaccccaccgatgatttcttccgctcccccctccccccacgcattcccaatttttaagccgatttccgtacttcctccgccataagtgcccaaatagccgttcagtgtgtgtcccgccgctctttgcaatccatcgtaatattcgcaattgtttggtgaataccaagcggtccctgcgcccgtcacagaagaaggggccgaaacagccgcagctgcggccatttgtccataataagtttgggaaggagcgcagagagcgccaatttgggaggaggaatctgagaagaaaaggacggacaatcaaagccaaaagggatcagaggaaaggaaaatgccaataaagtggataatgaaagcaaagtttcggttttgcaactgaccggcacagagcacggccgatcggttcatcgccgccgccgccgcgagactccattcggcggcgcccactggccaacagtaataaggggaagtgttttgggggaaggacgaagaagaaacagtggcggaagaggaagcagatgaagcggaggaagaggaggaatggccgagggaagagagcatcgacggatggacaaaggaaacggatggaaatttggctaaatgattgggaagaacggcaggtcaatccgaggagcacgatgacgcacttcccggctcaaatttagtggcggtcatttgatttatgatggcatttcggtttttagtgggggccaacgattgacgctgagggtgagagacgaaaacactgccggagggatgggggacagattaatggggcaaaattgcaaaaaaaataaacaaattgcgcaagggggcggcaggggaataaactcccaaaagtttgggagggaccggaaaattcaaatgggcacacagcgggagggacagagaaaaattgtggatttccccgcggctaaactcaaaaagggcggattaatgggcacaaataaaagggaaacttaattgtttggacaaaattttggggacagaaattaccaacgaaaagggacagaacgaaaaataaataaaactaattttggcggtgatttacggcgaaaattgcaaaaatggaggaaagacgaaatttgggattgaagaagcagcggaaattgacgtaatgacaaaattggcctaaaatggaaaatttgagggagagaaagggaggggacaagcaaaacacaaaaaggcaatgagcagaaagagccgaaacggaaggaggggaggagaggaagcaggtggacagcaggacaaatgggaacagatgggagggaaagggggggaagcatttgggatggatcatccgtccttggggactgactctgaagaaggcattggcgaagaatgtgcgcggatggaagacaaatggaagaaaacggacaaagtagcgaaaaattgactgaagggtaaagcacacttaaccattcacttcctctttgtcttcttcagtttgttttactctttgttttgattgtgccaactcccaaaatgccattcttcgccattaaattccattcatttgtctttcattcatttcatctcaatttcgtctcctcctttctctttgccccgaggcggtcaaaaaatgcgcttttatgaaatacgatccgcccattgctcttcactgcagttcaaatgcttgctgatttctagctgctttatctgtgcttccgattatttggcttatccgtttcgcttttactctatcggtttcactaaaggacaaatccgctgagggaaacggtggagcgaagggagaagaagcggtaaatgctcgagagtcttgaggagatcagtggacgggcggaggggggggggagcccaatgaggaggggcggcaaaaccaattgaaatgccaaaatgaatt

SEQ ID NO: 9686 - DNA, 2201 bp, Heterodera glycines
  misc_feature (56)..(56): n is a, c, g, or t
cgccgctttctttctcaaaagtgtccggaaatgtacattacgtattgccgaggtgngcatgttggtaaaaatgttgctaccgtttaccacccattcttcccagctgtactccgaagaacagttcaagacgtacatgcacgaggcgggcgatgcgatccgcgactgtgcgttgggttgcgccgggtggcggttcaattacgacggtgtgtcaccgaacatggcaatgttgagcatcaacaacaacaacccgagtgatgagctgcagtccgcccgacaagtgagtggcgttaatggacttttccttcattgtcagaattatttttggcatttgtttttgtctttatccaaaatttttgccagccttttactcgcatgtgctcggcccgttcctcatttgcatccacaggttggaatcgctatttccagaaccgttccgcgcacggcactctgtcggccgagggcgccggtgcggcggaggcaattcaaagtttgaacgaacttggcaaagacgacgaggagcgggacgaattgggcaacaacaacggcaacagacagatgatggacggtggaggcggcggtggcttatcccaggaggaggacctcaacgaatttaagtcggtcgtttcgcatttaatttactttcaaaaccattcatttaatgtgctcttttcagtctttactattcaatggccgaggatggtgcccgtttggactacttccaattcgcctacgagggcgtgtccgagtcggacgagccggactcggtgacttgttcaaggcgtaattcccaagaaagcgaagaggaaaaaggttggaatggacgagttatggacacagtttaaataacaaattaatatttctcgggtttattattagaattttggtctctagagaatttgttattgaatttattttgaccctttcttaccttagaaaatgcgaaggcaaatcgcaaaaatggtggctcacaatcagttgccgttccgttacctctgtcttcgtcgccgcccacaatttcggctcgttctcacataatggacgcaatcgtcgccactgagtggagcaaaacggacggagtcagtcacttaggttcaagcgttcttcctcccgtaaaattaatttcgaaattccttttaatgggaaattttttaaaacgaaattccatgcactttacttttgggtctaccgtcaattccgtattcttttcctcaaccttatttttaagccatttcagcaatcattcttgctttgtttagagccgtgatcagttcattgaaatgcttaacgcattgcctttgccgtccaaccgagaacacgttgagaaagccgctgctgctgggcccggtcgttggagcccggtgccgaagagagcgcgcactgttgaggagaacatggcactgatcgaatctcgatggcaatatttggaggtatttaaaactgccgactaaaaaagggggcgggggtcaaccgaggataatgaattatgcgaggaaatctgaattttgaattcacaggaattacgattggaaagagaggaaacagccaaaaaggagggagaaaagggcgaagaagacggggacaatctcttccgattggacttaagcgaagtcgcggcaacagacgaaaatgggaacagcgaagaacaacaacgacagatggcggaagaacggatggacgacgaggagaacggcgtcagcggggacaatgacaaaaacgcaaataatactgacaacaataacaacaatgaggacggatttccgatggaatgcgtcgatggaatgggtaagggtcaggttataggcgtaaaatacaagaatttagaaaatatcgtaattttaaaacttatttgtgcgatacatattcttaaaccgaaggaggtgtatatcactcttttaatttgttattaagtgtctgtcttattccaattgaatattatttaatttttctctctctctctctttcttttcaggtgccggcgttctgctcgattctttgttcgaagcattgagtcgactcactgagcacacttttgccactaatttgcaactgatcggcgcgttcaacgaactgttcgcctactcccaaccgttgctgaccacctatttgttgtacgtcgacgcgctcaagtcgcggcccttgagccgaatcacaaaagtacaatattttggtcatttatttattttatcaattattgtacaatt

SEQ ID NO: 9687 - DNA, 1012 bp, Heterodera glycines
tgccgccattttatcgcaatttgccttttgttttttatttatttgtttttcctttacaatttttttccccttgaattttaagttttatattctcacaaattcgacgagcccctttttctcttcagctctttttggcactgaaatatgcgagcgaaggtatttttggccatttcccctgctgctgttgggttgtaggggcgagcccagcgggactggccgagttgggacgcaatgcgataaaatccatccgtatttggaaataaattccggattaatcccacgcaaaatccctgcaatttcagtggcgtaagaagcgaatgcgtcggctaaagcgcaagcggagacaggcgaagaaatgagcggacggacggagagaaaactcagccgaacgcggaaacggaggcacaaaatgttgttgctgtttttttgttattgttgtcaaccgcccctttactcagataaaatttgttgcaaatttgttttttggttttatcttcgtatttttatggttttttaaaccaattactgattttttccaaccattgaatttccaaattgcagcgatttttcttttccccctcgtccttcttactctttatctctttgctttttactgtctgtctgcctttctctttcccttctgcttttagaaaacgattagttttatcattaagcaaccaaccacaccatacttaactaagaaaaaaaaactcgtctaacatggaaatgaacccaaccagaaacaaaaccaacactttcatttgctcttttctaagtttacgcgtccaatcagtgaccttcctcagtttttaggccatgactttttcttactttgtaaagcttaaacattcttcgtattgaagcacagcgttccaaacgaaattcagctttttcgagtatattcagaaattctgttactttagtccaacatttagttattaaaaaaatttgtccatagaccaagcttttgtttgataccaacaaaataagactgaccaaattaagaaaatgg

SEQ ID NO: 9688 - DNA, 777 bp, Heterodera glycines
  misc_feature (751)..(751): n is a, c, g, or t
tttccatatagcgccgaaaaattcatagtctaagaaactaattgtaagtgtgtcattgatttgacgcgtgcctttgtattttccatatattataatgcctaattttgatttcttaagcgcttttttaaatccgcggaagctctttttcaacaaaaattttctgaaatattcaactccttttgttctcacgactccgacgaggccttttttcagcagttttctggcagtgaaaaatgcgtgcgaaggtattgaatttttgataaatgtatgggttttttttcgtatacttgaatgattaattgcataaataggaatttcaaaattttaattgttcgaatccgatttcggggtctgatatagggctaaataatgtcaccttcgggttctcctggtcatcccggaaaataatttaaaatatttttagtatctatttcagcaacccctaaatcaacccctgttttcatcatattcaaatatcaattgattccaaaaatccatgctcattgtcagatcatctgaccaaagcatcttttaggccagattcaacgtaattaaactgagtctttccgtaaaccataaaaaatacacagagtttatttatttattagtccatttttgacgcctttgtaccgcccctttactcagataaaatttgttgcaaatttgttttttggttttatcttcgtctttttatggtttttttctccgtttcctggttttttccttcccttgcgtttcctctttgcggcgntttttcttttccccctcgtccttctt

SEQ ID NO: 9689 - DNA, 5558 bp, Heterodera glycines
atatatggacatgatttaattaaattcaattaaataatataaattaattataacatcatttaatgagtaattaagtaataaatcagtaaaacataatcaagaattaactcttaaaagtgataaacaaattaaaataattacatttaaaaaaaataaaaaggcaaaaattaatattttaaagcaaagcatttaaaaataaattttaattcgtaaatatagctaaaaatcttagaataaattatcatgagacaagaattaaatagaaatgaaatttccaatattctcctcattatcagataaatgaacaatacttaaaatttgattatttttaaagattaaaaaattaaaaacacaaaaactttaatttacatttaataatattcaatgaccaatttattagttacattgatttaaacaaattaatattttttgttaaatgtaaatgttataaaattattttaattaatttttttttatatattaaaaacgaataatataaaattaaacatattaaaagggaggaaattagtaaaaacaaagcgaattaattaaaatattatattatttcactagaaaaatttaaattaagatgtaattttcaaataaaatttaaaaaagaaaatcattcgaaaggaaaataatatagccaaaaataaattatgttttttttcaaaaattttacttaatttagtgtatcgatgaagacccacaaaatttgtttaaaaggtaataatcacaaatttttgaatatttgacacaaatggggggggggcagcaggaggctcgaaaaagaaatcagactgttctaaaagtgtatttataatacaaaaaataataaaatttttaaaccccattgtaatatttcaaaaaaataacaaacaatttttgaaaatatctattcagataaaaaatattataaattaaaaaaactaaactaaatattttcgttatgtgaattatttgtaaaaatttgtcatttgataatatctttaattctaaatcattagtataggtgataagtagatgccggattttaggcatgacttttttaaatatgctcttaaaatggacacgaaaaaagtgaaaaaggcataaaaaaaagacagcaaaaaagaattattatttttttactattgtaaggtagatccggggttttcctgtttgcctgccgaagccctaggaatttcactcacatttcattttctttgcatttcatttgccgtttattgtaccacccctttccccgaccaatcattgatcggtcatatttcgctttcacatgtatttaatgttcaccatttacgctattatcaattcagttgctcagtcccgagaataaagccactttcccattaagtgtgaccatcagagtgggatgggatccctaggcttgatcaccccatggggcccttccttcgggagttatatgagtttctccccattattccccatttggcctcccaaattgcccaagtcccaacgccagcacgtccaccgcgcacggccgcgctactctataaaagatttacaaaagaaaccgaatacaatttttgaaaattaaaatatttaaaaaggagagatgatataaatggaaactgagcacttttagttatgaagctataataaacctaaaaagcctaaaaaaattaatttaaaaaaatcttcggataagccgatgtactgtcccgcttaatcgccaattaacctagccccgagatagacattttgataacaaatatctgtacacagattgctacatcaactccatcctccaaacgaatagcaaagttgagcgggtcgtcgatacgttcaaaagggccctgaagaaatgcgccaaagatggtaaattttgggcataaaagatgcttctctcctacaggaaaactccgaattcggtactcaacggactttcgccagatcaattgttcttcggtcgaagactccgcacacagttgtctcttgtccacccaaaggaagaacaagccaaaatcatcgacccagccaaaagccgtaaatcacaagctgattatgcgcgaaaaatggctcgtcaatttgatcaacaccactgagcaaaatcggttgagtttttgccaaaggattcagttcttcttttgaacttcaatcgtggaaaaatattttggcttaatggaacgataattgaagattggaaaaatccccgacgtatcgcgtccacgttccgggcactcggacgagccgtctaacggcacgcaaaccaactgcgacgccgttatcctctcgaagaggccggtacggtaaggatcgcaccccaggctcaagaagagcacgaaaataaatcataataagcgaatgtgaatgctaaaagctttcgtattaacaaatattattattattataattgaaaaaaatatattcagatttattcggtgtaattaaataatgaaggctaacaaaaatatattaaaagtcaaactcacagtctttggaatattgacacaaaggcgcaagaggctcgaaaaaggattatttgactaatttatgaggatatttataataaaattttaaatttttgaactattgaatattgtaacatttctataaaagataaatattatgaaaatatacatataaaaatttatcataagtttataaaggaaaagatttgtttgcccgcaacaaagagcatgaactcagaatgaattaaaacgacaagagaaaataaaataatcattttaatccaaattcaactaaaataagtgataataatcaaatgaaattaaatggtaattcaaatttaaatattcacaaaataatacttaactaacatattaatgactagggttcaaagttgtataattttgcatatttttttctgcgcatatgctatgaagaaaggggctcaaaaatagcatttctatgttaaaattttttgatttgctgaaggtttttagtgcatataaaagcttttgggggttttcaagaataaatgcatattttgcatcttttaggccatattttagtgattttttggaattttcacaaaaaaatgagcgaaaaataacccataaggattgacttttttggaatttttaaaatatacacccttaaaaatcgaaaattttttagcttttttgtaagaactttgtgaaaaaaatttatttatataaaaaatataattttgttttagcatataataaaaattttaaaatttggaaattcaaaatttttgcaattgtctataaagtgctctttagcccttgttttagtgtttttaatgtcaattattaatttttacacaattttttgagagttaaaagctatttttagcaattttaaggcatattttagtgcatattttggtatttttcggttattagtgcatattttatgcgcatatttggcatttttagtgcatacaacttcgaaccctattaataaccgtcgcaaacacaaattcttatgacgatacaaaaataaaagcaacaataaacattttgctttagaaaaaataatttcaataaaattatggcggctcgaaaaactgataattaaatttattggtaaatttaattttaaccatgataatgaataattttaatttgaaatgacagaagaatttattaaacggctttgatatttttaaagtcaactttaaaaaatatattagttattgtaaacacatcaagtaatataaaaaaattaataatgattaattgcgagccaaaaaaacaattttgaatttaaatagtaaaaaatattctgtaataataatttataacagcttgccaaatatctcatcctaaaaacaaaatcattcattataagctcattaatgcaaatttggcctagaaattttaatgatatatgataaaaaattagggttagacgggtccgggtatttgggcaaaaaccgggtccgggattgccgggtattgaaaagccgggtaccacgtcgggtaccagttttcagagcgggtccgggcctgggtacccggtaaaaccgggtattaagaaataaaaaataaatcaattttttgaaaaaattttttcattaaaatgaaagtttatgatttttaaaaagcatgaaaaatataatgttttacaaataacgctttattaattgcccaattttttgttgttatttaaacctttttgcggtgattttccaaaaaactttcgtggccaggggcagtgcggtggtgccgatcagggaaggcacggaattccgatttccgacatttttggggtcggaattccgatttccgaaaaaattttggacgtcagaattccgatttccgaaatttttgatgaaaaagcggaaattttttttgaatttttttcaaaaaattaacaattttttacaacttttgttaataaattgcactgaaattttcaaaaatttcccggcggcgcctatcggcaccgccggaccctaaaaatcttatttttcttgagaaatttttgcctcaaatcgctaaatttggtcattttttggacaaaatttgttaagaatttgcattaaaattataaaaattttccccggcggcgcctatcggcaccgccggacctcccccgccatggtttaaaaatttttgaaaaatgcgatgcaaaaaaaggtaaaatttttgatgaaaatcattgaataattttttaaagcaaatatgcttttaaatagatcaaaaaatttttgagtcaccttttacttggttaagaatttaaaatttagcctagtaaaatatttagaaaatttttattatgttttttgaaaaatttccgacttccgatgtttttggggtcggaattccgatttccgacttccgaaaaatttttgggcctcggaattccgatttccgaaaaattttggacccccggaatgcattcctgatttccgaaaatttttgggacctcggaatgccatccctgatgaccatgatataccaaaatttctataattcatcaattctttaaaaataatttttaagaaacaaaataaaaaatctaaatttatgtgtaacaatttttgtatttgcctttttttgccccaaaaatattactcattacataaccttttccatctgatatttaaattttatggtgctctgcacaaatgaataaattgatgtatgaccttttgggtgcctccttttatgcgttggcattcataaaacccattattataaatggccttttggctgtgcatttccattcattttatctcgaaacgttcacaatcattttcataaagtattcaaaaatggcactgtattttctgatgttcccaattattttttctgtggcattaattgccgttccaacaactgaaaataaattaatccccgtcgatttaattaaaggttaataaaaaataatttttttttgtgtgtagtaagatttttcaatgtaagtaagggtcatcacagctaagctctgggatagaagcggtgcctaaggggccgcgggaaatttttttatgaattcatttaacactttttagtagattctgactaaaaattttttgaaaataaatagaaaaatgcaaaaattagggtaattgattaagatatattttaacattttta

SEQ ID NO: 9690 - DNA, 3162 bp, Heterodera glycines
tgctcaggccaccattctcacactcaaaacgtggcaaaaagctgaggttctccaaaattggacaaacccgacatcgaaacacggaactgcaatgaagtgccgttcaacatcgaagggaaatttgtttgcgacgtttgccagagagaattagttagtggttataatattgagtttagtagtttattttttattttttttttctttcagaatattctattctttttttttatattttttttttgtcttttttttagtttttttttaattccattttttttattgattatttttattcgtagtttttttccacggttacgtttagattttttaatgatatttttttgattttttcaatcaagcacccaaaaagctggtggcatacgtcagctccgaaatcaactacgatcttttcggactgccttggattgaggctttggacgtcatcccacatgaaatcatgtaccccgacatccgaccaaaagctaaaccagccccagcagaaatcaacgccatggccattcctcagccaacgcacaaaatttcggatttggaatcgctcacaaaggccctccaaactgatttttctgaagtttttggccccggattaggccattgcaccaaagcaaaggcccatttgatactcaaatccgatgctcacccaacattctgcaaagcacgccccgtcccacacggcgccctcaatgccgtcaacgaagagttggaccggcttttgcagattggagccatcaaaccgattgagttcagccattgggcagcaccgattttggccgtaatgaaaaagaatggaaagacccgagtttgcatcgacttttccaccggcctcaacaattcgctcgagttgaatagacaccctttgcctcggcctgaagacatttacactgccatcagcggctccgtctatttctccaatctcgacctccgagacgcgtatttgcagatggaattggatgaggaatccaaacacctttgtggaataaacacccaccgtggcctcttccaatgccagcgcctcccatttggcgtcaaatctgcgccgtctattttccaacatttgatggaccaaatcgtctcaggcattccaggtgcgtttgcctacctcgacgacggcataatcgcctccaaaacgcttgaagagcacattttttccctttacaaacttcaaacgaatccaggaatttggccttaaaatccaattagaaaaatgcaaattcctccagcccgaattgctatttctcggccatgtcatctctgcgaaaggaattcgccccgaccccggacgatcagaagcaattcgccaaatgccgccaccacatgacttgagcacacttcgctcattcctaggcgcattgaattattatggaaggtttattaagtccatgcgcgaaatccgcgaaccactggaccaacttctccgaaaagacgtgaaatgggaatggaccgacgaacagcaaaacgccttccaaaaggccaaagaaatcatgctgtcggatctactgctcacccatttcgacccgtctcttccaatcgtcgtagctgctgacgcatcaaaagacggaattggcgccacaatcagtcatatttttacggacaaatcggaaaaagtcattgaacacgcgtcatgcacactcaacgacgcacagaagaactatagccaaatcaaaaaggaagcattggccctcgtttttgcggtccagaaattccaccgaatgttatttggtaggaaattcacgcttctcacggaccacaagccattgctggctatatttggctccaaaaagggaataccgatttatgcagcaagtcgtcttcaacgatgggcactgatcatgtccaattacgaattcaacataaagtacatcaacacgtcatcctttggacaagccgatgtactgtcccgcataatcgccaattatccccggcccgaagaagacattttgatagcaaatatctgcacagagacagattgctacatcaaaacaatcctccaaactgcaactgatcaattgccgatcacgaaagcagaaatttcagaatggacaccaaaagacgatgttctccgaaaaatttctgatcacaccaaaaacggctggccacaaaagtgcaccgaccccgatctgtcaccgtactttcctaagcgaaaggaaattttggagatcgacggatgcttgctctacggaaagcgagtgatcgttccgaccaaacttcgtgaacgcatcatcaaggctctacacatggcacaccccggaattgtgcgcatgaaagccctcgcccgtcagcacgtgtactggccaggattggacttggaaatcgagcgtatggtcaggcaatgcgaagattgccagagcgcccaaaagagtccacccaaagcaccgctcgctccatggacgtcttgctcacgaccattccaacgcattcacattgatttcgccggtccctgttcagatggccactcctatttgattttgatcgactcattttcaaaatggccggaagtatacagaatggaccgaatttcgacaccagcaacgctccaagtcctccgatcaattgtctaccgactcggatttccagaagaaatcgtgtcagacaatggcactcaattccatgccgcagaatttgaggaattttgcagcgagtttggcatcaagcataccttcaccccgccgtatcacccgcaatccaatggccaagcggagagattcgttgatacgttcaaaagggccatgaagaaatgcgccaaagatggaaaattttgggcagaaaagatgcttctcgcctacaggacaaccccgaattcggcactcaacggactttcgcccgatcaattgttcttcggtcgaaggcttcgaactcagctgtctctcctccatccgaaggaagaacaagccgaagtcatcgacccagccaaaatccgcaaatcacaagctgattatgcgcgaaaaatggcccgtcaatttgatcaacaccacggatcaaaatcggttgagtttttgacaaaagatcccgttttgcttttgaatttcaaccgtggaaagagattttggcttaatggaacgatcatcaaaagattggaaaagtccccgacgtatcgcgtccacgttacggcactcggaagagccgtccatcggcacacaaaccaat

SEQ ID NO: 9691 - DNA, 2804 bp, Heterodera glycines
  misc_feature (1348)..(1348): n is a, c, g, or t
  misc_feature (1428)..(1428): n is a, c, g, or t
  misc_feature (2781)..(2781): n is a, c, g, or t
aatcgccgagccgatcccaaggcctttctctgatatcttagatgtctgacaaccacctaacgatcattttcaatcttatcaaatcgctaatcatttctttgttcccctaaatttctccctctccgggctcttcatttacgcaacgaacagcaagcacctcctgttgtgaatcgatgcgaaagttgcaatggttggagtcgcgcatgtgctttcgcagtgcgtcaagcgaacggaaacgggcgcattggcaacggacgcaggttaggccgaccccgactttgaagccttgaaatgtaattcgaaaaagaaattggaaaagcaaagtgccacacccaaataagtgagcaacccgggcacatccgtgcagaatggcgagtccgggaccagaaaaccgtgctgcttcctcatgtgcgccaaatttgcctcccaagtgtcggatttgagttcacagaaaaggcattcgtttggcgggatgccgtcctgccaacgaaaatggataataaacattttccatcgaatttgcaattcgtcataaaattttgaaattcgcgagaattaaaagttctaaccttcaaaaaatgattgagttcatatttaattattcattcgatttcatcccatgggcatgcaattacccacttcttttttggcaaaactgttgtcttctttctgctccgcttcttcatcgtcatcattatcactttcgattggcaaaaccgcttcttcttcaccatcaatgttttgtgccacaatctttggcaattttgcttccatgccgccattttctcgcccctccgtttggcactcattagcctcaattgtcgctgtcgtcttctgctgctgttgcagttgttcttcctctttgtgccgacgcgactgcaaatggttgtcaaaggcgttgcgcgaccgaaagcgtttgttgcggcacacagtgcaaaccaaagaagacggagaagaagacgacaaattggaggaggacaatgggggaagagaagaagcaacagcagaggcaccgaggggaagagatgaagcagcagcagaaacagagagggaggacagacgacgatggtcagcatcgaaagcattcttctgtattaaaagagagaagtgagaacgaggagagagaaggcagttagagcaaagagagaaaatagagggagagagagagaaggggagaaaaagaggaaaaaagaaagagggagatatagtgagaaaggagagagagagagatagagacggatagagaaacgagaccgacagagggacgaagagagaagactgagagagaatagagatagatagagaaagagagggggagagcgagatagaggggaagaagatgtgaggnaagagagagaagaagagaagtcggagcaaaaacaaaaaagaaggagaaagtgcaacggaagaaaaatgtaaggagaatangaagaagaaggggaaagagatggaggaagaaaaaagggggagaaagaaggaaaaaggaaagagggagaataatgaagaaggaaagaaaaagagatagataaaaaagaaaggtggagaaaaaaaatagaaggggaaaaaatgaaaaatgaaaagaaaaaaagaaaatggagaaaggaaaaaagaaaaaagtataaaaaaaaaaaaaggggggaaaagcgaaaaataaaagggggaaaaaaaaatgggagggaaaaaaaaaaaaaagaaaaaaagaggggggggggggggggggggggggggggggggggggcgcgccgaacaaaaaaaaaaaaaaaaaaaatttttttttttttttgatggggtggggggggtggggggggtgcgccacacaaaccaaatggggggggggggagaacaaaataatcccccccccgcgaaaataaaaaataagcggcgggtgtttgtgggagggagatttttttttcccggggggggggtgtttttttttcccccaaaaaaaatttgggggggcccccgttggtgtggggggggggcgtcccccccacaaaaaaaaaaaaaaaaaatagtttttttttttaaaagggtggcgccggtgggggggggggctccccaacccctttttgggggggggggggaaaaaattcccccccccgagatattttaaatttcccggttttttgggggagattttttttcccgaaggggtttgggtttccccccaaaaatttgggggggccattgggtttgggggggggtttcccccaaaaaacaaaaaaaattggttttttttcaagggtcccctttgggggggttcccaaacctttttggggggggcaaaaattcccaccccggaatttaaagtcccaggtttttggggaaagtatttcccgaaaggtttcggtttcccccataaatttgggggcattggttccagggggactcccccggaaaccccaaaaaaaaattttttggataaaaattatttaaatgaactgactagataatatttaaaatagggtatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacaaaggactcagattttcgaaaaattttttgagccagctagcaaaaggggctccatttcagtgntaagttagtcctttaccggggag

SEQ ID NO: 9692 - DNA, 2435 bp, Heterodera glycines
tttggaaaatgttggtttttatttttttttttatatcctaaaaacccccaacagacacagcgggctcggaccccagggttttttgttttgtgatcgggatttaatccttcggaattggtgttccgacggaaaaaagagataaaattttctttgaactttttctagggtaaaaatgctctgatcaagaatccgagctcggattttgcaaaatcattgattttgtctaagatatttcatcaaatacttgattttctttgaaaacttgttgtctaaaattttgttggcggtaagtcccatattcaaaatgatttagaatgcataaatagctttagaatgagccattttaagtgtacggaaagccaaaattttagaaaacaaaaattttcaaaaaaatcaaatatgtacttgaaaatcaatgatttttcaaaatctaagctcggattcgttatcagtgctgttttttaccttaaaaaaactgattttgtagtaaatattttttttcggtcgggacaccaattccgaaggattaccgggattttgaaagtaccgggcaattttttgcacgctctcaatcagtattgggtggatcaccaatccaaaaattggcccacctgccgcttcatgttgtacaggtgccattcactgcggtaatggtcccgctgcaattgcccgctggagaacaccaatttgcacgccaaacaggtccagcccgtggtgtggtccaagcgcggtgccgtcggcgtttctgtcgtcgtcatggtagcggtcgattgcctaattttttgttgatttgccagtaaatttgccaaaaaaaagagtcaataaacagcgattaaaatttgcaaaaaaaaatattaaaaaatgtacaaaaattgattcgtatgtatcggtacactccaaaaccaaaatagttgaaaaaacagtagaaaaaagcgtagacacacacagaatttattgtgaaacacgaggaaataacagagtgattcattttttgaattccaacgcgttcatctgctggtgaagttgttaatccatccatccatggctctcctcatcgacttgccgaatgccttcgcttccgcactttgatcgaagtggtccccccaatcccaacataatcattttccacttttatcgaattcatcccattcaaaacatcatcatgttccatctttatgttgttgctgttgatgagaatgttgttgttgttgagccgctgatgatgctgctgttgttgtgggaccaactgttgaggggtgacactggaaaaaagaaatgatttaaattggaaatttcaatttaaataattaatacacgattatttttaagttcgaaatgtcggattctttcaagaaagcaccaccgaccaacgaacaaacaattattgtaactcaaaattgttagtttacggcccaaaatttggaaaaagtgccgcccccccccccctccaccaactcactctttgtgcagtggcatctttttgccatggaaaatggtcatcgacggagaaatttcgaagcacttttcaaacgccaggtgtttctcaatgtgattgttgaccctttaggaaaaagataaagaattataaaaagcaagccattgcaaatcgagctgaaaatgaaaaaaaaattttttttttaatttccaaacaaatctttggaaaatccaaatttttcccagcgatagcgaaatttttacttataaataagccgcacaattccataaagtattaaaacagaaattttcagggacgaaaatttggggggggggggggatcgatccctttgcaaacattttggtcgactccccatgtcccaagaaaaatcgaatgtttgacatattaaaaaaaataaaaattgaaatttgtacctgcccgcgtcgttgcccaactcctccagaaactccaactttcgcattgagaattggaagcgttcctccgcgctcagatccttcgagtcgatggccatgtcaaatgcactgacaatttcactgtcccgcgaatgggacgaactgtaggccaagtcgaccagtgccaagtacagctgcacattgtcctggcaagtcaatgaatgcaaaaaatacattaaaaaaacattggtccgatcgccaattgttcggcacccgggggatttaaaccaaaaaatcggccaatttttggaaggttttcgagtaaaatttaatgagcgctgagcagccgacgccaattttgtaaatgctcgtacaatttttagtgttaggaaaaatttcagggcattcaacttttgtgatttctcaaaaatttaccgaacttaaaaattggacggaatcacaaattttctcaaacaaaaaagccaaaaaaaagatctatgtttattttaaaatacatacaaaaaatttaaatttcttgtggaattcaaaaaggcaaccttttgcaaaaaaaaattgcatttttttaa

SEQ ID NO: 9693 - DNA, 1815 bp, Heterodera glycines
  misc_feature (24)..(25): n is a, c, g, or t
  misc_feature (95)..(95): n is a, c, g, or t
aagtacagctgcacattgtctgcnnaaggcaatgaatgcaaaaaatacatttaaaaaaacattggtccgatcgccaattggtcggcacccggggnaaattaaccaaaaaaattccgccaattttggggctttttcagtgaactttaataagcgctggaaagccgacgacaacttttgtaaatgctcgtaaaatttttagtgttaagaaaaatttcagggcattcaacttttgtgatttctcaaaaatgtaccgaacttaaaaattggacggaatcgcaaattttctcaaacaaaaaagccaaaaaaaattgatgtttatgttaaaatacatataaaaaatttaaatttcttatagaattcaataaggcaacattttgcaaaaaaattgcatttttttaaatcgaagaactccactctaatattgttctgtatagtgttcacccaactcactttgtccttggaaattgcctccttcaacacctttttggccaacttccgatcatggcgaaatcgggtgtggaaacgggccaatttcagcgcccaaaatgaagcaattttgcgcgatgtgccggccgcctcttggattagccgctcgtacttggccaccagtgcggaatagtcgggactccttttttggggaagaaaaattataaaatttgaaaatgtcataaaaaatggcaaaaaccaattcaaaggaaatgcccggaaagtaagtcggtggtcaagaaaaaatggaaaattttcaagcgttttttccacaacatttgttttatgctgaactagttttttttaaacccaaaaatcgatgaaatttttttccattttttgggccctggttcaattttcccagactgcgaatgcaaattattatatatttttttgggtttatgtttggtaagtgaattaatttttaagtatttacaggaaactgaaatttttccaattttgagttttgtagccctccccacaattctcgcaattaaaaaagacaaaataaaaaaaacagttattgagtaattactccatttttgcaattttgcgtcgttcaatggccaacagtcggatgtgcaccgccagaaagtcagggtggcgtcggtcgaactccgccagaatggtggtggccaaatcgatgtcacctgtcaatggacgacggattaaaaggtggagaggtggctagggaccgatttttatactaaggtccaaatttttctccgatggcgaccctttgttttgcgattcaaatttttttttgcggctcttttcaaaaaaaaatttgggaacgggggggggggggtccggtggcgcctggattttcaatgaatatcgccaagaaaatttgttatactttgaaaattttcccctaggttacgaccaacccccgccccacccttacgacgaaggacaggagggatgtccgatgcatcgtttaaattttaaacaaaaaaacaaaaaaaaaagtttttttattttagatgtttgtttgctgatgccatttctttgtccgaccaccttgcttctcctcaaaagcgctgtacgccaagtgaatgcccggcttgcgtggacaatggatggttgtggcccgcttgtaaatggcccgggcagcaacagcgtcatcaatggacagcaaatagttggcgtactgtgagaaaaaaaaagtaaaatttgaaaaaataaaaggaaaacggatacaaattattcaaaatcatttagtcgaaaagatgtgtggaaaaagttttaagacaaatgaaactaaaacttttaaattgagaaaacctgtgaaaaaaacaaaaaaaaattttgccattttaatcttcg

SEQ ID NO: 9694 - DNA, 3868 bp, Heterodera glycines
aagatccatctccagcgacgggctcggcagggtgagcagcgggcggcgtaattcgttgagctgctgcatagaaaaaccccgaaatatttaaaaatatgtaaataaaagtcccaacttttgttcgcaaacacaaaaaagaaagtgtttttcctactaattaggctatggagaatccaggaaaaaatatgtatttacataaaattagcagccctaatgataatgttaaaactcgaaaattgagttaaaccaacagagttcgtattttggttttattataattttttggcactcctcgttttctcccttgattttcggttggatttgaattttctccatttttctactttttaactggttcaaaaactcttagaacgcatcgaatcggcttaatttcatcaagaattttcagattgataaaatttatcatagttcgaccgttttaaaatctcccgttgagtcagaagtgccatttaaattccaaccttttgttcgaattcggtttaggaagcggaattggtcaaaaggacgttagtagagatagacattttgaaaaaagcctggacctggattccatattggacctggatttcctggacaaaaatccaggtccaggaaaaatccaggctcctcgagacctggatccaggcctggacctggattttttgaaactcattttaaaaatcaaaaaaatatttgaaaaaattaattatttgcttagaaacatctaaaaatatctaattaataataataatgtgtttttaaatttatttaatctttttttgaaaacttgaaaaacatttgtcacttgaaataataaattctaaaattttgtccaggaaaatccaggttttttcgtgttttgcctaaacctggacctggacctggatttttttcacattagacctggacctggatttcctggacaaaaatccaggaaaatccatgtccaggaaaaatccaggttgccgaaaaatggcctggacctggatccaggaaaaatccaggcctggatccaggtccaggtcgatcgctagacgttagattaaaagccacgggaacatgtttttacgatatattacgacaaaaaaaattgcaacaaaaaaaatatatattttcaaattagcgaaaatatcgccacactttcaatgtctttcagattttaaatgatcttagatgagctaaatgtttgtattccttcacctattacctaaatgtcgcacgggaaaattcgaatttgcctgaaaagaaccttaaattcaacaacttttttaacaacgacagaacaaagccaaaacaaaatagcaaaaggagacagtgaagtgtttggagaaggaatggacaatgaacagcagaagaaaacgcatagagaaagaagcaaaagccagtaaagtgccgaatgtttggttatgtgccctttgcatcattcagcaacgattggtccgcccaattctctcctccgtttgcttcgcccacccaaccgaaaagtcgtccctcgtcctccaattctcccccctcggcagcagaagaagatgaaaatccgctgccagccgcgttcagaattggcaatgagtcggagagcagtgacgagagcggcgcggaaaggtcggaacacgaggaggaagtgatcagacgaagcaaacagatcaggttgaagacggaccaactcggaacaattaggaaacgcgaattttgaccaggaatcgagaacgatgggaactgctcaagtacaaaatgttgatctcttcgtgctgcactccgtcaaaaaaccccagtaaaaatgacaacgaattgcctgctaattgtaagcacgaaacggcggaggaggaggagcagtgggacgaggaaagggagcgcgagttcgtgttcagtttgttgtaacggaagagagcaatcaaaaatgaccaacggatcactggacagaccactaatttatacaaaaaataataagcatatacatatatatatagaataagaaataaattgtaaaacgaataaatatttggtactcattttcttgctaaaatagtcgacatgcatggactgacaaagcaatgaggagagcccataagggcatcataatcataaaataagtcgtttcgatggatttctgctgattgccccgctcgaattcatcttgcaatttatggcataaaatcatctgttattaaaataattttttgattttaatttgccttgcaaagtaccctcgtcctggtacatactgattaaaaactcacttcaaataatgcaaccattgtgacccggaaaaaatgtaacgcatttctgaatggcaggcgcgtgctttatccatctgttgctttttgtcaaaaaatgcaaaccctgcgatcgcccgcttcggtgatccgtcctcaatgacagtgcgcacaaaaataatcacaagaaagtaaaaattgagggcagaagcgacgaaaaggggggcgaacagatgcaaaattgtgagggaaaagagaaagtgccgactgagcaccttcgaaggcatttaaggaaagtgatgggaaaagcatccgaaaaactcacgaaaagaagggaagtgaggaacagagcggccgaatgcaaatccatctcgaaaagagtgaggccggtccaacgggcgaactcattcagagtcagcatttcagaggacagcaaacggaacacaaaacgaaaacacttttagttttcaagtataaaatgacacctatctatgtatcttttgtatagccctaatctcaaaagttaaaatccgcatcaatcataatcttaagagttttaatatctcaaaacattagaaattgcaaaaccaagttaacattatagtatatttttagtttgaaaattgaaacaattaacagactctctataaatatgattttttgggattttagaataaattttataattggtggtcggcagtaataatcggacagagatgacgctgtgtgacagacaaaaaggtttttctgcccttccttccttttccattatgcatttacaaatttttcaaggtaatggtggcgacggtttccaattgttagccgattcattgctcacttacaacgaaaacaatgaaaaattgaaaaagaagaagccgaggacgacacagaaaacgaacgacgaatttgaaaataaaaaagcgcaaaaagaggcggagaatggacggaacggtggtgggcacgacgaacagcaggaagaggaggaagaagaagaggaggtgggaaaacgcaccgaaggggggcatttacaggggaggatggccaagtgtccgtggagttttggaaacaaattttgtagattgctagtgaatcttgggttcttaagaaaagtgctccagcaagaccaaatcagcagggggaaagcgccccaaaataacggaatattattttttattaaatgggcaaattttaaaaattaaatttaacagtcctcaaaattgcttattttttccagccgaacaaattgacatttttgttcttcagattcaacgtcttcgaagagtccaccgcattttcacttggggtcacaacattccccgtccaatcagtgacttcgcttccctcccattgcccgacaaatttcgtgcaaatttgcgtgatttcatccagccgacgcccgttcaaatgcagggaattccgatcggacttctccacagggaccatctgatcacagcacccaccggtctctgctcaaactttgcatttcaaatgctcaatttctattttataatggcttttaattcgatggttttgataatttaaggttctggaaaaacgctctctttcgccattcccctcattgtccgtgttttgagcgcccgaaaagaacgttcccctgccaatgggacacaaaagtgtgccgacattcactcact

SEQ ID NO: 9695 - DNA, 1748 bp, Heterodera glycines
gaggagagcccataagggcatcataatcataaaataagtcgtttcgatggatttctgctgattgccccgctcgaattcatcttgcaatttatgtcataaaatcatctgttgttaaaataattttttgattttaatttgccttgcaaagtaccctcgtcctggtacatactgattaaaaactcacttcaaataatgcaaccattgtgacccggaaaaaatgtaacgcatttctgaatggcaggcgcgtgctttatccatctgttgctttttgtcaaaaaatgcaaaccctgcgatcgcccgcttcggtgatccgtcctcaatgacagtgcgcacaaaaataatcacaagaaagtaaaaattgagggcagaagcgacgaaaaggggggcgaacagatgcaaaattgtgagggaaaagagaaagtgccgactgagcaccttcgaaggcatttaaggaaagtgatgggaaaagcatccgaaaaactcacgaaaagaagggaagtgaggaacagagcggccgaatgcaaatccatctcgaaaagagtgaggccggtccaacgggcgaactcattcagagtcagcatttcagaggacagcaaacggaacacaaaacgaaaacacttttagttttcaagtataaaatgacacctgtctatgtatcttttgtatagccctaatctcaaaagttaaaatccgcatcaatcataatcttaaggttttaatatctcaaaacattagaaattgcaaaaccaagttaacattatatttttagtttgaaaattgaaacaattaacagactctctataaatatgattttttgggattttagaataaattttataattggtggtcggcagtaataatcggacagagatgaagctgtgtgacagacaaaaaggtttttctgcccttccttccttttccattatgcatttacaaacttttcaaggtaattgtggcgacggtttccaattgttagccgattcattgctcacttacaacgaaaacaatgaaaaattgaaaaagaagaagccgaggacgacacagaaaacgaacgacgaatttgaaaataaaaaagcgcaaaaagaggcggagaatggacggaacggtggtgggcacgacgaacagcaggaagaggaggaagaagaagaggaggtgggaaaacgcaccgaaggggggggggacatttacaggggaggatggccaagtgtccgtggagttttggaaacgaattttgtagattgctagtgaatcttgggttcttaagaaaagtgctccagcaagaccaaatcagcagagggaaagcgccccaaaataacggaatattattttttattaaatgggcaaattttaaaaattaaatttaacagtcctcaaaattgcttattttttccagccgaacaaattgacatttttgttcttcagattcaacgtcttcgaagagtccaccgcattttcacttggggtcacaacattccccgtccaatcagtgacttcgcttccctcccattgcccgacaaatttcgtgcaaatttgcgtgatttcattcagccgacgcccgttcaaatgcagggaattccgatcggacttctccacagggaccatctgatcacagcacccaccggtctctgctcaaaatttgcatttcaaatgctcaatttctattttataatggcttttattcgatgggtttgatatttaaggttctggaaaaccgctctctttcgcctttccctcattgtccctgtttt

SEQ ID NO: 9696 - DNA, 2306 bp, Heterodera glycines
gattgagccgaccaaaatattggccaaacaggtgggccaattaaagagctaacaacccttttttcatccttattgttattctttttgggtgaaataagaattttaaataaattaattgaattaattgcgtgaatttgtttaaaactctcttttggttttcattttttacccccttttcttacggcgaatgcgccgggggggcgacaaatcccttgagatatgtaatatattcagatgaaaattctttattcagacctacgaaaactttgtgagattctgtgatggattggacataaattgcgaatatttgcgagagaatggaattggagataaatgtaatcgaacactaagaattaattcattatcacttatttgtcttcatcaggtgacattttggtgaccactccaaatcgtttcattttcgcattggaaaaactttcggacgatggccaaaagagggcgaaattagtggagaatttgcaatggctgcttttggacgaatgcgatcggatgttcgaccggacggaaggggaggcgagtttccgagtgcaggtgaagcggcgaattgcaacggacggaccattcgaatcgaatggcatttgatcgaataaaaacggatatttcagctttcgaaaattctccgcctttgcaatggaaaggaaactcgtcgcggcttttacagcgccaccttttcttatgaggtggaggaatggtgcaaagaacatttggaagaagtggtgatggcatgcattgggccgaggtataaaaggggcgagggagagggaaacggacagtcggcgaagggatttggacccatccatttcaagggaagcggaaatcccaccaccgactctaactaaatccgtatcccttttggacatgaaaaataagtattcaaaaaaactttttgggtttttttcttccttttcaatttttttactttcgatctgatggttctaactttgaaaatgttcgactttttcttagttattgcaatgctcttccccccccccccccccataaattcttggaatatttacaggaacagtgccaatgaattggtgaagcaggaactgcttttcgtcggctgggagcaggccaaagtgagcgctgtcagagacatcgtccggcgcgggttcgaccctccggcacttctgtttttgcaggtcattataacggataaaaagcattgttaaaactgagccctgcacaaaatgggctttgtttttattttatttttccttcttgaactctttgctgtgccattctctcaaattgttaatcctatccaccacaaaacccaaaaataaatttatttcagttttttaacccataaataaattttagggtaatataagctgctttttccaaatatggcatcagaattagttcaaaatccatgtttttattaaattaggatttcttgtcaagtcctcgaaatcaagtctaaaaacattgaaattttagaaaatgcaataataaatattctgcaaccttttctctatattctgaacttttaaaaaaaaaaattaaaattggtcaaaattgaaaaataattaataatttttcaccaataaaaaacataaaacgaacaataattatacgaaaaactattagaaattctttgcttgacaaaaacagttgtagttttttatacaaaaagaattgcccatggcaggaatcgaacctgcgtcactacggccacaacgtagggtactaaccactatactacatgggccgacagcaaacggatttataaaaagctaagaataaaaaaatattgtcaaaaatgagcccataaagaaagtaaccattttaaattgctgacgtttgaataggaaacgttacataatttggaaaaatgttagcaatgaaatttttatggataaatgaagtaattttctataaaaaattgtatttggtttcatttaagcacaaagtgtccaaatttcctccctcaactaagttttttttaagagcaaagaccgtgcgaagcaattgttcgtggaattgtccgagtcgtgcaattcgattcccattgggctcatctccggcgaattgaccgaagaggaagtgctcaattctttagatcccttttgacccctcgtgcatttatttgtctttcccttcagtgtgaagtgaccatcggacggtttcggtccgggaaaatttggcttttaatttgcactgaaatgatgggacgtggcatcgacttccaagaggtgaacatggtcatcaacttcgacttggtaattaattacccttcctaattgacactttgaccctttttgtgtttctcttctcag

SEQ ID NO: 9697 - DNA, 1896 bp, Heterodera glycines
atgatcgacgaggggcagaaaaaagccgcagaaaaagtcatttttaatgatgatgtatagaaagttttaaatatttttcacatatttaggtttccaaaaaattgacaacccagaaatcgctttggaaagtgaatgatgggtgacgcttattcaaaagattttggggtttttggacctcgacctcgagtcctgcagtttcgggcctatgaaatattcaacagtcccgacagtttaaaaaaaaaaacttatttttagttatgccatcgcattgtttgtacatggcatttttattcagaagagtaactgagtaaattttatgacaaaatgaatgacatttagcgcaaattgtcactctttaattaaactaaaaagagaagctgaaaatttttttgcgtgtgtatttaattggcacttttggagatatcgcgcacgattcatgacaccttttttgccgccattaacacgacaaatggtgtaaatggtgtgtggtgtgtttggtgtggtgtgtatgtgtaaaataatgccacaaaacaaacagtaggaaaaaaatttggggaaaatttgtgggccaattgatgaggcctcctaaaattgaaagagcggttgggggacattcattttgtcgtttggcggggggggggggaggtttaaggagctcatccaaattggctgcctaattcaccttaaagagaggaggacaaattgaatttttttttttttggggggggatgccgattaatatatgcctattcctccctcccgctgctatacccctcagcaggggcaggggatgagccaacaacaacacactgttagtcgatttggcattgagtggaaatagggagggatgccgatgccaagggctaagctaagaatgggatgagtgccgataaatgatgatgatgaggatgatgatgagaattgtagaagattagtgcgagagtgtatgagaggaatggcgcaggttgccaaagaaaaaaatgccaaaatccgtcagtgggtgtcgaacccccgagaacattcaaggggacccgttaaaaacttagtcaagactaagttgctgaacctaattatcaagcaattaatggtggtaattattgattaaagcaaatttttttgtcaattgtcaaaagtttagacaaaacaattgtaatgttgaagtatacaaattattgagggcttgggtcaagctagctaacctattggcactttttgcccctggcgaaaaagttttacccccccccccccccctcttctttgtgtgtagaagaaaacggcgaaaaatgccccgcaggggagaggagaggcacacgcgattattaaacaacaaattatgtggaagattgagcaaaattgggtgggctgagggggcgagtgggtggtgggtgctgtgaagcacacatttgacttcccgttgagaaaaataatattgtgtggagaaattttgatgttaaaataagataaagcggcttcaaagttttgatgcatttttcaatttcgatgaggaaattttctgtcaattttttgaaatggaaaatatttgacaaatttttttgtgatattaattcgtaaaattttttcccgggggttttggggttcctgatcacgaatctgacatctattttgactaatctccaaatccctaacccgaatttaaaaaagtcgaaaattcaaatttttctatttataatttttttccaagttaagattatgaaatcggagatagttaaaataggtgttaaatacataatcaggactttaactagctccgaaattttgatattaaaatcatacattttttagggggggggtcgacccccgccccccccccccccctcgctcgcaaagggggcgccagcgagggggggggggttcgcagcgaaggggggggggggg

SEQ ID NO: 9698 - DNA, 2409 bp, Heterodera glycines
acccttacggattttcccattttttctgacccttgtttccttggccgatccttgacccgctttttggccctcttcaagtgccaacggcgcactatcaccgaaaaagcgaggttcgcgccgttgtgccaatgcttttggttgtccatcgcttgcggggtcgtcgttgctattgctgcttcggctgcggaacatgttggcaagaagttcgagcagttcaagccggagtccgttgtccaaaaatgatgcttcttcttcagacatcaacgatgaatttggaccagtttgctgttgtttttgaccaatataattggcagattggaccggataagcaaagtgaattgcagcaaaaaacagcacaaattgaagaaggcccaagaaagaatatgctgttgttatatgatatgtgcaaacggtacaaaatgccataaaccgcatggcattttgtgtggtggtgaaaaacggattccttcctttctgctgctgcaattggtggatgtgaatattgagccaaacctttttcttctgaaactgagtaattttttaacagaaaatctcatttttagaaatttcgggaatcagatttcaacctctccgaccccacgtaattgggccgatgaaatgaatatagccaattttatcgtatttagtaaaatacagccccctggggctttgtttttcaaccttccccctcaggaggagtgctttatttcaggagaagctctaatttaggggtcgggctttattttacaacccgcctcaaaagagggctttatttcagggggagaggggggggggggctgtattttaggaagtacggtataaatatttaaaaaatcttgaaaaacaaatctcgttattatatgacacaaaattttattggcaacaaaagggcgccggggcacggaaatgattttttgcgtgcgaatgttcaacaacaatgacacactctgcaaatggcacattacttcctccataagtccttccaactgtcgccccacagataattggttgcctccggggggaattgtggcggtcgccaaaggcaaaaaaaaatttttttttttccaccctttttcctatcagtcattgtgccgtgccgtcgtcgtccccaacggggactgccgtaattattatggtctcattttttggtgcttgtataaaatgggacaaaaaatggattaatccaaaagaaaaagtaatttttgcggaaaagtagctttatttaaatatttatataaatcaattgaaaatattttgtgtatataattcagaatgtagttaatgtgctttatccgattagtttcaaaaaattttttacttaaactaatatcaacaacaaagttttcttagcaatggtactcttctgttttggggcccggataggggcgcatattgcaaaaaatacactccaaaattatttcggaggcataaatgccataatttgagctataacaataagattttcttcaaatgcccgttccttactttttatcaaacgaattttttttttgttacaaataacgagccctattatattttttcaatattcaaatccgggccccaaaacagaaaaatatcaatttttaaaattaatttttgctaattgaattataaaataatatattttttgcggttaattttatgacatttctcggccaaaaatatctcttcatatctgcgcctttaaaaagctcgtaagagtgggggaactcagctcggtttgatctctgccataggggcggctgtttttgctcatttatccgcaattttcattgtgatgaatgggtatgatgtgctgtgctgctgctttttatgtgtgtatttttgacagctttttccccaaggaataattaaaaatttcggagtggcatttatagagagagaactttagatttttttgtaactgaaaataagattttttgcaatttaaaaaataaaaaatttattcgtttgcctttctcaaattgagtctattttatggaaatggtattgttgtgcgcaaaagtgttcgatatagtattatgaaattccacggctattaagacttaggaataaatttgccggtgaaatagatggaaaagtagggcaaaaaatggctaaaattcaaatatttatagacctagagattataaatgttagcaaaaaaagggtcgtcgatttgccacctccgaaatttaaatgtgtggttggttatatgggactcgggaattgagcctttgtctcgaatttagatgttacgaatgcgctgtccatttaattggatttgaaattttgtaaggcacagaataatgccaatgttcaaatgccatcaaatgttttcgcctaagcagcagcagcaggggcagcattcgtcgaagaagcagacagtttaaaagtcaagtgtcctccacccacccaccaccagcagca

SEQ ID NO: 9699 - DNA, 2102 bp, Heterodera glycines
cttgccgacatgtcgaaaggaattgttcttgacacggcaatgcgttcgctgctcacagtaattccattaatggtgtggctgatgtcgacagcgggcaaaatattttccataagggattttttgtcacgaaggttaatgctcatttttcaagaaaatagcaaaatgaatctatccaaaaattgccaccttttatatacctctttaatttatacatccgtaatttatttatttatttatcatttaataagatggtccctcttatttgtttcggtcgtaagtgacctacattcacattacatatgccattctcgaatgagtgaccagcagagaacgatggctctgttcgatcgaatcatcatttgcctattttatgtatgtttgtttttttctttatttttagcaaaatatgagccgccctattttacctatttttaaaaaatcgagtagagcctataatcggcactacagcatcggaacggttgtttaattaaataattttttatattcattataatttatatatttttattcactatttagatgattttttatgaaaattccaagccgcagttctacagcaatttatggcagcgatcattgatcgcggctgcattcattttcattttttggcttatttggtaatttaaattgtaatttttactattttttaaatgtttgattaattttaatttttagggaatgaccaaactctggaaatgttgagatacgccaacattgaaagagaaggaccgaggaatattgataaatttcaataataaattttgaacccttcgatttaactgtttatttaaataaccttcaccaaattatttaaataaatggacaaacttataatgataccctgattatttcttttaaaaatttttcctttgtgcttcttttctcttttcatattttcttctcctcttctcttctcttgttctcttcacttctcttcagttctcaattctcaacggcctcgtctgcctgtagaaataaaaaaattttaatttacaaattgatatttttaaaatttgccacctcctcaattggggacaatctaccaccgacaaattccgttgaagcctgtgaaaatttgtgattttatttatttgtttgttagtcatcccctccccacccctcccccaccgttccaattgggcgttctcgcccggcactcccggccggcaatcgatgaacaaacgaacgctgaattgccaaaaattatccaaaaggaaggaaatgaaaaaaatggggtgggggggagcgttcccactcacctcacgacggacaagaaagcgaagcgtacgcgggtggccctcatcattgttggaaacaggcggacgacgcggacgaaggcgctcgatgcagcgcaagcgcgctggcacattgagcaaaattgcccaaaaaatacagacctcaaaattatagaaattataatatacaattttccatcaaaaaattaaatgaaaattacttgggccatgaaaatgaaaaggaagaacacaaaattcatggagttgacacatccggcccctttgacgcacagtccgttgatcagctcggtgatgttcatgttgtcggggttgtcgcagggtttgctcatcaggtgcgcagaaaaatcacccacgtgtgacacgtggatgcactcaactggctttgtgtagtccaccggccggatgccaaccgcatccggccggggacacacgcagccctcgagcaccatccaggtcaaattggtggggtgggtggcgacaggttgaatgatgctcatgacagaaaaaggtgatcagttggactaaagcaattggaaaaattataaaatgcatagaaaaagagcacagaacaaatatgaaaaatgatggcaaatgcccgtggctatagccgaataagcccaacccaccccttcccatactcacattccgatcacttccattgtccacaataaccgtcgtacattttctttgtccctaaaagttttcagtccccctcccccttgtcccgacccttctccccaagcaaatcgctagatcaaaatcttttgtatgctcatctcctccactttttgccattccgttggaaagatatggctattaatattc

SEQ ID NO: 9700 - DNA, 1634 bp, Heterodera glycines
  misc_feature (1574)..(1574): n is a, c, g, or t
atgaaagcagttacatatcgtgtgatggaatacattcaaaaagtagacaattacgatgtcttaggcatcgcaaacattgtcatcacggatatagtgtatgaagaggcatttgctatctttcgcaaatttggggtcaatgcgtcagcaattaaggtaacattttataataattacatcattattggattttatttttaggtgctcattgagaatgttaaaaaccttgctagagattaggaatttgcggaaaaagtctacgaatgttcagagtggtaggttttggttaaagatcagattaatgaaaatgtggtcaaggaagcggtggattctattgaagagtacgaggataacagtgcgtatatagaagtggcaaagaaatgtaatgaaattgttcattgggaggatttggtgagatcatcctaccggggacacacgcagccctcgagcaccatccaggtcaaattggtggggtgggtggcgacaggttgaatgatgctcatgacagaaaaaggtgatcagttggactaaagcaattggaaaaattagaaaatgcatagaaaaagagcacagaacaaatatgaaaaatgatggcaaatgcccgtggctatagccgaataagcccaacccaccccttcccatactcacattccgatcacttccattgtccacaataaccgtcgtacattttctttgtccctaaaagttttcagtccccctcccccttgtcccgacccttctccacaaagcaaatcgctagatcaaaatctttggatgctcctttcgtccacattttgcgattccgttggaaacgatatgcatattaatattcgggggtggagagatagtacacaacttggagaggaagtgcgaagaagggaagagagaaaggcagagacaacgagaacactctgtccctttcttctcttcccttggccacccatcggctcgagtgcaaagggaaaaggatgagaagaaaagcaatgaagaataaaaaatttattttaaataaaaataaaaatttacagtataccaaaaaatgcgcgaaaaacaaacagccaatacccttgggttttttgcgcgaaaaagtgtgaaaaccagggaccgtcgcctccctccccttccccgaaaatgcgcgaaaaaacagccaatacccttgggtttttgcggtaaaaaagggcaacaaaccggggaccgtttaaggtgtgaaatttcacaccttaaacggcaacgggtaccggccactaactacttacggctcccaataattcgagtccgcagcaattgcttttcgcattgcattttccatactctgcacgacttgtgataaatccaagcggtctgacatatccacgaggctaaagaaattaaacattcatgaaatagagagaaatccaaggtgggaggggttaaaggcatattccgtagataaattttcaggaaaaatattaattaaagggaaaaaattcataaaaattcactaagtaaatcacaaaagtaaacgaatttcaaaggattttcttgagaaaccgaggggaaggcggagggacagggacagtcacagaattctggcttgngaagaggtaaagccgatttgcgcatggacaaaaaaagaaggaaacgatttttcaattccc

SEQ ID NO: 9701 - DNA, 2503 bp, Heterodera glycines
attctcacccactaataatttgatgctgattgtgattacactttgttgagattctaattttttttccattgaaattttgacattcaccacacattattgaccatttaaatgtgtaatggcaattttgaagagtgatttgaataatttcgacatgttttaatgatcatttgcagaaattattgtagattaatttatttaagccattacacatgccttgcaatgccattaaaaaaagcaatttgtgccaaaaatttaaaaatctgatttaattatttttgaaataataagttggttgatatttttggcacgaaatgcagccataaaatttccttccgaacgaactcgtcattataatttttacttttattcattaaagagaattttaatgatcttttattgatgaactacagtttttttatttctcgtaaaaaggagagcaaattaggggatcgtgcatattttaagacttttcgtccatattttgtctatataaatccggtccataataatactaattagttaattaccaaaataacatttttgtcattgtcattagtcgtaaaaatacaaataaaatttatacacaatttaagaattggaatggtaaagcaaggatcattttttgaccagtttagcaaagaaagttgcaaagaaggctggcaccaactgaaaattaaaaatttaaaataaacgaattaataattttcaaaccagatagaaactgcaagaaattgacagccacgccgcaacatgaactaccgagagcaaatctgaacatcaattataaacaattatttcggcatttttgaaattaactatttggctatggaatttgttccaaatcaggcatgtttcacattttatgtgaaaaacgaagttgtaaatagtgtgctctatcccagcggatcaatgataatttcgtacaattttttaaatatatttttaaaaaagtatttttcgtataaaattaaaaacggctttttaagaaaaagttgaaattaaatttttgaaatattttaacaaaaattaaagcttttataaagaaaatattgtacgatttgccgattgtaaaagtcctatttcgtacgaattgtcatgatatgacatcaactcagcattgaccaaaatgaagagttcaaattgttcaaaaatatttttatatatgatcacttccaaaatcaacacctgttctgaacggcatgtaacaagtgtttgtatagaaagccgccgcctctgatccggtgaaatttgtcatgaaaattgttgacgatgatgatgatgaatcggctggtaattgttgttgattttgcgcaacatgttcaccaccaccaacaacagatgcttccgcttctgccgaggttggcgctgcttcggctgctaattgctccattgatggccgaatgccattgctcatctccttgtccatggtaatgctgcgctccacacactcagccaaccgttccggcacacaactttaaagcacataaaattttttgggtcaaatgaaatcttctcaaaagtctgggaagaagcaataaacaaatggccgaaaaatcaatcttttgagttttttggccagaacttttttattcagagctaattttttgaattttattgattaatcgggactatcaagcgctttaaaatataccaagcttatttaatttaaatgacaaataaaaatgttatagcgtgccgaaatggctggcgccaaagtgggtggttcccaaaaaaggcccctccaataaattcaattcataaatttcttccgcaccctccctccctgtttcgttagcatttcataaattttggttagacctccaaccaaaaaaaaaaaaatatccgagggccaagcattgggctggtggtgtgtatgtaccatgactgggggaatgcgggctttggctcccggtggtgcatgtgccatttggaggtgcgccaaatggtgaagtcttcagtgccgttgacgccacagcatcggaactcgcgctgcaaactgtcccaggccaatgtaattgcggtcatgtcggacaagccgtacaactccttcaacgatgtgttcatcttcaagtgcagaggtgtttggactaacttaattgtaaagcaaccatttatttttaatttttgcattggaatcgatgtgtactgatatctgatcagtcgatatccaatttaaattaattcgaatccgatttcttttccaattttgttgctttgatttcaaagtataaatcattaaaataaaacatattacataaaatagaattacgaaaattttttctcactttttggcgaaaaacaagtcccatgattccaccaatgagcaacgaaaaacaaagaatcacagatgcggtagaaaactgaaataatttaatgtttaatagatatatttctataatacagcccccccccccccgccgtcccattgaaagaaagccctccttttcaggcgggcggttgaaaaataaagcccccaggcatacatggacaagggggggggggg

SEQ ID NO: 9702 - DNA, 3039 bp, Heterodera glycines
gtttttgcggcgtttttcaaaaaattttgggaaccagggggggaaagtgggtccggaggtgccgataggcgccgccgggaaaatttttgaatcgcagtgcatttgttacctgcttttgtccaaaaaatgaccgaattttgccattttcatgaattttattaacagattttcaccaaaaaattatatttcataaaaaaaaatttacgaatgagaaaaacgaaattcaatttcgtaaaatttcaacgactaggaaaagacaaaatagaattttgtgaacaaaatcgtaaaaattttgcgttttttggcacaattttttttttcaatttactaaaattttcccatctttaccagtgctttttcgattttggccaaaaatgcctcggaccccagtacgatttacgaaattgaccccccacccttgtccagctatgccccagggggtctatttcagtaaatacagatgaatctattttttcaccgaataaatcaggcatcggagctcttttagcacagaatatacagcaatcacactgttagccacgaccaatgatgagatcaccttattggaaaaaaaattaataattaaaaggaaagttaaacaaaataatttggccaaaaatgaatgagcccaccaaccatcatgatcaggcaaacatccacgtacaaacttggtgccaacagctcatagtattgggaccggttgtgataaagccaagcgccataggaaaatgtgatcagggagaaaacctgacatgaggacacatattttgagtaccaattaaaaccgttttattcgtggcacaactgatcaatttgccctgctgatcagcagtgtcatgacaactcgtacaattctcggttagacctaagctataggcctaagctttaggctaggcctaggcttaggggaaaatacgagttgtcttttgtacgagtcgccattgacccctgctgatcagcaccagaatgaatagatcacacccaccacacatagacgcataacccaccacggacaacacgtttgtgatgagaaacgtgtatttgacagtctgcccgtataatccataggcggaccatcgccacattgttgaactgcttgtggttgtgttgcgccccccacctccatggccatcgttgcccatttttgttgttggttttttgtctccgttttttgtcgctttttcacaatttgtataaaaaaatttggcctttcattgattttgaagacgtaatttatttaatatctttaaattctcaaataaataaatgaaaaatgaatggtgcaaatttcttttaacccttctcattcttcataactacgttaattaaacaggggacaatttccggttttgtgcaaaaaatatgacaatttaataaagtaacacccatcataattatcccaatttccgttgttttttttttaccaaatttgtaaaattttgttaataatgagaaatgaagagaagtgggtaaaaagaagttgagcgcagaattaattaaataaaaagtattaattttttattcaaagtaatgtattcttaattgtttttttctcaatatttactaaaaccatattcgcgtataaaatgtttctttataatttcattattcaaaatgttgactttgaaatggacaaggccagagaatgaaagccggcgcttaaataaaattggaagccggaatcgggcaccaaaaatttcgaaaattagaaacctcaaaaattgttccaacattcgttcagtcccgtttactcattataaaatatgtaaattttttcaaattttctgcttacaaatgagctccaacaatgtctaggagttcggatttcagtgtatgggtattgggaatgctggagaatttttaataaaaatttcggggagcaactcccctcactcccctgtcggggggaaatttcaaaaaaatcaaaaaaaatatataaattttctaaaaataaaaagtcttagaaaaacacatttagacattctcctgctataggaagtgcaaccgatgacatttgaaattcatcgggttgggggagcagccccttattttaaagactagatggggtgtcggacggttgcaaaactgttagggacgaaattttctggatgtaaggcgtaaggcatgggggagggaaattaaagagttgcgcggcgagagtttagcacaaattgtgcgcttgcgcagcgatggaatggtcgatttttgtgggccaactcatagtcaatcatcacatcagcagtcatcaacagcagcagaggggttgttgtgtgcgtttttttttgtgactcaacgtcctcgtcgacgtttctcctcccccatttttgtgtcggtttacgaccccaaaaatttttggggcggaaaaataacgacgacacttctcgccgccgctgctgctgatgatatatttaattgtggtagtagtgaaattgttttaaaaaatgagtcaattcaataataattggctatatgaaaggcaaatgatcaaaataaaaaacttattgagatgttaaaaaggtaattttgtgaaaaaaaattccttggttgctgaaatttggttaaaaagttttgacatttttatgaacgtaaggtaagggacacaaattaatcaccaatatatttcttgccggtgtgtaatttttccaatgttgagtttaatgttctgctggaaattgatttggggaaggatgaaagcgatacttcagttgatatatagatatttataaaatgttattttttaacaaatttgtaaaaaaataagtgtgagtttttcttcttttttttttacgaacctcgcgccgtaaaaaaatttttgaattcatcgggagacggaataaggcccctggagatcaggggttaaagccgcgattttgatggaaatccggaatttttaaattgtttgaaaaatgttaatttttggtgatatcggggaaggggtaggaatcacttttcttcccctcccccatgattactaatgctttctttcacagcatttttgtaggaaattagcgccaacttcgagctattgacggccgaaga

SEQ ID NO: 9703 - DNA, 5352 bp, Heterodera glycines
  misc_feature (69)..(69): n is a, c, g, or t
  misc_feature (130)..(130): n is a, c, g, or t
atgggcaataaagtggcaaataaaagtttcaattcaaaaactttttgtattatattgggttcaaaatcncaaaaagaaacatataaatgtgatggaaatacaataaatgctgtggatacaactagggatntaggagtaatcattgataacaaattacaatattccggtcatattaaccaaataacaaggaatgcgtatttacgtatgcgttccttgtttcgaataattaaatccaaatcgtctaagatttggattacgttatataaaacttatattaggcctttattggaatacgctccggaggtttggaatccgtctcttcaaaaaaatattaaaaaaatcgaaaagtgtcaaaaatatttcaccaaaagggtattttttaaatgcagccttccgccaattccataccaaaatcgattagaatacctgcaactgccaacacttgagaataggcgaaagctatttgatctgttcatggcgcataaaattgtttatggccgaacagatctgaaactattttcaatttttaatccatcgacacgctttaacatccccttttacagatttaacacaaaatataaaataggcaaaaaattcattccctttgctgggagggtaacaaaattatggaatcaactcgataaagaactaatcaaaacaaattctttaaatcaatttaaaaccaaacttagaagttcactagggtaatgaaaccggaaaagctagaattataacaaattcctaagtgatttggtatttttttatttttcgacctcatttgactttgacctcaatttcaatttatttatttattttcacatatttgtcttttttaattcctgtgatcatcactttattttatcacttactctacgacacattatctgaacagtcgtcagagtaagtggttttcgcccttctgatgacttttttatttttacgaataaataaataaatatggctaaaaattgattacggactctcaatttaccgctttagaaattcattatatattgataaaatgtgcaaaatagcaaataggtgtatctctaatttataaggaattatacagttcgcctaacaagaaaaagcattgaaacgaaaggacaattcattgtccagcagttgttttttcttttcaattcacttcatatgtttgtttgtttctcatataaaacgcaatcgaacgaagcctaatggaatcaacaatagcaaagcaatttttcaccaaattccttaaagtttcaaaaaaaagaattataattttattatatgcatttaaaaactttttccataacattctttagcgataaatattaaatatacagtgtgacaaataagtcttgcaccacctatgcttttgatgtaacttttaaaaattcaactaaaaatgaccaaaatatattcaaaatatgcacaacagattagggaatattgctacataatagtttatcccatctttcgagagtcataacatagagacaaaaatgtgccaaaaaaattttcaggtggcacgcaactcccgaatcaatattttggcataatcctagttaatttcttctatttgtctacagtgaatccatcttcattttatgcacaaaaatttccaaactaactaatttttttatcaatttcgcccgcacaattgccatcaagaaaataaataaatatattttggagacgaatttttgagaaattttcctttcttaggggtatatttttgaaaaattttggtcaattttaggaatttatttttttgaaatttttgggaccgattcttagggggtgtattttttgtttttattgcatttttgctataaatttctggaaaaaggccaaaataggtgctaaagttcgaaaaatgccaaaataggtgctaccccccgttttaggtgtttttaggtgctaaaaagttgctctaaatcaacaattgttcggagaaaagtgtttttcgtgcttctctcatcaagtactagccgtaaaaaataggtaaaaacttaaaaatccggtctctagtaatcaccatcgttttcatgcttatttttaaagaactaatgtttttttagatgaaaatgttgtcaaaagtttgttttccaaaatgtttgttgctgttgttattcagctgtataattggcaataaattttcattatgcgaccaaattttatcgcctcaaacaactgaagaaaaagattattcggaatgcggaatttcggtctttgatccgttcaacgaacgaagcgaagagaacacggaaataagccatgtaattatgttattaattacattcataattaggggacttttaactgaagcaaaagcgaaagctgtttttttgaccagaaaccgaaaatcgaaccgaggggctttaaagcgaggaggggaccaagttgcgtctaacaatgagacatcattaaggaataattacttttttcatcattttattaaactcaacaaatttaataaatccccggataaaaaacgaccgtaaccaattcccctaattaataatattaatttgttaggtattcaaagggcaaactgttgatgatgatcgcgcattgccgtggatggccacattgttaaggcgcccatgttctttcttttttcaaatttttttaaaattaattaattacactttttggcttaattttaaaaaatatttggaattaaatttaatctaattttgtgaaaacaattaattaggtacatgtaaattattataagtaaattttattaaaaaggcataaaaataaaaaattttatttattaagttgaaattgtccaaaatgcaactgtttatgaaccattttgcactgcaacaatcgttggaccaagacacattttgacagcattgcattgcgttgccgacataaatctcttcgcaggtacggtgaataaatatactgtacatgaatattgtaagaattttttttttactttataatttgacaaaagtataaaatttacaatttttaatgaaaaagattcccctgctattggaaatattttttgaaacaaagttttatttttttaaacaataaaaattgcgcaaaaattttatggctgccggaaccgctcagttgggcgcgcacggttgggcgccaacatgtttttccactatagctttttatttgttatccaaatccaacaatcttggtatcattcgaaagctcttaacatgctcacaactttaataagatataaattattttgtttaaataaaaattaaaaggcgcaaaaaaatatatatttttattttatgttcaatgtactgtacatcaatattgtcatattttggcacgaaatacggtatttctctaggttgctcgaaagcatgaaaatttaagaaaatttgattgaattttcagaaatttttgcaaattttttgaacctttttcatcactttttgaaaaccggaattaaattgatatttttttttgtgctaatagtgcaatccgagagttaagtatgagacacaagattatttaatttagttatgcttaagaaaggttatgacgaattttctcaaaaaatctgaaaattggcactttttgcgaatgacccacaggcactaatctgcttgctgttggtccgtggtcacttatattaaccaaaaaataaataaactaaaaaaagaaaaaataaaaagaaaaaagtgaagattgttttttaaatattatgccataattttttgttttttcagataattataaaattttattcggtgccgttcaaagctcaaaacaaacgcacaaattgcgcattaaacgcgtccattatcatgaaaatgcaacatatttggttcttaatgacaagttgaatcctgctagtggtgtttatggtgaaattgtgcacccggattttgctttaattgaagtaataaaaaaattcaattatttattttttaattaaatgttttttaagagcgtggagccaatacaattttcatctcgtgttagaccaatttgcttgtttggcataggtaagtatttataatttttttgaatttaaatttacctttaaatgcaattatataatcttaaaaaaattttcaaaaatttaaagcagtgaaaaatcattttttattgttataaaggaattttagaatttatagtaaaaattgttttattcattacgcggttttttttattaaggctagcctctaaaatttcaaaaaatttaaagcagtgaaaaatatttttttttttttgtacataattataattcaatattaatttgtattcatgctaaccccccatatttcaatattaaggttcctcaaatttgaaatattcattttctgaaaaaatttctgcccaacacttcaataattcacggccatttgttgttgccggatggtgctacacagagccaatttgctctaaaggaactcacaggacaagtgaccagctgatgtacggtacaatgcgcatggtttctaaagacgcatgcccacttgcttacggtaatgtaaaaacggatatgctatagctaaactaaatcggtatactatagccaaacaaaagcgggtatattatttgtaattccccgaaggtcggagaccaatcctaaaattaaaaaaacaatcgaaaatttaacaatttttaagggcgacagtggcagtcctttgctaagcaaaattggtgacaagaattgggtccaagttggtgttttatatggtggtggaggatgttctgaaaagcatcccttttccacaagtcggcgtcactgtaagaaaatcaaaaataaatatttaaatatcaattttatttattatttttaaataattttatttttcaattagcattatacacaccgatcgattgcgattggatttcgcgcgtgacaaatgatgaagtgaaatgtaaaggatggtgaattgaaaacggaaaaaatgaatttaaataacatttacattgtgacaacattttgatgcaatttacaaacacttacagtatttatgtacagaaataaaaattaaaaaatttatttttttaatcgaaaaaatttgttgcattaaaaagtttcaaccgataaacaattttttgcttaaaaagaaaacgggaaaagttcgacctcgaaacggaagcaaaaacaaaaaaaaatggataaggatgagtggtcacatatgaattagtaccgtatattgttctcattactctatgttacaaaaatgggctaaaaataaatatttattaaaaatgcaattgttttaaaataaaaatatatttaggtatgtatattgtagtaacacaaacgaagttgaacaaaaaaaattaggggtagtctgggaattgaacccaggacctctcgcaccctaagcgagaatcataccactagaccaactaccc

SEQ ID NO: 9704 - DNA, 2249 bp, Heterodera glycines
  misc_feature (2023)..(2023): n is a, c, g, or t
  misc_feature (2044)..(2044): n is a, c, g, or t
  misc_feature (2120)..(2121): n is a, c, g, or t
  misc_feature (2168)..(2168): n is a, c, g, or t
tttaatgaaatcacatagaaccatcattccaaaagcaattttgtagcaaattttatgctcgtttcaatgagcctactcaaaatttccataaaatttttccaaccacctaggagcttttttcgaaaaatttctcaaatttttagggtattttgtcatgtcttattcaaaatgaaggagtgatcagatcaagatgggtttttttgatcttttcacgaacaaaatttttgttccctttttttaattaaatttaatgtttaaataatgccacaaagcaactgccaattaaatactaataataaaattacaccttttcatttttctataattaaataatatttttgtctgttttatgaattataaacaagagtaatcaaataaattcagtaatttaatggacattttttaaaataaaattatttcatctaatatcaaatgaataccgagaatttgaatgatttggggctaataggctaaggaacgcgacgcgcggcatcaattaagtgccatttaatgatggactgatttatccagaaaaatatcttctggatgacatcattcaatattgtgtagtgcctaatggatgcccattttgtagtggaattacttgattagcatttgaaaaacgtttgaacacaaatggaaacgccgtctggaatgcctggcgatattccgtactaaaaaaaataaaaatttaattaatttaagtaattattataataccttgtgaagcacaaaatgggtgcattcgatgccgcaccaatgtttagtgaaattccgctgatcacaaggccaaaccaagcagtgatcggagaagcaattgatggtttgattaaaattaaataaattaaattagtacagtaaccaccaacattaacgacgattatacaaaaaagtgaacgaaaagtacgataattaatctgatcagcggaaggcaaacctaatcattaaattataaaattaattttatttttttaataaattatcacctgccgatttaattcttataatgagcccgacaaataaataaatgaatatggtaattatgatgagaaagagccatagtatactgtatagagaagaaccctaaaatattctttttcgttgatttgtgagcaagaatttatttaccatgaaaaaatcggcataagtgccagtgatcatttgatcaccattcagttctatactttggtaaattgttatacaaaaactgaaatttaaagcactacaaataattgttatcgtagccaaatacagtcggattttgcatttgctatgcctaaaaacggtggaaataaatcaataatattttagaatgtattcctttacatttcaccaaatacaattccaagcattctgtcaattccaataaaaagcattattggataaatgccaactaaataaaattattaaaatttaattattaatctgagtaaattacctaatccaaacattggaatcattaaaatcttttcgcaaaacgatactcaatgaaattttgtcccgaaaatgctgtataaacaaacaaaaaatggcgaatctgatggaggatttcaaaaaaggaacaaagtgccaagaggtaattaacagtgccacggaatgacctaattaaggtaattaaggttcacttataactcattaatactgcttactccaagaatttatctacactaattacgcactttgttaaaaaggttacaacaattacagaaaaattgaaaatgatgccaattaccgcaatgattccataaatcagtgcacaaccaattagtgaccagctgggatggacatctttgaagaccaaataaaactgcaaaaaaattttaaaaaagtaatttttaaatatttcaattaatgactaccgtattgtacgttgtgttgtcattcattttgtttaattttatttaattaattttttgagataaaacaacgaatggcaaaatgctgaattatttgcttaaataaaaccgaaagctcacctgacaatttatttaattaaatgtttctgaatttacataatatttgntgattttttgtgtctggcctntctgttcatggcacctgccaattaattaatgaaattacacgttttacatcttttccaacaattgaataataaatgnnaataacgctttttgtccgtaccgaactgagcaaaaagattcatatanaatgatttttttattataatgagaaatgagaatttatttttttatttttttgaaaaagagctaaggatgagaagagtgaca

SEQ ID NO: 9705 - DNA, 4778 bp, Heterodera glycines
tttttctattcccttttcagctctgatacagcaaaatgggtcactttctgcagctgaatttgaagaggcacttccgcttggctcatttataaaagatttttacggaatggcgttgcgaattgtggcactcgtaacttaccaagggcattgaacaaatgcacggaacgaaaatgtgcaaaacaatggtgggtgctgtaatgatagtatacttacgacaatcgaattagttgatgggtgggtactgtaatccaaatggtggcttgatttcctgtaataagttagcttttctccgtccatgctaatgtcagccttttcgatatgcaggtggccgccctgaaaatttctcttaataaagttttttattttctttagcctgtgccgaaagcgtcaaacattgaccatttgggcacaaactgtacacaaattgtgtttgccgaccgtatgccacagttttggctgaatgtgtccgtttctccctattttattgcgtgcgaacaatttaaggcgccatttgatccctcgactatgttcaatcagtctcggaccagcagtgatttgtttaatgcatgtcaaaaggtgccaacaacaccgaactgcgagaagttggcacattatctgtgataaaattattttaaaaaaaccataaccaatgtacaaattcgaggactgtcattagtctttaattctatgattttaaattttcagaaattccgtccttatttttcccattatcttgaatatttaaaaaaactgttctttttggtgcaaaaaactttcaaagtgctcaaaaaatttaaaggcattgaaaaaaatggaattttgtgcttttaatcatatattataatttcctatttttgccactccaattgttttttaaatatttttgccaagaacatctccaaaacgcgcgccaaaggcgtacggatttcgcatccgtttgtgtacacatcgcgaagcggaaaagcaacggatcattttggaatccaagctggacttttcattcactgatcaaaagtacttaactaacaaatagaatcaatcacaaaaactgattggaaaattcgccgctacaatggaatcattaggctaatattaattattattttttaatatatcgatttttttctattttttgcaaatattttaatttttaaaagtgatcaaaccaaatcaattaaggacagggctaatgaaattagactaattaaattaaatgacaaattaggcatttgccgcttggcattatataattaaataaatataaaattgaattgaattacattttaagctacgaatccaacaaaagcttcgcatacacagtgaatgccatggaagaggcaatgaaaataacggaactttttttaatcaaatttggcaaggataagcagccaagtgctgcgcttcgtgatgacaaagaaatttcggcccaattggtgatttattaagtttttcttttttttggcatttctagatgcaaatgcccagacgcgccgattttctgtctatgttttttgccatttttaatgtttattttagggatttcgcaaaatttcataagaaaaaaaacaaaatgcctccccctaagaagttaattgaccaaaaatttcagaaaaatccttcaaaagatttttattttttgtatatttttgatttcaaattatttagctttttaatctgttttactatctacctttaatttagctttttttacgcctatttgagggtttttgaacctttttttatcgtttatttatttatgcctataataacagacttttaattatctttttaaataatttagtaaaaaacaaaactaattaataattaattcaattaaagggcaaaacaattggcataattaattgtctttttgaattaattaattcattaatcaatttaagagcaaaacaattggcataattaattatcgttttgaattaattaattaattaattcaatttaagagcaaaacaattggcatgattcttccaaatcccatcgcccatcttttcgcgaaggatcactcgcaaaacgaattttctgccctataaaaacgatcccaataaggtgaattgatcaaaaacaaacaaacaaacaaataatttgtaaaataaaaataataccattccaaaaaatccgggcccaatgtccatttgcctggctctaagcaaagaaaagccttggtttttctgggcctggactttggtccaaaaaatcttttccatgttttacataaaataccaggttcagttgttattttagagaccggattttaaatggccaggactcggtaaatgaaccggaaagttgcggaaccatacatatacaaggggtgtctcaacttcgcccccgcgggggtgaaaatacatccctaagaatggcatttcttgtgataaaatgcaataaatttatacaattttgaatttttttaaacatcttgaccattttttataaaataaagtaattttgctttcttttttaatttatttatggtttagttgttagtgctgcagcactaacaaaatttttgttatgagttcgataccggttgacgttttcttttgaatttatttttttatgattaatgtacaaaaacacccataaaattgaccattcttggcataattcattaacaaattaaactcaatttttaaaaaaaatgtcggtttttttcggttaaaaaccgaaaccgaaaaccgaaaaaaaccgaaaaaaaaaccgaccgatccgatctctagtttcaattatataatatggaccacagcaaaaaattaaaacaaaacgaaacaaagttaagttagaacatgacggcgcactctatgttttcgaccaattgagcgcagatagacttcagaaattttggcgatgtgagtttcatggcccgtcagacaagtgcaagggtatgttaatatattattttgaattttgaaaatcttttaaaattcaggacgtttgcacacggatttaaataacgttgtgcagaagttggtcgtgagttcattcgtgcgacatgaacgctgagcatgtggaatgtcagcgacttgtaactggactcaagcgacgtgctgctgagatgtgcgaagcacctgcgactatttcgtgctcaagtgctgcaaaaaacatgcacacctgtgctagcagctttccgagcaaagcgccacaaaaaagtgggtttatatccaaaaacaattttgttatttttttggttttttaggtgatcaaacgattgcgccgtgatgaaaatgcaccgcggaccgaacctctcaatttggagcagttggaaattccgaatacctatcgtatttacaagcgaactgaaattgacaagaaacactttctattggcggacaccggcgtttttcaaattcaaggacagaatggaccccaacggtgagacatcatttatacattaaatgctgatcattgaaccggtattaagaattctcatttttggaagagcttctacggcggattgggcccatcagatgaaagacatttacgcggacggcactttttcattgacgccaccgcttttcagttggcaatggtcggtgcggtccgcacagtgcttccggcatgcagtgtccgctactgttttttcaccttgtccgcaacatgaagaggcagatcagaatccttggcctcacacatgtcaattgaatttttcagatgataaatttttttcttagtagtttaggcttacaacactgatcatgctttcgccgagaagtctaagatgatcacttcattggcctttctgcctgtgcaccaccttcaaaatggccttaatgttcttcaaggacaaattccaccacaacttaacggcgttttaaattggttaagtccgaaggcgaattttatgatttttttgatttttctaggtttttggacaactacatgggccgaatgcgtttcaatgttccaatggcggcgcctctgttccacccgcacgaatggaatgttcatcagcgcaccttagatggtgctgatcgtaccaacaatttcgccgaggcattccatcgcaaacttcagcggcaatttagctgcactcatccaacaatttggcgcttcattgacacgatcagatgtgagcagaaggcaattgacgcagacatttcacgttgtgtcatgggagaatccgctccacaaaagaaaaagaagtatcgcgaagccgacgcacggattctccgactcgtgcaccgttataacgatatcaataaccagggattctttttttatgtaaatacatgtttttttcctggattctccatagcctaattagtaggaaaaacactttcttttttgtgtttgcgaacaaaaatcgggacttttatttacatatttttacatatttcggcatttttctacatattacatatgtacatatttttatacatattttggactttttcgcattttttcgaacatattttgaaatttttgaggatttttttaaggaaattttcattaaatgtccccaaaaaaaacccaaaatttcacaattttttgtacatatttttaggatttttgagaagtgatagaaatttcatatgaaaaatttaaaattttttttgaaaatatacccctaaaaatcgtttttttcaaaaaagagatagtaaaaagggtgcttctaagcctatttaggtcatttttaggacattttgtacttatttcaccccttacgaagatttttttccaaaaaacaccatttaaaaaattttatttacatattttaagtacatatttggttctttttgtacatatttcatacatatttt

SEQ ID NO: 9706 - DNA, 1019 bp, Heterodera glycines
gatcaagatcagtgagaatcgtcggtgaaatcgcgacgacgcaaatcgtacaaatcatcgccatcggcaaagctcaaacggcgaacgtttgtcgtaagaattggccaaatttctcggacaaaaacatcccaaatcggctcgggcatttgaaatagacaactccaaatcggtgcccattctgtcccaaatcgtgcttgttggcacggagaaatgcaatgacggagtggtcaatgtagctgaaaaaaatacatataacaaaatgctctaatataatatacactttcgtttaaattactaaatctgaagatccttaatacggattatgttgggcagcggatggtccggcaatggaaaatccacaaaattgccatcgatccgtacagagagtttcgcttttgttccgttgtccttgcgaatccttatttctctccaaattctaaattccgtcgttttggcatcaaaatgcgtgtccacaagcgcatcaaaacggtcggaaatcagtgccattttgaggccgagttgagcatggtcaaaggatgggagaatgtccatccaaacgtcgccacaaatccaactgaaatttgttaaaaaaattgggaaaatgaaaatttgtaatttgaaatgaaaatccgtaatttttcaaaataataattgaataattgcttaccgtcggttcatttttgtagttcaattagcacaattttccctttttccaattgattaattggtgcgtcacaaaaagcaaaaaaaaaaaaaattgtgttaacttaaaacagagagaacaacaattaggaaaaataagagagcaaaataacacaaaaacataataactagggaagcaacttttagtgaaaaaacttttttttttgctcaattgttttgaagaaaggagctcaaaaacgcatttctgcgttaaaattttttcatttggacgtcacttttcgtcactagaaatcactattttagcgtttcgtcacttaaaatagtgaaaattcacttttttggcttttatcactatt

SEQ ID NO: 9707 - DNA, 2442 bp, Heterodera glycines
ctcttcgcaaccgaaggaatcgtgtcataattcagatttcttttgaatttctcatttcgcttactttcgtcaattgtcggtgtcctccgccgcttttcgtccttttgcttcacgcacattttgacgatggatgagcggagcatgtccacaatttcgtttccgtttttccccgtctctttcggctgtttcgtttccctttgtgtcgcattgtccggcgacgtttgctgttgcggcggcgcttcgtagacgaccaccacgggaccggtggggtgcattggcttcggatgttttatctctttgctgcgtcggaaattggcctcgctgccgatcactcccgccggatttgtggcgaaccgtcgctgcacaccgtcgtattgtccgattcccgtgctgcaattttggctgctccgatatgttcaagaaagctttggccggtgaaggaagttggttggatggccgggtccggcttcaacggtttgaacaaattttcaacggtcgaacatcgccgggaaattgtcgaatcggtggacatttggtaagacagcgccggaattgcaacatttgaagaaacggtgggcaatttttggtgggacgaagctgaaaaaataaaacaaataaggcggcgatgtaaaaattcacaattcagattgtgcaacaaacaaatattttaactcaaatcgcattatgagttgtgtttcgtccgccaaccccgccctccttcaaaagacagaatcacctgatcaacacaatatcgccatttatccaggaagtcacatttggagaacacctgacggacaaactgcgcaaagcccacccgttgacacggcacaaacgatcgaagtcgttcgggcacgtcgcaattgtcggagcaataaaagtccaagaaaaaccaatgggccaattcaatgtgaaagcagacgcggatttgattttccttctaaaaagtgaaaaatattcagatgattaatcgagtatgactcaaaaatgcctcattattcggaatattatagaggaatcggaagagaatgtcctccatgaccatctccggcacggtcggtccgaaacatttgacctccttgagataattgctggaggacgactgttgctggtggacatttactgggaattgctgctgttgaaccgatgggaaaagcgggggcggtctgttgcttgggccaacggaaggcgaaccaagtgccgataggcaccaccgtggaaaattttgaaaatctaagagacattacgccataaaattacaaattttctgaagaatttttaaaaataagaacaattgcccgaaatcagaacatttgcgcttaggcggtgccatttgttagtattagtgcaggtgctaaattaaaaacaaaagagaaaaacaataaatgcaaaaataattagacaaaattaacagcaaaaaaagaaattatattgcaaaattgaaaaatatttttcttaaacagtacgccaatcagaaatttttaaagaaatttgacagatttttctgagaagcgacaaatcagaacaaagtaagaacaatagcccgaaatcagaacatttcttacaaataagaacatttttattttgtaagatttgaaccctccaaatcagaacatttcttataaaaagaacaaatcacatccctgcactattcgtcactattttggacttttttcactattttgtcactattttggcactttcgtcactattttagttaactatttcgggatttttcgtcactaaaagtcggttccctaataataacaaaaacattttgggctggctctattatagtatagtttgtcccctataatttttttagatttaaaaaaatcgattaaaatgccttttgacgccgagttgggcttgagttaacagtttctaagcaagaaagccaaaatccaagcacgtacatggtatccaagtacgaatccaaaccctggtaaaaaaatttctagtttgtgaaaaaaattacattttattgccatttttcatgtgtttctcaattttgctaaatttcacttttttaaactgcagaattatacagccagagatatgattcgaaatgctaatttaatagctagggcgcaacttttagtgaaaaaactttacacccctaagaatcgacccaaaaattttcaaaaatacactcctaagaaatgaaaaaattttcattttcctggcaagaattttaatttaaaaaattattttttcggtactaattttggggtttttgcccttcaaaatttctgtcctactcattttcaactgcaactagttgataaaaattatttttgctcaatttttggctaaaaattatgtcactattcgtcactattttggactttttgaccctattttttcactattttggcgatttttactcgagtattttagttaactatttcgagatttttagtcactaaaagttgcggccctatt

SEQ ID NO: 9708 - DNA, 1448 bp, Heterodera glycines
gagaaaaacaataaatgcaaaaataattagacaaaattaacagcaaaaaagaaattatattgcaaaattaaaaaatatttttcttaaacagtacgccaatcagaaatttttaaagaaatttgacagatttttctgagaagcgacaaataagaacaaagtaagaacaatagcccgaaatcagaacatttcttacaaataagaacagatacgcgccctatttgctgacgctgcgagtccttttgaccaacgccaaaattattcattttctgaaaaaaaaaattaaatgtaaatgtcggataaacagaaaaactgacaacaaattttttttcttttccaattaaaaaaattaacaaaaataataaatttaaatgtttaaataaattctttctttgttttttatcaatcaaaagtatttgaatttgttagagcccgtcttgaatgtctgggatgcggaattttggaggcagctccaacaaagaatggaagaaatgagaaggaggttagcaattataccattaatattttcaaattgagtttttcttttttagagcagctgttgaacgaaattgagcagctgacggaccagctggcggaggagcgtcgccggctgggaaatctcccagacgagacggtaattgtctaaaagttagtatggctgacagctaaattggagaattgtcactggaattctaaaattttgaattttggttttgatgtgtgaattttttaagcagtgggtgccgccaccagcgggcggcgctcctcccgccgacgacgccgggcagcagcaagagccggacaggatgaattcagaagcgtcaaaaatgtattaattttgaatttgggtttaccggattttgaatttttgggacagggcaaataattgactttttccatatttctggaattttggcagtcatcaatagggctgtgaattttagtgacaaaaaatcccgaaatagttaactaaaatagtgagtaaaaatgttaaaatagtgacaaaatagtggcaaaaagtccgaaatagtgacgaatagtgacaaattttcagccaaaaattgagcaaaaataatttttattcactgattgcagttgcaaatgagtaggactgggatttttaagaccaaaaaacccaaaatagttacctaaaaaaatttttttaattaaaaatttttgccaagaaagtaaatttttgagaaaattttttttcatttcataggagtatattttgaaaaattttagctcgattcttaggggtgtattttttgaaaaaatttttaggtcgattcttaggggtgtattttttggttttattgcatttttgttaaggaattttccaaaagtgtcgaaatagtgaaaaaatagtgacaaaacgccaaaatagtgatttctagtgaccgatagtgacatcagaaccgaaaatttttaatgcaagaaatgcgtttttt

SEQ ID NO: 9709 - DNA, 4858 bp, Heterodera glycines
  misc_feature (1281)..(1281): n is a, c, g, or t
agtttcaagtgaatttttaaataaaaaaactattttatatattcaacaaatatattaaaataaatatcacattatcatcacctctacccgtcatatttaaatgataaaggcacttggaattgaattgaattattcggtagaaggagaactgccctcaggcaaaatccaccctaatggatttagcctaatccaattgcaaccgaatttttatagttaatttttagttattatgccaaatgggaaaactcacaccaaaaccaagaatttggattatttaatttcagaaaaaaatttttcttattaagaaaaattgattttcaaataaaattcattttaatgcaattttatacatgaaaaacttttaaaaatttgaaatttttaaacattttttcactcactaggagtgatttcttgaaattttggatctttggggatgtatttttctaatttttttgaaaatgccgaaatatggattaatatataagaaaacatggacagaaatatgaatatggaaaaataaagcccgctaaaaatgaattgtgtgaagattcagaaatttttgtgactctttgaatttgaataaaatttcaattttgagtttagatgcatatggataaaaaataattggaaactttgcaaaaaataatcaatccatcatttataaacgaacaaaagaagggaaatttgttgaccccaaagtttgagagtaaaaaaacaaatattgatgagaaaagaaagaaggagcgagagagagagaatagaaatacagaggagaataaagagagaaagaggaagagagagagatagagagaaaggaagaaatgaagagataacgcagagcgagagggagagacagcaataacgtggaaaagtagcagaaagagagaaaagtaaatgagaaagaagtagcgagagagagagagtgaaagaagtacagaggaaagtaagagagagaaagagggagagagagagagagaaaggaagaaagaaaggcaaaaaacgccggcgtcattttgcatttgcctattaataaacgcccaaatccttgtttctttttcccaattgtttggggttaacaatttctacattcttttttatttcaattcaacagaaaaaatgccaaaatatttaagaaaaatattagccaaaaatgagaaatttagagcaaaaaaaattgaattctctttttattttaatataaaaccaaaaaagtaaaaaaaaaatcatttattcaatgttgcattgcaaattaattacattttcagccttttcttggtatanagtagagtgcagtgggaccgggaattttgggcttaaccgggaccgggaccttttctggttgaaaaaccgggactttggggggtcgccggcgagggggaaaagaggaaaatttctgaaaaattggctattttcttaaccaaattcattaaaattcttaaatttttccccggcggcgcttatcagcaccaccgcccccctgtcccccaaaacctttttttcttaaaaaattagcccaaaatctcaaaatttggtcatttttagacaaaatctgctaacaaatagcattaaaattacaaaaaaaatttccggcgtcgcctatcggcaccaccgccccccccccaaaatttttttaaaaaatcgccccgcaaaaaacgttttttaaaaacaaaaaaaaactcgtcgatttgctaaaaaaatcgcaaaatttggcagtttttggtgaaaatctgttaacaaattgcactcgaattttcaaaatatttccccggcggtgcctaccggcaccgccggcccccttttcgcggaaattttcttgaaaaaagcaagccgcaaaaagtgcttttgaaaaaaaagtcgtcgatttacatggccgggaccccttcacaaaaattttgggttgacccccccccccctttttccatgtatgttttgtttttatatttcgctttttgaggtgtggatgtgcggtgggtccatcgaagtcgtcccctgctcccacgtcgggcacattttccgtgccggccacccgtacaacatgacgggccctggcggcaacaaggacgtgcacggcaccaactccaagcgactggccgaagtttggatggacgactacaaacggttgttttatgtgcacagaatgggattgaaggtgccgcaaattatgaattgaataaacaaatttgacttctcttcttttaggatgttgaagtcggcgatttaagcgcccgcaaagcgttgagggagcgtttgggctgtaaaagtttcaaatggtatttggacaatgtcatcccggaaaagttcgtgcccgacgagaacgttaatgcgtatggattggtctgttcggaaattcaattgattgagatccgattcctacttgaaaggtgcaagatacagacgggaaactctgtttggacacacttcaaaggctggagaacaaagggacagtcattttgggcgtttgggagtgccaaacgggcggctcctcctcacaggtgacgaattttctatttatgctaattccaaacaattaaatgacaacaacaaacgaataaattagacgaaagattttttagaaatttctaatataaaaatcagagatcaaatgtaaaagtggtcaaaaatcaactaatttttgaatttgggcacattgcaaatcaaagcaggcgtcacctccgattacgtcgaggcattagagatgaagattttcagcacattttggatgacattcccacctgaaaattgaacacgtttttactaaaagtggaaaaaactcacagccggggcaattgatgtccatcttttgggacaccttcgtgaacccgtccatgcacccgattgaacatccgcacgggtagaaaaaagagttgaattcacggcattcgtttggatggcagaactggcagtcgatgtctcgttgtcggatggagatcagttcctcgcctaaaccgaacagtttctaattccccgccattttatttttacatttttccctgcaggcgtagcattcctccacattttcgtctctcagacactttctgtgaacatttaaatggcagcctaaaaaatgtgaaaattttgacataatttcgcttataaaatgcctacatgggtagaaaagtgtgtcgctgtttggctcaaggcacatcacacactcgcccttaaccagctccgtgttcagtccgatgttcacttccgccctttgctccccactgtcccattgcgcctctctttcttccgcagtccatccacttttgagaagacgcgctttaagctttcgttccaacagtccacagctgctcaaaatgcttagtgtgctactttcttcgtacgaccgcctcaacaccgcctttttgtccacttcgatgacgagagaaaagtctgatttatacggaggataacgcacactaaacatgaatttaaacaacaaaaaagattcgccctgacctgtaccacggagtcggactcacactcccaaatgagaagcgaaccttaaatagtctcaacaaacgattagtttcaaattgctgttttaaatttgatacccggactccgtttccgtcggccaagtccagagaaatggtgaaaatttgaccccgcttcggagcaaccaacagccaattgggtatttcgttcaacccgttgtccacaaaacgcaccaattggatgaaactgagttggtctggcgttgcgtttttttcactcagcagagcacggtcttcgtaaagctcttgcaaagacaggcaggagaagccaatgcggggaagacgcggaaagtcatcctgacaatgtgaaaaccaaaaatcgaaccacaatttgtacctcgaaaaaaatgtggacatcgacgccatccgaggacacatcagcgcacaattcgttaacacatttccgggaaattgcgaaatgcgcaaaacattgaaactgaatgtatggctcgagcgatgtttccgccgcctctttccgaagaattcgcacatttttgattaggttggtctgtgaggaagttgaggcaccgctgtcctggttgtcttggccgtcgtcactcaacgtgtccttttgtgactctgttggctctggggttttattcagaattggaagctttttctcggccggaagaggccttgcaaaaaatattggcatttcaattcacctagaacaaaaatgccgaatattgaacatttatttgtacacacaaaaagttcagagacataaaaaggagaacaaaattgatttaaaattattgattctttgattcttaacacagcgatcgaaaatgagcccaaaagatttgcatgtgtggctcagtggtttttgtaagatagccaataggaaacgggtgaatgttcgagtctgcttcactttattaatacttttatttatttacttccaaaataaaaaaaaatctatttaagctttggaagcaggcttttttcaaaatccgagctctagcattaacaaacaaaaaataatagattttaatttaaaattattttttaaggcgttcagttggagcaaagatggagaattaaggcgtgagagcacttgtgtagatgtgcaaaaatcttctgccgctgatgcacgttccaaacggaaagccattctcagagaatgcagcagacaccaaatttcgcagtttgaacaccaaaaagttttaatatttattatatttttttaatttgttccgttttaaggacggtccgttgaagcatttgtcctctgggctgtgtttggatgtgcaatcgctgaacgccggcgacgacatttacttcgcccagtgccataatgagaaacaaagtcaaccatggcaatttggcacatacttttgagctttcataattgtaatttattttggtattactta

SEQ ID NO: 9710 - DNA, 1418 bp, Heterodera glycines
agcagcagcagcccactccccacaaacttatcacatgtcatcagtgtaaaaagaaggccaaagcaaagcaaaggacaaaaaaaagagctaatagtcaaagaagagagagattaacagattcgtagaattaaatctcattttattgccatctttttttattttccaaattattaatgaataattttcttaaaataatgaaaagcacctttctttccgatagtcctttaaagaaacagacaacatgaaaaaagattagaaaataaaaacataggtagtgaatttaattattcttgaccaaaattcccgactctaagatttcaaaaattccaaaggaattggtttttgaaatgtcagcttttttaactactaaagaaatatgacaaaaatttggaataattatagagcttcctatgagctaatagagtttctaattagctagctgtttacttattataaaattagcgtaccaggtgttttcgacagtgattggtttcgacagtagttgatttcgacagtactttttaattaattttctacataatttattgtataccatgaattagtattaatatataatttgcatatacaaaatttataattgaagtaagtaatacaaaaaaaagatttgtataggattttttgtcaaaaatcatgtgcgaacatcttctaactaatgtcgggtttgaatgccaaaatgcaaatctgtaggctcttatagctgaattcgtaaacgcaacaatatataagagcctgtgcttatcattttaattttaaaaaaataaataaactttatttatttttttatttatttattcaagtaataaaagtccaaaagaagggacaaaggccgcttatactttcggaatttttaccaaaattagcacttatttgttaggtaatttttggaagttttacattaaaaaggaaaacttttagaaaacacatcgccaaatttgcagcgactgaattgttttgtctgtgcgtctgctttttctcttttgttgtttaatggattcttgcaatagattaagcttaagcacatgaaagttgacttaaaaaatattgtgaattttaaatgatgttttttaaatttgcgattgattaatttttcattgtttggattatccattcgttttaatgagttaataatgactcccctaaatttgtatttactaatgccttttgttggcatcaggttttgtacacattttgaattcaaatcgtaaattcaaaaatggcggaatatcagccaaaaaaagaaccacgtgagcatcgctattcgttacgcgtttcaaaattgccatcgcgttaccgtgaaaatgtggcggaaagggacggggcacaacaacaacactttgttcagcagggcacgtccacacaaatagcggcgactggctgacaccatcacatatcattag

SEQ ID NO: 9711 - DNA, 1696 bp, Heterodera glycines
aaagggattataataaattaaatatttgaaattacaaaatggtctaataattgtttaattccatccaattaaattattttttacagccatccaaaaatggtgccgaaacacgaggaacgtttggtgccattgttccgctgtgtggacgagttgttcgacaatgggctcgagtttcgaaacagcagatgtgaagaggacgacgatgatgttggaaatgtaataaaaaaattaaaaataaatcaaaaattattgctataatttaatttattttgaaaaaaaaactaaattttttttttaatgaaatggcaacaaaaataatttataaatttaaaaatggaaaaaaaaattgatttttgaaagttctttttccttttcattttttagcatttttttttgcgatgagcaaaataaaggagccagagaaagatttaaaaacttttaattaaaatttttttgtctttataaatttatttaagattttaaaattcactattttttatttttaaattatttttttgagtttttaaaatttttaaaggcattgaaggactgactgactgtttgctgatgtgcccgattcggtcggtacttcaacaacataagccaaagcagcagccgcaccaataacaaggaggacgagaacatggccaaaatgagggcactgaacgaaaaatatgccggcgcagagcggacaaatgagcaaaatgcgtatgaaattgacactttttggcactaaattaatcgggaatgaacatattattatttaattcctttaacaaaattggcactataaaaaaagacatttttgtatttgagaaagtgtccagaaaaatgcaaaaacacaaaaattcacctttggcacataattaataatggggaatgtcccaatttattggttaatttttttttataaaatttgcaccataaaaagacatttttgtatttgagaaagtgtccagaaaaatgcgatacacaaaaacttttttttattttttataattctattttttttaatttttgaaaattttagaggctccattttcctccaatttcgaccgtctcttccgtcgtcccatcataaattcgcttgtcccgcaatttgtcatcataatttttttttaatttccattttcatttttcaccactctaccacaaatttctgtttttctgatgatgctgcacttttttttcaaaaatttttttttttttgcctttttaccaaatgcaaaattttgcctttcccaaaaataacattctttcatttttaaaaattattttctttattatttttatcatttattttatcatcattttatcatttgcaaacatgacacccattcttttgtagacaatttatgtgttgatggatttggaattttacatcaaaaaatgtgacttttttatctccctctaaaacagataagaatgttggaatccaaatccaatgaatgcaaaaaatgatttaaaaatgcaattaaaagaaaataaaaaatttaaattcccattccatcactgtaaattaattaattaattgtttgtttgttaaattgtattttttgtaaaatagcgcgaaaaagagtggctatggtctttgttcggaaactttttgtgccttgccaattttcccgccttttcatttttattattttatttattttattttattcatttttattttaattttcaatatttcccc

SEQ ID NO: 9712 - DNA, 4429 bp, Heterodera glycines
  misc_feature (4251)..(4251): n is a, c, g, or t
  misc_feature (4362)..(4362): n is a, c, g, or t
  misc_feature (4400)..(4400): n is a, c, g, or t
attcactttgtattgtgtatttctatttcaattcttttttccataaaattgtaaaaaataaactgttatggtgattgcataaagagcatgaagaaattttgccaaattttcataatttgtatgtatgggtcaagagtgtccaacaaagggcagaattattttaatatttaataatggatggcttaggacctttttcattttattttcattaaaatttctaatatttttttttcattttgtggccaaattggcatataaaattttatttaaaaagtctcttccttaacgcaataataaaggaaaaagaatatttttgttttaaaaatttgttaaattaaaatagtataaatattttaggttttgaaaataatgaaaaaatttctggtctctagtcttgggataaatgaatcgagaattaattcccgatagatgacatccaaagaattggccacttagagttgaagccgagaccgagaacgctcaacgaaaatcaaaaagcgagaatccgtcttttaatatacatataaatgttataatagatttttaaatatttttttaaaattaattttttccaaattatgctacaaaattttttgaataatcaatatcaattatgatcaaaattcttgtagccgtcaatttctttcatagattttttccatcaaaatccaaatttcttccacggatttgcattgaaaaggagttgttttccgccaaattccaacggttgtttcatggcatatcgttgtgaaattggcaagtccatcgtcaaaccttttgcatcctaaattgacaaaaacattatcgaatttaagcaaaaaaaaaaaaaaaaattggaaaaaattagagattacaattataagttttattaattttatttaaaaaaaaattattttttaattttcaaacgttcggcaaatttatgtcgttaaccaaatgaataattaatttatagactcaaacaaacaccaaacatttcgcgagtgcaatttgattaaaaatgcaaacatcagactatttaatttacctattagaaaagtgagtaatttctttgtgcaaaacatgtaaattaatttttctttttttatgactcattatcgtgagcttatgaaccggaagtttggtctccgccaaagccgcgattcgtcacatttaaataaatgttgtaaaaatatgacaacttttttcataggctggcactgataaaatcgaattttatttttttattaattacattataaaatgtcctcttatggcgccgaaaagtcagtgcttaaaactgtggcacatgggaaggaacaaaaattttgagaaaagtaaatggcaaaatttgtttttattttgttgtgtagagttcagcgggaccgagattgatctggattaccccggtttcttgagtctcgatccaggtcctggttgaaaatcagggtcacggccccggtcaatcgcgtgtcccggtttttccataaatctctctcatcccactcaattcttgacaattaaaattatttaaaaatgaaattttgtgccagcattgtcgatgtgccgaacaatgatcggctcgatacttgctggtgttgagaagtgctcccgccgatcaccactgggtcaacagattctttggattgatcactacggctcagatccagatcagcgcggaactcgttgattgccggatgatgcacaaacatttcatgctgtccctgggtgcgcaacagacattggattggcgagaaatagcaaggccgcctaaattggttgttataaataagactgatcagcagatttctctgattttcaataaacattttttaggtaaagcagataaattctaacctaaacaattataaattctgcaaaaaaaaaatcttttttcttcttaaaatttatataaattggtaaaaatcaaaatcaaaaatctaagaaaaagcgtttaacaaaatcatgcatttaaataaattttattacaaatcattcatgggcatcaaaaaaatgaattatgaattttaaaccaataatttatttgaattcaaaaattctttatcgaaaaaacagcaactttctaaaacaatttttgttgccgactttgaaatttgataaaatttttacctaaatttttttcaaacaacaaattttgataaaaccgaaaaaaagaacacaaataagcgcttcaggggcgttttgtacataaagcctaccgcatgggcaacagtgggctgttgatgtactgttgctgcggtttcagctcctcattttcctgttgttgctgcattatttgtgcctcggttggcaccaagagtagcagctggcgcgaatcggcggtgccatctccatgctctccttcggcaccattatttgatgccagccagcgattggtgttgtacgacgatggtacaatgtctgacagacgacgaatgtacgcctcgctgatgtgctggtgcaattgtgccaagattagcagcagcatcggtagaagcagagccatgggttactaatcgtggtaattggtgtataattgatggaataaaggtgctaagaatggcttagctaaaatttcgagatgaataaaaattacaattaacgggcacataaatgtcggtgaaatgaggaacaaaaatccaactaaatttgtatggaattataagagtgcaatctaatttaaaattaaagtcttaattaaaaataatcacctgtattaattgcttaacacatacaggccacattaaatcaattattgtaaattaattaattaaatttaaattaattactgaatatattagtaaaaatgaacattagttaatgtgttttttatgacgttgtttgacgcttataaaatgaaaaaattcttagtattaattaagtcaattagctatgagctaaaaaataattatattaaattttgcagccttattggcaacggattaggtcatttttatgccctcattagaggcatttaggtaaatattaaacctttcttacagagaaaaaaaatacatgtacaatgacgaaaaaaggaaaaaagtaaatttttaattgggttattaaacagaattatttaattataccgaagaaaaatggaattaaatggccgccttattggtaattgagtgatcatttagtgttaatatggccagagaaaataaatatatatttttagaaaataaatgtacggcatgtgactaaacaggaggattgttttatgtgccgccaaccaataaaatgccaaaaaggcactcattttggcacatcaaataaatttagagcgtaggaaaaatgcctaaaaagggataaattatgttagaaattggttcaattcaaaaagtttttatttttgcttaatataaaaatacgaattaatatatggacataattttttagacaaaaaaaaatggttaatttttttttgaaataataaaatttttttatattagttaatttttttagtattttttagaaaattttctctacagggtttggcaaacatttctcatctaatgggccaaaattgctgttttaatagaaggggggagggatgttccaattgagaattgttatgaaaaatactaaaatacgagaaaaaagaaatttaaaaaaaaagtgtgtatgccccgtggttatgacagtgatggcaaaaatctgtgtgaaattcacggtgtccgtggccttgaccacgaatgaattattgggttgtaaaataagtctttgcatagtgcccaaaaaatacatattaaaattcataacaattcaagtaataaaataaacttaatcaaactttgccagattattcccttataggtattagccacagctttacgccatttgattagtgttttcactttggcttaaaaaaattatggtcccgtaaattggccgagatcttgcaaaaaccactcacatttcaggaggcatttctcagcccctattttctttttatttgaataacaaatattttcctgaaaggcaaagttagaagaataatttagggcgaaaagaaatttcataagtaatttttttcattttttattggagattgttttcagaattggcccaagagagatttttgagaaagggggctttttcagaatttctttcctattgtttcaaaaattttcaaaaattcggtgtatgtaaagtttaggtctgatcataacaatagcaagaaattttgggaatcggtctcttattgaaaaagttatgccatccaaacactttttggagtttgctgattcaacaatttatgatgactcgtgngaatttttttaagaaaatctgaatgggccatgagataaataacaaatagcccttataaatatacataattggttttttaatttggctgagtctcggaaagaaaatcattanaaaatttcgaaaaatacatttttggaggttgaaattanaaatcataaagttcacaactcaaataaaa

SEQ ID NO: 9713 - DNA, 5503 bp, Heterodera glycines
ttcaaccccttaatatctatttatcttttgaatgtcatttattttgctcaccaatttggcgatcatacgtagcccagggttaaacaccattttatcatattccagccaaatgttgtacttggccttgtacatttcgatgaatgctctcttttcctcctcatttctcacctccgacggccagcccgacgcctccacctttattttcaagaacatgcgcacatatcctttgaacagctgactgtcaaattgctcaaagtgataggcccgatagaagcctattactctatatcccaacgccaaggatttccgcagttctatcgaggtgaatgtaccaatcaaagctctccgctctggccgatggttacattttttgacatccttagccaactcaaactctttcttcgtttttttcgcacatgtataacaattggggaagagaagcatattatcaatatgcatagggaggagaggataaagcagttcctttggggggatgaccttcacctttagcaggccatcatagggcacatcgtcgggcaccgtccaattcacatcgaattccctgctcaccacaattttatggaccccaaccggataaggggtgtcttaagcgaaggaaaatttcaaaaatgcaagcagattttttaccataattcacaaacggatacaagcttatgatatcgaacatcgaaatctcaacttcttcggttgcttttgcgtacaaacaaaaaggcattgtccgtccccccgcgtaagcatccctcggatttattggacccttatccggcacagcgtcaaagaacctcttcatctccctattttttcaagttctctttcacatcgcattcctaaatttgttcaataatcaataaaatttgaaattggcacacccaaacttcctccaccgagaagtttttacatttttccctcaaaaactccattcgtgtctcagttcgtcggaaatttacttccatacaacgcccattgggtcctatggtccaaggcaaaaaacattttgggcatccatgaaacgcacaaccctttagcaaaaaataaaatatggaaggaaattctgcctacctgaaattcaatgatttttttctcagctccgatgatacaatccacttttaatcccccgatttccacttcacccccattgcatgcgtgtctaagtctcactcttttgctttgagccaaccattcaaaatacttcacggcaattttgctctgattctcggctctctcataaccgccttccggaataattgggagatgattttctctcaaaaattttgttcgaaaaattctcatcacaacccccgcaattgttacactgtccttcaacacatccatcccatcagtaatctccaaaaacaattgccggaatttcaaaattgcctccatcaaaatttcgacgtcattttcgcaataaaccttgagctgctctcctaaaattcaattttaaaaggaaaacagattttctctaacctagctcaaattccattctataattttcattgtgccattttaccaatttagcacattcctcctccttcatattgtccggacaataatcttcaaggggtggtaggtgtgtcaatttttttccaaagttcacatttttgttgtacttatgagggaagtacaactttgctaaggttttcaaacccaaagtctttggaagatctgccaacttgttttggctgagcagccagaaatcccgaaaatacacaccacgcgctttcatttgataaatcttcaggtctgccatcatcaactcagtttcgacccctctttcagtcagctcttttaacacaaaatgcgagtcgaaccttccagcataatgagcaaaagcaaccgtttcaaatcgtttaaatcccaaaatccaatcaacaaattcgctcatcggttcaaacccatctgctacagaccaagtgatcatccgcggaccaatttcgcattccctctcttctcccacacaaacactacaagtatgcgcggcactaacaagatttggtttgtgttcgccccctacaaccgtcgtctcgaggtcataagccacaattcggtatgctttctgctgtcggagtttgatttttttaatgaaacattgccgacccggatgatagactttgcaaattctacagaatttctccccgcacgtgtgttttgatcgtgtttgatatgtttccccacatttgttgcatttcttgtactccctagaagctgtctttttgtgagactcgaaacaatcattgttgtagaaattccgattgcattctccacagtgtatcgcctcacaaacatccaaacaggggaacccgaaccccatccggcaacactttttgcaacgctccctacattccattcggtgacggtctttggtccaaaatgtcacctcacagcttacacaaaaatttttgacggcgaaaaattgagtaacagattttaaaccatcccaatgttcgccctctcttatcacacaaacttcgttttttcttactcccttccctttgaaaattggtctaagtccggttttctaaataaaacaatcacaggcagtttaggaaatgttcgtttaccatatcaaacgcaacgatacgaaatatatctgggaattctttgtcccaaaagttttgcacaaattcgaggtgtttaagcccaaaagttttctcctgtgtatttatcccagccttttccatcaaaaccaatgctaattcatgttgttttttccctgttttcatgatatgtcggaatttatcacgagaaatttcacgtccaaccgtttgataaagcttagcgaactcaagtgcataaaatatacctaaatattttcataaattgagtttcatttttcttctcactaaattttccctttggtgttggaatacgccctagttctttgacatcagcaaaaaaagatgagttgaacattattaaagttaaaagcttagatatttgaaatggaaattttaaagcagaaaaaatgtacatggcttaaaccaagttttttcatgacacatttcaacaaaaaatttatttcattaataaggcggtgggtattctggaaaatcatcaaattcttctggttcttcttcttttgtccaataataccatgctgcacaaagaacaaagagcaccagcgaaaccagcaaacacaacatgagaagcatggcaaaggagaaacccaaaaggaaaatgagaaattctgacatttttgctgaaaactaattaaaaacgcgttaagaattaacaataaaatagcataaaaccactaaaaactaaaaaccaattattacacatttaatccgttgtgactttcaaaaaccaaacgagatatttttaacagatttttccattcttgtttctgtgacatcagcgaattgaaagtccctctgagacgcttttgagcccacgacgacaggagatgattgctcaagaagactgtagacaattttgaggaggggaaggcttcaattatttcaaacaatagctcagggggcagtggcattgttagctaaaaaagacacggtggcattctctaacgataacggcacagaaacacaaaaacgaaaacgaataaatgactaaaatcaaagccaatccaattattttttcgttattttctttctgattaatttctgtgtcgtttaacattttcctaaaacttaattctgtcacttaaatttttaggaatcagggaattttctcaaccctttacataaaacgatcaatcaacaaaaaatttattaacaaatgcattctgttttctcattaatgtgggggtgagcgggggtcaattggtctcccaatccattgttgtcttggccaacggatcatttgctgtggattttgccccaacggattgacaattggaggcgcctaaataaattcacgttgatgattttgggtgttttgaaagttccgaacttgaagagcttcgttcctttgtgcgacgggcgggacgcgaacgatgacaggtgggaaatgccatggttggggcggcacaagatgagcctaaatttctcctgtcttagaaaaaactgcgggtttaggacctgatggggcagcggaagtggtaggccgttgattggatgatggtgatgttgaacaggcacaacatgacgcaacattggttgcccctaagaactcaaagcggtgaaatttgggtcaaaagaaggcgaaaaaggtcatgagtttttacctgatggggcagtggatgtggtaggccattgattggatgatggtgatgcggaacatgtacaacatgacgcaacaacggtggcccctaacaaatcaaagatgagaaatttgggtcaaaataattcaaagttttgacctgatggggcagtggaagtggtaggccgttcattggatgatgaacatggtgatgcggaacaggtacaacatgacgcaacaacggtggcccctaacaaatcaaagatgagaaatgttggtcaagagaaggcgaaaaaaaggtcattttttgacctgatgaggcaatggaagcggtagaccattcggtggaggttggacatggtgatgtggaacatgaacaacatgacgcaacaacagtggcccctaacaaatcaaagatgggaaatgttggtcaagagaaggcgaaaaaaggtcatgagttttgacctgatggggcagtggaagtggtaggccgttgattggatgatggtggtggtgaacaggaacaacattacgcagcattggttgtccctaagaactcaaaagtttgagaaatgttggcacaaaatagggtcaaaaaacagtatccaacctgagggggcagcggaagtggcggaacattgacaattggaaaccggatggggtgttgtggggcacggagggcgttgtatggcattggtggaccctaaagcccaaatttgacaatttgtggcaaagcaaaaaacgatttcgatttcgacctgacggggcataggaagtggtcggacgtgcagaagagggtgttggacatggtggtgcgggactgggaatacacgatgtggcatttgtggaccctaagacccaaagctgtgaatctgggcaaagaaactcaaaagcctttggtttctgacctgacgtggcagtagaagtggtggaaaggggcggcgaacagggccttgacgaaatgccggcggcacccgggcaattggacgttggacagctcgtgcgccaatgtccagttcctgtctttgcacaatgttttggtgggcggcattgccgtcaccgtcgtcatcgtctgagcttacatcttccgccggccgattgcctaaatttttgggggataaaatggccaaccatgaaaccgtttctctcattgtcaaagcacaaactcaccctccacaacaggaattggtagtccaacgattggtcgcggagttggggccctcattcttttgggagatgttggtggagttgggtcacgtcggctgcgttgcatgttgtgccagtctttgcgccttttccttcaaaactggttgataaaatacat

SEQ ID NO: 9714 - DNA, 2574 bp, Heterodera glycines
ttggaccctcaaaataaggacaatcttacaaataaggtaaacgagtaaccctagttgtgaagacttgaaagcaaggggttggtttttctaaatagtaatgaatgttattacttaaccataaaaacatataaattcgaaaacctaaaatgattttttaaatacataaaaaaattaatatttgaaaaataattaaataatttatatgaaaaaaaacaaaaaaaaacaaaaatagatgttataatcttgaaaaatactctcaaatacaagtatattgcaaatacaccaaatctgagtcagtttttaaatgcgcaagtggcaagtatattaattaaaataaaaaaaattacactcaaatatttatttagaaaaattagtcaataattgagaaaaaataaaaccgtttaggaagaaacagttactcattataaaattaacattaaaatagatgatgaatgtacttttaaattttaaaattcaaaagaaaaataatatatataaaaaaagcatcatagattggttatatggatgatataccccatgcatgtattataaataaataaaaaaaattgaaaatagttaaataaaattattaaatttgattaaataagaataaatagtaatgtaagatttaataataaatatagtactcaaatatggttgaaaaattttaatctatttccatcaccgatgtattgaatttatgagaaatgaaattgaaaaaataaacaaatacatcaaaaatgagaagatattgaagaagctgaaatttaaatcactttctatttttttgctaattgcgaattgaatgggagcttttaaatgatttcaggagaaaccgaagtaattatattgtttaaaatttaaaaaaaactgaaaacagttaaaatttgattttcaacaccaatatccgctaaattctttaaaaatatccaaataattaataaacaaaatatttttgaaatatcaacaagttatatttaattttctttagttgggcgtgtacttatcattattgtagtgccaagaaacaattggggttatttttaatatgattcttctggagtctaaataaattagaaattattatatgaaatttattgtttgatatttcataaataaaatgctaaataattttatattgttattttatttcatttttctaagattcaaaattataaattatataagggaaatattaatttaaaataaatttatgtagaatcattttaccaatttattattaaaaatttattttctacgttaaatttacaatttgatcaggctttttttagattcatatccttaatttatttattaccaaaaattgttataagatattcttttattgaatatttgagctttgtaatattttatttttattatttattttttaagttttctgatattcttttttttggtccaataaacatttgtaacctaatttaaaaatcgttcatgtattttgtaaatcaatcagttaagacctgtgttgcccttgataaagcaatataaaaaattattttaggtttgtagtcttttcacatttttaagtaaattaatttttccttaactctttttcttagataattttattaaactttttgttttttaaaatcattaaaattttgtagatttaaattataacatcagctgtccgacctgctttcccaaaaacgtgccgccctcaaacgggcccaggacgagttagccgaggcggaaaggaccaaccgccgcccgactccggcccctgctggacgaccacttcctttggctgccatttgcccttcctcacccaaaaaatccgccttcgccaatcgcaatgccacggaagcagcaccggacgatttgcgagccatactccatcgacaattcgctcgcctcgccactgatcaagaggctgccgcccaatggacagagtgccgaaagcgcgaaattgccgaggaagcggaacgaatgcttaaaaggctgaaggaagtgatcgtcgactccatcgacattcagcgacaactcttaaatgagcaggcggtcgcctttcgatccatgcgccgaagtatggaggaggcccccgacaccgaagacgaagtcctctccgtgaagtccgtctcctcgagcgctggtttacctggtctttgcgcggggagtgtcgccaaagcgacaaaagaaaaaaaggacaaaatgaaaaaaattgtgttgattggcctttggccggtgattcaattcgtttgtttgagaatttgattgttatatgtttcccaaaaatctgtcttcttgaattaatcatctttctttttgctctttgttccccatatttcgctactcccacacattttttctcctatttaaatgcttttcacttcttttgctttacttcaccatttccattgacttgatttgttttaaattttgtctaaaagtgaccaatttttattttaattcagtttttaagaaaattcgccacggcgtcacaggcgttgtgcgatttatatgtagaatattttagacagaggccatttttatagaaacaataagttgaattatactattgttgtgtagtgaatttattatatatttaaa

SEQ ID NO: 9715 - DNA, 1285 bp, Heterodera glycines
atggtctttttccatattcattcactttatcaacaacacaccgcagcaatggcatttgctccttcattggttattgattaatttcctctgactcatcatttcgttctccacttttaccttttgaataaatatttgtctttactattttgttgtgccaaacgcacgacacaacaactggcgcagtcagcaattcttttcaatttaaaaatcattttgagtatttgctattagcggggtgatcagacgaacaaggatttggcacttatttatttattttttttttcttttatcaatcacatcattttcatcaaattgcctaccttagcccgtaacacatcgttctcgtatcgataagccgtaaaaagcctctgtcgtaaaacgagacgaaaagcagggcgggaacactcacgccgtaaaaagcctctgagtgcactttcgttctgaaagtcatttgtgtggacagccaagtcacggcggtgaccgctggttgcaactcacttgtgcgacttccaacagcaaaaggcaattatctgatcacattacttcatcaatcactcacttatcaagccaatccgtcgtggtttctgaccgaagctaagcgaaatacttattttggactcaaacaaaaacatttcaaaaatcaaatcactttctcctttcactcatttcacctaaatctgagaaaattttaatcacgatcaaatgcctgccgaacaagcaacggatctcaaagacattctacaggcgatccatgcgcttttacaaaaaagcacacaaccaaacgtcccttcccaaaattcagaaatggacttgttctgcaaactcagcgcgcagatcaccgaattcgtctacacaccggacgacaatcacacattcgaacagtggtttgaaagattcggcactttcatcgcagatgaaggaaagaatttgcccgaagcaagccgagtgcgactgatcatcaacaaattgggcgccgaggagtaccgccgctacacggagagcattcagcccactgcaccggaaaagataggttttggtgaaacaatcaacaagctcaaagcaatttttcccgaatcaaaatccctttttgtcaggcgtttcgagtgttttcagcttaagtgcgcggacaatgacgtactttcgttcggagcaactgtcaacgcaatggcagagcgcgcaaaattggatttgacgaaggaccaactaaaatccctcatttttatcacagggattggtgaccacaacgcaaatctcagacagcggtcctcaaatcactcgaagagaa

SEQ ID NO: 9716 - DNA, 3747 bp, Heterodera glycines
gcagatcattgcccttcgccacagcactgcagctttggctcgtgaaagaggagttcaatgctgtgcagctgcgcccgcaaattttgaaggacaaaccgagggccagcaaatcgccactgagatcaaggacaaattcaaccaacacgcgacacaacagcacctcatcacaaccaccatcggcttgtacgcgatgcggcggtaatcactggaactcggactgcagtttccaaagggaagtgatttgcaataaatgcgggagaaaagggcatattgcgaaaatttgccgtaatcagaacaacactccccaacattcaggctttaaatattcccgcacaggctcaaataagcaaaatgccaacatcgtcgactgcctgcacatcatgccatccgattggaagacggaaaatgaaccgtacattgagcggcatgttcggctcaatggaaaagtgcacaaaatggtagtcgactcaggctcaaaattgacaatcgtgagaaaggccatttgggtcaaattgggccaaccgtttctcacagaaacaaagctcaagggtcgttcattcacagggaacattttcacatttatggggaatttcaaggtccaagcagcattggacgatggaatgcccctcgatttggaatgttttgttatcgattcgaaggacacactcgatttgatgggactcccatggataaaagcatttgagcgtgcctacaaacaagtggtggctacaactttgtcaatcgaaaatgttgccgacagtcgttggtgcaaccgatcaaacagcacgtcgacgcaattggagatggatttacagaacacatttccaagaatttttgagaaaacattgggactttgcaccaaaatcagggcccatctcaaaattaaagaaaattcatctcccgttttttgtgcagcacgaccaatcccaatcggcgttaagcaagaagtggacaaggaattggaccgtctcatcgatatgggcgtcctgaaaaagaccgactacagcagttgggcggcaccaattgttgctgttcggaaagcaaacggaaaggtacgtttgtgcttcgatttcagcacaggactaaatgccgcattggaaccacaccaccatccactgccacgacctgaacaactttttgcgcagctctccggcgcgaaagtgttttcgcaaatcgatttcaaagacgcatacttgcagatcgctgttgatgagcagtcacgcaagttattaggcgtaaacactcaccggggtttatttgagtgcagtagtttagccttcggaattaaaagtgccccagggatttttcagtgggtcatggaccaattgagcaatggaattcccggagtgcttggctacatggacgacttcatcatcgcctcccgttcaatcaaagagcattaccgaacactttatcaatttttccaacgaattcaggaatttggtttccacattcaactggggaagtgcaaattcctcgtccagcagatcaaattccttagccaaattgtgacaccaaatggaatcaaaccggactcggagaggacaaaagcactgcaagacatgcctccaccacacgatgtctcaactctccggtcgtttttgggtgccatcaattattatgggaaatacatcaaaaatttgcacgaaattcgtgcaccattagactcattgctcaaaaaaggagctaaatgggaatggacacgggaacatcagaaatcatttgatgaagcaaagtctgtgttgctgtcagacttagctcttacacacttcaaccccgatctcacaatcattgtcaccgccgacgcgagcaacaaaggaatcggagcgacaattcgccaccggttcaacgacggaaaagagaaagttttccaacacgcagcgcgaacactcaccaaaacggaacaggcctattcccaaattgagaaagagggacttgggctaattttcgccatccaaaaatttcatcaatttatttttggacgaaaatttattctccgtactgatcaccgaccattgttgggaatttttggctctaagagtggcatccccatattttcagcttcacgattgcagcgttgggcactgattctgctcaactacgacttctcgattgagtttgtcagaacggactgcacaggacaagccgatgctttgagccgactgatcagcgaccaacgatcaagctcaaaagacgaagacgtcgtcattgcacaattgttggccgacacggaagcagatgtggcacatgttttcaacacgcaaacggaacaattgccactcaccgcaagggaaattgccgaggcacagcgcagtgacccgctgatcagagaagttttggactgtacaatgggacgatggctaaacaaaggcattaatcccgaaataaaaccatattttactgtccgaaacaatctgtccataatctcagactgtctcgttttcaacggacgtacgatcattccacaggcactgcgcgatcgaattttgaaggcacttcacctcgctcatcctggcatcgttcgaatgaagagcctagctagagaattggtctactggccgtcgatggacgccgacattgaatcacttgtcaaacgctgtgttccatgccaagaagccgccaaacaacccacaaaacatcctctccaaccatggccatcaacaacatccgttttcgaacgtgttcacattgatcttgccggaccatgcagtaatggtagaacttacctggttgtaattgacacttattcaaaatggccagaaattttccagttaaacaatacttcgtctcattcagttatttcacagctacaatggttgtttgatcgttatggtgttccaaaaacgcttgtgtctgacaatggaccccaattttcgtcatccgtttttaaggaattttgcaaaaataatggcattaaacacattttcagcccgccatatcatcctcagtcgaacggagcagctgaacgctacgttgactacttcaaacgccaactcaaaaaatgtagtggtgactgaaattggcttagcaaatcacttctctcatatcgctcaacaccaattgctgttttaggccaacgctcaacagctgaattgtttttaggccgaaaattgcgcacaaaattgtcactcatgaggcccgaaaccattccaaagcaacaacatcacgaacacacgtccaaaatgaaattgcaatttgacaaaaagcacaatgtaaagccggtacagtttaaaattggagagcaagtccaatttctcaattaccgaaatggcaaaacactttggctttttgggcgcattgtttcaaataaagggctaatttacgaaatcctttcccctcagcttggcaatcgaattgtcacgcgtcatgccaaccaaatccgaacaacaatggcaagagaggggacgaaacatgtccggtcgccgatgacatcatctttgcgagggaggagcatggaactggaaatgaaacgacggacgatcaacagacaaacacgcagccacaacaacgggcagcgcaacaagaagaacaagggcaaaaccaacaaccacttcctttgcgtcgttccgaacgaacgaggaaacgtgttcgttttcttagtccgacgcacactggacagagttacgatcactgataaatcaccacacacattaccccaaaacaaaatcaaatttttaacattttcacttaaggggggaggtgttgtgtagtgaatttattatatatttaaattcacgccaaaatgat

SEQ ID NO: 9717 - DNA, 1147 bp, Heterodera glycines
atgttaatatttgggatactaatgtccattggtgaaaagttgtctaaaaattaaaccccaagtggacccataaaatacaataaatttttatgcaaaatatggagtcggtggttcagttggtagtgtcgctgaactgacaaaaaattatttaaaaacttaactctgctgaatgcctaaactgtgacaatgatgccattgcataattgggtaatttgcgtctgatcgtttatgatgcataaatatgcaacaatttctgagtcacagcattcttttttggaaaaatttcattcaatttttagtttaaagaatgggataaatcctctaacagtcagatttatagtttaatattcggatcaaaaaaggacaaatgtttgattcccgtgataatgtccaacttggttttcagctgctctcaaccaacgaggacgggttcatttcgctgatggatttggagacttgcgacaccaaggacgacctgcgtctgccggtttgtttgttgtgccattttatctgttaaaaattatattattttcccgtcccactttaggaaggcgaaattggtgaccaaatcaaacaggcctacgaaaaggacgataacggcattcttgtgagtggcacattagttacaacataacaagggaaaatgtttgctcgtaactttatgccacagaacccaaataggaaaacaaaccaccaatcattttttggacgcacaaaatatattttaaattttcaatttttgttcgctttctgtcttactaaatttttttgaccctcggaatttcgtccttggccttttaccaaaattttcgatggaaactttcagaacatataataaaccattggcaagaaaagaaaattggattttcttcagtcagttaagccaccgaattaaattccccgctggttcgtttggaattaaagccttagaacaaattgtatcttttgcacaccaacgctataaattcccatccccaaacaaggtgtcggtggtgactgcgtgcggtgaggaggccatcctcggctggaagttcatgccaaacaaatagttggaggacgacgacggcgatgacggagggaggaaggaagggagacggacagaaagagaggagagagggtgttggtggtggtgatgtgatggttgttg

SEQ ID NO: 9718 - DNA, 2870 bp, Heterodera glycines
aaaaatttccgggagcgggatcgtgagttcaaaattttccgggacgggagtcccgaacgggaatcccgtaaaaatcccgctcccgttaaaaatcccgttcaccgaaaaaagcgggagtcgggagcgggactcccataaaatcccgcgggagtcccgatctcgccggactctaaatttaaatgccttttttggcgttttgtttcaatttgataattcacgaatttgagtcttgcgtttttcaagctgtgattcaacattcaacctgcagcagagatccgacgctttattcaatcccttttgttaacatttaaatcgatcaaaataaattttttgaaacttttggaaataattggtttaacaattagataagttacacactattttattcctttttttataccgatttttacctcctctcattgcaccgtttgtggaaatgacttcacgagacgatgaatatgactatctttttaaaggtattttgtcttttactggccaatttttaaatagtgcgaggatttagccattctcgaacataaaaaaatacattcgggcagcgggggaacaaatcaaaaaaaaaaaaaaacgacacccaccggcgtgtaattttccatccctaatccacacttatggtcgttttgtttaactttgagtcccccccccccctctcccttacgcccatatactaaataaaatggtacaattttaacaaaaacaaaaaattcagtggttctgatcggcgactcgggcgttggcaagtccaatttgttgtcccgtttcacgcgcaatgagttcaacttggagagcaagtccaccatcggggtcgagtttgccaccagaagcatccaggtttggcttttttcattacaatttgcatacctatatgcatcgttaaacgcaaaattttttggaattttaggcataattcgtttttttgccccccccccaaattgtttcaaaagcgaaccaaatttttaaaaacaaagcctttttcttgtttttttgtgtctgtttttctgttcaaatgggtctgcatcggtcgattcgacgccaacaaaaacaactcaaatttaacaaaaattactccccggcattgcactttaggtggacggcaaaacggtgaaggcacagatttgggacacggcgggccaggagcgctaccgggccatcacttcagcatactatcggggcgccgtcggcgcactgctcgtctacgacattgccaagcatttgacgtacgaaaatgtggaacgatggctgaaaggttttcaatttttccccaataaatggcgccaatttaaggggcttttttcttgtacaggaattatgacggatatggccgcaattaaaaaaataatgaaattttcaaaaactttttatttttttagttggacggttaattgtccatttcggcacctttcccatttggttttacgcccgggccaattttacatttaaaggcacggcaaacattttttttttgtttccagaacttcgtgaccactccgaccagaacattgtgatcatgttggtgggcaacaaaagcgacttgcgccatctccgagcagtgccggtatgcacttttgcaaaactatgtaaaaagcgcccctaaactgcataaaaaacaagtatttataattcgaatgtgcaataattttctaatttacaattttaaacaaaatatttccctgccagaccgacgaggccaaggcgtacgcggagcgtaaccaactgtcattcattgagaccagcgcgttggacgccaccaatgtggaggcggcgttcaccaacattttggccgaaatttaccgtgccgttagcacccggtgggcattttaattttcgctgagtttttacaaattttcaatatctggaaggccggaattaggcccccgaaatgaaaaattttcgaaaaatgaattacaaattttacccaattttctcgctaaatttgaccttaagtttccgggattcccataatttttccaagattagtctcaaaagacaaaaaccccatttttgcaaaaagctctcaaaattaccaaaatcacccttttttctacggcgctaaaattggacctaaaggaccaacttttgaggttttgggtaaaattacggaaaaaaactcaggcgcgccgtcaacagagagataaatgttcacagcaaattttttaagaaaatttcattagtaaatttttgtataaaaacgcagacaagtgccgcccgaccgaatggtgccgatcagcagccagaacaacatcacgctgtcctccaccacggccaacaaggagaagaaggcgtgctgttcctccacctaattgtttgtgatgatggaaggatggtggtgatcagaggcagagacagacagacactactgctctctgcgctttttgtggatgttgtcgtgttttttttgtgattggtattatttattttggctgatcggtcgatgctcgagactctcgtggagacacacaattttcactttgatcagttgaggaaaaattcaacatttttcgaaatcaaagtttaaagattgtcgagcatctgtctgaggggtgacagacggacggacacaacatttcatttattttcaatcgactctttttcaccgcttaaaacatatatataaaaatcggacacattttgactgaatagcaaccgacacaaatgcttttttgtgggttattattttggctttattacagttgacacgaccataaaaaaagatacgacgataaaataatttggcaaatttaaggcactaaaactttttctaaaagcatccagaataaacattcaaaaaattgtattctgaacattagagatcggaatttgaaaaaagcctgtacctgtacctgtattctcga

SEQ ID NO: 9719 - DNA, 1744 bp, Heterodera glycines
gacggagggcgtaatccgtcgccgtcgccaccctccttaaagaagcagcagagagacggggaatcgaggacgaagtgatccgaaagcagcagataaggcaatgaatggaggagcggacaagcgcagtttaaaaggcaggcaaaaacggagcaaaaaacggacagagtgtccatctgccgttcccaggcgaagtgaagcgaaactttgatcagaaagtaaaaaacttaggaagcgatgaaatggaaaaggtctccgcccctccccacaaacataagtaatgggaaaacaaagtgggaaaggagagaacatcaagcctttttatttgtattcaaatggactaattaaatggagcaaaaggggcaatgtttcaaagtgtccgcaaattaataagtattaattaattgtctgtcgcaatttgtaattcttcgtatcatcactcggtccaatcagaaaatgggacactattgacaacgcattcggacagcgactgatcagtggccctccctccctcctctctctctgatctccgccgatcagtccctccgaatcggccgtgatcagtcattcgttcgctcgtcagcttctgcctcttacgtcgtcgcctttcgccgcgcacaccacgaccatctccttgagaagtgccaactcgcgtctcatggtgtccaatgtccttgacaaatcagaggatggcgttgttcgggatttccttaggccgttcgacttttggccctcacaatcccggccccttttccggcattgttcggcttttccctccctccgttcgttttgtccgttcccacctttccaattgtgcgttttcctctctgagttctctgaccctttgcgaagtgtgcacttgctccatccgcttcttctgccgcgttctgctcactgctgcgttgttcctcagtctcttcattgcgtagtcgtccatctcttcgttttgttgtccattttgaacctccggcgggacagcagcggaccaactcggctaaaaagggagtcactcgcccattgccatctccaaatgccatcgcacaattcattcgtttccctctccccccccccgggaatggcggagcaggacaaaaatcgcctcccaaaacttcgtgacataacgccgccgcaaaaaataaaataatttaaatcatcaaaattttaagtttcattattttttcggcgacgtttcggccgatgttctgctacaaatgaggtgtgccgttcgtcccaatggtcccttttccgcctccattttcacttgtccgtccgttccgtgtgccgttccgtcctcctcccctctcatttccccccgcatttcgtttcgccgttcgttccaattgtcttccctttggactgtcgtcgtttgatagggcgcggcatttcgtttccgcgcatttcgttgttgtgttgccatcccctcgaagagaataaaatattcaaatcgaaaacgaaaacgaaataattaaaagtaatttaacaaatcataattaatagaaagaattaaaagaatttcactttttattttaataaatttagtttttcaatggcaaaggcaataaaaattggttattatggacgaatttaaatgatttatgataaaaagttgtatgaaaattgggctgaaaaatgaaagattcaatgagaaaatggggaagagaaagggaaaaacaaacggaggacaaaaagtgaatgataaaagggtgcgaaagaatggaaaggaaatgcacaattatcatcattatca

SEQ ID NO: 9720 - DNA, 3453 bp, Heterodera glycines
aaaatgactctgtccgagttacacatttatggtcatcctgtaatcagaatgaccttcttcgttcccttttccctggcatttgccccccccccctccttttccccatttttcaccttttatttttgttgacgttgcgtcttccgtttgcattttgcttcttctcgttgctgaccaactgctcggccacctcctggaacagaatgttcacattggcatcgtttgctgcgctcgtctccacgaaaaaatgaaaagcgttggccgaggcgaaactttgcgcgacatccgtcgggatttccctctcctcttctctgtccaatttgttccctcaattccaatcaattagccctaattaggccgtcaattacttaatttcccactcacctaccaacattctcaacgcccttttgtttgcatattgctcaatttcgagcagccattcgctgatgcaatcgaaggtcggttgggaggagaggtcgtagacgagcactgaaaggggccatgggagacaaagggagggagggaaacaaaggcaaaccgatggcatgcgcagaacggtaataggactgagtgatggaacggaagcgctccttaaaaggggccatttaaagcacttcctccgtcggcattattcgacattcccccccccccccccggctttccacggcatttttcaccccacctgtccggcggtgtcccaaatttgcaatttgactttctccccgtccactttcacgtttttgaccataaaatccactccaatggtcgcattttgccccggcggaaaaattccctaagaaaatgaataaaaaaagcaatgcaaacgcattaattatttggacaaaacagccgaaatgccgccgctcacttgagtaaattttttgaccaaacacgtcttcccaaccccagcatttccgaccagcacaactttgaacagataagcataatcatccatctttaattgggagcagagaaaacacaaccaaacaacaaagcacaccaaaccaacggacaactcagtaccggcgtcccaattttatgaatttatttataaataagttcattagatagtaaaataactggtttttcttaaattgtggttcgaactttttaatttcaattagaaaaaaacatgaaaagacaagaataactcgattaaaccgtaatcatgaaattgttcccgaacagaaatgtcataacaaccaatcgtcaaaagaaaagaacaaacgaacgaagaatcttaaaccaattaaacaaacaaaaatatagcattatgtttagaagtcaattcggatttctacgactttatgagaccacacagattcccttcacttccattccatcggattctcttcgtctccttcaatttttccctcccaattcgctgtcaacttctgccattttcttcgccttcaaaagaacagtcatcatctgaaacagaaagaaaagaaattattgtgctaattaatgctaattagacgaaatgaccgcagcatgaataacgtcgggagtcgaaacgaaacagcagcggtcactgtcctccacaatttccctcacgctttcctgcaaccctttgtcgcaagtgacaaacagcgccatcacacccttaacccgtgaaactgttttaaatgggttttgggtacttttcgggcttgttgcacggatttgaatgtatataaaaaaagaaacaaaaaacgggcaattgtgaagatcataggtcccgaaatttttaaattttttttttctaaaaattttttaaacaattttctaggggtgttttgaggcgctgagcacgaatccggactccatttcaaccaattccgaatccctaacccgaactcgaacatttttcgagaattaaattttaaattttttaaaaaatttctcttaaaacattgttttgtgttttcggggttgtcaactttagataaacgccgtttcaaaaccaaaaaatggtcattctgtaaagatacgaacaaaaaaagaattttgataattttgaattttcgattttttgttcgagttcggatccggcattagaaattggtcaaaatgaatggcagattcgtgatcagcaatcccgaaaacactaaaaacaatgttttaagagaaactttaaaaaaaatttaaatttaaatctcgaaaaatgttcgggttagagattcggaattggtcgaaatggagtccggattcgtgctcagcgccttaaaaccccccctagaaaagcgtttaaaaaatttttagaaaaaaaaaattaattaaaaaatttcgggacctatgatcttcacaattgcccaaaaaatgcagaataatttttgtacttctttgtcacttatttttaaattcaaatcaggcccaaacccaaaacaggtatttgaatccaattaccgtcgagtttttcgacttgccaaattccaccatcggtaagtcagaatgcgtgtccccacaaataagcaccgtccctttttccagggattcgccgagcgttccaactattttcgccattcctttagctttggtccaaactgaaaaatgcattttccgtcccataaaaaaggcattcaaatccacgcaccctttccttgttcgtgcaccatcacttcgacttcgcatccattcgacggcgcaaagtgcagaaactaaatttggaatttatttcaagacattgttgaaaagtcaacttgcgaattcgggtcaactctttgcaccagctgaatgacttcgttttggtatttctgagacagtgcaacatctacgtgctgtcaataataaatgatttatggcgaaagaataaaaaaaaatttaccttagaaacagtttgtacgcctaaaaatggaaattataaaattcaaaaaacaagagaattactaacccaaagtcaaacggtcgaccttccgctggacaccactaccgatgagagcgaaatgggcgtattcattgtcttgcagcaaagtggccatctgatggagaaaagaattgcgcttttcctcatatttaccttttcagaaagactgtccaatgcagttaaacccgcgtcagaaattccttaaaacaataaaattgttggaacgataatcagtgcaccttcgtcatgaacaatcctaaattcattgttaatttattaatatttgctgaacaaatgtccaccgttttccgtcgaaccaccattctcttccatacgagcctccaaatacaattggcccgtctttcggcagagcgatcaaatcgagaatacccgggcctctcagaggacctaaaatatttggttaaaaaatcgtcgattaattaattaaataaccggctgtcagtacagcactaagacgagtgtaggccttgaattaaaaccaaaaaaaaataaaaacgaacgccaaaaaacctgtgaaaatttagccaaactaatcgcagtgtaaattggctgcaaattggttgcatatcgagaacagtaatccttaaaga

SEQ ID NO: 9721 - DNA, 806 bp, Heterodera glycines
gaattggtcgatataggtcccatctttgttatcatcgacatcgaaaacccccagttatttgttttcaggatcctttaaatcaaaaaaaaatatattttgaaaaattttgacccaaaactgggatacatactccactagtaccaaaaagatattaattaatttcgttagtatgaattcgagttttgggaatttcaatattgtcgaaatggataacagaatcgggtacttttgagttttgttcctatacctcaaaattttcttttatattggtgggcacaggaacagatctctatcatgttttgcgaacgggaattggggatgaacctcgactctacttttgattggtcaaattttatgttcaatacaaaattataaatggatattaaaaaatatatatataaactatcatataaactagttaagtacccaaaaaaatattatttgtgaaattactttgtacatcaatttcttgaagtcgtcaatggtgccttggttttgctccatttttgagatgagaccttaacagagatttcttaaataattttgttttttttgttagctatctatccctaccattccagtccgtttccgcatcaactgcctcagaaaaaatagaactatatctgtcccgttggtcccgactttgttgcccatgttgccgttcctctgccatgaatatgatgtcaaaaatgaatgagtcaatgagaatcaaagaatgcaacttcaaaatttgggcgctacttaaaaagaggtccattttgaattttttttgcacttttttttggtcaaaattttttttttgttta

SEQ ID NO: 9722 - DNA, 5384 bp, Heterodera glycines
  misc_feature (3035)..(3035): n is a, c, g, or t
atcttgtcatttcattacaaattcatattgatgtcatatcctcctgagtaaaaaataagaggaataatttaaagaggcaacgccttaattacaaataaaaaataagagaagatgcagtaatgacacatttcaattaaacaaacaaataaaaattgaacgattttggattcatttaacatttattaaatatggtaaataattagtccgacaatctgatggaaaatgaaattaattaatttactaagcatacaacagaccgacccttagctgaataaaatttttgttgttgttaaaaacagtttttttcctaaaaataattttcctgttagaatatattaaaaataatttgttcccgagaattccttcacacatttccaaacagtgattaatgggacttaattattcaaaactgtgctcaattcgtgcctatttaagctgcagcaatttctaaaaaattattcattttctttggcttccccaaaaatggcaaattttgcccctttttcccccatttttattttccaattaatttttattttccaattgctcggcaccgttttctgtgctactgtttatttgaaaaaacagtacggtgaaaacgatttgtatgttgagtcatggggcaaaacgaactgttcactgaacggaattgacattgcggcgcttggaattggccgaccatgtgaagaatgaccagatttaggtaaaaaagtgaactaaaattcattaaaaataattacatttacataatttatcaggcagtgaattattggggcgagcgaacgcttttcatgcgcgactcaaagcatttcgttgaccgtcctctgctgaaagatgccaaaaaagtcgtcgaggaattcaaaaccatttttgaagtgacggaatggagtaaattcgcggtcagcgaaatgagcgaagcgcaagtggacaaattggccaaatttgtccaacaaaattttggaatggccgacgaagcactgattgagtaaaatttacaagatataaataatggaaataaatgtttattataattaaggcatgttccggaagattgggtcgaatctccgccaaattttaaggaaatcaaagacgaaaagttggcgaaatgggcaacggaattgaacaaaatgtggaaggaaatgagcaaaaaaatgccaaaagacgtaaaattaattataaaattatcttaattaaaaatgataacattaagatggacaacaatgccaaccaaatgcattcgctgattcatttgtccaaccctttctcgttttccggtggccgatttcgcgagtttcgctattgggattcctattggatggcacgaggactgatcgcatcaggtcaaagtgatcaaaaagtgatgaaaatattttaattatttaagggatgacaaaatcattaaaaaatatgtgcagaattttgcggaaatggtcaaccgatttggcttgtgcccgccgggaggacgcatttattacaacaaacggtcgcagccgccattcctcacattgtgaattaaattacaatattttttaattaaacgacaataaatattgtaaaataattaataataaattgttaattaagtttggtcaatgattacttcgctgccaccggtgacattgcgttccttaaggaaataatgccagcacttgttaagctcaatcagtataattatattaaatttaaaatgtcctttatttatttctttaattttcactaatacttgaatttcatttccattagccaaaagaaatggtctttttccggtggatttttcatcaaacggttgagaccattttgcattgcaaaaattgcattgacaagaaaaaccctaaagaataatatcaaaaaatgaagatttcaattaagacaatgattgttcatcgattgaatgtgcactgatctttttgggattttcccattcgttttaaggtccttgtttttgtggcgtaagaatttcaaaaaataaaattttacaaaaatgataaaaatgtaagttaatattaaaaaaaatacaaaatacaaaaaaaattcggccctgatatttttatttgaattattataattaaattatttacatttgcttcttttttttgtttttaaaaccgacccaaatatatttgtttgcaatgctcaaattgaatgttttctccgattcgatttcttcaataaatttggcattgttttgatgcaacgacgaaccatctgatgaattggaaaccgatttaaaatgataattggtatttaaaaatggaaaaatttacaaccatcggccaacaaatcgacaaattcggcagccgtttgtcccttcgcacccgcataagccatggccaacgcaatttaataattttttgctaattttgcattttaatcaaatgatacgtattatcatctcatgcacacgtccctggaaattatttttaattcaaaaacaattaaaaccaaaggtacgaatatattattaaaaaattccgatattacagaatttttacgcaaataattccgttcccattcccacaataagctttagaccaatttgacttaacaaatgggactaatttgtaaattatagtgctaatatcgctcacttatcatgcagttatttactgatttttccagaacattttacactgaccttatcattttcaatggcgggaagtttgaaggtatttattccagatctgatgaaattaaaaataaattggaaaatttaaatttgtgatttttaattaatctattaaatttaataaagaattctttacgcactctccgcttatggtcaccgtaatgccattgaatgcattttcatttgcgcactcccaaataaactgctgcaaattcggtgttggaataccacgggaagggtaaacggagaaacggaagaagtcgaaatttcaaaactaaaatataattaataaaattataaatcaaatacttatttaattatttatggttgatgggtaattaattattaattaatctgacaatattttctattcttttttatttgccaaagtttctttcacctgctctcnaacactgttttcatttgggcgtcacaatttccatagaaaaacgaacttttcggctgctcaaatcaattttcacttttgccttacaatttttgtctgctcctcacgcgacgcatcgtcccaaaagtgcgagagtgcgtaaagagaaattcaaatttaaatttaaattaatcattttcggaggcacagtaatttttaaattgcttttacgtttattttcgtggccacaacgattgagaaaaaattcatccaggtttcattgagttttatcgatcgaaattttatttttcggaattttctttgtattttcgcattttctttgctaaaattcaaattttgctcaaaaagtaaaaaaaaaatcacgaaaaaagtcgcaaaaactaaaaaaagtcataaaaatcccaaaaagtaaaaaaaaaagtcacaaaaaactgcgtgatagaggcttcagacaaagtttagaacactttttaaggcattttaaggccaccatttagagtcagcaaaaaaaaagtcaccaggcccatttgacccaaaatgaggctttttgcccaaccaggttttttgtattttgtattaggaattttcgagtatttaacgacccaaaacatatttttttttagaatttgaaaaatgggttcgttaagactttctcgactcatccctcaaataaagctccccgccccctccccgaaaaagttgaaaaaagagtttacagggtaatctattaggtgaattcagcattaataatcactgatgctaagggctgggaattatatggaaatcctatattttttctgcactgtggaaggcctgaaacgcacgaaaaaaatgtttttagcttggtttgaagcttctaagacggagttatatatccatagtttccatatttttccatatttcgcgatttatgtccatatttccatatttgtccaatttatccatgttttggcatttcagtcaatattttatgtccatattttggcatttccaaaaacctctatttgaacggcccccagcggctaaatttgacttttgaccccaaagaccggaaaattttccaaaaaatcattttttgcaaaattatcatgagatattgaagaaataaattttcttaaaaattagtaaatttatgtaaaatatgcaaaagggcgaaaatttcgcttttcggttgacttttcgctaaaaattattaaattttagggttaacgtgttttttcccctaaaattatattaataacgtatttagccatttttcaacgttttactttacattttgtgaaattgaagaaattttgatccttaattttgaaaaatttatgtccatatttttgcaagtttatatccatatttcgcgatttttggtccatcaagtcacgtgaaaatgctctcaagcatcactgtattcaattattattttttaccacacaggcgaacgggttggccaggttcggtttcaactaattatgacaatggcattagaagccgccttacacattagtgcagaaatgcttgcacttgccgtgtcggtgctgggtcgtactcaaaaaccatcaaaataatttttttttttttttatacaactatgcttaaaggcaaccaaatttaaaaatttttgatatctttcgatgtccctaagttttttctaatatcatgcaaaacttcaaaaaagtttattaaatttcaagaaagttatgaccaaaaatcttgttgaaaatgtacctcgaaaatcgatctttttaaaaaaggaatacactggtggaaaaaagtcttttaccaaacccccgaaatttgttcagtggcgatttttgtaattaaaaaattttcccgcggagcctatcggcaccgccggcccccccccttgttcctcaaaagttctttggaaaaagcacagcaaaaaaatcaacttcgatttttcatgctcagaatatgccaaaatatgcttatttctaatcatggaatcaaaaaatgacatttgaacattttaagcgagttttgaataaattttgtaaaaatgaggctttttgacccaaaatgaggtcattttgcatgccaagtgaggcttttgcaaattttaatctggctatcctgtttttttccccgaaaaatttatcttatttgtaagtgcaaatcgaaatttaatccacaattatttttctttatttttatttttatataaaatcattggggatcagggctgggaccgcgccgcgatgtgcgatccgcgattcgcggcatttttttttgcgcgacccgcggtcgcggccgcggcaaagtaaatgcgcgatgcgcgggcgcggtttttttttttgcgagatgcacgaaattttgggctccgcggaaattttggac

SEQ ID NO: 9723 - DNA, 1377 bp, Heterodera glycines
  misc_feature (79)..(80): n is a, c, g, or t
cccccggccccgggggacgggacaggttttcggggctcaccccccgtccccgtgattcagacccccgcatcccccgccnncgcgaccttcacccccgcgggggcgcgggggtgaaaaatacacccctgagaatgacatattcgtggataaaaaatttataaattttgaattttttttatccatttgacaaattttatgaaataaagttaatttattagtggttagtaattcaacattaacagtcctttttgttatgagttcgacaccggctgacgttttctttttctttttatttttttccaattaatacagggtttttctttatgttcttatttctaagaaatgttctaatttgtggtaatgcattaaaaatacccttaaaaattgactatttttggcatatttgtaatccctaaatttggtcattttttagacaaaatctgtgcaattataccaaaaagaattaaatcgaggcgatatatcgaataaaggaatgtggagccaaacacatcattcaaaaaaaaaaattaatttttgtgaaattttttggagctaattaaacgcaaacccccgcccccgtccccgggggcgagtcatttggtcacccccgtccccgcccccgcgactctgacccccgcaatcccccgcccccgtgaaaagccacccccgcccacggggctcgaaccctacttccaatgcattaaaaaaaattaaattataattagcatcactaataattaaagcgaaacgtccgaatttggcttacaaattagttggcgaaatgtttatgggtgaattggcgaaacatcctaaatcggattaaaaggtaacctcgcgaactgtagtcaaaaagtacctataaattagataatattggatagaccagggtcgacttctattttaaatttttaatattatttgcgaaaccgtgattaacatttaaatttttaatattttattttaccataatagaacgttaattccctttaaaaatattagataagtatggtaaataaaggaagaacttcttaccttttttgattattttaaaacttttttatgaaaatgtattaattttatcactgcaaatttaaaaacaactttgacctccccccaccaactcaggcttgtcgggacctaagtcgggaactcttttcgcttcccggtctggcgccatgaagtttgggcaccgggaagtttgggcaccagagtaagggatttcaaaaaaataaaacaaaataaagatataaaatgttatataaatcattaaatttagtaaatttaacacccttgtgtcttaaaatttatatgctcgtgaaaatcaaaaaaatttatgtatggaaacctagcaatcttattattaagtcaaatcttacg

SEQ ID NO: 9724 - DNA, 2276 bp, Heterodera glycines
ggaataatggactaaacgcattgttcgggatgctttggacgattggtgaattgacttttgatgaataaaagcgtccatacagtgaaaataatggaattgtaatataactcagtaaaactgcctgaaaatgttatttattttgaggataattaggtcgtttccccaaatccggatcagggtgcttggtcaggcacgtagccaggaagggggcagaattctacccacccccgaaatgaaaaataagaatttttcaaggaaaatcatttttcttaacaaaaggtattaaaatttcaaaataaaaatttttttttcccggcggcgcctatcggcacagtctggggtccgggtcgttttcgtacgagcacaagttgttggctaaaatttttttgcaaaccaaatgcaacaatcttggtatcatttggtagtcctaagtgtcctctatttgcctgcaaatttcgaaaaatttcgttacggttcaaaaaggtatggcaaaaaatgctcgaacaaccagttttttaactcttaaattttgcaggctaacacttaaggctatcgaatgatacaaagattgttgaattttgcttacaaagaaagaaaacggcttggtccaccttattacattcagtttacatgatcatttgtctcaaggatttggaaatgtggcattgtaccgcacagatcgatcgctgtcataatttggaacaacagcatgctttttttgttcaaaaaattgccattcttggtatccattttataaatttgttcaggaaacaaatgcgggcccatcattttctagaataaataaaataatattttaatttcaaccaattatttgacatatgaaagatttattgtgttttctacaattatttaaagagacatcgtttatatggctgtcaagaattgaaatttttagaagaaccgtaaaccgaaattgactataaagaatgctttttaacacttcctgcatttataagagaataatctggccaagttttaatttactttattattcaattgttatgaatttctaaatcaattttttcggcactttgacataacattcttcccaccccaatatttcatattggagagcaagcagcagtgcctaaatgcgccgcgagagagaagagagagatagagaaagcgagagagagagacagagaaggaagagagagaatgcgagaaagagagagaaagcgagagagtcggagaaaaaagcgagagagagagaagagagagggggagagaaagcgagagagagagagagaagagagagagggagagaaagcgagagagagagagaagagaaagcgagagagtcggagaaaaaatcgagagagagaaaagtgcgagtgagaaagcgggagagagagagagagaagaaagccatagagagagttagttaccgtatatttgtttgggttcaatgcaatattctccgttcctttcaaaaaatcatttagtgtcggaaattgctcaaaaatcccatcgtaaaattctctccgaatgctaatgaatgagcgaatgtgtttctcaactgaatgcattgaacggattgtttgacagagcgccacacttttgtcactcaaagttgaaggaatttctaccaattgtgcagcaaatggttgatgcactttaaaaactaagtagagaattagtcattaaaataaattgttagtgcctttcttaattccgccaatgaaacgaaataaaaaataaaattataaagtttaaaaaaacaaaaacaaaacctcaaattttccttattaagccttaaaagaaaatattatcaagtttaaaatcagttttattgggttggtaagtccgtgcgcttttttcagagcatgttatttctgctgaagcgttatcgatcgattatgctcatcttgtagcacattcttttctctatcaaatgcactgtgaattagcgaaattaatcaatgtttagcaaagttattgaactttgaaaattgataaaaatgagcacagcgggaccacttttaaaaattttctttcaacaaaaactaaaattagtcggtatttatttatatcatttgaagccctttctttactctatctaatgagttttattcagaaaaatttatcaatttttaaccaagatattgtctgttaaaagtatgtgcaaaagtggagaaaaatggcattttaggcacattttttggtccgtgttacaatttgtcaaaaatggcactccagaagcttgattttgaaattttaccgcatccgcctataggacggatgtggcacttttt

SEQ ID NO: 9725 - DNA, 2068 bp, Heterodera glycines
tttattgaagaatgatgagtgggagcaaattaagagctggttggggtattgaaatgtgctgaagaagcaacaaaaaggttcaccgcagagccaatttcatttgtcattcctcaagcaagagcattacatgatgagttgtacgaaatgaaaattgttaaccggactgtggagacaatcagaacaaccctttattttgcggtcgagcggcgcttttttgggctagcgaatttgaagtagaaaaatttaacttaattttcaataatgtttggtcttagggaatatgcgctagcgacttttttggatgtgcgattcaaggacaaagtgctgactgaaaattccgcaacttttcgcgctcgagtcactgtctggatcaaaaatgaattgaaggaatgggaaattgataatgacctcgatgaactacaacaaaatgaatttgttcgtcctgttatgtcgccccaacccgaaaatccgccagctaaacgacgaatgtcatttttgaacgtctgaaacacattacaggcgcaaacacaagtgaacagggtgatttttggtctctaaaaattaaatttataatgaaattaaggcttccaaacgtcgcaagatgatgacattgaaaaagaaattaaggaatttctcgcgctggaaattgcgaacccagaagcggacccgttagacgaatggaagaaaattgctccccgattttcaatccttgccaaatttgcggaaaaatatctttcagcacctgccaccagtgtcccaagtgaacaaacattcaaagtcgcccgtgatgtttttgattatcgccgttccaaattatcaccagaaactgcagaacagcttatttttctgaacaaatctcttccccagatgaattacaattattgaatcaatttttctgttgattttattaaaattgttaaatttctacatctaattgatgaaattttgtgggttttttcccaaattaacatgcgaaaatttaaatttttaccaacccggaaaccggtgccgggcccggcaatttgaaaatccggtttgaccggttttccggtttgaccggtttttgagagaccgggcccggaaaccggttgcttctgaaaaagtcagcccggcccggcccggcagatttggaaaatccggtctctaattttcactattttaagtgacgaaacgctaaaatagtgatttctagtgacgaaaaacgacgtctaaatgaaaaaattttaacgcagaaatgcgttttttgagctcctttcttcaaaacaattgagcaaaaaaagttttttcactagaaatcggttcccaacatattagccatttttatttatatttagtaaaattttattaatttgaagaaaatttacccttcaattcggaaaatttatgtccatatttttgccattttatggccatatttcgcgatttttggtccatgttttatggccaaatttcgcgttttatatccatataattacaagcgctaatcatcattggttgctctgaactggttgagaaagattcaaaatcagcggctcttaaacttcaaattattttgaagaatattatttgcgaattaactttcgctaaagtataaaaacgtatttactgaattagagcggctggaagtggagagtcgtcatataaaggtaagctgggaatattattcaataggtctattataattgaaaagagatataaaataatattgatatacaggggagtccggttcttagtcataattaataaaaaatattcagtataacgttctatagtggcgtttatattgtggtcagtagagtggtggtaggatcagattcaggtctggccgtaaatgatattcagttacgtccatcggtaattcgtcattacggcgatattttcagtttcggacttccgtaatccgtcatgtcgggggtcaaaaaagtctcgtaattagtagtaatcagtcattttcaaaatatttttttaatttaaaaaatttttagatataaaaaatacaatctaaaaattgttaagagtaatatatgatccgaatatgtgcattgtttttatgaggtgatagtcccaa

SEQ ID NO: 9726 - DNA, 2501 bp, Heterodera glycines
attaatcatttttggacaaatgatcgaatattacctcacctgagatttgcttttaacatcacttttttttcggccctttttttccaaaaaatttttagggaggaaagaagaggggtcccggcggtgccgttaggcgccgccgggaaaaattttgaaaatttgagtgagatttgttaacagattttcaacaaaaaaaggctggtttttgggattactaggctcaatttgtacggattttctttaaaaaaatgataaaatatgtgtccattaaaataaaactatgagtaatcatattttgtcgataggaaagccatgagaatacaaaaagaaaattcaaaatattttaatttctgtagagggattgaaccaggggaaagaagaagggaaaagtcaaggagactagcaactaggctatttgcacaattgttatagttgctttgaaagaatatatttatgattattttttaatttttccctttaaatctaattttcatctctaatttttcactcagacccccattcttaccagtgcttgtttttcccggttcccggttgccctaccgggaccgggaccgggacctgagcttttcaaaatccgggaccgggaaccgggaccgggacctcggatgaccgggaattcccggcccggtcccgctctactctactttgaacaaaagtacgaatggcaccaacttttttaatagcaattttaattccttataaaatttcttaattattttttacaattcgaaatcccatatatggtgccgaattttccagccggtgtcgcattttatggctcccaattttcggaaaattttttttcgttgctctgaagctgccggtggagaaatggcctaaattaaatgcaacaatttaattttttttcctgagccttctagttttttatttttagcacctaaaaacaaaaaattttgaaaaaacctattttgtccaaaatttattaacaaaatgcaatgaaaacgaaaaaaaatacctaagagaaaaattttctcaaaaattcatctccaaaatttatttatttattttcttgaaagaagtttaaatttaaaaaattgcgtatctcaatactaatttgccttacttttgttaatttttggataaaactttaagctttacactctaaattgaaatttttaagaaataatgttttattttggcagttttcgagtgagttaacaaattgatatttagcaattaaaaaaataataatttgtacaaacatttctcatcctgtcgatcaatgtggttgggattatcagagtcaattcctggcccaaaattaaacggccaagaaaatttatattcttgatcactattcaaataccattcacacaaaataatggctaaaattaatccacaatttggtgccttttgtccggtcaaattagcaaccaaatccatcacttgacgcaatcaccaaaataatgggatatgacaacaataagacagcaaagagagagagaacatacaaatgacgactgactacacgaacgacgaacaccacataatctcataacactaattgttgcacacataaacaaaattcctttcccttttttcactaattagcgctgcgataaagcaacattagcagcagcggcaacagcggcggcggcattatgtactaacagcagcaggtgtctgttgctgtgtgtctatagccccaggggggatggggcgggggggggcggcgattgggtgcacggacggcagcttaatgagatttttgggattgagcgcgcaccacagcgggggggggggggcattcagcgtcagcaaatgtctctctgtctattgcctgaggcacaattctttgttttgtaattttttagtactttttttttgaaattcctaatcacccattgtgcttaaaattgttctctgtgccttcaaaaattttatgcttacaaaataagaagccgtttttacggtgacgtaaaagcgatttatgctaatggacaattaaattattaaggtaaattaatcgtttcctcctcgtatccaccccctcaatttatgtaattagcggtcctccctccctcggataaaaaatatccaaattcatctacatacacaatcaactttcttgcttgctgaacgggttggggttgatccttcttgcaagacactcacacataaataatgcgccaaaaatgggaagtcgggggcagagaatcagaggagggcttaactgatcagtaccaatcagcatcatcacaatgatcatttgacttttttgatcaacaatcctgatcactttttgaagtgaaaaagtgaattgttgcacacaaaaacactttccatgttgcgcagttggcggggcgcgatttgcttaaaaaatggttgaagccgcttctcctccccatttggaatggggcaagcgctcgcagtactttgacgtctgctgttcgttatttaaacgataatactcaggggggataattatttcttgcaattatagattttttttttgttgt

SEQ ID NO: 9727 - DNA, 2039 bp, Heterodera glycines
ccctcagcgcccaaattggtccgtccgtccttccatctgtcattccccccccacccattcataccaaaagctgatcagaggggagggcactgatcagcattgcacccagatccgggagatcaaattgggcggatcatgcttacacacacaatcatatttgattcacgatcacgccatggataatgtgccatgcctcaggggatttattattaactaacaatcctcagggggtgggcgggtgtcatcccattggatcagcccgggctaatcgagcattgcgataggagaggggagggataaagtatgtagtgatcatcagtatggaatctcatggtcattgtcatcaccgcacaatcggatttgtcactctgatcacccattcctaccaagtttctcggcggagcggctatcaaattgccagtgcaaattggtaaatacatacgtacatgtttaatgcgacacaaacaagagcccggggatttcaaatttgccaatcccgcagcgggaatgaaattcaaagtttttttgcgggacgggatcccatgggattaatcccgcaaatcccgcattttccaaaaaatgcgggattgcggactgggatcccgcaaatcccgcgccgagccctaatacaaaccctggcttgaatgtgggaatgttatggcattttggtacaatacgaaaatttcaaaaagcaaacaattatgcctctcagttgatgttttttcaacattgttttttgatagattatgccatccttaagtggatggcaaaatttatcccagaaatttattttgaataaattccattttttccatcctttgcctgttttaacgaaacttggcccgcaaattaaaaaaaaaatttgaaaaatcttaattagtaccgtcgaccatagtaaaaaacaaacatccgcataaaaaatgacgatcatttatcaaccacaaacatcctctcccctccccgctgcgacgatcagtttcatatataatatatatcctcccaaatatccgggtgctatgatgattagtgtaaaagtgaaagtggaagaggggacaaatggggatcatccaaatgatcagatcacccaccatccatcttaaccgccaatcatggggggggggatcttccccgatcagatcacccaatcgacccctcccccggcgggggaaacaatttaatgcgcggacaaaagccgtgcacaaagtgtcactgctaagacaaagcatcgacaaggccagcagcaggaagacaaatgattctttggcgcaatgatttgtcatcagtgtcattcttctgacagacgacaagcgatcacgacgacattccacgtcgttccacgaccgcgtccgcgccggcgctgagacagcacaagcgcttcgctttgttggtgccatgccgcacattgcctcgggcgaaaagccgattggtgcgcgcgcgggcgtgcgcagagggcgccaatggcgtcgccagaatttttgcgtgttggcgctgagacagcccgaaaaaagcgcttttttgggcgctggacatttgagttcgatggcaagtttgccttatggaaaaacaaaaatttaaggcagaaaatgatgccccaaatgttttcagacacatttaagaccacattttttggcaaaaagtaattttacctaatggaagggtaaagtctttcaattagtgtttcggttttctgtaaaccgatcggttaccgatttttaccgttaccaatttattacgggttttatgttaaaattgacttctaaacggatagcacagtaatttacagtgttttatcagctaaattttaatcacggtcaatcttaaccgctgcccgggacattaattagtaacaaaaccatgtagcaaatacctccccccccccgttgatctatggatagccacgccgaaaaatctgtccaattttttcgcttattcacacatttaaaaagtgcccccgccctataggagagaggagacccagtttagcgttgtagggcatttctccgccaaataaatcactcagtgctgtcccgattttctac

SEQ ID NO: 9728 - DNA, 2133 bp, Heterodera glycines
  misc_feature (5)..(5): n is a, c, g, or t
ctcgncagcgggatcagcaaatttggaatttccgggctcggattcttgaaagactgacccttacaaaatcctttttaatcattttaaaaagcttcatttgactcaaatgttttcccctcaccaaaattgatgaccctcatcactcagaacatttaattaatttatggattggtcgccacttttcctgttgatcactttgaaaagccctctctgagagggaagcggcaaaacttcccgcagagcatctttgccgattgccttcctgttgtctaaatttgttgctgctgctgtcggttgattgatcagcagcagcagatcacccaacaacggcgggaggagaagcaaatccgaaaaattgagcaaaaaatgggtggatttggggggggggaatgaaatgcaagcggatgaatgaatgaatgaataatgttcatttcttcgcctatttttctcttcctccattgtcatcacataaattcctcaacatcaccagacagacagacaatcactccaattcatttattgaatgcctaattggcttaacaattccattccatcaaataaaaaagaatctcttttctatctaaaaaccaaatccttttaattgtaggatcacttttttacagcaaaattttatataagttgttcatcagtctaagttttcggccacaacttgcatgttaattttttgagtataaaactgcgtctgattaaaagcaaaatttaagtcttggcatttttttaatggtcagaaccaaaatttttgtatttgcatttcttttctgctcaaacccaaaatttttgctcattggtatctcatttatagtcaaaaccaaaatttgcatcattggcatttttttttgatcagaacccaaatttgcgtcattggcatttcttttctgatcagaacccaaatttgcgtcattggcatttcttttctgatcagaacccaaatttgcgtcattggcatttcttttctgatcagaaccaaaatttgcgtcattggcattttgtttctgactagaacttaaatttatatttcttgggcatttgatttctaatcagaatcgaaatttgtggcttggtatttcttttctgatcagaaccgaacttttttcatccacttcatttttccactttttcttcataaaaagtgctgatcagaaaaaactatgaccgcatcacattcattgttttggctccgatctggatccgccgaccgcatccaaaatttattttataacaatttgctgtaacagaaatgtcatccatccgttcagcctaaccgaaaatcataattaattgccgtgatcagcttttgtctaagtctccccccccccgatcagttctacttttgttcacttttcgcttctttatttgttcctaatccgcggcgacgacgtccaccgcgccgtcaaaacttccaaaattcctcggtccgaaaaacatggccgaaaaaatgattggcggggagggggacgacgaattatataacagtcaaatcattttccacccccccccctccgaaagttcagcgaacactccaaaagcatattcactcactctgtctctgcctttctgcccattttgcctcccctccccgtacgtgttcgatcagcacactgaaaaaaggatcacccccatcccttccccctgcccctcccccgccgcccgccgattagcagcaaaaacaaatcacccccgccccgcatatataaaagctgatcaaccctagcccatccattcatcgtgtccgtccgtccgtccgtcccgcatttcatatcactacagccacaacagagagagcccaacgaacatcatcatcatcagcttgatgatgatgatgaaccattatgaccaaatttttacacaaaaaaataaaaaggggagggtgcggggggaacggagactttcgacttttcctcgccggggcggcggcgtcgctggtggacgactacaggtttcggctcggcagaaactaacagcgagcacacatttatatgtgcctgccaacttttttgaggggacggggcggggggagatggggcttaatcccccctggccccctctccttaaagccagccgcttttcccctctggcgccgtcctctcttcctacgcccctggcctccgcgcc

SEQ ID NO: 9729 - DNA, 5313 bp, Heterodera glycines
cccaaggccattgtcaaccactccgatcaggcgccatgcgcgtgttcgtgcaaaaactgccgaaaaagcaacacaaatggactttacaactaccgacaatacaacaaacacggatttgacaacgatggacaaggcaacggacgtggatttggcttatgaggacgccgcgacacaaaccgagcagttgaacaaacagctgaaggagcaggaacaaacgatcagctttctacgactgcagctccgcaacagagacgcaatgatcgccgatctgcgccgtcaattggaagagcaagcgcagacgaacccgccaacacgtaaaattctgcagaatttttagagccgtttatcatccaaattgtttttagcttccacacggtgcaaaaagaatgcgactacattggagcggacctcacggcgaaatttggtcgagaaaatcgttgatgtgatcgatcgagaccgctcccgatcagtgagccgatgttcgctgcaaactctacatcgtgaagtccgccacaaattcggacactacacaccaatgaagaaggaacaactcctacaacaacaaacaatccatggagaggatgggctgcttttgctgtcacaactcgggacccaaaaggcttatgtaaaaatgttttgcgatcaatcgaatttgaccggataatcctggcgccttttcacgtcttccagggcattggaaatgcactgatcaaagagctcgaaggatcaactgaaagcgcggaaattgcgaacggatttttcagaagcatcgcggccaggagagaagcgttcagaaaaaagacatgacggggaatttaatcagaaaagttctgattcatgctgaccaattggagaggctttactcagctgaatggcctcaaattatttgcaaaaccatgggacacttggcaaagatacaaacttttacaaaagtgctttttattttctttcttgaaaataaaaataaaatttaaggcccagccactgtcgccacgggatttggacgaattggaaacgtcgattgatcaatttcggacatttctcaacgatcagccacggatgcgcactttgctcgccttaaaacctaaggtccacttgctgttgaaccattttgtgcccttcgcccgacaacaccaatttttggcacttttggacgagcagggtcaaaaagcattttgaaattttagcccgaatttttttaggcgatgaagcattgaattcggtgtggaggcgtttggaacagctgtggaaaacaatgcctgacgaagaacaaatgcgtcaattgttggagcaccattttgtctcaaattggcttctcgacacgggaaagctcgacgaaatgaagcgggtcagtttggtgaaaattgggtttcaaataaaattcccatgcctcaggaccgtgaagaacaacaggaacaaatcggaggccgggagagcgacgaagaaagcgatgtagaagaagaacaattcgattttgaatagacacagttcgataaaaggtttttcttcgtttttacaggaaataaattttttatttaattttcgagcttcattaaaaactgtgttatcatttcacttatatttatttgctttaaaaacctcaaaatacagttacagcatgcatgggactcgaacctgagacccccccttttggtgactaactcacagaccactaagacgaaaaaaccaacttaattgtacttggagcccaaaattgaatcgcagtgttctattgagaaccgcccacttcggcgcggtttttcagcgcctcttataacatgacttttcggtgccgtcattggaatttaaaagtttttgaaccggtttgaaattcgaaaaattgagtgaaaagggggctcctggtcttgtaaaacggtcaatttcggacaaattcggtatcattcgaaagctcttgatgagttaaatctaaaaataaagtacggtagccatctctacacatttaccaatacaagtgccgatggaacgactaaagagttcaagaacatctgtcgacataaatagaatccaagtcacatcattgcgcaaagttacgacaaccatcaaaaggcgtgcagttgacacgatggaagcgccccctgtaatgcgtgctacttctcttcaaagcatcagttcgcccgcactttcagaagtgccgtaaaaaaatgccagcaatttcatgttgatgaacacgggtcgtccgagtacagatgggtcgcaaacggaaccgcgtttcaaagccgaagcttggaatgtctacgagagaacgctgggcaattaagacaacaaaaaatttttagtggatgatccgttaccatcacggatctataacaaacatgttggtgctatatatttcagtctgtaactgcagaattcttatggaaatataaatatattccttttattgagaaattttttatttaatttaaaatatttgcgttttttggtgaaagtctcttaaaatgaatgcaaaatttaaaaaatttcctgccggcccaaaaaattgcctcaaaattgattgcaaaattaggtcacttttggacaaaatctgttaacaaagcacaccaaaaattaaaaattttccccggcagcgcctgccggcaccgcaggacccacctcaaaattccacaaattttgaaaaaagcccgggctcggcgggcgcccgacaaaattttggaccgggccccggaccgcccggtaaaacgggctttttgaccgggcggcccgggcccggtgattgtctaagccggagccaagaattttcaaaattctgactctaatgcctattttggaaaaatttacattcttaattctggtttaacctctatattcgaattgtctaaaaatgtttttatttaggaaagtttctcgtgaatatcatatataaaatatttaaattcaaaaatcagtaaagacaaattctgatagcttaatcggatcacaataacaaattcttcccttctctgcaattctttctcaacaatgcactcatttttcgtagttccaacctttccaaatattgggccatcccttctttttgtttcaaatagatcactgtcgggtccatactggccaaaaggcatttgtccaagcgacagccgcggcatcgagttccatctgaaaaattataattaaatttaattttattactatttcttttagattaatcgttttttaacaacctttttcaatttggcagtttttcgtcccataacaattgaacaatgttttcttgagaataatatgacgaaagaattgcttgcagccttaatttataacaatttgtcggtgggggtcggtttagtctggccgttttagtctggccagtttagtcagagggtcaatttagtcagagggtcggtttagtctgacaagctgtttttgtccataactcttacaaatatttttttgttaattatagccgcctttgttcagtcaaatttatattcttcaggcaaagtaaaacgttaatttttcacgtttttttccatagaaggcttcaacggacttttgctttttcatatccaactgtcttccgcttcatcaacacaattcgatatgagaaaagtcatttgatgcagacatcgcatgatgcgtcgctggtgaagtcgtgcctcaaaaaacatgcaaatatcgtgccgtcgatgcgagaattctcgactattgcagagttacaataacatcaacaatattaatcctgctcaccaaaatgatcaagattaccatgccaacttaatcccgataatatcatcattttttagttgagatttctccaaattatgaaatacgcctgtattcatttttcaatgttttgttatttttttcgttgaaaacatattgataagtatgttatggtgtcatatatcatcaatttgaccaaaagtgcgcagcattataaaaaaaataatgtgtcgaagcgaaaataaaaaaaacaagaactgcgaagaaacagcagacatgtgagagtcagacactacataaaaattaatgaaaataaatgcgcacagtgcgccaagagaaaaaagtgataaaacagtgatttttatgaaatttctaatgcttttaacttggtcattagtaaaccaaatagagcaattttggtctcattttgaaggggaaattcttaagaatatgtttaactatcgtttttacgtaccaatatcatttttaacctttaaaatgacggtaatttattaaaattttcacccagttgaaaaaattttccctatgttcaaatgttcttgtaattttgcatagggccatattttgaccccctctagcgattccaagtttatttaatagaacttgtttttaactcgagatcggctcttccgtttttacaagggaaattctcgacaatttttgaattagcgtggttttttggcgttttgtctgtgcggacttttggtcaaattgatgatatatgtggcgttaaattaaagatttttcgaaaaaagcagaattgaatcaatttaggacaaaaacagcttgccagactaaaacggccagactaaacagatccggtccgaaatttgtaaataaaaatatttaatgtatttaaaagagaatctgctgaacagagattttcattcaaattaagattggcagtttccgtccccgttgaaaaaaatcctttcagttttcttttctgcagaaagtgctgtactttcgccgactccctgattcacactcacatttaagtatattaaattataaatattcttttttcgtcactcactttcgcaacatcggattctgtaataacagtacatgcttttccttccgcacactttgcattcactcggatgccttttcggtcgtcccaccactttggcattttgcccttccgtgccataagcaggcatcattgatgaattttggctaaaattttgtgccactaaatattcaattgctgtcaaattgtcccgttgtgggcccaacaaaacacgatggatgaagtcaaactccttttgggcagcacttgccaaagacgatgattttaatcggctaaataataattctgctgggccactttctccattaatcgaaaaatttataaaattgcttagaaatttaattttttgcgtttgttagatataaagcaaagaaggaaatcccaatatattaacctcctatttctttttggaatggaatctgttgtagattttttcagttacttattgattgtaatatctttattttattgatcatttaaatgcaaaataatatttggacaaagcaaagggaaaattttaattattttcttttcaaaaaagatatattgaataatcaataattaactgctttttaaatgaa

SEQ ID NO: 9730 - DNA, 4601 bp, Heterodera glycines
  misc_feature (1722)..(1722): n is a, c, g, or t
aagtgaaaagtggtgggcctctctaaaaaattttcaccgggtttaaaaaatctagaaaaattagtaagcatttgtagtgttccgatacgtatccctgcaaaatttggtgagccgctgatcaattacaaattatttatggacgatcaaattttttgaatttttttaagtgcaaaagtggtgggtgtctgcaaaaaattttcaccgggtttaaaaaatctagaaaaattagtaagcatttgtagtgttccgatacgtatccctgcaaaatttggtgagccgctgatcaattacaaattatttatggacgatcaaattttttgaaattttttaagtgcaaaagtgaagggtgtctgcaaaaaattttcaccgggtttaaaaaatctagaaaaattagtaaacatttgtagcgcttcgatacgtatccctgcaaaatttggtgagccgctgatcaattacaaattatttatggacgatcaaattttttgaaatttttttaagtgcaaaagtggtgggtgtctgcaaaaaattttcaccgagtttaaaaaatctagaaaaattagtaagcatttgtagtgatccgatacgtatccctgcaaaatttggtgagccgctgatcaattacaaattatttatggacgatcaaatttttagaaatttttatttatttttgcaaaattaattcattttttttctgttggccacacttgagtctgggcccattctaaatgcggtattcctgaaattaaagtgatcgatcataattgtgcatttaactgggccataccaatgtctgggcccattctaaatgcggtatttctgaaaattaaaaattttttgaacagttggccataattatgatcagcatatgtgttcatttggctgggccataccaaagtctggcccattctaagtgtgtcctgatcattggcaattgatggtgattgattgagtgatcagcggaattgattaggttccgctattcccaaattggaaaatgagcaaaatcttttttaaaattgtttaaaattgatctaagcgatcggaataatgcaaaatgataaagaaagcattaattaactttttttttaatttgattgatcaaaagtcatattgattattttgcatgccactttcaaatagtctaatttcgaatttatacaaaaaatcactcatgatgaattattgaattgaattgtttttaatttacctgcaaatttttcaattctttaaatcaaaatatacataaatgaatttcataaaatttgcaattttcttttgtcagtaactttttaattgatttttgcaatttccaaattgttaaggtttgatcactttttgaccaattgatcatttttttatattatagtaaaagattgaccaatcaatcatccattaattaattataattacttctgcgagttggggttaaatcatgtgataatctgtgcactcattatgaaattcttatgtaatactacagaattttcagcttgaaataatcattcatttaattttttatttgaatatttttatgcaataaatctttttataattattatttaatgaattattaaaattaactcaattttatttaaatatccaatttttttttgattaaatataaaaaacattaactgagttacatattaaacaacatttatgacattttttttacttcctcttccgggagaataaacagattaaatggatgacgaaaatccncaagaagaaaatgggaccaattggtccgtcgtcgtccgatcattaattccctgtgattttcttcgaccaaaagacactcaattttttcactttttgttttaattaggtaattaaagagaaacatttcaatttattaaaagcaataaattaaacaaatttaatttgtttattttgaagctgcttttttatttcttttgtttgttaaaaaaaaattaagtcgacaattttaaattatttataaatttaatttttttccaatcagaaaaatattaaaataatgccataaaaagccttaattggcattaagaattctaatgctttaaaaaaaatgctcaattgacatgaaaaatatcccttttttaattttattcaaaaaataccaattttaaaagattatttttggtccaaccaatggaaaatttgaataccttttacgtaattttctattttaatcttttttttatatctaaaattcctttaatttccaaccccaattaatcatctattattaattgtgtattgtaagaaatgtgcgaaaatgaatgtttttcccgccgggtgcgccattgctatgtcacgaaaaagcgttaggcattggcactggcccccaccatatgtgtgaaaattagttttttttcccacattacgcctgtagtagctgcacttttcgcgcacataatcaacagagcggcctccgtttaatcacaatattaacactaattgcgtcaggcgaggaaaatatttttaatgagtttttatgcccccggggaaaatgagcattttccgacctaattagccttttcccgctgcttcatcatagtccattatacatttttgttcgcgttttaatgtcacaaacacaattcataaattctcagaaatttacatgactcacaatcagacgattttttaaaatcagtttgggtaaggtcgaaaggatacaaacggatatttaattaccgatttgttggatctcaaattaaattcctttatttttatccaatactgatatgaaagtaatttgcttttatgagaattgaaagttcaccctatgttcaagcctttttttcaaaattgggaaattcattccaacagcgcaataagaaatgggcaaaatgttaggcctcgggtggggatcgaacccactcgtccaccctatcttgtgggtaaccctaccacttaactaccgaggcatatccgccctttttttctgttatcatattaagtttttaccaaaaatttaaattaatttttattccataaattattatttaatacacaattaggaaaaatatataaataaaattttaatgcatattttttacttgaagcaaaattacatcaacaaatatccccttttcaccactaacacaactttttaaaaaatcactctcgcctcactcgctccccccccctaaaaaaatcgtatatttttttggctaatgacaaaaaaaaaaaaaattgcccacccctgtcccccgccgaaacaaaaaaaaaaaaaaaattgaaatccaaccctccgagaattgacgtttgcgaccttgggacctcgctcgcttagctttgggcccattctatttttgctttttgagcgagagcacataacctgtttcttcttctatggaacgtaatttgagcacacacaaccccagcaggcgcatttacatagtgaaaatatataagaaaataatttttttttaacctttcttggccacacaacatttggtcattgaacacacagaaaaatgtgagcctttttggccacgcgccatgtgccgtccgccccctacaggtggagagggggcagggtgtcatagaacatagaataaaaagaagaagcggctgtcaccaacaagccatcacactaattgctttggttggccgtagtcgtcgtgtgtcagcaattttaatgggttgtgtgagtgaggagctcaatgaacagcagcaaatggaaagcggtgccgaaaaggttaagccaaccaaccaacaacagctgtgtgtgtaagtgtgccgattgtgagagtttgtgatgggtgggtgacacagaactaagcaaccgaacactgccggaaaatgaatgttttttggcttaaattttttttgatttttgattccctacttttttataatcaaagtttttttaaatgctgtactctaattttaaactattagttattcatttaataatataattagggctaattatgattttttttttggtgaatattttgccatatcagaaatctcatttgctcagaacaattcaatgatttgactgaattttgagttaaaaaaacatttatttagcgcacattttcataaattagaaaatccacttgaattatatgtaaaaaaattaaagaaaattttaaattttgtttaggagttccgaaaattttaaaaaatgattaaatatgataaaaaaaatcccgtgaaaatgatggattcttcaaataatataaatatttggaaaattccttcaattttcattcctaaatattttttaaactttaatgtgactcaccctttaaaattgcattatttttatgaaaaaatagtttaaaaaaaataatttccaatttctcatatgaaatcagaatactttaaataaattgttaattccttgtaaataaagaattgcattttttccaccaatttccactccaatgaactatttcggatatgccattatgttcacatgccatacttttacaagaatgcatttatggccataatgataacacttttcctaagattttttggccaaccgccgcccattaaggccatttccgtgcacaaaaaatgcatttcctgaattagtggagcgtgtgacttttggaggaattagcatgctaatatatgtaagaacattaagtata

SEQ ID NO: 9731 - DNA, 3616 bp, Heterodera glycines
  misc_feature (62)..(62): n is a, c, g, or t
attttcttgccatttttagacttaatataaagccattttttaatttaattattaaatttttntggattttcaatattttttattatttaaataaattagttaattaacatattttccatagatctgctttatttaagccgattttgactcaaaagtcattttttaatttgaattatatttttctttttttggttttcaataaattttattaataaaataaatatatatgtaaattattttccatgactttgctttattcaatttttgctaatttaatttgagccacataaataatattaaaatgtttttcccaaatttttttttgtactttgtggcatttttcgctgaatttttaagcatttatcttcccccaatttttcgtttcacaccctttctatggccttggcaaaattccatttataatccatttatgttttggcactggccggcacataatttggtttttcaacgtgccgaccgtcccttccttaacccaccatgtgaccaaattttttttaacaaaaatcatttttaaaattaaatttaaaatggaaattggcaaaattagcataaaaaattcagaagaaaagttgtatacatgaatgaactttctttttacatatttattttacataaagccacatgcttttcgggtccaatgttcacatatctttaatccatttccatttttaactcaaataaaattgctctaatcttcaaagtttaaatccatttccatttttaactcgaacaaaaattgcttttttgaatatttaattcctctttaattgatttggttcattaattattaatcagcctattcccataagtcattttaacttttaatctttggcagtatgagaaaatgttagaacaattttaattcttaattcacatcttcacttatgtatgtatgtattggggtaaagaataaattctgtcatagtgtcctaaaaaattcatttcaaaattaatgaactcaatttcaaaatctgaaatatgacttattaaaaagcctttaattttctcttacaaattttatatgcaaatcggcaattgtctgtttaagcgatttttaaaaatttcacaaacaattgaatatactcgctatgatagaacttattcctcacccccaatatatggatttaatgggattattctttataaagagtattaatttttgaatggttttttatgaatggatttacattttttggaagttaaaagagagtcaaaataatttttcatgcattattttataaaatgaatagttttatttgattttaaaaagattattttaagaattttgcatgctttagttttattttatttaatatttctaaaagttttcgacagattttatagtttaatacaaattttatttatttattttttaataaattttaatttttctttcgttttcataactttggctttctaagatgggcacttggtttgccgctccgctgcagaatatccctaataaataataagcattttaattaagcgcaaaaaaaagtacacaaaactgagagggcagaccagagaaacaaagacactggagaaacaacgttatttttccgtaagaagaataatgacaaagaaacaaatttaggaaaatattatacagccaatgaaagatgggcacttgagtgccaaagaaaaaaagattgcgcaagactattctaaaagtagagaatgtcgacagagaaaaagacagtagaaaatagtgggtgcggatgtgtgtctcctgcctcataaaaagtgccaaatgccctgagggcatttcccgcattggccacatgccgtaaatgaattggctggggcagggccatgagttgtgagtgagtgggtagcgccgagcggaaaacgtgaatacattctcaatgatacgacaaaaacattttcctcggcagatactgcgcgaatgaaaagggcactcatctcctaattaaggatacctaattagttttttatttttattattttccgttttattacatgaataataattaaaaatgttttctattttataaaattgcttattttttaaatgaaataaattactaatttattaatatgaattatttttaatataataaaagggaaaattccaccaaaagtgtaagcggcaacaatgcccttcttttggttattttatttttgaataaataaataaattttaattttgatttttttaaatgctcaaaaaaaaaatatttttggtatataataaaaaaaaaattccccatctatcatttatttggatcttatttgattttttcttgactaaaaatgaatttcattttttatttaattataaataaatgaaaatttatttatttttgtgtaattaaatttcccaaaaaaaacaatgataaaaatatttttgtttttcttatataaacatttccagtacgcctccctaatcaaattctgttgctcctccaaccaccaccaccttttcaccaatggcacattcttttcaacgaaaaatgccgtaactttttgttttcttcccatttttttttctcacaatattcaaaatgccaaactaaaaccaattcaaatatgatgccgttgttgttttgcgtttgctgcctgctgtctttcggcaacaaatttctctcattaaaatttctgtgccatgaaaattgagctttttctcatcgcctccgcatccctgccggcggcgcggagtgcaaaaggcaaatgttataaaaacgccttaacccccccccccccccctccctccggggccgtcctcgtccaatccaatgacatgccatataagactgataaactggcactttttaatccattcatgccgaaaattgtaaaatgatttttcaccctagataattgttgattttggcaagcaagttttagtttttttcgtgtaattcttggtaaaaaaaaattggtttaaaataaatatattctttcgagtaaaattggcacgcaaatttcatttttaaataaaattgttgaaaatttttgaacatttaatgagctctccagctactcttatatattttgaatttaataatattttcaaaaaattaataatatttataaaaaaaataaatttaaattttcgcttttgttcaaaattaaatttggttttattaagaaaaaattttaatgaataaatttaattacttaaatgacatgcctaaataatttcttttttatttctcaattattttgtgaataaaatattaaaaaaatttttttagatttttccaaaaatttcgaaaccataccttgtgaaccattgcaatgggacaatccatgggcaagccgcacaataagctgaagggagacgatgtgaaaaagttggccaaacagacatactgtatgtttattttttgtaataaaatatataattattatttttttcaatttagtcactgaaaaagaaatccgacaatggcacaaaggctttgtcagggactgtcccaacggcatgctaactgaaattgtaaattaaaatttattttaaaaaattaattaattatttttcattattttaagggcttccaaaagatttacaagcagttcttcccccaagagggtccatctgattttgcagcatatgtgttcaaggtgttcg

SEQ ID NO: 9732 - DNA, 3807 bp, Heterodera glycines
  misc_feature (856)..(856): n is a, c, g, or t
ccaacgataacaacacgccaagcagcacagtgttcagaaaggggacagagaaaaggagtagcagtgcaggagcacagacacaaaacaataaaaggtacaacacagcagtgtgaagagacggacgaacagcagagaaagaggggaacgaacggcacagcgaaaaaggaactaattgactaattagcaacaatgtgcgagccaaagcccaagcaaaataacacacgattagagcatataatttacaatgcgctaatgtaaggcaacttaatttgtaaagcataaaatattttttaaaatggcaacaattcgaagagtaaaactgctagtaaaaaattgttcgaattcatccgggttgcttaattaaattcgacttgtccgatcactgaagaaccaacccaatccgatcagaaggaatgtcggggcatttccaattgtataggtaatattgcaaattgccatctccgatgccaaatttgagatcctccagaattcccttgttttccatcaaatccaaagcattgaatacgtcaaagccaagctgattgtgaaacaaatttggatatacccaaacgaacggaaacaaaaagaaaaaaacgaacatttcttgccaaaatcaacgcatcgttcaaaaggtggctgagcggaacactcccggcgacattgtagaaagaataagccgcctttatgcttttgtggtgggaatggtgcatcactgtggagggaaggctgtagaagctgaccaagtcggtgacctctccgttgttctgcaaaaatgcctttttattgtcccccgtctcgcgacttatcagtcggttttcccacctgaatcatataagtgtaaatgacatcatcgcgnggcaggaagaaatgttcgaactcttcgatggtgaagatggggaccaagtcgaatttggtcaaatatccgctgagcaattcgaaggcgcttttggcagaatctctgttgagtagcgtcaattgagactcggtgttctgaaaatgcaatttacaaaggctgaaaatgttcgaagactcacttcgggcagtttatacaattttatcatacgaggaagcgtcatatttttgccaatatgcgaaaaacttgactcgacgagctttttcgggttcaatgaccggtgccaatacctaaaaaagtaatatgtatgactattatgattcaaaaaaattgctaccggcaaatgcccactggcttaggaatgaaaatcccagcggtgaaagtcgcttgaaaaatcccaaacaaattgactcgtcgggtgatttctttgattagcactggcgccagtcttttggttcgcagctttttgtgcacacaaaggaaatttatttcgacagatttgacggttttgtcataaattcgaattgtggcaggaacagcagcgataaatgccaccaattttccggaagtaacggcccttaccccacaatgccattgttgctgccaaccgtgtggcatcagtgccctgaagacaaaattgagcaaatttgagaaatgcgggattatctctgctggcagtcatttatttattccgactgaatccgtacaaaaattggaaattagtcttttctaaattaccatatgctaaaacctatcgattttgaatttgcagaaatattattatattttcatgatgtaaaaaacgttgaaaaagatgccctaccatcgaatattaccaattttggttgtcctaccatttcagaaaatttttcccataatcgaagcgaaacatattcgcgtcgtcctcaacataattctcggtcaaaagaatgtacagctcatccaattgttcatccgcgttgagatcaatgtcagaccaaataaacttttccaacaatgaatacggatctttttttatggtcgaaacatcaagcggaggatcaatgtaattgttttcggttgttgttgtatcttaattaagtgcaatgaaaaaaggcacaatgcaatccgcctacttaattttgggacgggttgtgtgttccaaaattggtatttgtgatgctttgcttcgaatggatctcttacagccgatgaactggtcgatgccgcctggatgagctgaagcttacgagcaaattccgctgctgccatgtcggaattaatttgtatgggttcgacgtcgttcttaacattttttcgctttggtttgccttttgctgctaaacttttcgcaatttgttgtttttcatcatcattcatttggggcttttcatctgataaatcattttgagtctcatcctctttttgttccaatgttttgtcgtcgtctgccatttagaataaaaatgaaagaaaattttacagaatactcatgttgctgaaaatgggtaatttgataatggtcgaacattaagatggaaatttcctaagttcctttctaaaccttaatttttgcagcacatacatacctacacatccgcattccggatccgaggattccggataatccacaatatgtagcattaattagtaatttagattatagaataaaaattggcataatgtttgtaaattaattatttttaatagagaccggcgtgggatcctgcgcgggattttgcgggtcccagtcgggatttgcgggattaatcccgcgggatcccatcccgcaaagaattttgagttccaatccctcagcggaatccgcaaatttgaaatttccggtctctaatttttaagcttaagctatagcagataagcttggacacggcgattcaattttgggctccaagtataattaagttggttttttcgtaggtggtctgtgagttagtcaccaaaaggggggtctcaggttcaaatcctcctcatgttgtgtgttaatttcaatttcttcgtttaaagaagaaaggaaaaattattttccattaataaaagttttcgtgtcaataaaaatcatattcaaaaagcgttggttaggtacatcatcgataattttatgaaattttccagacttataactcgggcaataataggccaaatataataattttatattcattttaaagagaaaattctggagaatattgtaagttttatttgatttggctttaaatagcgcacttggctaaaaaagagttaaatttattgaaatttttactagggtcaaaaaaattttcctcgggtcagattttcttaaaattttgcataggcccatattttgaccccctctatcgaatcacattttattttttacctgtctagtttttaactcgagatcggctcttgtgtttttacaagggaaaatcccctaaaaaatttaagtatcgcaaagttttggcgttctgattacaaaataaataataaacttatttgcactgggagcccaaaattgaatcgccgtgtagagtaattaaagttctgcttcttcacacccagagaactgatggcaaattcattcatgcaaattatcattgttccttcataatatttgagcaaatctaatacatattatcttaaaatttatgcatttttaaattcgaaaatgggacagaaggaatcccgtcatgcgtttgtcaattgtgccttgataaggcgagaagaatttgaagacaaaattcaggaactcaacaaaaagtttggtccattttttccttaaattctttagcgtaattcagatgtgctgagtgttttgaagaaagtactttaaatatgctctttgctacaaaatccacagaagaacgagggattttatggcagcgttctgtccgaattcactgctttacggtttcactttttgggttacttttaaaatgaatggtgatttcaggttttcgatgaaaaaattaccgaaa

SEQ ID NO: 9733 - DNA, 886 bp, Heterodera glycines
ctctcgtcgttagccttgttgttctgatcgacccaccaaacctttccaatttgacggcagggacgccttttttgaggagcgggggatgtagtgatattttgactttgaccattcgatattattttaatttattatttttggcattttgtttagttatttttgttgagctttttcatttgcgtttttttttagtcgttaattgtagtaatttgttttaataatgattcgtggtaattgcggatatttgtgtgctgtggaataatcttgtttgtgttttaattgtgcagtcaattgcatttattgcgaattgactgagtcggcataattggaaagaagccgaacgaattggtcaaagtccctaataataatattgtccccaatctctcctgtcctaattaaagactgttcccgtgcccctgccctaattaatctaaggcaaataagcagcgaacagcaccgaacggcgagaagtttttactattcaccaacatttcaatcactgggactcaacccaacagcatttcaatcactgggactcagcccaccaacatttcaatcactgggacaacccaccaacatttcaatcactgggactcaacccaccagcatttcaatcactgggactcaacccaactgcattctaatcactgggactcaattctcctgcatttcaatcactgggacaacccaccaacatttcaatcactgggactcaacccaccagcatttcaatcactgggactcaacccaccagcatttcaatcactgggactcaacccaactgcattctaatcactgggactcaattctcctgcatttcaatcactgtgactctacccatcagcatttcaatcactgggactctgcccaacagcattctaatcac

SEQ ID NO: 9734 - DNA, 4319 bp, Heterodera glycines
  misc_feature (3849)..(3849): n is a, c, g, or t
  misc_feature (3851)..(3852): n is a, c, g, or t
  misc_feature (3854)..(3855): n is a, c, g, or t
  misc_feature (3859)..(3860): n is a, c, g, or t
  misc_feature (3863)..(3864): n is a, c, g, or t
  misc_feature (3867)..(3868): n is a, c, g, or t
  misc_feature (3875)..(3875): n is a, c, g, or t
  misc_feature (3877)..(3878): n is a, c, g, or t
  misc_feature (3886)..(3886): n is a, c, g, or t
  misc_feature (3895)..(3896): n is a, c, g, or t
  misc_feature (3909)..(3909): n is a, c, g, or t
  misc_feature (3920)..(3920): n is a, c, g, or t
  misc_feature (3926)..(3931): n is a, c, g, or t
  misc_feature (3951)..(3951): n is a, c, g, or t
  misc_feature (3954)..(3954): n is a, c, g, or t
  misc_feature (3956)..(3958): n is a, c, g, or t
  misc_feature (3963)..(3963): n is a, c, g, or t
  misc_feature (3966)..(3966): n is a, c, g, or t
  misc_feature (3968)..(3968): n is a, c, g, or t
  misc_feature (3972)..(3972): n is a, c, g, or t
  misc_feature (3975)..(3975): n is a, c, g, or t
  misc_feature (3977)..(3977): n is a, c, g, or t
  misc_feature (3979)..(3979): n is a, c, g, or t
  misc_feature (3987)..(3987): n is a, c, g, or t
  misc_feature (3990)..(3990): n is a, c, g, or t
  misc_feature (3992)..(3994): n is a, c, g, or t
  misc_feature (4002)..(4002): n is a, c, g, or t
  misc_feature (4010)..(4012): n is a, c, g, or t
  misc_feature (4018)..(4018): n is a, c, g, or t
  misc_feature (4027)..(4028): n is a, c, g, or t
  misc_feature (4030)..(4031): n is a, c, g, or t
  misc_feature (4037)..(4038): n is a, c, g, or t
  misc_feature (4041)..(4043): n is a, c, g, or t
  misc_feature (4050)..(4050): n is a, c, g, or t
  misc_feature (4052)..(4052): n is a, c, g, or t
  misc_feature (4070)..(4070): n is a, c, g, or t
  misc_feature (4075)..(4077): n is a, c, g, or t
  misc_feature (4083)..(4083): n is a, c, g, or t
  misc_feature (4088)..(4088): n is a, c, g, or t
  misc_feature (4101)..(4104): n is a, c, g, or t
  misc_feature (4112)..(4112): n is a, c, g, or t
  misc_feature (4125)..(4128): n is a, c, g, or t
  misc_feature (4132)..(4133): n is a, c, g, or t
  misc_feature (4148)..(4148): n is a, c, g, or t
  misc_feature (4152)..(4152): n is a, c, g, or t
  misc_feature (4158)..(4158): n is a, c, g, or t
  misc_feature (4167)..(4167): n is a, c, g, or t
  misc_feature (4170)..(4170): n is a, c, g, or t
  misc_feature (4187)..(4187): n is a, c, g, or t
  misc_feature (4189)..(4189): n is a, c, g, or t
  misc_feature (4196)..(4198): n is a, c, g, or t
  misc_feature (4203)..(4205): n is a, c, g, or t
  misc_feature (4226)..(4226): n is a, c, g, or t
  misc_feature (4231)..(4232): n is a, c, g, or t
  misc_feature (4236)..(4236): n is a, c, g, or t
  misc_feature (4238)..(4238): n is a, c, g, or t
  misc_feature (4256)..(4256): n is a, c, g, or t
  misc_feature (4266)..(4266): n is a, c, g, or t
  misc_feature (4277)..(4278): n is a, c, g, or t
  misc_feature (4290)..(4291): n is a, c, g, or t
  misc_feature (4293)..(4293): n is a, c, g, or t
actcaacccaccaacatttcaatcactggggactcaacccaccaacatttcaatcactggcactcaacccaccaacatttcaatcactgggactcaacccaccagcatttcaatcactggcactcaacccaccagcatttcaatcactgggactcaacccaccaacatttcaatcactgggactcaacccaccaacatttcaatcactgggactcaacccaacgcattctaatcactgggactcaacccagcaacatttcaatcactgggactcaacccaccagcatttcaatcactgggactcaacccaccagcatttcaatcaccgggactcaacccaccagcatttcaatcactgggactcaattctcctgcatttcaatcactgggactcaacccaccaacatttcaatcactgggactcaacccaccaacatttcaatcactgggactcaaccgtacgggggccttcggctccattccagtcaccaaaattcaatctcaccaattcttcgaaacccaatatccggaaatgaatgataaaaccgacagcggctcgaccgcttagcggcctcgcactcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacaaacaacaaagaaagaaaaagaaacatttttaagactgttttttacacaaaatgacaaaagaaaaaaatgtaaaacaaaaacatttcattttccaaagcatttatacaacacaacacaatgttaatattataggattttcttagtgaacaaactaaggagtgtcctctttcttttgttaaatattttatacaataaaaaatgggttataataaggaagggatgcgagagaaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgcccctctcacccgccgctgcccgcgtagacagacaatcagacagtgcactatttcccaccatccctccctctaacctctacatcctaggaggagaaatcttttaccttctttttctgtgctatttcttttgccttcttcttcttcttaactatttattttcgtctcttttctttatattctcttctttttcaaaacaatttcttttcatctcttttcaaattcatttttaacgcaaaactcaaacaaaacgccacacaaattcaaacactggacacacacaacagacactcaactttaatatataggatttcagaaaattacaatagttaatttctaaaaattcacacttaaacagttttgaatcgcttaaatataataatataaacgcagtttctcattataggtttttaattcatcatcaaaatataccgcccgaatttctagagagaagcttcagagttttccaaaaaatatgctggtacccaaccacaggcactaaaagaatctttttacaacgtcatttcatttttcccaagaataattggcaataagaaagaatttccaatgttttttggcacacctgggcaaataataaatatgcaaaggttttataattttcttattaaaatacttaattatataatggaatttgtttaattcgtttttcctttttgttgaaaggaatgaatttaatgatgatttcagaaaattaatagggtttatttctaaaaattcacacttaaacagttttgaatcgcttaaatataataatataaacgcagtttctcattataggtttttaattcatcatcaaaatataccgcccgaatttctagagagaagcttcagagttttccaaaaaatatgctggtacccaaccacaggcactaaaagaatctttttacaacgtcatttcatttttcccaagaataattggcaataagaaagaatttccaatgttttttggcacacctgggcaaataataaatatgcaaaggttttataattttcttattaaaatacttaattatataatggaatttttttaattcgtttttcctttttgttgaaaggaatgaatttaatgatgatttcagaaaattaatagggtttatttctaaaaattcacacttaaacagttttgaatcgcttaaatataataatataaacgcagtttctcattataggtttttaattcatcatcaaaatataccgcccgaatttctagagagaagcttcagagttttccaaaaaatatgctggtacccaaccacaggcactaaaagaatctttttacaacgtcatttcatttttcacaagaataattggcaataagaaagaacttggaattgcaatgattagccaccgatttgacttttacgtggacgaacacttcaaaactcgcaaatggacgctgaaaatcatggaaattgggcaggaaattggagagaatggcaccaaggaaatggaaattgtcaatttggatggaaatctattgccaattccgcaaatccaagtgccacgcaaagtcatcggattcgaagccatttcaataaggtgatgagaatgattttttggtgttttcttttttttaaacgattcatttatttttttacagatacatcgaccacaatgtcatcgcttttgtccaccattttcgccaacttttcgccgcctctccaattaatttgtccatcgaaattacgaatgaccgtcgcatttcggagtcgattttgcacaacatttggccactgctcgaaaaaaacattcaaagcataagattgtccgacgaaaatttccgccgtttgcgcaaattggtcccctcatttctcagcgattgtccatctcttcgctttgtcttttcccattttgtggatatcttcatcgaatttccggccgatgacaatgccatggcatcggatggacaagcattggccaaatggcttttcattgcccgtccggacgatgtgccaaaagtgttcaattgttctcttgccaaaacattgaattgggcgtcaaaaattgaagcattgaaagcggtaataaccaaattaattaatttaattgtattccaaatttcccacttttcaggcttttgcctcggcttcatctcctgtcaatttcatcgctgttatttcgttttttcatttgtctgctcaacactctgttgtgccatttgtgctgaccaacgaattgactcgggaacaatttgcgttgaaaagaattgacaattgctatcgttttttgttagtgcgttgtccaattgcgcgagacgaaagcaaatggacaaaatgggagacggaagcgatcgggaaacggtaaagaattgttggcaatcctgaagaattggggtttctatttaaaaatgttttaatttgctctcaaaatcaggttccggggattttcgagggcgatggtcatgaattaggacttcgtaatcgagcaagtccgagttagtttcgtgataaagcaacccccgaaaacccatggaaaatgattttgagaccaaaataaaaaacttaaattttaggggcattccggcgactgctttctttgaccagtggaatctaattgacattcgaattgatggtgaggatgacatcggggacgggtcggtgaatttttttttctaacattcaatttatataatttttcgtttcttagacttctcgacgcaactcccggcccaagtgatcagcngnngnngtgnntgnntgnnttgttgngnngtgttcgncccctttgnnttgcggtgttggnccctgctttgncgtttnnnnnnttgttcttttgttgcggtgntcncnnnttgtnttncncttngtntntntgcctttnggntnnntttcgcgnttttctgnnnccgttnttggctttnngnntgtttnngtnnnccttttngnggtttgccggcgttcttnttggnnncgtggntccgncgtttcgggttgnnnngcccggcntttttggctgggnnnncccnntttcgggccttggtnctcntttgtncgtttctcngtncccggtcccgctccgtngngtccggnnntttcnnntttgcggttcccgctgcgggnctggnnctcncncttttttgcgggccgggntccctcgggnttcttcccgcnnttcccgcgtttnncntttgcgggttcccgcgcgggtttttg

SEQ ID NO: 9735 - DNA, 1113 bp, Heterodera glycines
ggatttttgagagtaaaacacataaaacttaatccaaaaatttaattagtggttatttaaatgattatcttaaggatatattttcccgatttattgcatttttaatggaattttcggaaaaaaacgccaaacatatattttgagaaaaactcaaaaaaaatatgaagtctgagaatttttctcatttctcgcatatcgtaatattttggcataatgtgttacatcacgaaattacacaagtcagaactatagcaaatcgaatttttgattatttttgtgtcacaatgtaaaaatatttgtttgcctttgctaatgcctttaattagttttaaaattcatattcgggtttttcaagagattaaaaaattctgctgtttatgtaaaatatttggtcaaagagaaggaaaatttattaaatttaatattttacataaaaagaatttggaaaatttgactaaaattttatcgcatttttgtaattgattttgtgccaacaataaatttcaaaaaatccaggtccaggcctggatccaggtctcgaggagcctggatttttcctggacctggattttcctggatttttgtccaggaaatccaggtccaggtccaacatggaatccaggtccaggtccaggcttttttcaaaatgttatctctaccaaatatgtacataaaatatgtaagaaaaatcccaaaatatgtacaaaaaacccctaatatgcaaataaaaatttttttaatggtattttttgggaaagaaattccccgtaaagtatgaaatagccacaaaatgacataaaaattacttttttggtatttttaggcaacattttcaaacttattttttctttataaattttcaaaatatgtaaaaaatgaaaatatgtacaaaaatatttgccgaaattttggattttttttttgaggatttccaaaaatttctgtaaaactcaaaatatgtacaaatatgtaagaaaatcccgaaacatgtaaatatcagtgattctttttttatgtaaatacatgtttttttcctggattctccatagcctaattagtaggaaaacactttcttttttgttttgagaacaaaaagcgggaattttattcaca

SEQ ID NO: 9736 - DNA, 3468 bp, Heterodera glycines
  misc_feature (67)..(67): n is a, c, g, or t
  misc_feature (72)..(72): n is a, c, g, or t
  misc_feature (162)..(162): n is a, c, g, or t
agtaggaaaaacactttcttttttgtgttgcgaaacaaaaatcgggacttttatttacatatttggngattnttctacatattacatatgtacatatttttatacatatttgggacttttcgccattttttcgtatatattttgcaatttttgaagattttnaaggaaatttttattaaatgccccaaaaaatccaaaatttagcaatttttcgtacatattttcatttttttcagattttgagaatttatagaaatttcttgtgaaatttagatttttttttgagaaatatacctctaaaaaatcaattttttttttcaaaaacataccaaaaattaatttttaaagtactaaaatgtgattctaggcctatttgggtcatttttattgcattttatgcctatttcaccctttacgaagaatttttccaaaaaaaataaccgttaaaaaaatttttatttacatattttcgtacatatttgggagtttttgtacatatttcatacatattttagcattttttatacatattttatttacatatttcgcgatttttcttacataaaaaaagaatccctggtaaatatgtataaaaaccccaaaatatgtaaaaatatgtaaataaaggtcccaacttttgttcgcaaacacaaaaaagaaagtgtttttcctgctatttagagcaaggagaagccaggaaaaaatatgtatttacataaaattggcagccataaaaattaaatttaattgggtccaaaatttttgagacggaaccggccctttgagtacaaagacggaactgccagacggaaccggctccagacggaactgacccacttcgtcagggattggttgccgcaaaaatattttttcggattcttcaattacagaccgaggactatcaaatatttcggccattttggcctcagtgccatatgaccaatatttaccgaaaaaactttaaaacaattaaaatataagcaaaattaagttttttgattaagtttttacgtgaaaaacgcatccctaaattacctattttattatctgaaaatgaacaaaatcaattaatatttgagtcatcaattaggtaagtttaattacagcatggagatcatttgtgagatcacgtcttcttctgttgcggctgcttctctccgcttcctcctttgccgttttcatctcccgcctcgcctctgccccggtaattggccaccagcttctggaactccgcctccaatgtccgtcgtgcgctgtcactgtccggaatttgtaaaatgtttgccaatgcgggcacatcaaaggttgtgtcgaaggccttaaaatattgagatttggataatcttccttttttctaccattaatgcgccatgaacgcccgagtcgacggcattcgtaacaaagtctccaagacctatctttttcagccatttgatcacccgctcatttgaccagaccattagatctacataattggagatcgtcaattatttaatcgcgtttcgacaaattccctctttttcacctctgttgtcgttttccgatgcgtttcgccgttcttccaatttcttccaatcataattcaatttcttcaggcacacaatgccgtagtgtaagcttgtccttgaaagaaccatcaaaataagccaatcaaaataatgaaaagccgaggataatattttttgactttttcattcaaattcttttcccaccggtgaaaactgtcgatcattttcatttcgccgagatctcctttgctcaaatgctccaacattcgcgaatcaaccttgaaacggaaaaattaatcgtaaaaaagaaaaaattcgatcaaaacaagttgtcgccccgggaggatttgggttccttaatttttacatagtcggggtagaattgggcttctaaatcccacacaaagcgacctcaccaggcactccatgaactcggtgcggtattttccaagaccatgtgaaggcagccattcgttgcgaagccattaatctttcatttctcgattctttcattgactctttttgtcgcctccatttggcattttgtcgctggtgccgatcgccatgccattgagttccgtgctaccgccacattccaagtcggacaacggcatattctctcctccgtttgcaattttccttgaagcagtaaaaaatttaaaaaatgggaaaatctgactaataattaataaattccgtccaaaaattgacaaaaatggatttaacccaaattagcacatgtcgttttaccccgaccgtcccacctctgctcgagtgccatccaatcattgagggaataggaggtgatgttcattaagcattgaagatggtccatccacgttttctctttcgttttagtcgtatcagaattttccaacaacggcacagcgagacgttgtcctttgtataaatacgtcaattgatcggtttggcggcaatgattggcacagagagcatccatcacattttgaccgatactgaaaaaagggttgatgtaaagacagtaggacaacaaaacactcacagcatatccaacggtaatcctttgatcacatcaaatgtaacacgcaccttcgcatcgccaatacgtacaacaattgtcaatctgaatttaaattcatgttttaggcgatgaaattaatcaaaaacacaccgtccttgcgtcttagaactgccgcctattccagtaacttttgtagcgcgacgtttgtcaatgtgtccatgcaggtagtggcggcaaacaaattcatatgatatgactgatcccatggaacctgtaaatgtaaacaaaaaaatgaaaaaaaaatatgcacaagatgataaacacctgaatacaacatgccaaagatccattggccattgacaaacaccaagatgtatttcagcggtctgtaggagtgggctttgatcacgctgtcagtagaagtggacgtagagggactttctgatgaactgctgttggaaggcgaggtgcttgaatatgatgatcttggtgatgaactggatgaacccgacgaagtggatgagccagacgaagtggatgaacccgacgaagtggttgaactggaagtactgcttgaggaatctggtgatactggcacggcaaactaaattgtaaaaacgtctctcaactctcaaaacaccaacaataatcctaccgcttaaattggactgccgcagtgatttcctttcgctttgtaatggaccatcagacattcgggccaaaaatttccattcggagtgggctcgtcgtaaaggaattgacgacggacgaccttctttgcggcacttctgaatacgctaaaacaggacgttataaaacgcgagtttagacaaagaagagttaaaaaaagaaaaaaaagaggaaaaaagaaagtgaagccaaatgatttcttttgcttacagcgcttgcttatatacacattgacacagcgcaatgccagcgctatgggtcaactcc

SEQ ID NO: 9737 - DNA, 1178 bp, Heterodera glycines
  misc_feature (1079)..(1079): n is a, c, g, or t
  misc_feature (1087)..(1087): n is a, c, g, or t
gaaaagagaaaaattttttaaaacctaaaaaaactcattataaattccaaattgtcgtcagcagcgcctataggcaccgccggccccaagtttcccctaaattctcaaatttggcctaaaaatttaccaattttcggtaaaaagttgttaaaaattatcaaaatttccaatttttccctggcgcttgtcggcacggcacagactctccctgttggccaaaaattttttgaaaaaacaggccgcaaaaaaaaagcgattttagaagcaaaaaaaaggaggtcgtcggtttcatggctggaacccttcatagaatttcggtgccccttttcaggcatggattaaattattgtaaataattcaattttaagaaaaggaatgctaataaaaacaaattattttttaatcataaatcgattttttttgatcaattttcttgaaaaaaatacaaaaattttcctcaaaaatacttaaaatttagacaaaatgccaaaaaaaagttaagacttttccaaatattttctcgagaaccctactgctgctggtgccgctgataatcatggtggttgtacaactcgggcggcgagtttggcacgccgccgcccccgccggcgccgcctgtcaacgcggcgaccagcaaagcggcggctgttgtcgccgccgacgccccactcgcgttgctgttgctgccgccggtgagcattgtactgctcgccgctgtcgtcgccccagtcgctgtcatgctattgctgctgctgtaataatccgtgacggcgattgttgttgtgctgctgcttgttgttgcagttgctgcagtaccattaccgttgttgcttaacatcgttcgtgcgcgcacacacagactgatcaatcaatagttgattgattgatttattgatcggtgttgtttaaatgatacagtacacttttttgctgttggtactgttctgccctctcaacacgacgtacggtagcgtgtgccgtgttgacacaattctctctcacacaaagcacacaatattatgccggctaagggaacagagagaaattaaccaattaattaaagttgcacgtaatattgngagtgatncaagggaaaatgtataacaaaaagatctatcaaaaattaaattttaattttggcagtgatcaaagggcaaatacctatctaaaaatgatcg

SEQ ID NO: 9738 - DNA, 4237 bp, Heterodera glycines
  misc_feature (4174)..(4174): n is a, c, g, or t
gacgacaacagttggcttcttcaactgctgctggatggatgctaataataatgggtgggtgaggggaaggggaaagggtggggatgaagccaagagacttttgctctgcaaaagagcctccacaaatcacacaatcatcagctttacatacttatgagtgggtggagggagtgcagcaaaatttggcattttttgcgcccccccccccgccttttcctgcccaaaaagggtgggggtaatgaaggggtggcattttggcattttgggagggatgtgccgtaattgtttcatagggtgccataaatgacagcgcaaatagtgcagaggagaggaggaatgacgtcataggatgggtgcctatcttctcaaaaaaaatatttataaaagtgtattaaattaatagtggctaaatgccatccttgacaaaagatcaaccccgcccagtggcaatctgtcaattgtgggcaggggatgaacaaagggtaaagggcatgttaattgatgatttaagcaaatgtgctggatttccagggtgtgtgatgatggcgaacagcaggaactgtccaggatttcggtttggaggggatacggtctccggggcgacgactttttttttgcgcttttcacgcccttttttgcgccgtgttttaaaaaaattttcggagagtaggggggggggggtggtggtccggagatgccgacaggcaatgccaggaaaattttaaaatttttgccattttttaatagttttcatcaacaaattgctaaattttgtggattttaggaaaaatttagcgaagtttttttttgataaatttggatgagggggatcaaggagggagggccaataaggaaaaccgaaattttcagcacaaaatacatttttacctcgaaaatttctagtgtggaaaaaatatgaaatgtgcaattttggacaaaaattgtcttggaatcgaagcattaaacagagagtgccaaagcttgaaatggggggccgataagacacataaatagggatgggatttttagtgataaaaaatcccaaaataattaactaaatagtgaccaaaaatgccaaaatagtggcaaaaatagtggcgaaaaagttccaaatttaggggtgtaatttcctaaatagctattttttaatttgaaataatttaaaattaaggaaaaagattttattcactgattgcagttacaaaatattttcttagcaaatattgaacaagaaaaaaaaatttgggggaagaatttttgtgaaatttttccaattcttaggggtgtatttttgaaaatttttaggtcgattcttaggggtgtatttttgaaaattttttaggtcgattcttagggggtttatttttcgtttttattgcaattttgggaagttttccaaaaatgccgaaatagtggcaaaaataatgacgaaacgccaaaatagtggcaaaaaattattttagtggccaacttccaaaataatttttttttagtggcaagctccaaaatagttattcctagtgatgaatagtggcactaaaaatgaaaaattttcgaaaaagaatgtgtttttcgtgcatttctcgtccagttaaagccgcagaagaaatagttaaaaaactaagaatcctcaccctacacataaaagggcggatgtgcctcggtagctccgtggtaaagctgcctactgaatgggcggacgattgggttcaattcccacccgaggcctaacattattttgcccatttcttcttttatcaatattatgacaatcgggggacagtgggaagtgaaggggagaagcatccagaggtaaagcaattgaaaagcgccttagaatggtgccaaatttggagagagtgtggcgtgccataaatggcaacagttaaaggaaatgcggtggcataaagtgcctcccgatgcttaaaagagggtgtcacaatgatcattttgggaaaaacaggcacgcccaaatgggaggaggggaagaggggaaaagcatggagagagtcaagggtttgagattgattgatgacccccccgaaagatcagtttttctcgagatttgcagcgatcgggaaagataattgacccattcagagattcatagcaaaagcgggattcacatttatcccaatgttcagacagtatttcctaactcgtcaaatactctcagtcaaagagttgatctaaaaattcgtggactaagactgagaaattgttcctagagcagtccccaaggtacgataattgaaccaatatataattgagccggaaatccgagaccaagataatgaattgttcaccgagaatcgggaccaaaacacaaaaaagttggcattctccaaatcgagactgatgtctatgtggaaaacgaaacatggagaggggaggaaaagcattggaaaggaagaagaggggaggaaaagcattggaaaggaagaagaggggaggaaaagcattaaagcctaaagtgggtgggggtggtgggcgtgtttgttgtgttgacagaaatccaaatctgtgctttaagcatcatatgtggaaggacccgatgtgatttgaagcgacaagccatgccatggctaggagcgggggaggggatgccaacaaaagtcgtttccggttgatcaatgggtacgccattgttggcattggcattttttgccctatcgatggatggaattggcatcaatcaatcacccccaaaaatagtgggggagtaaatatgttttaaaaataataataaacagaatttattcaacaattgcaaaaatatataaaaatatatgtgcacatcagcagtgttcttactgtttgaatgatgggcaacaaaactagcccacaaaaaaagacttagtcaaagaagtatttttaagttgttgatcgaatgcgaaaaggatttcattcgaaaattcttaacaaacaaaaaaactattagtctaattaataattataaaaaattgttaaattgaaaaaatttggggaaaaaactgtagaaatctaccccttcattgcagttttgttttcacaatataataagacaaaaataagtacggtaggcctaaaaaagtacatatttattttaattcattactattattaacagaattttggtcaagatctttgatcagagcagctgatatgatgtgatcagaccgaaacaataaaacatgcatggttcatgatgatgttttaagtgatctgagactgagagagaaagacgaagccattaccaggataataataattttaaactgtgaacatgtcataaggccttacttaccatgattcaaatccatcacataatcagagtttggtttaaaagtaattggggcgcaaaatttttagatttttaaatattttgaaaaatttataagttttgaatacctgggcttttctgaccaagccggttcttaaaaaaacaaaaacaaatgaattttaaaaaataaggacaaattttcactaaaaaattgaaactttcagtttgaaattttcaaaaatctatgggaaaatatagaaaattccgaaaatttgaaatgatttttctactatgtattaaaactaaaaaaaaactaaatttataatccatccttttatccgatccacacacacaccacattattcacacattcgcttcttcgcccgaaaaatttcacagctttttgtgctgttggcaaagctgcttttgtcacacagagattgactttccacgacacacaatcactcattcactaattaggcgacttttaaaccatatttagtaattagtggttaattagtttggtcggaagtaggagaagagatgtgcattttgtgtatattttaggaatttaattcactctgaagaatattgtgctcgctaattagttgactgttgtccaattggatagatcgcccattggagggagtagagccaatttctataactcattagtagtttattcgaaacttttctaattgcttccaaggatgacgaaataaaaaaaagactcgacaacaaaaataaacaaaaaaaaaaaatctttttttttcacaaaaataaaaaaagaagcgaaatgagcataaaattttaaaaaccgaaaattaaaagaaactttttcatggacgaaaattaacgaaaaaatgacaagggaacaaaatgaaaagcgaaacgaaatttcgttcattctgnggggttttgttgcgcgtgatttttcaaaattttatttgatcgggagagcgggagggggggggg

SEQ ID NO: 9739 - DNA, 942 bp, Heterodera glycines
ggggagtggggggggattttttaaaaaatgagaaattttcaaattttcttggcatcccctcagccctggaatttttccaaaggcccagcaacagcattttttcttgctactagtggaaagaagcatggaagaagcatcatatggacagagacgggatgtccggcgcgattttagagcaaaaaatgtgtcaaagattgatgatggtggtggaaaattttttgggagtactcctcccatcgcgcaacccttccgccccccaggggagagagagagagcattaagagtacctgctgctgatgatgatgcacagcccccgaggggtgggcgggggggggggcaacgcggtggtggtggaaatagtggtgatggtggtggtggtaggtaatttctcgaacgacgacgacggacaacccgacccgaccaacacaacgacaaccgacgaccgacgacgacgaccaccttgtgtgcgcgaaattttttggggagcgaaaggtcaacgacagattatgcgcggcgcgggagcgccgcaggggtaaagggagcggaacaaccgaagaaaaaaaaaggaacagcaaattttgggggggggaagcggaaaagcacaaagaatgaatgagcagcagcgagcgcttaatggaggagccgatgggtgggtggggtagtgatgaaattaatggaaaatgaagtgctttgatttgacagcctcatgggactgagatggaaaaactgatctggcagattcccatcgcttcaaatgggtggggactgaattgttcaacgctatgagttgatacaactaaaatgggagggactgaaaattgatcaaatgtgatctggcagagattcagccgtccgcccaaatggaaggggggacttaactggtcaacgccggtttggcactacgaaatgagaggactgaaaattgatcaaatcaaagcggag

SEQ ID NO: 9740 - DNA, 5189 bp, Heterodera glycines
tcgtctggacacaccgactggacgtgtgaatgccccccccccaatctcacctctgtcatccacctcgtgcagaataagcgcctgtttgctatggtcgctcaaagcgcgttgtggtcgcgtcacgtgcccaagcacgtcaaacaaaaaaccttcgacacgtgtgctggtgctcgtacccggtcgtaagtcgtttccatcgtcgttgataggtaatggcaaattcgtggaaatataacctaaatgatagcggcgcgcttttaaaaaaatggggaacgggaggggggggggggggtccggcggtgcagacaggcgccgctggagaaaactttgaatttaatgaatttttaaaaagcgaggcgtgaggggaagggatgtggcttttttacgtaagattccaaatccctcctccgaagaccaacccaaggcaatgcccgctttctcagcagctgctcgctgttcactgtagtcgtacccctcgaacatgtacagcgttcttccctccgcttcatcttctatttgcgcatcatcaatgttttctttgtcgtcgccctgtcaaaaagtaataattatcaaaaaaataaaaaatggtcaacttttatttgccaatgtccgttttgatcggtttgtcccaatcgctcttcaagctgtttgtcggtcagaatgtgaaactgtgtgtgcttcttctgctctttctccaggtcggtgagcccctctagcaaaagtttggacaggtcaaacattagtgaagggcctgagaagatttcaaaaaaacctaggaacaaaatactcgaaaaccttccttttcgtcggttcccaagacattctcggatagcttcagcttctttactgatctctgctttatcagctcctccaccgtatgttttgccacgagacgaatgcttttaacaggtctaaatcgaaaaatggagaaggaatccgaagactttttgttctttatgagggaatctaaagattttgttctttgttccaaagagttttgagaaaaaagtcaaacattttttattgaaaaattcatgttttttttttgtataaaaataataaatataagacccacttgtcctgcccgatgcggtggcaccgtgcagccgcttgtttgtcgttctgcggattgaagtccgaatcgagaaaaatagcagtgtctgcggcggttaaattcagaccaagaccacccgctttggttgtcagaagaaaagcgaacacgtccgaatcaggccgttgaaagttttgaatggctttctgacgatccggttgactaacggttccatccaattgctcacagatgtatcctgtgcaaaaggaaaacttaaatgcttattgtaatgtaaagaaaattggagcctggaaaggcaaaatccaattatgctgacaatgagtcccgaaatatacaaacaaaagcgtgattttcaattctatcaaaaagtttcataaaatataattggggatttacctcgaagactcataatgtcgtacacaatgtccaagaagcgttgcatttgcgtgaaaataaggacacgatggccctttttgtgcaaataagccaacagtctgtccagaatcaatgcctttccgcttaattttggccttcctttggtcagttttgtacttcttctctacctgtcgttcaccaaatgttctccctcctcaaacggttccttttcgattcctcggaacaaataaggatggtcacagcacttacaaagttgcaccaaagttgacatcagagactgtcgcgcctgtttctccgtccgcatgtttttggcaaagaaagctattgaaaaagggggacgggacgaaatctcgccgccggaatctcgccggccgaaatctcgccgagacaaaatctcgccgccgaaatctcgccggctgaaatctcgccggccgaaatctcgccgcagaaatttcaaaaaaaaaaaattcaaacttagaaatttttcaaggaaaaaattttagaaaatttttttataagaaaattccaaaaaaaactatttgctaagtttttttgaaattttttcaaaaaaaaaacagtaaattttcataaaatttctaaaaaaaattgctgaaaaatttttcaacaatttttttatttaaattttcttataaaaaaaattttctaagaattttttccttgaagaatttctaagtttgaattattttttttttgaaatttctgcggcgagattccggcggcgagattttggggtgcaccccttgaagtgtgcactgccgggtaaaaacgtctttccgtccattttcattgcattccattcttccatccatgcccaaatttgcccccttcagatggctgctcagcggatgaaggtgtgctatcgcctcggctcctccgcggttgccgggtcttccactggtgccaatggttccgccgcgtacggtcgcgcttctgccgtcggtagcgccgctgttgcctccggaccgtcggccgatgcggtcgcaggcggagccgcgccaccgccgctgatggctgcgccattgatcgcggcggcggcggcgaatgccgcggcagtggccgccgctgcgcagccgtccgcacagcaacgcgccgttgccgccgccgcgccccaacagccgcagcaaccgcagacggccgctgttcaactcgcactgtctgcggccgacttctcccacctcttccagcactaccaaagtgcaatcggacaactgcagccgtcgatgggcagtgctgcggccgccgtcgccgctaaccaagcggcggcagctcaaatcgccgcagctgctgccgcggcaccgtacgtttgccaaccgttggcggccaccgcagcgacagtgctcccatacggtatgagagtcaacaaaatgaattgcttttgtattctgcttttgtcaaataattgcttccacattcgacaggttccgcccggcatcaaccaccgccccaattttccgcagtgactgccccccaggcgcagtcgctgtcccaattcgtgccgaccgcgatgcatcccttcgtcgacccgttgatcgcggcggcgaccggagctgccaacgccgctgttgcggcggcggcccatcagcacagccacgcggggacgatggtgacgggatcatctgctggaggaaatgcatcaacagcgtctcacgtggggccgcaacagaatggcgcggtgccccaggggtggccgacccaacagcagcagcagggctcggcaaatgccacggcacaaaaccaggcggcgacgttggcacaaaacgcaaacacaactgcggcactgttcccgtgggccatcgcggcagcggcacaacaagtaagctaattgggtttgatttcttgactggtctctctgatttttcaggccgccctgctccccggcgctggcaacaaccccgcgggcgccgctgccgaccttttccttccggcgaatgccgcagccgcggcggcggtgcagcggcaaatggctgctgcggcggcggcgcttcagttcccccatttgttttctgcgcccgtccaagcggcggcacaacaaacggccaaaaactactcacaacagctgcaactgttggcacagatgcaacaacagcagcaacaggtggaggagggcattttgttggagatgagggaacattggaatggacataattcttttttaaataaatgctccgtttctgttacactcaattagcggagttgcacattgaatttgggtgggaagggggggtggagggattggaaatgtttttacattcttggcatttttgtaatttttggcattttgtcccccaggaggaatgggctgcccaagtgctgaacggtgtccggccgatgaatgcgcagcagcagcaaatgctgcaacaacagcagcagcagcaacaggcgatgatcgcccgactcaaaaatgacgcggccattctcatgcaaaattcgttggccgaacattaccttttggagaggttgggcaaaaaataaaatgcgaaaaatattgaaatttggtcgagttttttaatcattttttgtgaattgcttaaacacttaacatttgcctgtaaataaatacctattatctaaacatctaggattttcgttctataccaatttatttgaattatgtaattacgaaaaagttacctaaaaccggcccaaattgatggcacttatggtgccataggcaccattggaaaattagaaattttaactgctgtcacgaaaatttgcctttgtcattgtcatcatccccaggagcaatttggagcatcagctgaacaacagtggcggaggcgctctgctgcttaacacttcgggcatcggtgccgagtcgagcaacggcaactgcaacagtttgtcatcgtcgggatcttttgttgtgccgaacgtcaccggaggggcgagcggtaacagtgggcagcaaaatcatcaccatcagcaacaacatcaacacaacacggttggcgcagatggagcaggaggaggcacttcggcactatccatgtccgctcggaaaagttcgaacgcgcgctgtgcggtcgtccgtccccagcagcagcaacagaatgccgcggcacaccatcatcagcaacaacagtcgtaccagcaaatgcttctccaacagcacgttgaacaacaacagcagcagcaacagtttatggtgtcgacgggtgggagcagtacgtcggttgcgggcggcgttgccaatgcgttcgaaatggccactgctgctgggctggactcatgttacgcgccggttgcgctgcaggcggctgccgcagccgccgcggcagcaaatcgcaacagcgcagcggcggcatcgaacccggcgatgttggcacacatgcttgacttgacgtgcgtttaatgcaaatcatttgcctgtcgatcatccgtatcatcggccccatttgccttttttcagaaacgcctctttgtacgcggaattgggcgccggcggcggtgccggtggacccgcggcaaccggcgccgcctacacaaatgcgccttacatgtgaatgaatgagtgcgtttgtttggcttgtccgtgtgtgcttctaccaaattcatcaattttccttctgtacacaaaatgtcttttttttccactttcctcctcctctatgtcgaaatttgtcccaacaacagaggtgcgggactcgaaacgcaacacatagccgaaagtcggaatttcgtccgtctctcggcctca

SEQ ID NO: 9741 - DNA, 867 bp, Heterodera glycines
aaataattttccgggacgggagtcccgaacgggaatcccgtaaaaatcccgctcccgttaaaatcccgtccaattttaacgggagtcccggcgggagcgggagtaattcgaaaatttaattaaatactcactaaaatattttaatgcacaaatttgaaggacaatccttttattaaacgcagaaaaattataatatgcactttactcgatgtatcgcctgatttaaattgcaacgtacctcattaaaatcattttcatgatcagtgagaccgattttgatcacttttttgctttccaaaacatttttcacggcgcactttttccaaggactttgggccgacatgaaaaaattttaaaaatttgagtgcaattttgttaacagatttttaccaaaaactttgcgattttatagcaagtcgacgactttttttgtttttaaaagaacttttttgggggacaggggggttcggcggcgtcgataagcgccgacagaaaatgtttctgtaattttaatgctatttgttaacagattttgtctaaaaaatgaccaaatttagagcttttgggctatttttaaaaaaaagttttttggggccggcggagccgataagcgccgccgggcgaattttgaaatttaggctctattttttaacagataataaccaaaaaaaattaagattttcgtataatttttgttttctttggtatttttcaaaaatattttaatatattcattttcatgatttactcatgaaaaattgaattaatttaaacgaaatttatccgaagtgagttcaatttgttaataaattatgccatgaatggtcaatttttattcaaaaatgacctatttttgcaattttgagc

SEQ ID NO: 9742 - DNA, 2627 bp, Heterodera glycines
  misc_feature (2594)..(2594): n is a, c, g, or t
agcgcccagcgccgcgtcttgaaatgttcgtcgacgtaaaagtcaaatcggcgactgatcattgaaatgccaaggccaagttgagaaggcggaagcaattcgaagacacaaagccaacaatcggcggagatgaaactgaaaaaagggaaaacaaaatttaaatttcaaattccaaattattatttttcttttttacatttgtttttttgtttttttgaggcggtccaaataattccggtcagggacgttttcgtaccgccattttcgtaccgccgtttcattcataaatttaatgtaaaaaatgcataaatttaacaataacaaaatgggacaaactagggtcgcatctcatagtttcgggaaataccggcgaaaaaattgttaatgttttcgggattcacattgggattggcataattgtgatcattttgggggacaatattgacatcgttataacgttggacgagacgaagaatccgtgaatcggcatcgcgatacttccttttcttttggggtgcggcttctcccatcatgcaacgtgccatatcagcatcaagcgccttctgctcacatctgatcgtgtcaatgaatcgccaaattgttggatgagtgcagctaaattgccgctgaagtttccgatggaatgcctcggcgaagttgttcgtccgatcagcaccatccaaggtgcgctgatgaacactccattcgtgtgggtcaaacagaggcgccgtcattggaacattgaagcgcattctgcccgtgtagttgtccagaaacctagaaaaaaaaattcataaaactcgtcttcggacttaaccaattgaaaacgccattaagttgtggcggaatttgtgcttgaagagcattaaggccattttgaaggtggtgcacaggcaggaaggccaatgatgtgatcatcttagacttctcagcgaaggcaggatcagtgttgtaaaccttaatgagtttgaatgggaacggaataataaaaaattctaaaattacacgagtgaggccaaggattctgatctgcctcttcatgttgcggacaaggtgaaaaaaacagtagcggacactgcacgccggaagcactgtgcggaccgcaccaaccattgccaactcgaagtccatcgaaattgtctgcggcgcgaaattcggccatcgttccaaaagaagctgtaacatgcgcgtataaattgcggcacacttcgatgttaaaagacagtagcaaattggaaatacccaaccatctctcctaaaaagattgaacattgtgataacacaattaactttactttgccaacaacacataaatttggctgaaaagcggcggtgtcaatgcaaaagtgccgtccgcgtaaatgtctttcatctggtgagtccaatctgccgtagacgctcttccaaaaatgagaatccttaatagtgtaaatgaccatcatttaatggtttaaacgataaatgtcttaccgttggggtccattctgtccgtgaatttgaaaaacgccagtgtccgccaacaggaattgctcatcgtcaatctcagtgcgcttataaacacgataggtattcggaatctctaactgctccaaattgagaggttcgactcgcggtgcattttcatcacggcgcaaacgtttgatgacctgaataaaaagaaaacaaaattttttacaaaattgtttttgatagtaacccaccttttttgtggcatctttgctcggaaaagaggctagcacaggtgtgcatgtgttttgaagcacttgagcacgaatggtcgcaggtgcttgcacgtctcagcagcacgtcgcttgagtccagttacaagacgctgacattccacatgcgcagcgttcatgtcgcacgaatgaactccgaccaacttctgcacaacgttatttaaatccgtgtgcaagcgtcctggattttaaaagattttcaaaattcaaaataatatattagcatacccttgcattggtctgccgggccatgaaactcacaccgccaaaatttcttaagtccatcgttactgaatttgtggaacacataaagtgcaccatcatgcaccaatttatcattatttcgttttgttttaattacttgctgctggttcattttgtagttaataaaagcttaactgtcaaaacattaaaagtaatttaaaaaattaacaaattatttgaatgcaattttttccatactcactcgtacgaaaacggcggtacgaaaacgtctccggtacgaaaacggcggtacgaaaacgtctccggtacgaaaacggcggtacgaaaacggcggtacgaaaatggcggtacgaaaacggcggtacgaaaacgtcctggcccgttataatctccctatttttcgagaaattttaaggtctgccacaaattttttttgatcttttggtcccgaatgtactgaaattgtccttatttctaagattttcttattttcaggcttcacctaaattttttagtttttttctgattaatgttttatttcgctggttttgagaaaaaaaaaactttaaaatggccattcttatgtaaaaaaaaatgtatcaaaaactctaattttcatttttttttccnggtggcacctatcggcaccgccggttcgcaaaa

SEQ ID NO: 9743 - DNA, 1260 bp, Heterodera glycines
  misc_feature (27)..(27): n is a, c, g, or t
  misc_feature (34)..(34): n is a, c, g, or t
  misc_feature (1203)..(1203): n is a, c, g, or t
aggtcctgggaaaaatataaaaatgtncgggcangacactttggggggccctaccctaattttaattaataaattatttaaataaagccttgaggtcccactatatcagggttcggatcgaaaaattttcaaaatcagaacatcgggtccaaaaaatcagattttggggtcgaaaatcagaacattttgcaaaattgcttcaaatcgttatttttacaatttattcgatcaaaaatgtattaaatattatatttttcacctcccatgatcagacaaatctgacaaatcaggacattttaattttatcagatttggacccttcaaatcaggacaaatctgataaatcaggacagatccgaaccctgcactatatggccaaaaaggttaaaaatttggttttttgaattcttcaggtcataacttttttgaacctcaacgataatttttcagaattttgaagactaatagatgatacttagagctttcgaatgacaccaactatattggatttggttgacaacgaaaaaagctatagccagaaaagtgctggcgcccaactgagcgagtccgcacgaatataatatcagatttgtaaaatcttttattctattattgattttgaaaatcttagatttttgaaattttgtcaatatggtcaaattttgcaccctttcactatgggtacgcgccactgtgcagagaaaagcccagtactgtctcgtcgtttctctttttctttgtaatttctctcactttatcttcattttcattatgtaaaaaataacatttacttcgtgatgtttaacttttttttcccgatgttaaatccacaccaaattttgcaaatcgatagagaaaaaaattctgcataacacattttatgttttatacactattccattgagttataaaataaaacctaaaaacgtatttatttttctctcatttttacgtactatttcaatgcctctaacatatgaaaaacattaattcgcaaattctaacaattttagtttataggctacaaaatcattttggacatttaaaatcaatagaaaagttattagctttaggattttggtagaaagcagctgcttagaacctgagttataacgtaatgaaaatttgaaagtcacacaacttttttctaaaaaatcaaattgcttagttttcgcttagaaggaggttctccttttctttccntttttagatatcccttaagggggtttagttggagatgaagcgagttatggcagatca

SEQ ID NO: 9744 - DNA, 4037 bp, Heterodera glycines
ggaaaaactatgaattaggcccgcaaaaaaaccgcccaaaacggctttaaataatctctaatgacctctaatcatcgtaaaaaatggtcactaggtgcggaaaaatcaaaaaatcgttttttgaaccggttaaaatcacgaaaaattgcacaaaaaatcaaccataaaaaccttttaaataaaaattttcgaacaagtttggtatcattcgaaagctcctggtcagctaagtctgaaaaacaggtgtgaagtcgaaccgatgccatctatgcactgggactactgagtcccagtgaaaatgtacacttcagtaacaaaaaaaataaaaaaaatttcttcttagataatgaacgaaaatcgtttagccttgaatatcgagtattgcgctaaaaaaccgccgcacattcggcttcgcatgctcccttttgcgaaatttttgcttttaaatggtatttcttttggtactgaagtgtccattttcacggggactcaattgtcccagtgttcagatgtcgtcggttctcttagctcatcaagagccttcaaatgataccaaatttgggtgatttgaccgttttaaaaggtcaagtgcctcccttttcactcaaattttcgggttttaaaccagttttggcatttccgcacctctggagtgatttttatgacgattagaggtcattagagatggattggaatcagggctgcacgcaactggatttgcaattacggaaatccgtaatccgtaattacggcgattttatcagttacggaaatccgtaatccgtaattacgggggtccaaaaacaccgtaatccgcaatccgtaatttttaaaaatcaatttttctcagaattttagaaaaaaatttttaaatagtgattaataaaaatcaaaaaactgattttcttgatggagtttcttcattttttatttaaattttaaaaaaatttataattttgtgtctgatcaaatcattctttttgaatttatgggttgatttttgaaaattttttgaaagtctgatcattataatcggatttatgtatatgtatataattatttcaacattttaatagccagaaaaaaattacggggggggggggggaatccgaagaattttttttggtaaaatttatttaatgttatttaaaaaagttcagcgccggacagcaaaaacaggaattgtaaccatttttagccaaaaaaaaaagactaatttttgccattttgtagtcaaaattaaaaaaaataaggtaaaatcgagtaaatcgtggtccggcggtgccgataggtgccgccgggcaaattttttttttaattttaaagattttattaagaaaaatcgacaaaaaaatttaaaagtcccaatttttcctgtaaaaatttttaatttttcatttcgggcgggggaaggggggaattcctcccctcacctggctaaggttttatgaattttcataaaatgcgtgaaaaataggtgtgacataaaagtgatgcctctattttctaggccaactacccaaatagccttaacaacaacaaatagaaaattataaatctattttaattcttaaataaatcgaaatacgggtagccctttaaataaaaaatagaaaaatttttttttataaaaataatcttacaagaaatcgtctcgaaaaataatccaaaagtcaaattacggatcaaaattaaggaaaaatccaaaaaatccgtaacccgtaatccgtaatccgtaactcccaaaaccccgtaatccgcaatccgtaactcccaaaaccccgtaatccgcaatccgtaattgcgtgcagccctgattggaatgcggtttatgtggttttttagcgggcccaaattctataatacagcccaaaatacgaacacgagaacgagaacaaatagggcatacgagaaactagatgagcaaaatccctgtcatagctatgtattcttctcattttataataataaatacgaacactctttctttagcaaatatttaataaatattttgattagcaaaaagtaaattttattttatttagattatgaaaatattcgtaaaaaggttgacaaataggtaggaatgaattgaataaattgcaatgaacgtgataaaaaggatgataccaaaaaggcacaaattagtgagcttattgaaggaagctggaacttttataaaaatttggtaccctggatttagagcattatcgcatgattttattatatttggatcacgaccccattaaaaaaaagaatttatcatctgagccagatttttgaaatcttcatttaattgtccaagggtacctaaatgcatatgtcagtaaattccggcttttattttgagtatttagaatgcatgaaaaaatttggaattaacaaaatgtaaataagatgtaaagatatttaatacacgttatacgaacagtagttatttcgtttattttgttctgttttaaacaataaggaaattcaatttttaaatgtcaaaaaattcttttttataattaaacaaaaagatttttgttgattcgatttataaaccttaatttcgaaaagtcttctaaaataaagtgtatttgaataaagaaatcaaaaaacagaatgtcagaatttgattggtttatgcaaccttacgcttcctaaactcagtcattcaagatcaacacggtttttccaattttctgcaaaaaaagtgtcagcaattcatcgctttcttcactccacaataatgcgacctgtttttgaagagaatatgtgaaatcaaatataaaaatagccaaaacaagaatttcaaagtaaaatcctaccatgattagaacatttaataagtacttaggaaaaacctcaaaatatttaggaaatatcgaaacaggcccaaaaacagaaaatgttgaaaacaaaacttgggtaattttggttggacaaagggaacaatttacccttaaagaaaaaaaattcagatttccttctgaaattttttaaatgcattttctcgaaaaaaataaaaatttcagaatcaaaaattgttcaacaagtaaaaagtaacttagtgtaaaaatagagaccgcaaaaaggaaccaaaaatcgcgaaaaaggcactataataggcacaaaaaaattttaaaaaaagcatgaaaaggcacaacaatcccgaaaaaggcaaacaaaaaaaggcatttaaaaatttttctaaggtttttagggagtaaaaaacgtattaaccaaaaacttaattttgaaatgattttaaatattttaatgttttcggataaggaaaacttttaaacaaaatttttaacaagaaaaaaaaatgaaatttaggcgatcaattttgagttcaattattaggggtatattttttaaaattttgcaattcttagtgtattttatgaaaatttttcaattcacttctttagggtgtattttcccgatatttttaatggaattttccggaaagaatgccaaaaaaggcaccaaaatcggaaagaatgccaagaaatgcaccaaaatcggaaaaaataccaaaaaatgcaccaaaacggcaaaataggcattcaaggcacgaaaatcccgaaaagggcaaaaaaaaagcataaaaaaagtcaacgtagaagccagaaaccaagtggaaaatgtgatgcttaatatatcgaaattaatgcgcagaaaaaaggcatatgcctcaaaatgcggtctctaattagtactataaaattttaaataatatttattaaagaaccaaattattttatattttaaatatgcatttagttatgctcaattgtaaaattaacacgctaaaagcggtttttcgaacctttcccagctaaccaaaattgcaaaaatattaaaatataaaatgcaccccctaatcatggtgtattcaggacggaaatgccttaaattccaatggctattcattcgttaaataaaaaccaacttcttcgtttgagacagtgaatgtagtaatgtttgggcaatttttgtaaatgaaaatgagaagcgctgcagcggaagggaatgccaaacga

SEQ ID NO: 9745 - DNA, 1363 bp, Heterodera glycines
  misc_feature (68)..(68): n is a, c, g, or t
  misc_feature (122)..(122): n is a, c, g, or t
  misc_feature (136)..(136): n is a, c, g, or t
  misc_feature (215)..(215): n is a, c, g, or t
aacataaacagaatgtgattggctggctcttttatggatatatttttaaaaactttcaaaatcagcgncctcgaaaaagtatcatctgagtaaaaagaaaatcaccaagattgttgtttcanatagattttgagtntaataaaaatatatgcgttttaataatttacaaatatattttcatgcaatttatagaattttttttgtctaaaggtacncaagttggcagataataaaaatttctcgttctctcgaaattgctttatccaacgtaccttgttatttttgtgtgaagccgtgcttggtggtgaattgtttagccttaacacaaaaaatatgtaataaataattgtatgatatgtctaatcaactgtgaagaaaaactcaaaacctaatcatttctaaatcggaattttccacccaaggctagacggattacggttctgtaattacggtgattaacacccaagtaattgcggatcatggattacagtaatttaatccatggctgggacttttttcgaagcgatttaccaaaaaagtatgggaaaaaataaatgcaaaatttttttacttttatattaaatgagaaaaattttaaaaattaagaaaaatcgtttaaaatatccatttaatgcaaatttttcatatctaacaaaagtttggaattttatttaaggccaaaaaatgaaaaaaagctgctcaaaaaataagtgaatttcacaaaaaagtctcattttttatcaatttcgctatcacaatgctaatcaaaagcatttcaatgctttttggcgtaatttttttttctatcaaagatttactccttttcggatttttttcgctaaaaagcaaaaaagtgaaaaaagtcataaaaagcgccaaaaaatggaaaaattgaaaaaatgaacattttgggggcattttgccaggaatttgatcgtcaaataataaacttttgtaaaaaaaaaattcaaaatttctcaaaaaatctccaatatatgtgccaaaaacgaccaaaaccccaaaatatgtttttattcgcgaaaagcccaaaatatgtttttatatgagctaaaaactcgctctgattgaaaaaaaacaggtaaaaatgctatttttgagcttttcatatgatagcatatgcgcaaaaaaaatatgtaaaaccatataaatccgttctacctttttttagactttttcgtattttttatacatattacgcaatttttgagggttcttaaggaatttttcttaaatgtccaaaataataacccgaatttcgcaatttttcgtatattttttataattgttaaatgcaaaatatgtataaaaaaataccaacgtttgttctcaatgtcagagacaa

SEQ ID NO: 9746 - DNA, 1842 bp, Heterodera glycines
  misc_feature (58)..(58): n is a, c, g, or t
  misc_feature (139)..(139): n is a, c, g, or t
  misc_feature (1813)..(1813): n is a, c, g, or t
  misc_feature (1823)..(1823): n is a, c, g, or t
atttttatgaattttaataatcatttcataaaatttaccattttttattttattatgnagaggcaaatgaaaaaggaatgttttttatagatacatatatgggagggattggctgcccaaagggcgacaaacaaaaagncgatgggagaaggtgagagagtgtgtgttgaacggagggcggtgagaaacaatggagacgaaagagcaggcagaaaagaacaggggaaagaaaacagaggaacaggtttccgctgccgtggggaatttccaatcgatcattctcattactaaggcccaacttccaatttgggaattcaataactttaattcaaagctttgattatcttttaatcataaaagtaacacatttccataataatgttttaatttaattgattcccatatgaccaaccaactaattaatgttttgcaccttttctctctctctctctctctctctctctctcttttctgtgctattgcggcgccgcgacgagacgtcggcgcccagtcaaaacaaaagaatacttgcggcgcctaaacttgcggcgctatcatttcttctttggggtgttgaaattttgtcatagcagagaatttttagtctattgattgtccgtgatctcatggattttacattcagatttctgtgagtgatcagaaattgttgatttaaaaatggtccaaaagggttcaggaggcaatcaaaattaaccaattattagagaccgacttttgaggcaaatgcctttttttcttatcaaacataaataacgcattttccacttggtttgaggcttctacgttgacttttattatgcctttttcgggattttcgtgccttaaatgccttttttggcatttttcccttttggtgctttttggcttttttccgaaaaattccattaaaaatgcaataaaatcgggaaaatacacccctaagaaatgaaaaatttttagaaaatacacctcctaagaattgaaaattttccttaaaaattgatcgccaaaatttcattttttttcttgataaaaaattttaggtttaaaaattttcttattcgaaaaacattataaaacatttaataatcattttaatgtccaaaattaagttattttgttaagtttcacgtgttttgctccctaaaaatccataataaaaaattttaaatgcctttttcgggattttcgtgccttttttcaattttcgtgccttttatagagactttttcgcgatttttggtgcctttttagtcggtctctagcaattatataaagacataatccatatcattacatgcatttcggtcaaagagaaaagattctgaaaacatacctttttcaaaaaattctctaaggccaattcaaaaaaatgaccaaaataaattaattttttaaataatctacataatttaattaatattgcttaaatgagaatttaattcgcaataatttttaaataaaatttttgttactatgacaaaattttttcaacaccccaataattaaaataagcaaaatgttaagttaatgaaatgaacgttccttaattgtttgaatttgggtcagggttcggaaatggaaaaatttttaattcatgtaaattgcaaaagaatgttttaaaatagtttaatatatttaaaaaagaataattatcatcctttccgtcacattcttatttaaagcaatgccgaaaatggattttgacctcttcgatatgttcgcacccattgtgggtttgtttgttaattttttcattgttaatgcttagaaaagtgcttgattatgcaaataattttatcgaatgcgtgtnaatttcccanattattatgtatactgact

SEQ ID NO: 9747 - DNA, 1306 bp, Heterodera glycines
gcgggattttacgggagtcccgctcccgactcccgcttttttcggtgaacgggatttttaacgggagcgggattttacgggattcccgttcgggactcccgatcccgctcccggaaatttttacccaaaaacgggagtaaaaatgcactggtaagaattgatttttttggtaaaaataatgatttttcattgaaaatctgttaaatatatagccaaaatttcaaaaaaaattcccggcggcgcctatcggcaccgccggatccttaaaatccttaattttcttaaaaaacttgctcaatttgcaaaaattggtcatttttgaacagaatctaacaatgtattgtattaaaattttcaatttttttcccggcggcgcctaccggcaccgccggcctccctcctcctccttggatcaccaaaaagttttttcaagaaatacaccgcaaaaaattttgtaaaattaataaagggagtcaaaaatataaagttaataaatgttttgttcgaattaattataaaaaataatttatttaagcaatttgaaaaaattttctgatttttgactcaaaaataagattttttatttctaatttctcctttataaatttttctatatatttttaatttaataaattgattgtcctttaaatttgtgcattaaaaatatttttgtgagtttttaattaaattttcgaattactcccgctcccgcccgggactcccgttaaaaatggacgggattttaacgggagcgggatttttacgggaatcccgttcgggactcccgccccggaaaattttgaactcccgatcccgctcccggaaatttttttttaccggactctactaattacgaataccaaccgttttaagccgcgaaccaacgtatcacgctcattttgataattatataattccttgaaaataaaataaaacaattattaaataaaatccataccttgatttgtcccactaaatttttgtttctcgaaaaaacaagttcccgcgtcgcttgcttaataacgataattagggtataagattttttaaatgggcccctttaaatataattaaaattttatttttaatttaaaaatttaactcattaattatttaaaaaattagtttaaatatgcattaatcaacatttaccaattcgtcatgaagctctttgtcgtccaaaatttgttcatttaaagtgagttgttgcagttttgacagcaccaaaagcaagccactccgtattgaaactgaataaattattttttaaatggtttttattgcaaaatttaaaattttaaataaa

SEQ ID NO: 9748 - DNA, 1274 bp, Heterodera glycines
agtgtaaattttcccaaaaatttttaatatttggggtgcaatacaaattaccaaataatggcagtgtctcattaagaatttctttataaaaatgttcatccgtatgtttttgaaggttttcatcaattttggtgattagtgcatccaaatgaagaatttgtttcggaaaatcgttcttcacaaattgctccacttgatggtccaattcctttccaatctcattaaactgttggaaaataataaaattaattatcatttaaacgcggaaaattttaattagtttatatttgtaaagctgtgacataataaatccacagggtttgggcaaggctatgaaaattattttttcattaaatttaacgaaaatttgctgaactttttctccaatagcaatttttttttttacaaaaacccatctttttatacaaattttgcaaaatcatgttcaaaatttaaaaaaagaggcggatgtcttaaaaaaaatatagcactaagcttcccgttctacttaaatttcaaatattttcaattatcccaattccgagaccaaagattatgactgtcccgtcacgaatcccgaaagtttttttgaaaaatttcatgctaattaattgtttgttttttgaaaaattatattttgacgcaaccaaactttttttgagattgtgtcagttggctcttcggcatcaatgcttttggtgcgatcagttgcagttgcaaactcaacaatgatcagacaaatcaatgggaaaataaaaatgctcataaaattcataattaaaattttagaaatttcttagtgtttttattagtctaaaaatgatagaagaatttttaaacaattatttatttctttttatcatcagaaaactatcatttttaatagtaaattttataaatgttgtttttttattgaattaatattattccattggacggattaatttttatacaatttaaaaattttttttgccaacattattacaagtaaaattaaattgttttgttacattgattaataaatatttttacaaggaaatttgcatttgttcaaatgaaattcaaatgcatttcataaaattcacatgagccggaaatccttgttgcttgttcgttgataaataatgaatattaattttttatttggttgaattttatttatttttctttaacccttgtaaatttattaaatacatattttattttcaaaaatatattattttataaaaatagtttaaaaacattttaattaatttttaataataaaaatttaa

SEQ ID NO: 9749 - DNA, 932 bp, Heterodera glycines
cctccctctctctctttccccctttactctcttctctctctctctcttcctttttttcttttccttttagtctttccttttccctttccccctttagtctcttctttctctctcttccctactctctctctatttcccctattctctctctctttctctctctcttccctacgctctctctcccccactctccctccctctctctctttccccctttactctcttctctctcttcctttttttcttttccttttagtctttccttttccctttccccctttagtctcttctttctctctcttccctactctctctctatttcccctattctctctctctctttctctctctctttcctactctctctctctcccccactctccctccctctctctctttccccctttactctcttctctctctctctcttcctttttttcttttcccttttctctcttttcttccctttcctttgcttcttcttccttttttcttccctcttttaaacgtttctttgctttgtttccattaatcccttctctttttccccttttctcaactaatacccaaacaataagcatgcattttggagcaataaatgttttccgtttccctttccgaaattcccttctctttcccccccccccccctttctttccctctcccccctctttttttatttttccgtcaaagctaattaggagtgccaatttgccttttcgattggttcctccaaaaatgccgcaaaggtgcaattttccaggaattttatgtctaagtttgtgccgtctccggcatcctaatggggggggggaggacggaagaattccctttgaccacccccaaaatggcgcaatctctttggcatatctcctataatgaaaataattgcgggtgcaatttatgccttaactctcttgggcactctcccc

SEQ ID NO: 9750 - DNA, 3231 bp, Heterodera glycines
  misc_feature (69)..(69): n is a, c, g, or t
  misc_feature (3167)..(3167): n is a, c, g, or t
  misc_feature (3170)..(3170): n is a, c, g, or t
tcgtgaataatgcacaaaatcattcttccttaaattttcacatccatttcccgccgatagaattaccgncttgtcctcccccccctcccctccgtcccgtccctccccgagggatgaaagtgccatattatcgtcgtccgttcgccgccactttgtcttgtttcccctccgggctcggatttatttgtcttttggccgtatcactccaccgactcagtttggctactgtttactttagtcccattattacgtccccgttataaattttcagcctaattcgtttgcctgaaaggcaaaatgccaaaaattaacggattttgccacaaaaatgccattcacttcgtttcgtctcttccgaaatggttcaaatttcgctttcgcttttcctttccttttttccttttttgtttaatgtctatcatttatataataacaaattggcattttctctgtttttttgtgattttcatttccattttatcgaaattcagctgttttttccgtgtttttctccacctttcctttcctttccctttctctgtgttcgttttcttttttaaatgttttcagtgaattattcaaagtgccctctctcctcttccccccgggggcatccattagtgttggtggccatatcattgcgtactcatcataggccatacatatattgccaaatgcgtggagggcacgcaattttggacggaatgccaacgagtgaaggaattggagtgggcactttgctatacttttataattggatggacaaaggagagagaaaccggggacagatagcacattggcatggaatgaggtgaccacaaagacaccatagagacaaatgagcggagtgaagcgggaagaaaactccatgtcgtgccatttctgagttttttggacatttcatggaccttaccgaccctcccccccccctcacatcggcacttttttgccaaaaattccgacaattcaaattttgaatcctaaatagaagaaagaaaaatatataatgaagaaaatattgatagagagagtgtgaggaggagagagggaggaagagagagagagtgagagaaaactcattaagcccaggagaattatcaaaaaagattatattaaagacatttccggagttaatgaatggccaaaccaatcgttggcgcgggggacagtcaaataaatggacaaagtcgccccgggggatgtaattaaataataattatccgtctgtccttttttttggtttgttttttccgcgtggtgccattcaaaaaagcattacccttactctttaatgaacactggcagaaaatgataaattacttgaaaatttaaatttaaataaattgtctttctttttttccctaagcattgattaaataattatttctccttccccccccccccctccgttatgcttttgacacgttttgaatggcttttggaaagtgttcattttttcttctctctctaaaacaaaaccattttaatttactataaaatggggaaagtttaatacaaatacaacaaatgattaatggaaaacttttttcacattttcatatttatttataactggcaaaatttaaaatattattttaaatgtttttttatcggaaatttgccactttttacagccaatcactggcaaattcaaggtaaaggaaatattgtgtcaatctcttcatctcaatttgatcagcaaaacattcgttttgtttgcaattttcaaagaagaaactaataaatgtttctgatcgcgaaaattgtgcgggggcgacgattgcttcaccaattggagcaggaagaagagaaggaaaaggcgcagaaggaacgcgagaaaatcatggcgaccaaagcgggcggcggaggtgaaaagggacaggggacaaagggactgagacggaaagtgccgaaagagaaacgagcaatggcattcctcgggactgagacagaaagtgccgaaaagggataatagagaaaggagcaatggcattcctcgggactgagacagaaagtgccgaaaagggataatagagaaaggagcaatggcattcatcgggactgagacagaaagtgccgaaagagaaacgagcaatggcattcctcgggactgagacggaaagtgccgaaaagggataatagagaaacgagcaatggcattcatcgggactgagacagaaagtgccgaaagagaaaggacaatgtcattcccaggaactgagacggaaaatgccgaaaaaggatagtagagaaaggaccaatggcattcatcgggacggcgaccatgggactgagacggaaaatgccgaaaaaggcagtagagaaagaagcaatggcattcctcgggactgagacaaaaagtgccgaaagagaaaggagcaatggcattccccgggacggggaccacgggactgagacagaaaatgccgaaaaaggacagtagagaaaggatcgatggcattccccgcgacggatggacaatggtactgagacagaaaatgccgaaagagtaaggagcaatggcattcccgggaatcgaacgatagattagtatcaatgtttcgcaaaaagaaaaaatagcacgagaataaaaccgaacatttgttcccccccccctttgatcgagaatttgaattgggaacagaatgaaattatgaaaaaaggaagtcaatcgtatcccttaaatatttcgtactaattaaattctgctgcagtttacacatgcacgacagcaggacggtccagcagacagcagcagacgcggcagaacagtcaggcgacggaggaatacgcgggcgaaagcgccgggggcaccgaagggccgacgacggcaccggcggagcaccaccagcacaaccaacagcagtatcagaaccaacacgcattgttctgcgcgtgtccgagctcatcctcggccgtttctgcgggcggagttgggactgaatatgcgacggtcggaagcattgaactgaacgacattggcactgaagcggtgagtggtgttgattacttttttcaagcgaatatatcaaaaacatttttgaaatcaccttttttacttggttaagaattaaaaaattagggagcaagctcgtttccccccccccccccgagaattttttttaaaaaattttgctaacagaaatttttcaagaaaaaaatcttanganagttttttcataagaaaattctacgaaaaaaaaattttttttgagaatttttatggtgaat

SEQ ID NO: 9751 - DNA, 2116 bp, Heterodera glycines
accaaggaaatcttaaattttcagcaaaaatactatttttccttaaaaatttcgggcgcggaggggctttgggggcggtacgtaccccgcgtacccccccccccccccccctgtgaccgtccctggaggaacgatgggggggggggggggaaaatgaagtgcacccaaaaaatttagcctattaaaatatttagaaaatcttattatattttttgaaaaatttccgatttccaatttccgaaaatttttggggcctcaaaatgccatccccggtgacgatgcttttaacggaaacacttgggcaggctcatttttgagagatgagaatctttttggcgtaataaagccgaaaaatgatgccaaatcattgaccctgctattagcccattttttaaatcaacctttagcttcctttctcctcattgcacaacaatcaacaacaaaaaatgacgacaacaaaaacaatggacgcaaagcaacggcgacagtaagtgactaattaaaatggaaaaattaattaaaatatttcttttttgcattcttatcaaatatatttctatacaaattttctttaccattttcttttaattggctttttctcatcaccaattttctaagtgttgctaaagggcaaagtccgattttggcaattttgggccaatttggcaatttgggacgggccaaattcaatcgtcccactataattgagtgagcgacgaagggacacccgatggaaaaaaagacatcgttccgtcatagcattctcaaggggttgccaagcaattccgattcatttgaaaagaaaagcaatttgagggagaagcggcgaacggagaaagaagctaaacatttttaaatggcaatgccaaaaccaacacataaaaggggaaactttttggcattttaatgccaaagaatgacaataaatatttcaattaaaagtaacacctttatctggcacggcacttacatttaacaatttgttgaatttgtatctgtcgtgcttcccgcccccaaaggcttccccctccctctccctccccccttagataattgctaataaaagggaatttgtgcaagttagactcatttttccctttccataaatgccgttaataatggacaaagtctgtctgtccccgcgtcatttgtcccctgccaaagtgccggcccatttggtggccaccacctcagttttattggccgggttgggagcgtcggccagcggcagatggaggcgttcgttcaacgatttggcccggttggactttggaggggtacaacagcagcaggacaaagaggaggacgacgagcacagccggtgttcacagcggggccaaaaatggcattttgccaaactcaaaaattacattattctcatccaatcttgaacattgccaaccaaacaccgaactcgaaaacgccccaatttttacgttttaattttctgcagaagggccgttcgacagcgcaccgattcgtcgctgccatccgtggacgaggagctgaccgcgtacagcaatcacaacgccaaaatgcggcgcacttcgtcaatgccttccgtggtcgaatcggacacacatgggaaagaagcttttgccattgtaaaaaagggtaatcgtttagcagattaattaaggaggatgtcaataagtggtgattaattaagaatgaacttttattttttggttttctcctcggcaggtgccatccttcgtccgataaagcattacaactacgaagaccgtctctcaaagctgcacaaaagggcgcttcgcttcacatggcaacggttgcagacgcggaacggcgggaaacgaattgagacggtgttcgaagaggtcggcactttagcattggcactttggtgacattggcattatgtaaatgttgcaggtatttgaccgtatgatgcgatcttttcccgtcatgcgcgagatgttcaacacacggacgttcatctccgcaatgtcgcgttgcgaagtcgccacccctcgagaccatgtaagtgtccaattaattaaagtagagtgagttgggaccgggatcagtttggtcctggcttttcttgatctgacagttgtcttttgtgagtaaaatctgtcaacaaattcaa

SEQ ID NO: 9752 - DNA, 832 bp, Heterodera glycines
gtttctatttgagcagagagttcccattacaaaagatggcacagctgcaaattgtgaacgacagcgagggagcaatggagagccataagcaatactcaacagtcgcagcaacagcagctttgtaggatgaagacggataagagcaacaagagcgaggaggaggagagagcagcgggaggagggagagtcaacgagggggtccaatgagagataagaggggtagacaaagtgggggagggagaatgagagacaggggggtagacaaagtgggaggagagtgggagacaatgagggggtcagactaacccggggggggggtgggaaagggatgggttgtgttccgtttgagtctaactttctaatagccttaacatacaatacaacccattcataattcagtttttggccgtaaataacacggaaaatcgacggaataccattgcttcgtgtagtgacagtccgtactctgaggaagaggaggaggaggagaggaacaacagaacgacagccgagcgcaacagaacagcgaacaccgaaggcggcgggacgacgacggcacggcgcaaatcaatcagccgaaagcggcgggaacagcgatgcttttcaatgataacggacaaaacgggcactccgagcaaattggagatgaaaatattacacgacatggcttcaaccgaactgtgatggatggagaagcatcggcagaagacaaataaagggaccatttccaattcggacttaatcaccatatttttttgatttttgtttttcatatacggaaagaaaagagagaaaatttttctaaattataatgaaatgcaaaatacctatt

SEQ ID NO: 9753 - DNA, 1579 bp, Heterodera glycines
ttgctcagtgatttttgtaggatagtcagtggaaaagggtggaggtttaaatccgctatttattttattttcaaaactaaaaatagtaattttcgaaaatatttttttaaagatttctgccaaccaaattaggtatacaagcttaatacatcaaaatgctcacaatttaagcaattggatttacctgagactgaaattgttttatattatttattgattcaaattcttttaattttagcttgtttttcatagttccacggatttttcttgtaatggtggatttcgacacatcgtctttatacagtgtcaaggccattcttatccttgaccaggacgggaagaggataatggcaaaatattacgacaaacagctttttccactcgaaaaggagcagaatgtctttgaaaagaatgtttttcagaaaacccacaaagctaatggtattttttcattaatttaataaaatttgacaccgaacatttagcggatataatccttttggatggcctcgtttgtctttatcggtataacgtcgatttgtttttttacgtggtcggaagtgcaaatgaaaatgaattgattctgcaaagtgtgctcaattgcctttacgaagcgttttcgacaattcttcgaaaaaatgttgagaaaaaggctctgttcgagcacattgacacgtcttttctcattatggatgaaatttgcgatgatgggttcgtttccaattcacttttttaaaactttctgctatttcagcattattctggagaccgatccccaggcagtggtcgcccgttgtgcggtcaaagcggacgaattggcatttggcgagcaaagcatttcccaagttggcatgtcgctgttgggctctgcgaaggaccaattgaaatggtctcttctgaagtgaccgaaggataaaccaattttgtgattaatttttgttgtgggaaaataacaaaagtgttttatttgtattttttctataaataaattggttattcgtactttacttttacctcaattgataaaatttcaatttgttatctgtgcatttattcggatttattgtgtttaaatcttgtcagatgtctgaccggttggccctttgggaccgattgatggtgttggcttcgaaggtgcaaaaagtcatcaatctgtcgtccaaaatttcatctgtccagaacacggaccacatgatgcaacagccaacggaggaacagcgccagcgaatttatcaaagtccaatttttatttgaaatgaatataaattattacacattaacacaataaatacaccatactaaaaatgacgttttagctgataaagcaaagtctgcactgcttcatcttctgctcactgattgtctagcgaaaaatggtgggacaaaccaacgaaatggttgtgagggaaaattgttcaatttcatttactttcagatgaaacaaccgtttttgaccgttttaaaatgttaaaagaggaaaacaattgtaaaattgctccagagatgttcagcaatttaccattggcacgattattagtcaaatttgggaagggaatgacaatgagacgaggactcgcgt

SEQ ID NO: 9754 - DNA, 1213 bp, Heterodera glycines
ggtttaaaaggcaataaaaaaaaatttagtcagaaatttgctctttcgtgcattgcaagtgcttattgacgcggaaataacgccatctgatgaattactctgtaggaaacgaaaaaaacttattcggttaaataattagggttaacatttgagatattaatatttcctgcatcttacaaatagaacgaacttcagaacttacatctagaaaaaattttcacttacattaatagtaatatatattttgcttttttagatagcttcgagcagcaaaaaatgtacgaagaggcgaagctaagcggtttgagcacattgtaagttcggtttgagggaggggggggaagtgatggtcgaactcgagtgcttttcaagacaatggttggaacgtcagagatcattgaacaagaggggtaaaaagcggaagcaggaagtggacacgaaggcatcgaaaggacgcaaaatccgttacgtggagatcccaaagttagtcaatttctttcccgccacccccgaaagaattgcatggacacacgaaagacgggacgaactgttcagatcgttgtttatttagagctattttttaatttgtaccatcgacaatatttatgttaaattttgaatctacaaaaaaatacgaaagttgaaaaagcaatacaatcagtgatcccgtgtgtaagttgagtatcgaagtaccaaatggaacaaatcaaatgtcactttccgcttaatggctcattctttcatttccaaaactttctcataaaattccacggcgtctttctccgtttcgaagtgaaaaatataggccaaacttttttctttgtcaatccatgcacatttttgcggttcttccttgagatgttcaaaaatttgtttgtcgaatacaaaattggagtctgggtggccaattcttccagtacaaaatacatttatcgaacctttgtcccatttggccttaaaacaacaaataagtgcaattgttaaattgtcaattttctggacctttttaataaaatttgcaaatcaaagccaccccccccccatttttttgaagtcgcacttcaacatctagagatgcaaaattcaattcatacgtgaatttcgttgacatttagggggtgaactgcttcaagctcacatgtaataaatgggccttggccaagtgttctggagaatagtcttttctatgcaaattattaataagtgaaaagtc

SEQ ID NO: 9755 - DNA, 1258 bp, Heterodera glycines
gaaataatgtaccttcataagctagcttctcaatttttggttttgatttagcataattttcgttaagccatttaaatgtgaatttttctctttcgagtttgacactaaaacgaaaaaaaaatataggtatacacgcactcaaacaaatatttcttacaaatgtattccatcaatgccataaactttgcaatatataaatgaagccatcaggtaatccgattgaaaattctgaaactttaggttctcttatgctaaagtcattcgtaagacagttcttatagatagacacggaaaaaacgaatgggggtaaaaatgaatttgataaaaaggatttttttctaactgttttaattggtaagtgatcttcaaatcataattttaattggttacttctagaatattaggtgattttttcaattgtgatttatgagaaaattgtatttttcaaatactttttaaatttgaatttttatttattaacaaaaagccaaatttttcttttttttttacttcaaaatctgagatctataaaattttaaaatacaaaaaaaaaattttacccgctgtcttaatttttccgatttatgatgcttgaaaatccatgcgcatatatattttacagcttaagcttctctttgcagaaccaatgaaaataaataataaacctatcaatttttgtctttcgactcgcttgaaacttctaatttattaaaaatatacattgttcagattacactcacaatcttatctacctagttattttttcatttgatcaactacacgattaaaagcgtcaatcatgggcaagggattccaaaattttatgtccaagaaggacttccatccaagtgcatggtggaacttaaaaagggtaattcctcacaatcagttatatttggctattattttaaaaatttacagaaatgggaagctgagcaaaagaatgacttggagaaaagaagacaggatgaattgcgtgtccaatatgagaaggagcaagaaattctcaacaataagtttgtttaagaaaacattttgcagcttacctaaattaatttttctttagggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgaa

SEQ ID NO: 9756 - DNA, 1509 bp, Heterodera glycines
tccccccccccctggatacgcccttggattcaacgatctcccagagggattttcagtttatgtgtaaaagaacgaatgatttacaactcgaaagaaagcatctttaattgtgctaaatccatcctaatgtcaacagtccgatcacctgacttaattgcctaacggttcataaaacgttcgaacgcattcgccatcatgaactccttcttccggctttcaggcacaacgtcgtccaatgggatggaatagtcgcggtcaccaatgagcactccctaaatttagaataaaaataaaagtcatttatttcatgggttttcaggtttggtaaaattcggtagaattgcagtcccgcaggaaaattaagttaaattaaaactcaagaaaggaaaacttcgaaaaattttttagttcgaattcgggtccgggctccagaatttgtcaaaatggatgtcatattggaattcagtgacaactaaaaaattaaggatattttcagattccggtttttccaaggtttgggttccgacccctggattcaaatcccaatttgtaggaatccaaataccgggtgttattttaggggcgggatcccggccgggaataggatttttacaagaaatgaaaattgcagcaaaaatgcatttgtcctaagaaattgtctaatctatggttttataatagctgtgactttttggcaagcaataattttcaatgaaaacatcaaaatgaggcaaaagctttagtttagattaattttgatagatttagggcattctaattgtgtaaaaattctagaataaattgtaggaaatgcagcagtttattatattaacaattcaaaccttctcttcgaggcgcttggctagctcagaagggcaggaatgcatgtacttgacgggatactcgcaaatttcacgcattctctggtatgggttgtaatttctataaaaataaaacaaaatcattgtaaatgtaaacaaaacaaaacatacttcccaaattccatatatgccttgcgacgaacttcgacgtaaaagaagtaaaaggaaaggccaatgagaccactgacccccatcgcacagaaaacaagagacttggcccggatgtgagccatataacgcagcatgtgctctggagggcggggtaactttgcagcgggtgctgacattgttgattgcacttatagatctaaactcataaagccttttaaatataatcggaaacgggttttcaatattatgaagccaattaacaattaaccgaccaacctaagttttggactttttttacataggaattagtatggaaatttggtaatactggagaatctgggctccacccaaataatttttttttttttttttgttataaaaagactaacccctggttttcgggtcttctgatcacgaatatgatatcagacttgcaaaaagcattgattctatcatcgattttgaaaatcatagattttcgaaattttgtcaatatggtcaaatgttcctaaaaatt

SEQ ID NO: 9757 - DNA, 2884 bp, Heterodera glycines
aaaacggccctttcctccaaaaccggctcaccacggcgtgtttgtatgtttttgactctaggccatatttttcattttctcactccttagcaagaaatgcttctccgaggacaccttgcaaagttaaccctttttgaactcctttttttgttcggccttttccggtgtaaatgcgaccataactcagattccaacaacttaaatccaatcggttttcctcttgtgtaagtattatctccacaataataaaactgttcctttgtagagtctcaacttgggattcatttgatttccaagcggctgcccaaaagggttcgtcgtacacgccaatttttttttttaaagaaatgagttttcagcgttcgatattttccgccaagggcctgtcggttggaatacttcctcgtcataccgacgtctgaatgcaattgttgagggttcgcttattagacagagcagagacggtcgcaggatttaagcttggatgggataccgcccctgaaaactgaaatggtgttttggaggggggggggggggggggtaccaaaaaaaattcctattttaccatgaatttcggcaatggtcaagaattggtgtcccgacgaaaaaaaattaaaaatttcgtaggtgttttttctaggcttaaaaaatgcgctgatcattatttaaactcgcctgaatttctagtcgagccttattcccgtcttccgaaggagagtggcaggggtggtggagtcgtaccccccgcaccgcacccctccccctgggaccgcacctgagacagagcaataaagaaatattaccaatttgaaaaaaaatcattaaggactttctgagtgtgaaaaaagacgatgcgatcgcactgttggatttggtgggtctccggatgaaagaggcgagacgactttggatgcactggtgatggatggcccagggcataaaagtggggcagttgcggaactacggtccgaaataccttataaagtaatttagatgcctaactataagtagaattttgcggtcggggtcgttttcgcgtggccgttttcgcgttgggggaggtgaatgttattgatgtcgttatagagtgcgccgtcatgttctaacttaactttgtttcgttttgttttaattttttgctgctggtccatattatataatttaaatagccttaatttagtttataaactcattaaattataaaataaaaactcgttagttaaacaaattttggtaaaatataatgtgagttatgaattctcttttatatgcaaccacgcgaaaacggccacgcaaaaacgtcctggcccgagaattttcacgcgaaaacggccctcacgcgaaaacggccactgccaaaacgtcctggcccgtataaatagggacctaaaataggccgctgcccgtcaaaatccctccgcgtcataattagggatacgatttatagttactaaaaagtgccaaaatagttagttttagtttctaaaaacccccaaaatagttgctaaaaatgggaaccgcccactttggcatgaatttgaaaaccaagcgaaaattttttgtttttgttttaaataatatgatttatatgctaacaatgatagctgacaatttatattgggacacccaaaaataggttgaaaatcgggaaatctctaaaaaaatttctaggagttagggaaatttttggaaaaaaccttattgtcaacagaaagagcacaattctctacaacttaaaccgctgagttatgggcacttcaattcgatgtctacaaaaagaagtgtatttcttaaggaaatagtgaattttcagtataaatggtaatgcaatttattttctattcattcattaagtcattcatccacatttatcgaatggtcgttcttcgctcaaatccgttcctgcgcggcatcagcaaaatgatcagcttggcattgtctttgcacggtctttcaaaggcgacatgaaatattcgttaaaaagcttccctgattcgtaacttgattaaatttactatgcttttaattagatggttgcaatttatagacaattaaaaatatttttattttttaaatccttactctggtgcccaaacttcccgccccccccccccgtcaaactcacaatcagtccactccaatagaatttgatttaacaaaaatctattcaatcaaaaaaacataaaataacccaaatccaaattatggcaccatggttaatcgaattattttcacctgagagaatatctttaagaaaatgcggtgaaattttgcagggcttatttgtacagaattataaccccaatgaaagcgtcaaatatatttatcgataattttatttttttaaatataattattctttcttgcatcttttattttttccaatgcttttcttttcttcactttttaatttatttcttcttttccttgtcacatttttcttcgttagaattaattttagcttttagttttttctcactttttatttattttacatacctatttataattcacatttattttatgatgctaatgattctattcaaatgtacagtttttatttaaaaaacattaaattaaattatttaatgaaattaattcgattctaatattttagaagattaaagcatgcattttcttaataccagtttatttattgtttttaatttatcatacatccaattattgtgcagccaaccgtaagaaacatttttttgttatttttcaaatttaatttaaagttttcatttgacgaatggcactgacggagtgaagcttatacagttttgggccacaaatgagacggataaagcaataaaaaagccttatggcattgaattttggcttgcacatgacgggggattttgtgacggagggtgggaga

SEQ ID NO: 9758 - DNA, 1869 bp, Heterodera glycines
gttgcctcggcgcgaatttcggcaaaataaagggatttcttccctgatcccggacatgttcggatttttataagatttcttaccattattgcaggatcttctatttcactaaaaacaaaaaaattttgaattctgtttaaaaattcacaagtttgcatttcttatggtacaacattgactcattgggcttccctcagacccatcgaccatttctgatcagtgatgttgacacataatttgatgaaacaataaaatttccagacatcaaaaatgttcggatggcattttaagtgaatcttcggcattattgaccatggcgaaacaattactgatcactcccggcaaatgatcggagtgatcaatcaaatcactccgtatttagcctgggcgcgtaccatgacggctccgatgcaaatgccaactgttcggcgcgccaaaattttctgatggcgcccatttcggcctcgcacacattcagcgaacagttcggcgacacttttcccaatgcctttgtgctcagcgaatgctcaatgcgccaaattgagaattttttaaggcaattaattcattaatgacaaatgcctaattaccggtgtcggttctcgtttttttttttgaaattttacaattctaaatcaattttcaaaaaattccgacgatgcataatacctcaaaatattagattttttgtgaaaatcttctaattaataagtttaatggactgaaggttcgaaccttttcagcgcagaaattttttgaactctgcaaaaaaagttttcgtcataattaattagcaatcatttatttttcaagttcggccgagtcggaatgccttaggctaaacagcggcgatgatgagacagacgaaaattttgctgatcagcagcagtcatcagtggtgatcagcagcagctccgaattcaacaacgcccattcatctttatcaggcgatgccaacaccattttgccaaaactggaacaggcatgatcaatcaatcaacatgacaatcaccagggattgagctgattttgaatttgtgcgccatggatttccgactttttttttgatgcctcgtgatttaaaatggaaataaatacagaatttccggatttagcgaatgccagatgaggctgatcaacatcagcaacatttgacgggtgatcggattgctgccgccggcgctgatggtgaatggtggtcaacaatgatcagccgaggccatggcaggcccggggagcagttcgactcatggaaacagtgccaaattgtgttcggcagccattacggtaaaaatattggcattttaaaatccaagtcctcaaatgattttttaagcgaaataattcaaaaaataggcaaaatttcttttgttggccattgtttcaaaacattatgtttccttttatattactgtaattttgttattgtaataattctattactgtagcaatcctgttactgtattactcaaaagtacaataaatattttttgtaattttcaggcaattgccgggtgagtgatttgtgcaccaaatccatcgagcagaaaacattagccaaaacctttttttgaagcggaaggatttcatgctgctcaatgccgacccgtgccgtcgcctgtggtgcaaaaatcgaaaccaacgccgctgggccccgtgcgaaacgaagggatttttgccgatgatggacggcacgcggtgcggcgatggaaaggtggagaaaataatggaaaaactccagaatttgtccttgaatgcttcaaattacgcctttgaaaacttaaattgattaaagacaattgaaaatgccttaaaaatggctaaatggaatcgagttactgtaataatactgtcctactgtattttagt
